United States Patent 9,328,346 (POLYCOMB-ASSOCIATED NON-CODING RNAS) - sequence listing, part 134

SEQ ID NO: 191706 - RNA, 139436 nt, Homo sapiens
aguagggaggugggcaggagccagugaugacggaauggcaaucacauuugaccucugaucuguuuauuuccuccuccuugacgucuccauauaaauguuacacgggcauccccacacucggauacgcacccacaguggcugauucggggguaaccgugucauuugcuugcaacacuggcaccucugcccugcaccccgggagugagcagugagugaggcucgggucugggcgcuggcuccgaaucuucgggcugggagagacuccaccaucugggggcggccugggggagcagccuuagugucuuccugcugaugcaauccgcuaggucgcgagucuccgccgcgagagggccggucugcaauccagcccgccacguguacucgccgccgccucgggcacugccccaggucuugcugcagccgggaccgcgcucugcagccgcagacccgguccacacggccaggggcuacgacccuugggaucugcccuccgcucagcucgagcuucccucguggccgacggaacaaugaagguaacuacuuaugguuuuguccguguuuuacaaaaaugugugcgugaaucgaaccggcgauuucuccaagaaacauaguuggcagggaggggaggaaggcgagacaaccauggcuuauaucccccgcaaacgucucaguaucuucuuuaucaaucguaguuugcggggaccgugcauucuguucagauuucgguuuaaccuccacucgcaggacgugccuucucggacuuuuucacauucgcuuuugggaacggaggugaaagucugcuacagcucccuccccugcuugugaaguuuggaaaggaagugagggcuucucucaguuucuccuaugcacaggagguggggaauuuuggagaggaggucuggggaugucccgggcuguaaaugcgcuuuccugcagcguguguucgugaugcaggagggagcggcuggaagaguugacccggguggagaggggagggagaacgaucuuuucacuguuaaaagcagaaggccccucuuauuuuguuucuuguggaaauuaaagcuucuaggaguuacaaaugauagacgccuaagggcauucauuuguuaaaccagugagcacccuaauggcucugaucuugcuaaucaaggauaauuagccuagcugccuauuauuucugacuauuuagguguagggauguacaccguugaguguuuuguuuuccuaguuucacacacuggaaaacugcaaucgcauauaaaacccgaagagcaacuuuuuccaaggaaagugaaggaugggcagauauucuugccaucuaacauuuuggaauugagaugaccauaaugcaaucugaacuucugguaggaauaaagccucguuucagaguuucuaaggagggagaugaagcgugguucucaacugcucuuaucuacaacccaucccagaccauaguuucacuuagaagaaauaauauguaaauagcgccuuuguugccaaacaaaaacuuucacuacaauuaaacaguaaccgaguggaaacuaugcguuuuuguauucaacagagaucacacaacuuuucuucuauaguuagagguucuauuucuggcuuccucaugcuuguuucauuucagaugaaaaacacacuuuaguugauuauagcuuuaguaaguaaaaggagaaaacuaagaaugaacagucuugcuuuuccagcuuuuuccuguccaugugcaguugugguuaauuacgcguuuuuguagguccaaaaaccccugucccuuccacaagauacuuuuauaacauggggaacuagguaagauaucuacaaguagucucuuuucuguuuccugauauuuccuaagauuaagaaagaaaugauuguauucuagguaugaucgaagaaguauggaagguuccauuaaguuaguuuuaucacaauauuucaaacaucuuuccacuuaucucuuaaauauguauugcuaucacaagcuugauuuuuuaaaaaaauguuauuugcacauggcaucuugauugccuuuguccucagcaaauucuccgggcuuaagucaugcaugagcuuguauuuuaagacagacacaugcagaaugggcaacuuggauaagaaacauaggauauacacugaguagcauguguacaaaaaugguaagugaguauuaugacuuaauaaauuuagauggggauuuaaaaaugauacacauguaaaugggauuggaggcaagggaaguccguguguguguguguguguguguguguguguguguguguguguguggagggaagacgggaggccuaguggggagagagguuuuacauuccagacacaggauguggccccucaggcuaggcucagagauguaaagcuaguuaagcuggccuaacaaaaggguggugguuagaaaaaggaaaaaaagagguggggguuggggaggaaaagaauuuaaugcuggccaauauuuucaucugauaaguuucaguaaugaguaauuucacuggauuucagaacuacagagagaaaaggggaaaaauauuuuuccuuuuuuacgcaagaauuucucuugcuuuucagcucauuagaaccagaucuaauuauuugaaaugaguuuaaaaccuuauuaugaaaggaaguugaaaacauucgaucacaauugaguuuuguacuauggacuaaaaccaagaugugcuuucugucaguagcugugcaacucccugaaaaaagaaaaauagcgcagagcgaucugagcuuugugaaggcuacacaauuuaucaggcccagagagauaggagugugagacuucagucacguccccccguacgcaugcgcaggaguaauuauuuaaagacauuuuguuccugacuaacugccucacucauuauguuccuggaauuugugauacaaaaaaacaauguuuagccuaucaauaguuuauauaguuuauguuauuuuaauauaaauucuucucaacuuagaaacugccucuuuuuucuuuuaaaaacccacuuguaacugcuguauauauucagggcaacuugauuugguguuucguugguugcaguccucaaauuugaccucaauauacucucuacuuauauaaauuuugucucaguuuuguccguaggcugacauuccaauuguuuuccuaauuauauauuuuguuccuuauuucucaugucuagaaauaaagcuagggaaguaaacagcuggaaaacugauagugguguuauuaaccuaacugagagggcugggcuuaugaguaaauuauuccugugcauaaaugaaagauuguuucuaaauggcagcuauguugagccuuuguauuaguuacaucuuuugggguuucagguugccagcuucuuuaaauggccucuucucaacugguauaggaaguuggaaaauaaagaacuuucuuuauuucccuuuaguguugguaaccacaguuucuuuaaauaacagaugcccaccccagggaaacccaguggcaugaucagccuuaugcucaggaagguuugguugcuauacuggagagugagaaucugggaccuuccaugauagacauaauugugccagcuauccucuacuuucuauaugaugcuaucauucuuuuuucuuuucuuuuuuuugacagaaucucacuguguuguucaggcuggagugccgcagagugaucucuacucacugcaaccucugccuccuagguucaagcaauucuugugccucagccuccugagaagcugggauuaccaccaugcccagcuaauuuucguauuuuuuuguaaagacggaguuuugccauguuggccaggcuggucuggaacuccuggccucaagcgaucugcccaucucggccucccaaagugcugggauuacaggcaugugcuaucauucuuuuugagcacaggaggaaacuauggcugaucugcucauuuuacugucaaaaauauaggcagcuuuuguauuguaacauuauccccuuaacagcuguccaacuggucuauacauuucaccuaacauaugguaaauguuccuacuguuggccuuuccugagccucuguccauucaacuaaggccacugcaaugggauuguaugcaguucagccaagaaauaaaugugaggugcaacucacauuuuuuaaauguuucaaaauuaagcauuuaggugcuuuuauucauaaacaugacuuugcaaauauugguaaacaguuucaucauaagaccuugucagugacucacaaugucaauggugaacgcaaaggagaaucugucuuuucuggaacaccagguucagguaucaguuucaacuaugcuuauaauuugugcucuaaaguccacaaagcuaaauuaucuuuccccuaaaaauugaguacucauauccuuaaaauagcuuggaaauuagauuaccuuaugaauacagcauagcaugucacauaaacguuuuucuacuguuauaccuuuuuggugggaaagacuauuuugcaaaacauuuuucuuguguucaguaauuaaugggaaaaacaaacucuaaaagaaagagacaguuaugucccaaaaauacaggaaaauggaagaauggaaacagggaagaccaauaaagaaaaaaauagaggaaauuacaaguaauaaacugaagucauacugaaaaacauauggcucuuucuuauugaaaguugugaaauacuugcaaaacucagcuaguuccauuaagaauagucuuuaaucuaaaaagaacaaauucauuugucaguucuuuauuucgguguguagauuugaauguuucaucaauugcauuuacgguuuaucccucagugugagaacuguuuuugcuguuuugacuauaaauggauaucugcuuuaggaagacuuaggaagccugggacauaggauuacagaucaaauucuauuugacuccauagaaguugagacggaaggagcaccuguugggauauucuagaccaaacauuccacagcugucucuuaacgugacugacaaagagacacaguugagacgaaguuuggguauauccugggaugaggccaaggguggauuugcacaggauggucacagggcaguuguuagcauuccaccacuacauaaaagggugauuuugccaagugcauuucauuucauuucaguugauuuagauaccaaguuauauuguuuugacuuuaggacuagaugugaguucaggaauuugaaaucauaauaaauguuuccuugaacuuugaagauaaaagguagaguuaaaagacagcugcgaagucuacauggggaagcauaauacaugacucaggguuccaugguuuucagugucggugagugcucuguacacuuauaagaauagugcugguguuuauagaagaaacacaugcagguuugaggcaagacuuccuugcuuaauuggugcuuuugcuuuccauuuucuaaaugccaugcaaacuacuuuuuuuuuuuucuuuuguugagacggagucuugcucugucacccaggcuggaguacaguggugcgaucucggcucacugcaagcuccgccuccuggguucacgccauucuccugccucagcuuccugaguagcugggacuacaggcgcccgccaccacgcccggcuaauuuuuuguauuuuuuguagagacgggguuucaccauguuagccaggaaggucuugaucuccugaccucgugaucugcccgccucggccacccaaggugcugggauuacaggcgugagccaccgcucccggccucaaacuacuuuaacugaaaacauucuucuaaggaaagcaucagaaaacuuacuagaauugcuuaagaauaaauaaauaauacaaauaaaagagcaaaaugagaaaguagacagacuccuagucuauugugcuauugaucucuccagguucuaggcuuucuugggucugacaccacuuuguaaauuuuuuuuuuuuuuuuuuuuuuuuuccagauagggucucauucugucaccuaggcuggagugcagugguacaaucauggcucacuucagcuucaaccuccugggcucaagugaucuuccugccucagcucccugaguagcugggaccacaggcaugugccaccacgcccggugaauuuuuguauuuuuuguagagaugggguuucuccauguugcacuggcuggucuugaacuccugggcuccagugauccacccaccuuggccuccaaagugcugggauuacaggcauccgucacugcacugggccaguuuguaaaucuuaugaaaaguauggccaaucuuuugcaaaaugugcaaacacauauagacacaaaguuuuauaucuaaauuauugguuauuaaagccaggacaauagagugcauauagcauggaagacagguagaaaagacugaaaugguuuaguuauucagagcaguggagggcuauuggcucuugccuuugcagucagcugagauaugaaacuauauaagcagaagcuucacgcugccauuugaauauugaaaaucuccacuuuuaguucaagagauaaacaaccaaugguuuguuuguucacagcacauaaguuaucacuuucuucucuguuucaucccaucaagaucuaagguguauaguuacagaauagaacucgguucauaccauaugcacccuaauuucuucgaucuucaacuaguuuggaaguguguguggguguuuucuuagccaagguuaauaugcaauuucuuaguggaguguaggaguuuggggugccuagccuuccuacuucccacuuagauaacuuccccuaccuguuguaccugucaaaggagaaggccaguauggccauguucuuugcaggugacuccaccuuagccacagcugauuguaacaaggguguauauuuggcccaaguccagccaucuuuuuuuuuuuuuuuugaggcggagucuuguucugucacccacgcuggagugcaguggugugauuuuggcucacugcaaccucugccucccggguucaagcaauucuccugccucagccuccugaguagcugggauuacagacacccacgaccacgcuuggcuuuguauuuuuguauuuuuaguagagacgggguuucuccauguuggccaggcuggucuagaacucuugaccucaagugauccgcccgccuuggccucccaaacuacugggauuacaugcccagccagccaucuuuuacuucuuucuuauucucuuauuccacauauucaagcagguaccacguccuguggacucugucuucucugaaucuauagguucucucuuucccauugcccugcauacugguuuaugcucucauuacuucucgcuugaauuauuccaaaagucucccaacuggucugaagcuuaauuuucauuaugugcuguucgaugucauuccaccacgcaaaaucuauggcuucuccauugucuccugaguuuaguuuagugcaugagaccguuuaaaaucuaccuacaccucuucuaugugcaugcauuucucuagucauaagagaggauuugaucuaucucaaaauguguucuuauauuugcauuuacugguuuuuaacucccuccauccuaucuauaauuugcaccauguugcucaccaugcagcccacuccccagacaccuugugagaacagugaucauguuuuugcaguggaaugaacaugggcgaaaggugggaagguaugcauagauuuacauuuugaagucaggaaauaagauacugaucaaugcuuuaauucgacugugcuuuuuaccuuuuccucuguuguagcaugaaccuugccccaaaaagauauugaucauaugcugcaacuccucugcacuuaccuuuucuucuaccauggcaggaaccuugcaccauuguuggugcuuuacagauauugguugaguuaaaucgagagccuauuucuggacuuucaagauucagauuaauugauucuguuuuauacuucucuguuuuugaauggcacauacaucuuuccacacuuggauuucuuugaaguuaaagcuuuaauugacuuccaaaagacagaggauuauaaaaacacagagaacaguaaaguauuuacacggucuuaaugccuauugccaaacacauauagcugcuauuaaugccuauugccagacucauauagcugcaaacucauguagcuuaaugcccauugccaaacucauauagcugcuauauaugucuacuggaaaacucacauagcugguugauuuuaaauugauuguaggaaaauucauacaaaaagaugcuacauaggaauauaaacugaacaccacaaaaaucguaaugaacaaacucaguaaugccagccuguucaaucacuaguuuucagauuaaggcaguaugcaaagggaaacauccuuggaauggucuuagaauauagaacaaagucauguguuugggaaucuuaaccaauuccaauacuguucaacauguuuuucuuuguugcaaacaaugcaguuuuuaagcaaacuaaugaaugcauacccugacaaacaaauccaacaaaagagguacuuagagcaguguucauugaauccuagaauuuugaaagaaaaaaucuauuaggucauuuugggcuuuuacuucugcugaagaaggauuguucuuuugaguuuauuuuucuagcuuucaguucuauuccauuuaaaugccucgagaaauaggacuucucaaauucccuguggagaguucuggcaccuacuauauucacuuuugaaagucuccugauaacugauuuccuuuuucuuuugguuauacacaucaacuauucaugguuggcucugcugauaguuuuccaugauucuuuaugcuuauuuaaaagaaaucauauaacauuaaucauauaacauauaaccauuacuugguuauaaagcaugauauuaacuaaacuggcuuuuaaaaauucaauaacauuagagcaaauauuuuauuaauauugucaguaguuccaugaauauauagauguaggaugucaauaaaguuuaugccccuuaauaacugaguguguuaauguuguauuugcugguuaacuggcaccuucccuccuuuugaucaauguucuuagaacaguauguacaggaguacuuuagucuaccacuugauauucaaggacaacacuucgaagcuugaaaugagggauuguuuuaaccauauuaacguaacugcauaguuugcaauagauuuaaugauucaacaucauuguuaauauuuaguuuaauuaaaagugccuuauauuaacuuguacacaugugaaaugacuuaucaacaagauuauuuauugcagcauuguuugugauuacaaagaguggaagucauuugcauagucauuaggcguaaaaaauaaugacauuaaaagaaaacaauugaggaaagaaccaguaagcucucagguagagauaaaaagaaaguuaccgugagccuuuucacuguauauauuuauauauuugauuuuugacacgugaguuuauuauaaucaagauugaaugaaaaaaauugaagccuuuuaaugaaauuagcuugacaccagagucauuaucaagaaaaucugaaauacugguaccuaugcacauuugauuuuauuauuuuuaguuuuauuauuuuuugagacagagucuugcucugucgcccagacuggagugaaguggugugaucucagcucacugcaaucuccagccucccagguucaagcgauucuccucagccucccgaguagcugggauuacagaugccugccaccaugcuuggcuaguuuuuguauuuuuaguagugacggaguuuugccaugcuggccaggcugaucucaaacuccugaccucaggugguccaccugccucagccucccaaaguguugggauuacaggcgugagccacugcacccggccauuuaagcaaauuuuaguuaagaccaguaacauauuuuugacaguauuuccgaaguguuguauuuaauuuaacuaauugaaaauuaucuauuaagaaagcaaguuaaauguaauguguauacuucauaguauacacauuauaaugauucauaguaaccauuauaugaagagugucuaaacuuuucuucaaaucuaccauuuauauaguacaauaaugaccagcaaacaauggcuaaguuuuacuuaauuagacauuuguguagcuccuaccaaggcuaccagacuuuguacccaguaacaggaaaacagaaauaauucaagcauuauucucacucuugagaaacaauucuauuuagggagauauacauaaaaagcaaagguggcugggugcaguggcucaugccuguaaucccagcacuuugggaggccaaggcaggcagaucacuugaggccaggaguucgagacuagccugaccaacauggugaaacccuguuucuacuaaacauacaaaaauuagcugggugugguggcaugcaccugcaaucccagcuacugggcaggcugaggcagauaauugcuugaaccugggagguggaggcuacagugagcugagauugcaccacuguacuccagccugggugacagagcgagacuccaucucaaugaauaaauaaauaaauaaauaaauagcaaaggcaauaaugugcauauaguaggugcuacaguagaagucugcacaagguucuguguauguggaaaagacaagucagaaaaauuaggaaaggcuuuauugggaggugacauuuaagcagaaucacgaaagaagaccugaugaacauggggguaagagcacuuguacacaaccccauacuccugggcucagacucacuugcucauucccuaaucauagaagaccuugaggaaaagcaugcugggguucccuuccagcccacugguaaauacagagaggccuaagcacccaacaucccccagggaauacaccacugggacuuaaagcauuggcaacccagcacccaguuaaauuccccuugucacuguuuccacauuguccccaucaccuucacucucuugaugcucugcauuuucucucuuaacucgacccacaguagacccucccacucaaaucugcccccaauaaccuuugcaaccaauauuaccgcacuacacuuuaucuucccuaaggguuuccugcuccuccuggucuuaggugaggucauuucucugccagccuuuaaaguggaagcugcucauuuucucugucccucauccagggcuggagugggacugaugcccuucacccugcccaguacuguuuccacaugagacuccuugcauagcaucugcucucugcuacucagaccaggagucugugcucucucuuccucuaaccaucauuggaagacaccccagucccucuggccccauuauccacuguagauuuuagcacuuaccuccucucuucccucccaugugcuguuuucccauuuauuuuaaggugcauguggauggcccauuccccuuccuggcaucuuaaucccuuuaauuucucauuuccauuaauuugcuacauuccucauaugccagcuaccccuauggccauaucccagaccuuugaaucacacaccaaauuccaucaaguccuaugagucauuuuugguccaagaccuaucuuacaucuaugcagugcuaucuauuuuaacaaccaugugcccaguuuaggccacugucuucucuucacugaauauauguguuccuguuuuuucucauccccauuuguuucccagacacaauuuguucuccagagcagagugaucacaucagucaccugcuauaaaaacuccucaacccgguggggcauggugacucacagccccagcacuguaaucccagcacuuugggaggcugaggugggaggaucacuugagcacaggaggagcugaagugaucugugaucacgucacugcacuccagccugggcuacagagugacacccuaucucaaaaacaagcaaacaaacaaacaaacaaaaaccaacaaaaaauuuuuuauuaagcaaaaaaccucuucaaccucuuccuguuauguuuugaauaaaagcuaaaguccccaccaugcuccagaaguucccaagggaucugguccuucucaucuuuacagccucaucuuguuuugccguuuccaccucccucaucccccaaacucuuuuucuucagggccuuugcacuugcugaugccucugccuggaaggucuucuucugauuccccauccaggggugccuuaucacccugcccugccaaccucagauuggaugcuacuuccucaaagagacccuugggacucccauguuucccaggcuuucagugcccucaucucaacuuguaaugauuguauuggggugauuauuuguaugacuuugggauugauaucugacucuuccacuagaccauacauuucuugagagcagagagcauauccaguuuuuuuaccacugugcaaccauaugucguccaaugcuuggcccauaauaggggguuggugaaugugguaggcugagucauagcccccaaggaugcccauagccucauccccagaagcuuucaugguaaaagggauuuugcagauugugauuaaguuauggaucuugagauggagagauuauccuugauuaucuaaauagguccaauauaaucaguagcgucuuuauaagagagaggcagagggucaaaagcagaaucagagaaggagaugccacaguggaagcaaagggguguguguguauguguguguguaugugugugugugugugugagagagagagauugagauuuaaagagcuccauuacuugaucugaggauaaggaugagccaaagaaugcagguggcuuguagaagcuggagaagccaagaaaacauucucacucuagagccuccagaaggaaugcagcucugcugacaccuugauuuggaacuuccagaaccauaagauaauaauuuuguguaguuuugaggcugggcucaugccuguaauuccagcacuuugggaggccaagguggguggaucacuugaggucaggaguuugagacuagccuggccaacauggugaaacccuguauguacuaaauauacaaaaauuagccaggugugguggugcacgccuauagacccaacuacuugggaagcuggggcaggagaaucacuugaacccgggagguagagauugcaguaagcuaagauugugccacugcacuccagccugggcuacagcgugagacuucgucagaaaaaaagaauaauuuuguauaauuucaggccacaaagucugcagucaucuguuacaacagcaguaguacacgaauacagauuuugguaccuggaaauggugugcuacuguaacagauaccuaaacaauguggaaguggcuuuugaauuggguguugggcagcauguggaagaauuuugagaagcaugauaggaaaagccuagcuugccuuagaaagacuguuaguagaaguagggauguuaaaggcgcugcuggugaggacuuggaagugaagagcaugguaaagaaaauguguuucauuuuagagaauaucaaagucauuguagaagguuggcagaaguguagguuuucauaauguguuguuggugagggcugagaaagaaaugaggaccauguuuagggaaacuggaggaaaaagauccuugucauacaguggaaugaaacuguggaauugugucuuacaguuauaugggaagcagaauuuguuugaacuuggauauuuggcuuagcuuuccaaguaaaguauugaagguguagccugguuuucucuugcuguuuuauaguaaaaugcccgagaaaaagggauaaauugagguaggaacuguuaagaaaaaggaacaaagacaugaugacuugggaaauucucaggauaccugguuuguaaaagaugcuagaauuagaagauucauugucaggaaagugugcucuggagaggaagccaagggugaguuccuuguggcguagguuaggggcuguggcagggaugcagggaagagaugauggugacuuggacuaggggucugacgggguaugggaaaauagagaggaaugaguugauucuguugggacuuuguauugaguuccuugauuccauaaguggaaacacauguagagcucucuuuccuggccaccuaagcucucugaccauaucccugacucucuccagaaugccuuggcuucauguccacgugaggacaaaucauauuuuucugcauuuugcgugcuggauuccucucuggacuaaagauccaaugagaggugguuucuagcuuucugcucuuucccacaacacuccgucagugagucuucuggauguccuauaggcaacucacuggauccacuuggucuguggaagaaucacuaccacauccauuucaccuugggcacagacuagaaggugaggcagucauguccugcagucacuggguagcuuacaagugcuaauacagcaauagcuuaauuagagagagagagaagaagaagaauguuauggagccuguuucuagagaggaaaccacaauaucuugaucaagagacccuaaaacuggaagaaccagagcagcugguaucaaaauguggaaaaaacugagauguggcaagugguacaacugauagccaaggaggaaaaauuuguaucccccuguaaucccagcacuuugggaggcugaaacagguggaucaccugaggucaggaguucgagaccagccuggccaauauggugaaacccugucucuacuaaaaauacaaaaauuagcugggcgugguggugugcaccuauagucccagcuacuugggaggcugaggcaggaaaauugcuugaaccugggagcagagguugcagugagccaagaucgcaccacugcacuccagccugggugacaagaguuaaacucugucucaaaaaaauaaaaagaaaaguuuguacccucuucuuuucucuugccucaggauaacugagauucuuauaaugcauuuauugaacaaauauuugaggaguacucauuauguaagcaucagacacugcucaaggucuugaggcugugaggguguauuaguccguuuucacacugcuauaaagaacuaccugagacugggugauuuauaaagaaaagagguuuaacugaauuacaguucaucauggccagaaaggccucaggaaacuuacaaucauggcagaaggugaagaggaagcaaggcacaucuuacaugguggcaggagacacagugagaagggagaagugccacacuuuuaaaccaucagaucuuaugaugauauaggaguuaagaagaaaucacuuagguagauagugaggguacgggaguccuugguaaggcuuuucuuuuaaaugaaaagcagccccacacauagacaagcaagcugggagcuugcacgggugaaugccggcagaaacuaggaaccagacacguuaagauggcggcuccauuuucccuucucugccagccaaguguacaguaaggagcagacaagcuggugccggccaagaggagaauucaugugcauaauaagauuaggguggggugaccagccuucccagugcgcuaugugaacaucauaccugauugaaccaaucugugagcccuauguaaaucagacaccaccuccucaagccugacuauaaaaucuggugcauucgccacccgccgguguuuccucucagaaguccccucucucucauuagagagagggcuguuuuccuuucuccuucuucugccuauuaaccugugcuccuaaacucccugugugugucuguucugaauuuucccggcaugagaggaugaaccugggguauauaccccagaaaacauagccacuuaagugagaacucacucacuauucacccccaagauccaaucaccuucgaccagguuccuccccuggcgugaggggauuaaaauuccacaugagguuugaguagggacacagagccaaaccaaaccauaucagagggugaagagcagguaaaguugcagcucuccugcaacuugcagggaaaggccauauaacacaugguuaugagcacaaacugggacuggacugcaggugugugagccccagcuuugcuauugagugaccaccagcaaguuauuaaacugugccucaguuuuuuuguuuaugaaauggugguauuaguacaacccaccucucauggaugaugugaggauuaaauaaaauaacauguugccaggcacaguggugcacaccuguaaucucggcacauugggaggcugaggcccgaggguuacuugagguuagaagccugagaccugccuggccaacauagcgaaaccucaucucugcuuaaaauacaaaaaaaaaaaaaaaaaaaaaaaaaaaaaaaggccaggcgugguggcucaugcuuguaaucccagcacuuugggaggccgaggcggguggaucacaaggucaggaguuugagaccagccuggccaauauggugaauccccgucucuacuaaaaauacaaaaauuagccaagugugguggugggcaccuguagucccagcuacucgggaggcugaggcaggagaaucacuugaaccugggaggcagaaguugcagugagccgagguugcgccacugcacuccagccugggcgacggagcgagacuccaucucaaaacaaaacaaaaaaaccaaaaaaauuaaccaggcaugguggcacacaccuguaaucccagcuacucaggaggcugaggcaggagaaucacuugaacccaggagguggagguugcagugaguuaagauugugccacugcacuccagccugugcgauagaaggagacagucugcaacaaagauccaaaaacaaauauaaagcacuuauaacagggucuggucugaaauaaguacuauguaaguacuguaaguauuaacuaauauuauuacaauuuauccucauauaguaacauaucaaauauuuucagucagugaugcaauaugaauaaaaugaaaugaugcaguagugacagaacugagagaaagcugguacaaauuuauacugacuggucagggaaagcuucacagaaaaggugaacuuucagcugacaccugaguaccauggucuggagguaagagugucccaugcauauggaacagcaaaugaaacuucccagagcauaaucugagaggggagauuucaggaguggagccacaucauugaaguuccuuaguccugguaaguguggauuuuauucuaaguguggugaaaugccccugagagguuuugaguaguagauggaauuccauuuuuaaaagucacuggugagucaaguaguguacuaugguuacauuuuuuuccccuuauaccucauuuuguuuuuccugcaguuaauucuugcauuauuuccuuuuauuuacuuaccuuacuauauauuuauuaugaauucuuuccaauucccaacuuccugacagccucucaauguaauuuuacuuagguuaaauguaucugacaguucauuuucuuuuuugucucuguacucuuucugcuaccauucucauucuugcacuaauuugugcugguuucucucugagccagcugcacagcugccugccuaagacuuccucuuggcaucuuuuacccucucucuguguuacauccccgguuuucugaaucguguggcguucuccuuuuuacuuuacuuccucauuuguguugcacguaugcucuaguuguuuuuagauaaagagugcaucagagguagauguuuugauuccuuacaugccugacuuuuuguucuacuuuugcucuagguuaauacuugauuuugaauaauauccuagguuagaaaugauuuuucgucagaauuuuaagggaauugcuuuucuguugucuaguuuccuguguuacugauaggaaguccaaaggggcucguauuucagguccuuuuuauguguaaccuguuuuuuguuccuugagguauucagggucucuuuuuauugcuaauuuggggagcuuuaucauaacauggguccuuagucauucauccuagaaaauuuuccuuuccuauaucuuugaugauuucgucuccucugcuuucccucuuuucucauucuuaaacuucuauuuguuugacauuagaccuccuuguuugaucuucuaauuuaauuuuucucuccuaguguccaauuuuugaggugggagaaagaucucaucaauguuaucuuucagccuuuccccugaauuuuaaaauuuuacucuucauauuucuucugauuaauccuuuaaaaaaauagcauccugggccaggugcaguggcucacaccuguaaucccagcacuuuggaaggcugagcggggaguggaucaccugaggucaggagcucaagaccagucuggccaacaugaugaaacccugucucuacuaaaaauacaaaaacuuagccaggcgugguggugggcuccuguagucccagcuacuugggaggcugagacaggagaaucaccagaaccugggagguggagguuguagugagcugagauugugugccauuguacuccaaccugggugacagagcaagacucuaucucaaaaaaaaaaaaaaaaaaaaaagggcccuguuccacugaggcuucagugcggagcauggagggauacuaccuccaaauuccaaacacguuugacacaucuaaagaaccuucuaaaggaugacuaaacuaauucugcaagcuuuagccucuaacuuaucuccaauuuauauuuaauagaaggcuggaaauugaacagaaaggaaauaagauuauuuggaaauaaaaaauugucagccaagcaaggagagcuuggcauuucuggaaacuucuuuacccuggaagagguaaaaaagugauucucccauucccccaacagggcauucacuaaaaauuaagugagaaaugcuuugccuagaggaucuguagcuugcgaacacuugacuugugccacugguguacggaacauagcagugucagcucugcccugggacagucaaggcuggcuggugcugccugugguuagagucaagagaggggucuucagugggugcaguuugcaguuccagaguuuaguagagcaaagacgucaugaacuaugugaacucugaggaaaggugucauagaaacaccucaaaaggacacugucuaagaaggcuacuugcuggggcaaggagaccccaggggucagaggcuguguagggaauaaugccagagcugggguugaaggagaauccuuagaggugagacagaaugugcaucauugcaguggggcugugcaaggcaguggucuccacaggaggugaggacaagggggaggggagguugugaagaauccguaagugaccaugaugcaauagaaagccagaauuugggcauuugccauaggagagggcccccagugccagauuauaauggucacagacaaaugagauuuuuaaccauuuccucuaauucaugguccacacuuaaccccguggguccuggaaacagcagcuggagaauggagaggaaagugaugugggagagagaaaacuuucuuuacccuuuucauaacugaguuuaugaaguaaacugacaguagaaagauaaauaggagaaaagacauaaauuuauuuugugcguacacaugggagucccauaaaauaugagacucaaagaaaggccagaugauugaaguuuauauaguauuccugagcuacagaaaaggaaucagggcuuggggcuuauugaggggagguggugacagguuauaagagggugaggagaggaaguguauagcaagcauagguugucuuguuaugcagauaaaaagucucucaggugauaaaaguugucucagagucccccaucagaagaauagguaauagccugugacaaggucuaccuguccaaucuucucccuggugauaaaaucuucccugguugaugagauucuuaucaaaguuuuuuucuuuauagauauaaauuuuguuuacaaaaagacaguuuuucagagcuacuccugugucuacagugucucagaauaacuaacuggaaauacaucaaauaagcauauccugauguggcauauucuggucauauuuugggauggugcguccugagcuccaaugcugaaaaaacaggaaccccauuucuguuggaugugccaaccuaaaauaaucaaaagggucagaaucuaguuuaaagauacuuuauucaagugcaaaguuuaaggacagugcuagggaaacacggaucccaaagaauggaagucagcguucugaacuuuagaaguuugggauuguuuauagagagagaguuuagggaagcuuaacagaauuucaacaucuuucuguguaaggcuuaaugccuaguuacaaugaucugauuagucaagguggucacuuucauuugagaaaggcauauuuaacauuucacgggcugggagcggugguucaugccuguaaucucagcacuuugggaggccgaggcgggcagaucaucugaggucaggaguucgaggccagccuggccaauauggggaaaccccuucucuacuaaaaauacaauacaauaaaauaaaauaaaauaaaaaaaauuagccgggcauggugcacgugccuguaaucccagcuacuugggaagcugaggcaggagaauugcuugaaccugggaggcagagguuguggugagcugagauugcaccauugcacuccagccugggcaacaagaaugaaacuccaucucaaacaacaacaacaacaacaacaacaacaacaacaacaacaacaacaaacauuucacacugaagguguaacagucauggguuuguauuuucguuuuucuugguuuuuuuuuuuuuuuuuugagacugucucgcucuguauugcaggcuggcauggcacaaucacagcucgcugcagcuucgauuuugugggcucaagugauccuaccaccucagucucccgacuagcugggaccacagucaugugccaccacacccggcuaauuuauuuuuuauuucuuauagagaccagaucccccuuuugcccaggcuggucucaaacuccuggacucaaacaauucuccugccucagccucccaaagugccuggauuacaggcaugggcuacugugcucaucccauggggucuuuugugccaacuggugugaguuagguacaggacaauaaaggaggcaguuaauccauuaauccauaacaaagaucagugaagggggaaggucuggucucuggucucuccuagucauuuacagaacuagaacgaugagaagagagugaaucuauaaccuaagaagcagaauugcaaacaugcuaugugacucaguuuccaguacuuaacuucucccuuggcauaauaaauaauuuuagagaguuuuaagaauuuuguuuucuuuuacagauguuaacaaccucagcuugcugggggcugguggugguggcugcucagacaguaaagcauugaaugcaaugugaggucaaaguuuuauuacagaucauaccggucuuuuaaguacuugcagcaagauuuuccuaauacuuaaaagugacuggaaacucaauaggaucagugugaucuucuccagauagggaugguagauuuuugaaagugggugugaagggcaguaaugagagaaaaauaaaacuauuucugguuguacucucccaagucaaggucauucaaugaaugguuauauagauuugcaucaaaagucccuguuuucagccucaccuuuggaaacaccuggauucucuauucugagacuuucugagaugagggaaagguggcuucucaucaguaucuccuucuuugugcaauacaguuucaguucuuucuaaucuacagaguuaguuccuucucuacugucagcuuucuaccuuccaaaauguguuaaugucacucauuaucauguuucccauucucuuucccuuaugguuuaaacuuuaaaagacaaugguauuuguuuaagugaauaucuaaaaagauguggagaaagauucauguguucagucuaccauguuuaauuggagucacugguagauuuuuaaggaaaaauaacauucuagguuuuuccaguauugcuauguagcuugucuauguagaucaccuugcauucuucuguuucucucuuauaacuugauuuuuuucuuuucuuuucuuuucuuuuuuuuucgagacagagucucacuuugucacccaggcuggaguacaguggcacaaucucgucucauugcugccuccaucuccuggguucaagugauucucccaccucaccuucccaaauagccgggauuacagacaucuuauaacuugauuuuuacucauuucauuaucauccaagagaugaaauuuaacucaaagcaaaugacuauuguuucaaauacaaaucuuaaucagggagaaaagauuauaacuuauaguugaacugggguuuggagauuauauguguuuuuuaaaauuauucugucccacauguaacauacaagugaggauuuuaaaaauuugucugcaguuuuuuuuuuuuuaauugaucauucuuggguguuucucgcagagggggauuuggcagggucauaggacaauaguggagggaaggucagcagauaaacgagugaacaaaggucucugguuuuccuaggcagaggacccugcggccuuccgcaguguuugugucccuggguacuugagauuagggaguggugaugacucuuaaagagcaugcugccuucaagcaucuguuuaacaaagcacaucuugcaccgcccuuaauccauuuaacccugaguggacacagcacauguuucagagagcaccggguuggggguaaggucauagaucaacagcaucccaaggcagaagaauuuuucuuaguacagaacaaaauggagucuccuaugucuacuucuuucuacacagacacagcaacaaucugauuucucuaucuuuuccccacauuucccccuuuucuauuccacaaaaccgccauugucaucauggcccguucucaaugagcuguuggguacaccucccagacgggguggcggccgggcagaggggcuccucacuucccagaagggguggccuggcagaggcacccccaaccucccucccggacggggcggcuggccaggcgggggcugcccccaacuucccagacgggguggcugcugggcggaggggcucuuuacuucucagauggggcggcugccggguggaggggcuccucacuucucagacggggcggccgggcagaggcgcuccucaccucccagacggggcagcagggcagaggcgcuccccacaucucagacgaugggcggccgggcagagacgcuccucacuuccuagacgggauggcagccgggaagaggcgcuccucacuucccagacugggcagccaggcagaggggcuccucacaucccagacgaugggcagccaggcagagaagcuccucacuucccagaugggguggcggccgggcagaggcugcaaucucggcacuuugggaggccaaggcaggcggcugggagguggagguuguagcgagccgagaucacgccacuacacuccagcuugggcaacauugagcacugagugaacgagacuccgucugcaaucccggcaccucgggaggccgaggcuggcagaucacucccgguuaggagcuggagaccagcccggccaacacagcgaaaccccgucuccaccaaaaaaauacgaaaaccagucaggcaugguggcgcgcgccugcaaucacaggcacucggcaggcugaggcaggacaaucaggcagggagguugcagugagcagagauggcagcaguacaguccagcuucggcuuggcaucagagggagaccguggaaagagagggagagggagaccguggggagagggagagggggagggggagcugcaauuuuuuauuuagcaauuuccaaaccuauuguguuaggcaggguucuccagggaaacagaaccaauagggcauaucuauaucuauauuuauaucuuuaucuauaucuauaucuauaaucuuucuaucuaucuaucaagagaucgagagagagagauuuauuuuaaggaauugguucaugugauugugggagcuggcaagucugaaauccauagggcaaguuggucagcuggaaauucugguaagaguugauguugcagucgugagucugaaauuugcagggcaggucagguacaguaucuauugcaauugcaguccugaggccaaauuccuucuucaggaaaccuccgucuuuuuugcuguuaaggccuucaacuaauuggaugaagcccucccacauugagggcaaucugcuuuacucaaagucugcugauuuaaaugguaaucacaucuaaaaaauacuuucacagcaacauuugaacuuguguugucuaagcaauugggcacuauagcuuagccaagcagacacaugaaauuaaccaucacucuguagagaugaaagaacuacuguuucaaaaaacaacuguuuuugaauccgucauuuaucaacggauucacccaaugguuaaccuuucuauaugcuuucucuuucucccaaguacugaaucauaugaaaauaaauuaugguugugauauuuccuaucuaaauacuucauaugggacauucuccuacauagcacaccuaagaagauuaguauuaauucagagagaucaugucauaucugguucauauauaauuuucccuagcugaccucaaaauguguuuguuuuguuuacauauuacucuuuauaguuauguuucuuuuaauacggaucaauauuuguguguuuuugcugcuauuuuuuuuaaugacauuguuuugaauaauucaggcucauuggcuauuucacauccugaauuucucuaauuuuaucuuuaugauuagagccaggcucuaauucuuggcaagaauaacacugaagugagguuguguacuccuaauugcccugcaucaaagacacaugauaugcauugguuccugcauuagucauguuaaguuugauuagcuggugaagguggucgccaccauuucucacucuuguaaagggacauuuucuccuuuuaaauuaauauguaauuuguggcacaagacuuugagacuguguaaauaucccauucucugacaaccuuucuucugaugacuuuagcauuaacugaucuaauuauaucauucuuggcauugaguagcauucuuguguaaagaagggguucucuuucucucccuccucucauuauaauuuguuacuguuauuuucuuacaaguuacuaagaauuacucaaaggcaguauuuuucaauaaaucauugguaauuuauggucuucucacucuagaaaagggaggaugggucagaaagcugaggggaaaaaaagggaggaaacgagaauguauauuaucgacauaaucgguugaaaaugucuagugcuguaauuaugccaucaugcagauuaaaaagccaccugugaaaaaucaacuuguauuguuuuguuuuguuugauuuuuaauaaauccuuauaguguaugaauaaaaauuaaauuaauugaucaguaucuucacuaauggcagagaaggggauggacugagcagauucugcuuuucacucugauauuuguuaauugcccuguguggucugaagaccuggguucuaguaccagcucucccucugcagacagguguguuacuuuggucaaggcaaucaaucuucuugauacucaguuugguucucucugauuugagcauaagaaauauacuugaaggccgggcaugguggcuuaugccuguaauuccagcacuaugggaagccgaggugggaggaucgcuugggcucaggaguuugagaccaggcugggcaacauggcaaaaccucaacucuacaaaaaacaaacaaaaaauuagccaggcaugguggugcacgccuguagucccagcuacucaggagguugaggcaggagaauccugggaggcagagguugcagugaucugagauugugccacugcacuccagccugggagccugggugacagagagagacccugucuaaaauauauauauacacacacuugaaugcuucaugucccuugcucagugacagccccguccucugcuucugcacaguugaccaaggcuucucagucuacuccuguguagaaaagaauuaaagcaggccugaggcugcuagucuuagaaaggcuugcaaaguuggcccuugucuggugucugggaacuugaauuucuggaggguucucaccauucccugaaaagaauggcucacgaugccuaaaauauuuguacaaacaaugaaguuucugcugaacaucugcuuccuucugggagucuggaauuuuaggaugugcuagguagggguguuuacaugacagccccacauaaaaaccuugggcacugagugucuaaugagauucccuaguaaguaauauuuuacacauauuaucacaacucauugcuggaggaguuaagugcauccugugugacuccacugggagaggacucugggaagcacaugucugauuuccuuugucccaugugccuuuuccuuuugcugauuuuugccuuguaaauuuuuuuuuuuuuuuuugagagacagagucuuacucuguugcccagacuggaguucaguggccccaugucggcucacugcagccucugccuccuggauucaagcaauucuccugccucagccucccgaguagcugggacuacaggcgcgcgcugccacaccggcuaauuuuuguauuuuuaguagagacgggguuucaccauguuggccaggauggucuugaucuccugaccucgugauccgccugccucggccucccaaagugcuggaauuauaggccugggccacugugccuggccauaauuuuuauccuguaauaaauuauagucgaaaguauugaguccugugaaucaacuuagagaaucaccaaacugcuuccaauuuucucauauguaaaauggguugcuauaauaaugaugauaucuaccuuauaggguuguuuuaaguaugaaaaauauggugaaauaugugugaaacuaggggccggauguaggaugagucauacagugggugguuauuauuacggaucauauuaacucuucagguaaaaaccaucuuguagcugggcaagguggcacaugccuguagucccagcuacuugggggacugaggcagguggaucgcuugagccuaggaguucaaggcuguaguacgcuaugaucacgucuaucaauagccacuggacuccagccuggacaauguaaugagagucugucucaaaaaaaaggaacaaucuuguguuugcgugugugcucaugucuuuguuggaauaauacugacacagucacucaaauuaacucucaaaucuuugauuauucauuugaugggaacaacagguuuaugugccagcuuaucaggaccccuaguucuuucauuaaaguguguauguguguguguauguguguaugugugcacaugugugcuaguuuucuuaucuaacgacgaaguccuuugggagguuuacuuuuucauuacuauuuuuuucaugcuuuccuuugaugugcaccuggcaauuuauagagccaauguguacuacauauucugcugcagaaaaugacagaggugaggaaggagcaggaagcagauuuagaaaggaauguuacaguuuaucaaguugugacuaauggaagcuauuaaaacaaaagguaccaacccaucuuaaauauucacugccucuacaacuauuuuucuauaacuguuguuccuugucagcucugggguggagggaauauuccugaauguuuuauuaaguaauucaaagaucuuccuagguauguguaucaaagauccuaugauguaucugucuuguaaauugagacuggcauauauugggcuuacauuacugggaaaaauguaugucaucaucauuggugaaaaagaguuuccauagcaguuuuuucuaaguagagagauaaaugaaucagacuuuuggaggagguauguuuuaacucacuggaggaucacaccaagucugaacaucuaaggaacccuaguggaaaacugguuuuccuguaugcugcucuagcgaucugaggaaaggccuaaaaaaagccagugucccugugauauugugaaauacauauauguggucuuuguuccuguuuccuggcauacaaguacuaaaaauccuuggaaucuccaaagugcugucuuuuuguauauuaguguugacugauagcuucagaguggggcuggucaaguugaucaccaauggccagugguuuaaucagucaugccuauguaaugaagccuccaugaaaauccaaagggaauggacuggggagcuucuaagaaguguuuuuuaccuucccgugagccuccugugcugaacacguggagggucacgggaagguaagcaaaaauucauucacaugcugggaggguggcacaucccaacuccacgaggacaaaagcuccugugcucagaacccuuccagacuuggaccuuguaucucuucauuggcuuuuauuuguauuuuaaaaaauauccugagugauaaacugguagauguaagugucuuccucaguucugugaaccacgcuagcaaauuaaucaaaccggaagagggggucauggcaaccccaacuugaaaccuguuggucagcaguuccagagaccugaacuuaugacugguuggaaggacggggugcucuugugggacugagcccucaacuuguggaucugaugcuaucucuggguagacaguguuggagcugaauuggaggacaccuagcuuguguccacugcagaacugauugcuugcuuccugcuggggagaaaucccuauauauuuugggguccagaagucuuccguguugauuguuuuugugugagagcagaggaaaaaugguuugagaguuuuucgggaaacagccccucuuaguauagugguagaaacacuccaaaaauaaaauaugcuaccccaaaaauaaaaaaugaaaauaaaaauaaaaaucuggaguggucaguuugccaagaggauuuauggagcaucuaaggucaagcauuacuucucagcccugcagcaggccucuaauuaagccaugccacagagugcgguuugcagagagguggaguuccuguggauucauucuucucucuaaaauuauaaauaacgcagcuuccaaacaugccauauuaccucacaaggucuaaagacucaauaugaaucuucaacuuaacaauuauaacugacacagauugagaucuuccuggaugcugaaauaggcuuuacaugauuuaucucauuuaguucucauaaaacucuauuauuaauauuauuuuacagauagagaaauggaagcacagagaggguaaguguauuaguccauuuuuaugcugcuaauaaagacauacccaagacaggguaauuuauacagaaaaagagguuuaauggacucacauuuccacauggcugggaggccucacaaucauggcagaaggcaaaaggcacuucuuaccuggugguggcaagacagaaaaugagaaccaagcgaaagggguuuccccuuauaaaaccaucagguaacaugagacaauuauucacuaccacagaaacuauaugggggaaaccgcccccaugauucaguuaucuuccauugggucccucccacaacacguggagcuacaauucaagaugagauuuguguggagacauagcuaacccauaucaguaaguaauuagacaaaccuugcaaagcuaguaagugguauugcuggaauuaaaucugccaaugucacuccagagucuaugugauuuacugguauauuauagggucuaccuauaagcuugauaaccuuauguuagaacaaauaaccaugacauauucuguucaguaguuugcauuuccuuuugacuccuacaggggaggaggccgagguucagggacauuaaagugggguuuagagacauuaggugguuuacccaagcuuuaucuacuagauacuagauaauugucuaucugacaauaaagcuagaacuuacacccagcuggacaauggagcuacagcuuaaaacaaaaucuucuaaugagcucagaacucauggcuuaauaagauuugggaaaaguccugcggacauuucacugucuauccagaaaugcgaggaaguuaggagaaaaggcaaaguaucucauagacagauaaaggcaguucaguaaguagccugaauaaauagccauauuuaaaaucuaauuugguucuuuugugccuaacacaauugacuuuaugcugguaucuauuuucugcucugucucucuuucugucucuacuuauguguguaugcauguguuauaaaauauaucagcccauugaucaauuuuuaauuuaagcaaaaacaugguagauuaauauauucaaucaauuuauugaguagauauuuaucgaggcucacacauuuaucugacuguguacuaagcacuggaaacccaaagagaaugaagucacugccuagacaguuggaggcugacacauaaacaagcaggguaauaaucaagugucauaacuagucuauuacaugcaauguuaaacuagcaucucuaccaugcaaaacuugugcucuuggggauacaggaagacuuuccagagaaguacacaggacaggaauguguuaggaaaccagucaguucccagguccucgaucaggucacagugacuugcgauucuauuuugaacauaggucuuaaaucuuuauuuugauagcaaggguuuuaaacuuuugauauaugauauacuucugaaaaucaaauuucauauucuaaaauuaaguauuuuugcccuuaacuaacuugaacauaauacuauaauacauuaacauauauuauuaauaauaaauaggaccccuggaaguccaagagagacaugaggcuuauuugguauguuaaaaucauacaggaaguguuguuaaauaagaaaugguguuacacuuucuuugaguuauauuuauauggauauguuguuaauauguguuccaacauuguaugagauuccuaaaaaucugauauggacauccagugugguuguuggguccucuaugagccuagggagcacuggccgguuaccuugcauccauucaugucagcguugguagugucaggcacccgaugguucuuagaagaguacuuagcucuacucugcagugucugaaguugcuggauauauaccugcuguauaaacugcugacuagggcgcugcaguuuacuuacugucuucucauggggaccuuccccuucaacucuuuccucuuggguuucacaucuuggguggggaguuucauccuaguaguuugccugagaauacaggugaacccacagaacaaaguggacuucgaaagcaucuccuuggagugagacuuugcuucuuucucuuugcuagcaccaucuuguaccuuaucgucaugaacuuuguuggcugaaucauucccauuuacuuaauugaagaguaagagacuggaacaaugcucacuuugauuuuccuggauaagaguuaagaguucuugagauggcagcuuguuugacacaugaauuuucuucaaauuugugcuuacuaccaacugauuugguguggaggagagcccagagaaguucccucucucugucagaacaacuuuguaacauuuauuaaccugacuucugccuucaauuaacuguaaccuuuugccuuccaaauuaaaaaguuccacauuacuccaaaaauaaaaagugaaaauaaaaauaaaaggcugauaugucaugguauaugcaguaaauugcuuuauucugauuuuuuuuucuaaaagccuuuugcaaauccugaagugcuguguauucaaggaaauucaugaaagggaccuugacaaguagucuuaaauacagguuucugauaacuuuggagaucacaccuuuggacuagguaaaaacauccaaaacucgucugggcgcaguggcucacgccuguaaucccagcacuuugggaggccaaggcaggcggaucacgaggucaggagaucgagaccauccuggcuaacacggugaaaccccaucucuacuaaaaacacaaaaacaaaauuagccgggcgugguggcgggcgccuguaguuccagcuacccggcaggcugaggcggaagaauggcgcgaagcggcaagacggagcuugcagugagccgagaucgcgccacugcacuccagccucaaaaaaaaaaaaaaaaaaaaaaaaaguccaaagcucuaaugaaaaacugaugcauucaugcagauugcuaacccaacaucaaggagaacgagaauuacaugggacugagugaaugaaggauugaaauuacuauuuuaaaggguuuuuguuugaaacauuacugauuuuuuuuauguuuuguuuuccagacucaagaaaauauuuuuuuucuuuugagcuauuuauagcuuacagcauugggguaaaguauacuucugugagcaaaauggaaacauuuaccuuucuuucuaccugaauucuucagaauuuggaaacuauucauuaguguucuuauuuucuggcaauauaguuauuugcauaaguucaauaagaaccuauuuucggcugugcaugguggcucaugccuguaaucccagcaccuugggagggcgaggccgguggaucacaaggucaggaguuugagaacagccuggccaagauggugaaaccccgucucuacuaaaacuacaaagauuaaccaggcgcgguggcaggcgccuguaaucccagcuacucgggaggcugaggcaggagaauagcuugaaccuuggguggcagagguugcagugagccgagaucgcaccacugcgcuccagccuaggggacaagagcgagacucuaucucaaaacaaacaaacaaaaaaacaaaaagcaaacaaacaaaaaaagagcuuauuuucuuuuguaacuggacacauggaaacagugguuauuuuaccaaggcuuugacuggaaugucuuuuuuuugagugcaaccggacugcuucgagggauugagguugacuuuauacagccaguagacuuggaaaaagacacaccugguaccuugcccacacaauuccuuuauagcguuucuaacuuugcaauaaguaaagaaugucacuuucugacaggcccagggaccucaagauauuuuggagacguugaaaagagagcaauucacccaauucauacagguuuuacaggcacagucugauggcgaaucuuuggcuuggcuucauugcuucaagaguuuguuuuuuugacacggaaucucacucugucacccauucuggagugcaguggugagaucuuggcucacugaaaccucugcuuccuggauucaagugauucuccugcuucagccucccgaguagcugggauuacaggcauguguugcuacucccagcuaauuuuuuguauuuuugguagagaugagguuucaccauguugcccaggguggucuugaacuccugaccucaggugauccacccaccucagccucccaaagugcugggauuacaggcgugagccacugugcccagcccuugagagguuucaaaagucuuaaucugagauuccuuaugaaaaaauuccaacaaagccaacuuaagagccaucccuguagaaaauauaucuauuuaaauaucgucuguuuuaugccacaauguuuguuuugcguugcaagccguuaucuccuaggcauggguaauccacuuugagaggaaaauccagacaucauugugccuaauuugcugccaccugugucugugcuggaucuuaccaggguuagcuuuauuuucuuucaacuggcaaaauucugauaaagcauguagcuucacgguagagcaaaaaguguaacuuaauugaaagucaugacuuucaggagucuaaugaugcuaauauauuuucuucuagagaggugucuuuauuguauguaauucccugaagaaauguaaagauuuaucuaauuccuauugcucugacaggcgugcucaauagaagcauugaaguaaaauaaaaauaaccuuuuuaaucuguguauuucucuugcccaccaagauauuuaauuuuuuucuugaucuuugcuuuuguuuaugugaagauauuuaugucuauaucauuucuguauauaucacagaaaaguuuucacuugcuugacauuuuauucuacaaugauuuuuaguuuaaguuuaaagaauggcuacauucagauuuauuuucacaacuauaguccugcuaaacugccuuuguugaaaacucaguuuuuauaauaaauaaaaaauaucaaagcaaaaaaaaaagagccuucaugauaaaucaccauucuuacugcacuuuaagcagauaaucaugccagagacuaaacugacuuugcaaauaaauuaguuuuauuauuauuaucuuuguggguaaaaguugggaugacuguagaagagaaaauuauauuucagaagaaaauuauaccauacuuguuauuagauucuagucuugauaauuguuuuuuugaguuuuuguuauuugccuacaauuugggcugaauccugaauuccuuccuggguacaagucuccaaacuaauguuuccuaauuuuucuaccauuuuucugucuuggaaucaccaagcccugcaggcuuuagcuagacaacuugauauaaacuuuggaagaaauaaugacagcaacuuaauauaugagcaguguucaugucagcugauguauggauuacucagaagguuuacuugaacaccugauucaaacuauaauccagaaauaucuguaagauugccacugcaaucugaagcuacuucagagacucuaggaaaauuaguuuauagacaacuccagauguuaaucuuuguuuuucuuuuguuuucauggaaaugccuuuuauuaaacaucugauugcuugauucauagaggccugacuuugguggaagcaacaccacugccugaaaugagauauaacuguuaaccguuuaauuggagcggccuguucucacgacugcaagacuaguucaauggcuuauaaaauaauccacccgcugggcacaguaguucacaccuguaaucucagcacuuugggaggcugaggugggcaaauugcuugagcucaggaguucgagaccagccagagcaacauggugaaacccugucucuaccaaaaauauaaaaaauuagccgggcauaguagcaugugccuguggucccagcuccucgggagguggaugugggaggauugccugagccugggaggcagagcuugcagugagcugagauuaugacacugcacucuagccugggcaauacagugagaccccaucucaaaaaaaaaaaaaaaagauaaucuaccaacccaauuucucaacuggggaauguugggcuccugcucuccugucucugaccuuucauucucccuugaggcuagccaucaagacuacaaccccucuuccccaaagugggccauagaaacaaaaccccuuuuccccaaagccaaccauaaaaccuaaaaauaguacucuaacuuccaccacccccagccugucuguguaaggccauaaagaaauuaucugacucacuuuguuugacugaagguuauaagacccccauuccagagaggguccagcaccacacccagaaggaagaaaugcaugcucagagaggcaagaaggguccagacagacaggcugugcuggauuucccugcucagucuauuagcauuagaccauaccuuuuuuguccaaucauauuucuacguggcucuccauacuuuguuuaaccuaaccuaagggggcucaggguuuuggccugggcauugucuguuggggaauagagugagucauccccagcucauggguuugcauccaguucuuguuguaaaaggcccaaagccuguuggauggcaacccugagccaucguggaagggggguuccaguuucacaaauagauacucagacagccaaacuaccaucuacuuggugccaacguuugcacuguggucaaagacuuaccuagcacagacugaacaaaucuucccaucugucacauaaauguccccaagcaauguugaagcacaugccaggaucggccuugcuagguccugcuugguagauaagcaaauggcuuccuugugguguuuuuauucuauuuugucucauuaacacuacaacuuuguguuaucuacuugauaaucuguaauuguaaauacauacaggauuauguaauuuguguaaauacauaaugacagacuucugaaaacugguauuuuuuacuugguguccauuugaagcuguuuuagguucuguggcacaugaaccaauggcauuuaaaaagcauacucuccuugcucuuaaaaaaacaaacaaaacaaaacaaaaacuguccauuaaaauuuuuguauuuuuguaaagacaggguuucaccauaaaaauggacaguuucccuuauaucuuugggucuucguucuguaggcucucgugucacauaaaauuaugaucaaauaaauuuguaugacuuuucuccuauuaaucugccccuugucaaugauuuugagcaaccuucugaagaaagugauggggaaguauucccuuugcugccacaagguauauaucagauaagucagucuauuuucuugaacauauaucacauucauaggaaaaacacuuuuuccaaaagauuacugucuucccaaauacccacguucuccauuuuuuuuuuuuuuuuuuagagauggggucucacuguguuguccaggcuagucucaagcuucuggacucaagcaauccucucaccucagcuucccaaagugcugugauuacagacauaagccaucacgcccggccccauuuucuccuuuggguguauguauauugcucauugucaggcaucaaccauuucucuucucugagauggagucucacucugucacccaggcuggagugcaguggcgcaaucuuggcucacugcaagcucugccucccugguucacgccauucuccugccucagccucccgaguagcugggacuacaggugcccaccacuacgcccggcuaauuuuuuuguauuucuuuuuugguagagacgggguuucaccguguuagacaggauggucucaaucuccugaccucgugauccgcccgccucggccucccaaagugcugggauuacaggugugagccacugcgcccagcccucuucuaauuuuuuauauuuaucauguauuuacuagaacugguuuauuuucgugagcauauguuguggauucuacuauaaauaaugcacuuaauaaucauuaauaaaacuuaaauccuuuccgucuugauuguggccuuuucuuuuugcuauuaauuuccucagcauagguuaaccugaacucuuaaaagcuauuuagguacugguauaaaacaaaauuuucuccaaagcaauccaguauauaauaucuggauuuuaaaaaagcagccucauuuaauuaggauuaauuucuccuuucagaaguuaagugauucuguuucuguaaaacgcaaaauuauaagcuuaauuguuuuccacacaggaaaugaaauuccuaaucuuuuuauccagaaucuucauguguuugucucucuguccaucugucacuccuuuuuaagguaccuggagaugaccuagaggcuugccacgcuuaggguuuccucccugugcagaagaagaugggaagugcaaaugaggacgagggguggggagggaagagggagucaggugauucagcaagugcaggagcccacagacuaagcucaggaauuugcacuuugucugcucgcagagugaguuucaucgugguguguauauauugagauaugcaacagacuccacuggaaugucagaagaacuuauguuuauuuuuccucuaacaugugggaaagauuaaacuguauuuguauuuaacucacauagauuggcacgugcucauucugugugucacccugccacgcugucacaaacuucgagcaggguccugaggggagaggagggcauagcuccugcucccaggggguugccuguguagcccugcgcauucauucucuuccagaggguugugauuuguggcggucugugugagccugguuaaggagaguuacagauuaugucaucugguguuaacugauaaucuuugcaaaagggacauuggcuuuaagagaugucugcaaaaaaaacucuaaacaaacauaaauaaaaauuuaaaaggauaaagccagaauaauaaugaaaauauuaguaauguaaaacaaggaaaugugucauguuuuucaugauaacuaauauuuuuucaauuuuuuuuuuuuuuuaagacagucucacucugucaccaggcuggagucaguagugcgaucuuggcucacugcaaccuccaccucccagguucacacaauucucaugucucagccuccugaguagcuggguuuacaggcacucgccaccaugcccagcuaauuuuuguauuuuuaguaaagacaggguuuuaccauguuggccaggcuggucucaaacuccugaccucaggugaucggccgccuuggccucccaaagugcugggauuacaggcgugugccacugugccuggccccaguucuuauuauaaguucuccauuaaccauaucaugagauuaaaaaaacaacaaugauuucaucggaacugacaaauagugggugacacaauuuugaucaucaagaagacuuuaaaagaaggauuuguaucacugucauuacugauuacuuggcccuuguguauacugggccuuuagcuagggcugguacaauaaaauaaccauaguuagaaagauauuuuaaaggauuacuuauuucauguuuaucucacccuuuuaucccuauuuuugggcaugauuuauuauuauuagguuuuuaaauaaauaaugaaauaagcauguuagguuugcaugcugcuuugguuaacauugcuauauaaccaaccaccccaaacuuuguggccuuaaaacaauaauuuauuuauuuauuuauuuauuuauuuauuuauuuauuuauuuauuuuugagacagagucucgcuaugucacccaggcuggagugcagcggcaugaucucggcucacugcaaccuccaccuccuggguucaagugauccuccugccucagccucccguagagcugggauuacaggcacccgccaucaagcccagcuaauuuuuccuuuauuuuuaguagagacgggguuucaccauguuggccagguuggucucgaacuccugaucucaggugauaugccugcuuuggccucccaaagugcugggauuacaggugugagccacugugcauggccaacaauaauuuauuuuuaucucucauggucucuagauugccugggcccggcugagcagucugagucagccuuauggucucucauguguuuuuaaucagucaugaggggccggcaucaucugaaggcuugacugggcuggauguuuaagacagccacucacagggcugacagugaugcuggauguugcacuguugacuaaugagccugcacguggcuccuccaugugauuugggcuauuuauagcuggggugacuggguucuaggugggguaguuccaagauccuuccaagaggaagaaagcagaaacugccuggccaguuaguguauaugcuuagucuuagaacagugucacuuccauauuucuccauaguccauuaaucaaagcaguuacaggaagcagacagacaggaagggaaaacacaaugcaacagaaggagagauugaaguguuggcagcugcaagccaagaaacaccuggguuaccagaagcuagaagaagaaagguaggauucuccccuacagguuccaaaggaagcugggccuguccacaccucaccucuggaacuaugagacaaucacuuucuguggguuuaagcuacccaguuuguggcacuuuguuacuaccguccuaggcaaaugauacaguaacuacauacacaguacauagaauugcucauuuuacuucguugaaugggacuuggcauugaauaagcccaaaugagaauucuuuugucaagauuuuuuuauggcucacuuuuccagagacgugacauggcaggaguaaggggaggguuuggcagguaggaauuauacucaucugucauugucuucccaauaccaaccaggaagcauguaaauaauagcugugcaguuuguuuucugaaccaaacugggccuuauuuuuuuuaaagaaacuuuauuaaacaaacaaaaaccuagaaacacuagauguauauuuuuaagguuucucucacauaauauccuaaucaucaguauaccguaauccaagggcuacauauaacugaaaaauaaaugggucuuaaaaaaauuaaaacaugguauauaacacuagcuaacauguacugagcaguuacuaagugcuaaguacugcuaaguccuuuauagauaucuucauguugagugucgucacugcccauuacuuacucugaguuuaaauaugagacucaaaagagguuaguaauuugccaaaagucauagggcuuauaagugauagaaccaggauaacgaaucucaaccaagggacuucaaugcccaaaccggugcucagacuguagccccauguaguuagcuauuuacauuugaaaaaauuuuuaauguuuauuauuuuuuuuaagacagggucuugcucugucaccuaggcuggaguggaguggugugaucuuggcucacugcaaccuccaccuccugggcucaagugauccucucaucucagccucccaaguagcugggaccacagguguauggcaccacgcccaacuaauuuguuguguucuugguagaggugaguuucaccauguugcccaggcuggucuugaacuccugagcucaagugaccugcccacuugccucacccuccuaaaguggggggauuacaggugugagccaccaugcccggcccagcuauuuacauuuaaauauaaauuaaaaugaaacaagauuaaaaauucgguuucucaaucacacuaaccacacuugaagugcucaguagcuacauguggcuuaguggcuaccuggcagauauagaacguuuccaucagcacagaaaguucuacuggaaagcauugauccaaucucuuugaacagucacaaugcauauaaaguccuuauuaugacuguacaagggaagacaacgaguagaggaaggcagaaaauaggaaaaaaggaagaagaaagauuuagggugagggagagcaguucuaugaagaaaagaagcucauaucuaggaguggaguggacccugagaacauguuagucuauuauauucuaaacuuuggcaguuaaaauuccaaaguauauuaaguacaugcuuucuaaaauauuagagagcugcaguucaacagauuuuuaacucuccacagcauguccggcacugggugaggugggauggcuaggugaauaauauaggcauugucauguguguucgugugaagagaccaccaaacaggcuuugugugagcaauaaagcuuuuuaaucaccuggguacaggcgggccgagucugaaaagagagucagcaaaggguggugggauuauaauuaguucuuagagguuugggauaggcgguggaguaggaacaauuuuuugugggcaggggauggaucuuacaaaguacauucucaagggcgaggagaauauuacaaaguaccuuaagggcagggaaggauauuacaaaguaccuucucaaggguggggaggguguaucauacaaagugcauucacaaggguggggaaauaucacaaaguacauuaucgcaagggcagggaggguguauugucacaaagucaauugaucgguuaggguggggcaggaacaaaucacaacaguggaaugucaucaguuaaggcaggaaccugcuauuuucacuuuuguugaucuucaguugcuucaggccaucuggauguauacgugcaggucacaggggauaugauggauuagcuugggcucagaggccugacagacaugaacuucccaucauaaaauuagaagagcauuaaucaaaugauuagaauaaaauauuaccauuauuuugaaauggcaagcauuguauguaaauaaacagcagaggaacccacuguagccuagacaggguucagagacguuccugccaaggacauggcacagggacugaacaaggaaggaugacagugccuggcaaaggcagggaauguuacagguauuugggcaccugugagaaggccugauguccgaaaggacugaaauaaauuaaauguguggggggagagagaaagaaagagccuagcaaaaggugagcuggagagucagaggcagaaggcagaaucugggaugggcugggagcuugccaaucauuuugucaaaugggugaugugaagccuugaagguuuuuugaccaagaggagaugucuucagauuugcguuugagacauuuucacugguugucaugcuaagaauggcuuaaagagaagcaaggcuggggucagaggagcugcuuggaagcuguuugguacuaggaugcggauaacaugguuggagaaauggcaacugucaggguauuuggagcaagaauggauagacauuggugaucaucacuuggaugcauuugagggacaacugcuauguuucuacuagagcaacuacauagagcaggaguaagcaacuuacaguccacagaccacauuugcucugucccguuuuucaaauacaguuuaauggaaacagagccaugcccguucuuucaccuauucugcauggcugacaucaggcaugguucuaaguaauauacauaaguuucauauauuaaugcucaucuaucccaguugacaaacaugaaguguugcuauugucucauuuuacagcggagaaaacugacauagagauucucuuucgcacccauagcuucaguuaccaccucuaugccaaugauucaauaauaccucuaauccagaccucuucucugagcuucagacaggcagaucucucacagccagucuuggagacacuucagaaaucauaggucccaaaccagacuccuccucauccccucaaacacauucuuuuucaacauuccuuuuuucuuagugaacaucaccaaauagauaagcaagucagauccaaggaggccuccuuggcacuucucucauccuugucccaccuuauaucaucuauuuuucuuuuucuuuuuuuuugagauggugucucacugugucacccaggcaagugcaguggugugauccuggcccacugcagccucaaccucaccaaguucagguaauccucucaccuuaaucccgugaguagcugggacuacaggcacaugccaccgagcccggcuaauuuuuguauuuuuaccagagacaggguuuugccauguugcccaggcugccaccuuaucuccauucuugcugaaaucuggcuguuucucuccacuucuauuaccaaccaccagccaaaucugacuuauuaaaaggaucaucucguauguggguucuguaauagcuucuucaaaauccauuccucuccacccagacccucuuccaaucuccaaacugcagccaauaccuucaauucugucaccgcuccugcauacuccaccuaauccuuaaccuuucaaugguuucucuugccccuagguuaagcuaaauugaaaacugcuaaagcuacagcuucuuaguguaacuaguaaguacagugacuacuaugucugguuuacuucagcuguugcugacuaauagcacuucuugaaugaagaaauuauauuaccguacuguagggaaaaauuuguacuucaauggaaaacugaauuauuuagagcaaaccuuuaagguuaucugauucugauuccaugggcccuuucauugggucuuacauuguuucauuguuuuugaguuauuuuacagaugacugauagaaaugcaaaauaauuauugcaugcagucaugcaaguaaaaucugaaggucaggguucaauuaacuucucuccccuacuguggaagaagccaauuucauuugcauauucauuucaauauuucugaccuauaaacaugccuguucuuugaaccaguuuuuauaucugccugguaacuucauuaaaugauuuaaauaaacucuauaauuuaguuuauuuuauaccuguaugacagucaggcuuuuaccuuauuuuugcuuuuuaaaauuauucuuuagcucucccuaaggcacuacuuggcuggcccuuuggcuacucacuagcccaagcuccauccucuucugucuaccgcagccccaggcucucuuuuggcccuuuguuccagcccuccucagagaaguucuuuuguccuggaacucacuuucauaccaggugcucuucaucccuucuuccuuuaguaaauuucuuuaaucuuucagauuucugcucaaggaucacuugcugaaagccuuuccaggccuuucugagucaauacaauccauuauuagaggcucuuagagcacaggcagcacuuguuauaauuuuacaucugucugugggauuccuuaacacuuucuaacacaauuaacacuuuucucucuggcugggggcaaugcaugauaacaggaugaugguaugcucucaacccucccccagcaacuagcccagugcuucgaacaugguggauagauacaccguuuuuauuuuagacagauuuuugaguagcaaguaccuacugcucaggagacagauggacugaaaaaauauauuugggagucaucagcacauaggugcagccaugaaaaugcacgagaagcaaaaccauuggcaggaacaaaaugaaggcuauuagagaccuuauuuagguggaauaauuggacagaagcccuuaauggggaggaaauagaagcaguuaauacagauggaggccgggcgccguggcucacgccuguaauccuagcacuuugggaggcugagauagguggguggcuugaguccaggaguuugagagcagccugggcaacauagcaaaacccggucucuacaaaaaauacaaaaauuagcccggcgugguggcgcaggccuguagucccggcuacuggggaggcugagaugggagaauugcuugaaccggggaggcggauguugcaauuagacgagaucgcgccacugcacuccagccugggcgacagagcgagacuccgucucaaaacaacaaggacaaaacuuaucuuauaagcgacccuggacuuccagggacacucgccgcucuauggugguacgugaccugccuggacucuguggucuuuggagcuugggaccccaccccagcguaagaggccuuucugugccuuguauaaaggagaggaaaaguguagguuuucugaguugauaagauuagagcuacaguauauuaucaguagcguuguaugaaaccauuuaaaaaaccaaaccggauuuaaccgcuuucacccagaauaaacugcccucccccucuuuccaagaucaagucagccccaguuaccacuuccuauuaauuuaaaaaccaggaaggcucauaauuuaggcugacguugccccaggcgaacacugcauauaagacaauagcuauuccaauccuccuuucccuuucuaaaccgaauaguacuucuaacaucacuuuuccaguccucuuucuaaauauugcgaucacgagccuacaucggaaaacuaugaaaacaguaugauuggagcucuugauggucugcuuugccugaaaacgaugaaaggcauugagaucuuugggcagaaauggcccuuagggaaugcgagccugguagccccauaacaccccgaguuacaaauucgguuuggguagguggcgcagggaaaucuaaaagcuggauucacguucucccccuucaguuugcacauagcggucaguggcagacaagagcagacgcacaaaugucaauccccgcccgcaaacucucgagggcagaaacugcuuuuugucaguuggauuuggagucgguggaaaagcugcccuaauguaguuucuccgagguuuccuuagccuugaccgaggggcgcuucccggccauucaccuagagguuguuuaauaaacaaggaugcucgcgaaauaucugcgcuuggaaaggcgcucguucguggcgcgcauucucgggccuccgcaagcgaccccggugacagggacaaccgcuucgguuuuagcgacugcagacagacugggacgagacgguuggaggcuccuccccaagggaugcuggagggguugcgucguacccugcgccuggcccuggcgcgcggccccaggucgugguacccagcgcccuaugggccgugcgccggggcuuggccacaccgccugcuuucgcuuccagccgcgcgcuccgugccacugccgcucucugcagccccgcguccccgcagccuccccauggccagcccgcuucgcuccgcugcggcccuugcccgccagguaccucgaacccgggcguuugcggaaggggggaggauuggaacccgggucucgguagcucgcgggccuggccgggcgccuugucgccguuuccugcaccauccuccuucgccuugcccuccauuccgccuccagcgaggcgucuucccuuccccgcaucccugcccgaaaucuggagucccagccugcaaucuccaccucuucgagguucccgcugcccaggucuagcacccucauggguaacccgcuccggagcguggcgaggaccgccacgggggacgugaggguagcuauggacucgcucugagggaggaggcgggagcugaaucucugggcugccagaacccacagccacauccuacgugacucugccaccccaaaauauuuugaccgcagccuucugccuccuuggaucucuuccuuccccacccccacccccguaguuauuuagcagauuacgcauuaaaacaaaugucugcagguuuucccaauuagucccgcuucccugugucuuuaucuuuuaaauugcccacuaauaccaugagguuuaaggugugggguggaugcugcggcaucggaggacccugcugguggaggaaaugguucacgcccguccccguucccuuugcaggcuugcuauugugcgucugugauugacaagaccacgaggcugagcgcgcccuggagauuuuucuauaaauggcuuaacaccccagucuagacuauuugcucggauauaagggagacaauuguuuuuuuguucuuugccggcgaacccuggcucuguagggcugaccuggaauuuaaccagucuucccugagccggcggaggaggacaaaaaccgccgcgaccccggcagggugggaagugcagggcagcgcucccaagacacgcuuguuggagguucgggccugggugcuugguugucugagccuccuuuuuuguguuugccuggguccuggagaggagcgcacgguaucauggugagcgucacguagguuaccccgggucccgcuuacccaccugcauuuacuuaauggugguuuaauucuucuuuaaggauugcaguaacggaugcuccgcagaguguaccggagaaggaggaucaaaagaggugguggggacuuuuaagguaaguugcuugccagaggcuuagugucuaaagcaacguucaacugaauaaauccauuucuuguugagauucggggaaauuuucacuguguggguuacccaguuccuagguuguguugccagacuuuuaaaauuccacucuuagaggaaaaaaagccauuuagagagugacaguacauucaucacaacaaaaauuaucuagcagcuaauugcugauuuuauuuugagucauauauuuuucuugaaaaauagucaaugcguaaauauuaaacuaguuguuuaucagauuccauaauacguacaaaccuucagucuacuuguagaaaaaguuaaacugugauuuuucucuuucaguagcacauaacacucuacagugaaaguguugcauuuucuucuuuucuaucugaauugcgggguuuauauaguaaauagcucauacuucaaacagugagaaacaaagcacguugaaaacuguacaaauacaaauguaagauguaauauuauuuuuucuauaagucuaucuccuacccucccuccucguggagguuuuagcuucuucuuuuuaugccuagugcugcucuucugccuguuugagucacugucaauugucaucagacaauugacacagaguguccuaaugaucucacauccuggcgguucagagagggaaggaaacuugacucaucaguuucucacacauugagcucucucacagugugcuggagacugugccaugcauuggacauccaaaggugaauucaagauuaggucucuacuugcaaggaauuuuuauuuuauuuuucuuuuuccuucucuugcugucaucuuagcaaggauuuuuuaaaaagcaaaauuagaauauugcaauuucuuuucuguuuuuugagacagggucucgcucugucacccaggcuggagugcaguggcacgaucucagcucacugcaaucucugccucccagguucaagugauucuccugccucagccuccugaguagcugagauuacaggcaugugccaucacgcccagcuaauuuuguauuuuuaguagagaugggguuaucaccauguuagccaggcuggucucgaacuccuggccucaugcaauccaccucccaaagugcugggauugcaggcgugagccaccaagccuagccugaagaauucuuugcaaagaaaaauaucaacucaaauuuaaauaaucuuuuccuuucuuuuucuuuuuuuugagacagagucuuguucuguugcccagacugaagugcaguggcaccaucaauuagguaucacuuucagccuugaucucucagacucaagugauccucuuagccucucaaguaccugagacuaucggcuugcaugccaucaggcccaacuaauuucgucauuuuuuguagagaugggaucucccuguguugcccagacugaucuccaacuccugggcuugugcaacccucccaccucggccucccaaaaugcugggucacaggcauaagccacaaugccuggccauaaauaaucuuuuuuauuuguuaauuuagauuucuguauauuagguuuuauuuaggggaauugccuguuuacacucauguauuuacacaucaaaacaugaguuaugguggauguauucacagcacauauguaauaaggcauguguaaaaaugauauugauaauuuagggaauaaaaaugguagauuuuauagaccaucuuuguuuuugauauacuuuucucugucucaaaaaacaaaaacaaaaacaaacaaacaaacaaaauauauauauauagccuacauuguuguuaacuauaaucacccuacucugcuaugaacaguagacuuuaucgcuucuaucuaacuguauguuuguacucauuaaccaaccucucuuccuccaccuacacccuucccacccccugccaucuucugauaucuaucauucuaugaguacucucuuccuccaugagaucaacuuuuuuuuuuagcucucacguaugagugagaacaugcaauauuuguuuuucuggguuuuuuuuuuuuucuguguuuggcuuauuucgcuuaccauaaugacuuccaguuccauccauguugcuacaaaugacacgauuuuacucuuuuuuaauggcugaguaguauuccauuguguauaugcaccacauuuuauuuguucauugauggacacuuaggugauuccaugucuugacuauugugaauagugcuguaauaaacaugggacugcagauaucccuuugauauacugauuuccuuuccuuuggaaaauacccaguaguaggauuguugguuuauauggucauucuacuuuuaguuuuuuuuuuggaaagcuucauaccauuuuccacaguagauaaacuaauuuacauucuuaccaacaguguauaagcguucucuuuucucuguauccucaucagcaucuguuauuuuuugucuuucuaauaauaaccauucuaacugugguugcuuuugacauauuucucuaccuuuuuguuaaucuacaucauuuauaacauuucauauggccuuuugggucucucuuggguaguuuucguauuucuucuccccuccccauuuaugaugcagucauauuacaugaggaugcaguuuugcagcagggccuagcaaugagauacguuguuacacauccuggcgaaucuuucuguggacucuaggauccucuucauuugcaagaggucagccaucuauuucuuccaauuccuccagcuucacauaucuccacagaaugcaacacugcaaaucugcaguucucuucaugauccucuuuauuagauuuuaaaagaguaucuccaaaagaugaacauagugccuaaggcuuuccaaauggaguaagaauaaugcacaagaaccuagaauaaaguuauuaaaugucugauacaguuguaauacagacuugauuuuugaaaaauguggccaaugaagagaagagcaaaugugcuauacgauggugagcaaaagguguugacaggccuggcauggugacucaccccuguaaucccagcacuuugggaggcugagguggguggaucauuugaggucaggaguuugagacuagccuggccaacauggugaaacccuguuuguauuaaaaauacaaaaauuagccaggugcgaugacacaugccuguaaucccagcuaccugggaggcugaggcuugagacuugcuugaaccggggaggcggagguugcagcgagccgagauugugccacugcacuccagccugggcaacagagcaaaaaaaaaaaaaaaaaaaaaaaaaaguguugacugaacccuggcugaaacaguuuucaggugcuuucaacaaauuuacacuucccugcccugagccucccuauuucagaacaaaugauuacccaacugcaaacuuugaauuaggaaguuguuuuuaauaugcccuguuuuucucaauauuucuugccauuucacaaucaguuauuguggcauuccaauucuuccacaaacauaugaugugaaacauccugacuucgaugucaucagggaauguggagcauuggaaagagacagauuaauuaugcagaagaaaguaucauuugacaaaauauuauuuuuauuuaucuuuggaaaggaaaucuagaaaaagaaaauacuuuuuaaagaacacugauaaaaauuguuuauaaaauuuguuuccuuuaggaaacaaaucguucccuuaaaacuacauuucauaucugccccaaacgagucacaugucuucagcuaauauugcuuguuuacguuugaacuuuauucaauucuaucaccuaguaauuuaguauucuuagguaauuucucuuugagcucagguuaaaaguuguuauuuuuaguuuucagaguugcagaauuuuuuuuucaaguagagaaaaguucaugaugagauucugaagccaccuaaucguauauuacuuugaaaaacuggauauaugccgggcgcgguagcucacaccuguaaucccagcacuuucagaggccgaggugggugggucaccugaggucaggaguucgagaccagccuggucaacauggugaaaccccaucucuaccaaaaauacaaaacuuagccggguguuguggcacaugccuguagucccagcuacucaggaggcugaagcaggagaaucacuugaaccugggaggcggagguugcagugagcccagaucacaucacugcucuuccgccugggugacagagugagacuccaucuaaaagaaaaagcaaaacaaaacaaaacuggauacagggcagugcuuagguacaaaucagaaaguuagagguugcuauucauaucauuaagaaauaaugugucuuacgaaagaauguagcaguuuacugaaauagaagucauaccuagaaauguaauaauuuaucuuuaauugucagaaauuuaacugauauuaugaaguucuaauuauaagaacacuuauuugagguuaaaaauuaccuuauucuaucccugcuuugccgcuaauuugaucucucuggauuaguggguuauuguggguccuauggguauuuuaaggagaggucucagaaaacuaaaaauuauauauacuggaucauaaucauucuugucacccacucucaucuuucuguuuuuguuuuguguuuuacuacccuuccccuuuuacuaaguagucuuaguagaagaaaauuugcauuaaguuugucguacuguauugauauggcuccaaauguuucuuagcccaggguccuccccauucacugauaaaagcuaacuaagguaaaucacagguguuuauugugcaagaauacugugaaacuauucauguaauaaaaaguuuguguuagaauuucacucucuuuaaauccuggacaucuucugugaguguaucugaaagcagccagacaucuucaguauuuaagaaacccuuuacuauucugugugcuaggcacuguguuagcuuuggaauucaacugugaauacucuagccagacuucuugucuaaauaguccagaauagggguugcuaaacuuucuuucuuuuuuuuugagauggaguuccacucuuauugcccaggcuggagugcacuggugugucucugcugacugcaaccucugccucccagguucaagcaguucuccugccucagccucccaaguagcugggauuacaggcgcccaccacuacacucaguuaauuuuuguauuuuuaguagagacaggguugugcuguuugccagguugaucucaaacuccugaccuuuggugauccacccgccucggccucccaaaguguugggauucagggugugccacugugcccggccugcuaaacuuucuuaaauggcuagaugauaaauauuuuaggcuugagggccaucagguuucuguuacaacuaguuggcugugcugccacugaagauacaagaauggcgugacuauguuccaauaacauuuuaauuucaaaacaggccagcuggcugcauuuggucugcaaguaaagucugccugacccccuaccuaguccagaggacaacgggagagaaaagggauucaaagauaaaaauaauuuagcuggaauauauuucuuuaaauaaacuuauuauacuuaguaaaaagucuuaaauuaacguuuuuacuugaauuaaauagugguaaaacaggcugggcacaguggcucaugccuguaaucuuagaacuuugggaggucgaggcaggcagauugcuuaagcccaggaguucgagaccagccugggcaacauagugagucccuaucucuaaaaaaaauacaaaauaauaauaauaaugguagaacaaagucaauuuuuuauugaaacuuggcauuuuauuggcauauuacaaaguagcauuacuagacuagccugaacauuacaguaauauucuguccuuaaugccuuuugugucacuguaauaugagcuuucuguuuguuuuggaauauguuuucagccugaauauuauucuaaaaauacaauuuacuaucauucauaauauaucaaaugacucacguagcugcaaggcagugaauuaaacagaauuagaucauuuuaaaaauaaugauaagagcugaugauguaaagugaaggucuguauuuaauuugggagggaaaagacuuuuuuuguauauucaaagagauggaguuugacaucccuucacaaccuguuacagguugaacuugccccuguuuuuuuaacugaucaaaaaguuccuucucuuguguuucuuuuuuucuucucuuuucucuucuuuucuuuucuuuuuuuuuuuucugagacagagucuugcucugucucccaggcuggagugcaguggugcgaucuugacucucugcaaccuccgccucccggguucaagugauuuuccugccucagccuccugaguagcugcgacuacaggugcaugccaccacgccuggcuaauuuuuaguauuuuuaguagagacgggguuucaccauguuagcuaggauggucucaaucuccaaaccuugugaucugcaugccucggcuucccaaagugcuggucuccuguguuuuugucagcauuccacagaugcuauaaaguuaguggugguaucgcaugcaauuuguacgcuuaauguuuggccauuugcagugggcaaacuggcuaugucgggagcuggugagaugcugcuuguggggaguuguuuccuauuacucugauuuaucuuuguuuaaauaagaguuccuuuguucacuguuuccuccacacagaacagaggauuuauaucuuaguguucauucucaacuuuccuguuuucaaagaggaaaacauuugcuucacuuugcucauuucuucuccagugcacccagaggauuuugaaggcuuaugccaacaauucuuuggggcaguuggaguguaaccauugcuaaauagcaguucaguacuuaaugacauucauuuuaguuuaacaaaucauugugaguguugccauuuuuuauuagggaaaacaucucuuucaucuuucccaaauacucaacaugaguccuauggugagagugaaaaaggguuguauucuuuuuuugcaucaucuuaccccaucugcuauuuugucccucuucuauauaucacugaaauuugguucugauauucuauuaggcaguguacauugcagagauuaugaauaacuggccgaauucugaaugcaggcaugauuuguucagcucagaguguuaaauuucuguguuagcugcuaaccuuuaaaagucaauugauuuccuuuuuuuuuuuccccucuguauaaucuagccagcgaaugcucaguagcuuuucuguaaauagugaugauuuuucuuccccaggcuaaagaccuaauagucacaccagcuaccauuuuaaaggaaaaaccagaccccaauaaucugguuuuuggaacuguguucacggaucauaugcugacgguggagugguccucagaguuuggaugggagaaaccucauaucaagccucuucagaaccugucauugcacccuggcucaucagcuuugcacuaugcaguggaaguaaguacaugggaauuaaagagagugacaugcuugcacuucacuguggguacuaaguagcuucuccugcuaaaauagcucuugggcaguaugggcuuuaucauauuuaccagaggaagccgaaaaugucuuuaaaaguuuuccuauagacaguuggauugaagauaaaucuuagcagcuaauuuuucagauaaucuugcauuuucugugacgucaauaaaaaaauuauuuaaagcaaauagaaaggacagcuggugggaaaauuggcaauuaaaaagccagcacuguugauaauuuaauaagucaccuuucuucuuagaucuucuaauaauugagaaagggucauugagaacaauauuaugauuugauuuuaaugcuaacuccacauuuuuaugaccaguaauaaugucuaguuaugcauguuaagggacauguaauuaaauguccuccuucagccaugaguugaaauaauuuuaagcauaaaauguuuaaagaauucuuucucugguccuuuucagggugcacaauuaaccagaugcacaguauacuucccauugucuugauucucauuguauuuuacuuuugaaugauuuggacaucuuucccagaauaauaggggugcuggaaauaauaauagucuuccuauuaagugcuaaaauaugguaauaguaaaauauuaauagauuaaugauaaaauaacaacuuuuguuuacugaauuccugcaauacguucuguauuauguuccauauaugaaucaucucauuuaauuaccuuaagugagaaggcaugugauuaagcauucaggcuuugaagucagacauccugggcucaaauucggucucauuugcuccauaggaaccuuuaugacuugaggaauuuaaucauuugugcuuuaauuucuuuaucuauaaaauugggguaguuauaauaucuaucuuacagugaucucauaaguauaaaauaaaguaauuuaucuaagcauauagagucauaucuggugcauagcgagagcccaguuguuagcaauaauaauuaacucuugaagcaguggucucauccauuauaaaaggaggcucagaagaguuguuucuugacuaauauuacacagcaguaaggguggagcuaagguuccaaugagaagcuucuuucuguuauauagccccuacauguauacaccaaaauuacuaggaugcuuuugcaauuaacuccuucaaaauuauaaauucauauaauuuuggaaagauauucacuguccauauguauccacaaaauguugaauuuaggaaucuaaguuucuguucccagcucuuccuguuaugucaauuugaaugaguucuuucauuauuugccacaagcccucaccaugucauaagguauaauaaagaacaggugaaaugaagugcuuuuauuuauuuauuuuucagacagauucuugcucugucacccaggcuggagugcaguggcacgaucguggcucacugcagccucaaacuccugggcucaagcaaaccucguaccucagccuccugaguagcugggaccacagacacaugucaccaugucuggcuaauuuuuacauauuuuguugagacuggguuuugccauguugcccaggcuggucucaaacuccugggcucaagcaauccucuugccuuggcuucuucaagugcugggaugacagccaugagccacugcuccuggcuaugugcuuuuaaauuugaaaggaauaauaugcccaagcccaggucacugguucucaaacuuaaugugcaucagaaucagcuggcuacaucuccagaguuucucauuucuaacaaguguccagaucauguuaauuuugucgcuccagggaccacauuuugggaauugcuggccuaugggaaguaaaugagaaaugauuuaaugucauuuuuggaaguuaaaaaagauuuugguggucacugguuuuugaaaacucuuugaaggcuggguggggugguucacaucuguaauuucagcaguuucggggagaugggguucuugggaaaugagcccuccacccaugggaucugaugcuauuuccacguagauaaugucagagucguucaaaccagagugacuccauccugaauaggggcuggguaaaauaaggcugagaccuacugggcugcaacaugaugagacccugacucuauugaaacaaaacaaaacaaaacaaaacaaaacaaaacaaaaaacggccaggcgagguggcucacgccuguaauaccagcacuuugggaggccaaggcgggcggaucacgaggucaggagaucgagaccauccuggcuaacauggugaaaccccaucucuacuaaaaauagaaaaaaaaaaaaaaauuagccgggcgugguggcaggcgccuguaguccaagcuacuuaggaggcugaggcaggaaaaugacgugaacccaggaggcggaguuugcagugagccgagaucacgccgcugcacuccacacugggugacagagcaagacuccaucucaaaaaaaaaaaacaaaaaccucuuuggccaucuauuuagaugaguuggaaugcuacuuugauugguuuugccaauuuagauuuuuguaauuaggguaguuuaaaaaaacucucaaauuacuguuauccuuuguuaaaaaccaaaaucuuuuauuauuagucuucugcuuacaauauaaguaaaauaaauguuuuguauuaauaacuggauuguauauugcaugguuaccacuauguaacaaaauuaauagcuuaaaauuacaagcgucauuuuaaaauuauuuuucauguuucugggguugacuaggauggcuaagugguuuuugcuugggguccgucacacgguugcugucaguggcugggguuagagucagcucacaggcuuccuaacucauauggugcuggagggagugucucuuagcaugcuaaugcuucauaauuuguguauaaugaacagugaggaugaccagaggucacuuucauugccaucugggcugcaaaacucaaggaguugaaggcucuuccggcauuacuuguucuccauguggucuccucaggauggcagucacagaguaggcagccuucuuaugugcugaccuagggcccaaaaucuguaugugucaguugacugagcccagauggaagcucuauugcuguuuacgcccuagccucaaaacuacucuuucaagaaaaauucuccaaccgaguuuuuccucuacucucacaccaccacaacaauagucaacauaggagacuucuaugaucaaagguguagggauuucuccccaccaccaagcagugaaccccagcuggguguccuccaauucaauucucacacuguuauuacgggaaaggugucccaauccaguccccaagagguucuuggauguugcacaagaaagaauuuggggagaguccacaaaguaaaauaaaauuuauuaagaaaguaaaggaaaaaaagaauggcuacuccguagacagaggagcuccgagggcugcugguuggcuauuuuaaugguuauuucuugaucauuugcuaaagaagggguagauuauucauaaauuuuccagaaaagggaugggcaauuccuggaacugaggguuccuccccuuuuuagaccuuguagguuaacuucccaccauugccauggccucuguaaauugucgugacacugguaggagugucuguuagcaugcuaaugcauuauaauuagcuuauaaugagcagcgaggacggccagacaucccuuucauugccauaugggauuuggcagguuuuggcuggcuucuuuaccacaucuuguuuuaucaguggggucuuuguaaccuguauguugugccgaccuccuaucucauccugugaccuagaauacuaaccuccugagaaugcagcccaguagguuucagccuuauuuuacccagccccuaaucaggauggagucgcucugguccaaacaccucugacauuauccaccuggaaauagugucagaucccauggguuaagggcucauuccccaagacccuaaccacccucaccuggcccagacacaagucacaaguccuguccucuggaaugucugacugagaggcaucaaguuggaguucccaugacccccucuucugguuugauuaauuuacuggagcagcucacaaaacucagggaaacacuuagguuuagugguuuauuauaaaggauacugcaaaguguauagaugaagcgauguguagggugagguaucgggggauagagugcagggcuuccaugcccucccggggugugccacccuuuaggaaccuucauguguucugcuauccggaagcucacugaacucauucuuuuggguuuuuauggaagcuucacgucaauauuccuuccccugggguaugaggcaggaccuucaccggagagggucuuuuauuuuauuucauuauuuuuaaaauauaagauggggucuugcuauguagccuagggugguauugaauuccugggcccaaguaagccucccgccucugccuccgaaagugcugggacuacaggcaugagccacccagccccuuuggagaggaucuuaagacucacaguuagaaaggagggcaggagaaggucagagagauucugcuuccugccccugaggccuaacacacccagcauuauaacaaaagacuguaacaagggcuaugggaguuaccagccaggaacuguaaaucacacaguauuauuucugccuuacucuuaucagucaugaugguuacaaaggccuguccaaguucaaaaggaggaaaaaagcacuccacuucuugaugaggaaggucaggguucuggaagagcaugggggacuggaaauauuguucggccauuucauggaaaauacagucuguaauagacaucagugauaaauggggagauaugguggauguauuguuuuccucugagugccaaauuggguucuaagauuucacaggccagauauuauugaaguggcuacguugucugggguauauaccuugggguucgucauuuugugccaggaaaauuuaggacaaggacucacacgaggaguuuaggaguggagguuuaauaggcagaagagaaacagaaacaguucuuucuguagggagagagggaucuucgagggaaaagaccauccagcagcagaugagcuggauuuuauagucagguuugaggaggaagugucugauuuacuuagggcuaacagguugguuugaucagguaugacguuuacauagcacaccgggaagucugguugccccacccuaauccuuuuaugcaaauggacuuuccuaguugauuggagcuaucuugucugcuccuuacuguacagguggcugacaaagagaagggaagauggagccgccaucuugaacaugauugacgcagcuguggauaucuaugucugcagcuugauuuuacaggcugcucuucuuuagaaaggggcugcuuuucauuaaaacaaaaaccuuacugaggacucuuguacccucacuaucugcaggugauuucuuaacuccuguaucauuauuauagugucauaggaaucuaggaagugugauugccuucuggagagaacuucagggucccuggauuuucucacuaaucauauucauuucauucccuguuuaccuguuuaauaaauguugaguggcuacuaugugcccagggcugugcaaggugccuggaauaggauggcaagcaaaccaaccaugaccuugcucucaaagaauuguuuucuuucuuucuuuuuuuucugagacaaggucuugcucugucgcccaggcuggagugcaguggccugaucucagcucacugcaacuuccaccuccuggcuucaacagauucuccucccucagccucccagguagcugggauuauaggugcccaccaccaugcccggcuaauuuuuguauuuuuaguagagacaggguuucaucauguuggccaggcuagucucaaacuccugaccucaagugauccgccugccucagugccgagauuacaggcaugagccacugcaccuggccuguuuucugucuuuuuuuuuuaacccccacauggaaaguuaggcagggauuuaauuucaaagaguuucuucccaaauauuguggugaaacaucuaguccauuuauguuucaggcuuuuucauagauauuacuguuucucuuagacugacagacuuaggacaucacaugauugaaugucaaccugacuuuuaaguucaauaauaguuucauuuuuuaaaugcaaaauuaaauaggaguaauauccuugaacauguuucuccuucacucaucggaccuauugagucuagaauccauuuuauuuugagagcuccaacuacaugugguuucuguuaauaucugaaaguaauuuuuaauaucugaaaguuucaaauagugauaauauuugaagguuucaaauaguggaggagagacgcaaacugcgaguagggaacgcggauugaaggaaaugaaaaguugauaauaggcacuucauuuucagauuauaacaaauauuuagugaaauaaagcauaauuuuaaaaaauggauaagacauguauguacuauuuaauguguacuaauaaaugaaugcucauauuugccauccagauaaagaaauagaacaguugaacaucacagaagcccucgcgugucccauucagaucacaaacucuaucuuucuacugguaaccauuauucuuacuuuugugauaaccuuucuuugcuuuccuuuauggaguguguagauucuuaacacuauaguuuugccucuuuuugaacuucauguaaaugaaaaaauguauauauuuuguguuugugugcaugugugugugugugcuugcacacgugugaauaccccuuauuguuugagcuuaguauuauguaagaucuaaccaggaaggaccaaccuaacauuuguggggccugggaccuaaguauagacagagaugacaugguccacuccauaucuguucccaucccaguucugcccugugcuacaaggggucuuccagacacugcauagguacccauaccaccugcaggcagaugaccuuugccuguccuuuggaguuaggccuggguacccuacuaguggugucugcucuugggaugauaaacccgaggggcuuaucagcuuuauauauauauauauauauauauauauauauuuuuuuuuuuuuuuuuuuuagcuagcaucucucucguucuuccaggcuggagagcaguggugugaucuuggcucacuguaaucuccaccuccuggguucaagcgauucuccugccucagccucccaaguagcugagauuacaggcacgugccacuaugccuggcuaauuuuuguauuuuuaguagagacuggguuucaccauguuggcaugugagccacuaugcccggccucuuuuuuuuuuuuuuuuaagagacagggucuuacuauguugcccaggcugguguugaacuccuggccucaauagauccucuguccuuggucucccaaagugcuggcucagucauuauguucuuuacugccauccauugcaguauaaaaagaauaacaguuuucccucagaauauucuuggugaaacaguaacaauuauuaauuuuauuaaaucuuggcucuugagcaaaugucauuuuaauauucugugugauaaaauagcaaugucacauaaagugcuuuuacauacuuaaguacuaugguugucugaagaaaaaggaguugugugauugucuugaguuuguaaguggaacuacuuuuuucaucgagcaccguuuuuacuugaaauaacaaaguaugaauaugaaugcagauuuggccauuuggcagauuuuuauuuauuuauuugagacaaggucuugcugugucacccagacuggggugcagcucacugcagccuuuaccuccugggcucaagugauccuccugccucagccuccuuaguugcugggaccacaggugugcagcaccaugcucagcuaauuuuuaaauuuuuuguggagacaaggucugaccauguugcccaggcuggucucgaacuccugggcuccagcaauccucucgcuucagcuucucaaagugcuggaauuacaggcgugagccacgguucccagcucgccuuuucauauguuuauuggguugcuaaauauguucuuauuugaagugcccacuuguucaaguuuuuuguucacuuuuuuauugcugucuuuauaauuuuuugaugacaagaaauauguuuaaauuaaaggcaguuuugucaaucugccuuauguuuggaauuuguugugucuuuaaagacucuuuuccugcccuuauauuauaaagauaucuuauaguauugauauugucauucacaguuaggucuuuaauccuagaaguugauuuuuguaugaaguaagggcccaauuuauuuuuuuccaccuauguauacccaguuuucccagcaccauuuaaacgggcgguacuuuccccucugauaugucaugaugacaccuuugucauguacacaugaguuugcuucuggaucucuauuuguguucaguuguuuuacuugucugcauaaaugccacagucuugguuucucagucauuauaaugagccuugccugcuaggaaggguccuucuacuuuguucuccaagagugccuuggauauucuuggucauuuucuuuccauauaauuuuuagauuugguuuaucaagucgauaaacuuuugucaugcaguuuuuuaaaagaaaauaaagugcccuaaugugauuuuuuuuaauuuggauuacauugaauacauaaaucaguuuggggaaaaucaacaucuuuauaauauugaggcuuuuuauccaugagcaugaaauugcuuucuacauuaauaacuugguaaaguuuuauauuuuccuuauggaucuuucacuucuuuuguuagauuuuucuccaccuaaguacuguaucuuuuaauucuacuguaaauaguguuuuuauuuuuuaacugcugcuauuacauaggaauauaauuuugcaucuggccagcuugccuaaacagaugauuucaaaauauuaucugucagauuuucuguguucucuaucucuguaaucauaucaucuauguuuuaugaucuaugacaguuauauuuuuucaucuccaagcugauauuuuaaauuucauuauucuugcuuuauacugguuguacauauucaguuagagugauugcaguaggcaauuugcgauguucccaauuugauaaggaaagcuuuuacauuuuaccauuaaguauaacguuugcgagcuuauuauagcuauccuuugucacuuagggaaguuaucuuuguuuuuuaguuaucuaggaaacuaaaaaaucagaaaaguuaguuugauuuuaucagauacaucugcuacaucuaaugagaugaucauauaguuuuuuuccucccauaaacugugaauauaaugaaucacauuaauugauuuuuuuaaauguuaaaccaaucuccauuucugggauaaauucaacuuagucauguuguauuagccuuuuguauaucuuauaucuauaauacugaaugagauuaucauacucuuuacauguauuugaagccaugucauuaagugcauacaauuuuuauuaaauuuuuaauugacaaauaauuguauuuauuuaugggguacgauguaguguuuugauauauguuuacauuguagagugacuaaaucaagcuaauuagcauacucaucacugaacauauuuaucauuucuuguggugagaacauuugaaauuuaaucucuuagcaauuuugaaauauaugauacauuauuauuaacuacagucaccaugcugugcgauaggucucaaaaacuuauuccuccuaauugaaauuuuguucccuuugaccaacaucuuccaauuccccaaccccuagccuccucugguaaccaccauucuacucucuacuuccauuaguuugacuuuuucaguccacauaugagugaaaucgugcaguauuugucuuucuguacuugucuuguuucacuuagcauaauguccaacggguuccccaugucauuguaaaugauggaauuuucuuuuuuauagcuaaauaacauuccaucauguauacauaccacauuuucuuuaucgauucaucuguugauggacaguuagguugcuucuguauccuggcuauugugaauaaugcuacaauaaacaugagagcacagauaccucaugcugauuucaauuccuuuggauaaggguccccaaaccccaggcuauggaacagcagugguauguguggccuguuagguacuggaucgcacuguaggaggugagcagcugcgagugagcauuaccaccugagcuccaucucaucucagaucaguggcagcauuagguucucauaggagugugaacccuauugugaacugugcauugcaggaaucuagguggugcacuuuuuaugagaaucuaaugcuugaugaucugagguagaaugauugcacucugcaagacuccccacgcucaucccuguggaaaaauuaucuuccacaaaacuggucccuggugccaaaaagguuggggacugcugcuuuuggauauauacccagaagugggauugcugaagcauaugguaguuuaauuuuaauuuuaauuuaauuuaguuuaauuaauuuauuuuuagcaccuaggcuggaaugcagcagugcaaucauagcucacugcagcuuccaauuccugaccucaagccauccucccaacucagccucccaaauuucuggaacuacaggaaugagccaucucacucagcccuauuuuuaguguugggaagaaucucaaaaaguaaugacuguacuaauuuacaccgcuacccucaguauacaaggguuccauauccucacuaauacuuaucuuuuaucuuuuugauaguagccauucuaaguauguauaguuuuaaaauuaugaaguuuaaauugaaccuuaggaaguugcuacucugucaccaggcuggagugcagcagcgugaucuugguucaccacaaucuccgccuccuggguuuaagcaauucuccuggcucagccucccaaguagcugggacuacaggcacaugcuaccaugccuggcucauuuuuauauuuuugguagagauggguuucaccauguuguccaggcuggucucgaacuccugaccucaagugauccaacagccuuggccucccaacguguugggauuacagacgugagccaucacacccagccuugaaguugccuuuuuuaucuucaguagugcuucuuggcuuaaauucuuuuguuuuauaaauaguaauggaagcuugccaguuuuauuuuagaaaguauuugcaggccaggugcaguggcucaugccuguaaucccagcacuuugggaggccgaggcaggcacaucacuugagcccaggaguucgagaccagccuaggcaacauggcaaaaccucgucucuacaaaaaauacaaaaaauuaacuugggcgugguggugcgcgccuguagucccagcuacucuggaggcugaggugggaggauugcuugaacccaggggguagagguugcagugagccaagaucuugccacugaacuucauucagccugggugacagagaaaaacaacucugucucaaaaaaaaaaaauaaauaauaaaaaauaaaguauuugcaugauauaucuuuuucugucuuuuugauucagauauugucagcugaguccaaucuaacaaacuuauauuuuaaccgaagcuuuaguacuguuauauuuaauaaacuaauaauauauuugcacuuaaauacaacaucuaauuuuaugcuuuuuaauuauacaugauuuguauuucuuuuuuucccauguaaguuuuuaggguauacaucuuuaaaggccuuacuuuucauuaucguucaguuuaacuuauuuucuaauuuccauuuuucuucugugaccuaugguuuaguuagugguggauuuauuuuccaaaauauggaugguguccagucaaacuuuugguauugauuucuggcuuaucuuguguuuggaaaauaugugaauucuacagcuggucuguguaagaguucucuguaucaguuagggaaguuuguucuuccuguuguucauaucuugcauaucuuuacuaagguuuagccuguuuguucuauaaauuacuuagagaagcuguguuaaauuuucccacuaaaauuauugauuuuugucuuucucuguauuuaucaguauguaucuacugaagucuuuucaaaucccugaucagugguuuguucaggacagcacuuugauugagggaggugacguggcuuaacauaguauggucuugagcugccugguuucugugauuuagggacugaaccagcucuggucacaucuggauuaucuacuauccagcauucaaaugaaccagauuacaugaaaggauauggggguacucuuugggggccacggugccacaaggccuuugguuucgaucuccauugccuagggaauuaaccugugcugugugauucuagauguuuucuuccugcucccuuaaauaacaccuaaauguguuauucagcaguguggcuccugcuaagcagaggagaacucggaauuccuaccaaauucugauaauaaaauaacuuuccuccaccucaaccauuguuuuuaccaguccugucaacuguuagcuuuccuggauuuaaugaucucaaguugaggucaaugucaacagcuuuaugggaugaauaagaugaacgcccauaggaaagucagucucuugaacacggguuguuuucuuuugguuacccucuaagauuuuuucucuuugaucuccaguuauuugaaggauugaaggcauuucgaggaguagauaauaaaauucgacuguuucagccaaaccucaacauggauagaauguaucgcucugcugugagggcaacucugccgguauguaaguguaggaguuucuuuuguguuucuuuuaauguaacgggucacgguguugaccaccaaauaaauaauuucugaauaguuagauaaauauucaguacaaaccauaugaacauuaacauuauuucugaucuacuuuaguuagguaaaaauacaagaaaauggccgggcacggugguucacuccuauaaucccagcacucugggagacugagguggguggaucacuugaaaccaggaauuggagacaagccuggccaacauggugaaacaccaucucugcaaaaaauacaaaaauuagccggguuugguggcacaugccuguggucccaucgguguggcugaggcaugagaauugcuugaaccuggcagguggaggcugcagugagccaagauaaucacaucacugcccuccagccuaagccgcaaagugagacucuguaaaaaaaaaaaacaaaaaacaaaaaacccaagaaaauaauaucauuuggcaauuccacaauuuuuuaaaaucagugucugugggggauucauaugcaagugagagaugaaagaguaaggaagaaaaauguaucucaaccuaaaauaauauuugaagaccacaugaaauuaauauugaaaauggaaaauauggugugcagcacagguauuuugcggauauuuugccuaauugcuuuagaugcuagcaagauauaguaacuuaauuauuuugauauuuuaucuuaaguaauguuuugagauaaaaagauaucaaaaugguuucucauggccauugaaucguggcugucacaauguuucuuauggagcagaaaucauuguaagauggguuagauuuuuuuuuugagagagagucucacucugucacccaagcuauagugcaguggcacaaucuuggcucacuacaaccuccaccuccgggguucaagugauucuugugccucagccuccuuaguaucugggauuacaagugcacgcagccaugcccagcuuaauuuuuuuaaaaauuauuuuuaguggagacaugauuucaccauguuagccaggcuggacuugaacuucuggccucaagugaucugccugccucagccucccaaaguucugggauuacaggcaugagccaccgugcccagcuucagggauuuagcccaaccuaugcauucaggaagccugaggacggcuaaauccaaguguucuucauuccucugccuauuuuuguaacccgcauuucacccaucuccuuuggaggccauaauauaguagcagaggggaaauuaagguaaauucuuuggacuagggcauaguuucgcucuucuucucauuacagcuagaucacuggggaaaagucuuuaaaauggggcuggaaggaaagggaaguaauauuuguuagacaucaauuuugcuaccaaacuguguuauguaguuucacauuccuuaucuguguaaucacagcaguaaggcguugcuaagaagauuauuuguuguacaguuuauuagugccuuuguacagagaagaaaacuugaguccagagagauuaaaugacuugucugaagucacaaagagcaaaaggacagggcaagaaauuagauccagguguuuuuauuccuggucaaguucucuucucacugaauucugucucuagacagcaauaccaggggcugaggcaggugcuacaggguucaccuauaugauuggcagucccaauuucuauaacauuacuacauuauuauugcuguuacaggucaauauuuaaauagacaaauucugacuucaugagcuuuacucagaugcuuaugacugacucauuucuaccuuaggugacccaucacaucucugaaaguauguuucucuacuuugcaagugagcagagacuaaauuauuuuaugaaguaucacccaucuaguagauguaauuuuuuuuucuuuagaaauaaagugcucuuugcuuuugcccauuuuccuauuggguuaucuaucucuucauugacuuuggggauauccaaauauauauaccaguuaaaauucuuuguugaucaugcuaccaauaacuucacccaguuuguugcuuuacaucuuuugaagaacggaagucuuuaaguuucaaauagucacauuuuauccauuuuuuuccuucaugauuuguguuuuacaucuccuacuuaagaauccuuuccuaccuuaaggucacagagauauuuuguacuuuuuaaauaaagucuuaguauuuugucacauuuaaguauaucaucuaauuagaauugauugggggguaugguaagauguagggaucuaaucuuaucuuucacauguggauagcucgucaucccaucacaauuuuuggggggaaaaucagaaaaaauuguuugguuuuauuauuacuuuaaaauuuuuuuuauugguaccauaaauuauacauauuuaugagguacacugauguuuucaugcaugcauauaauguguaaugauuaggacaaauaagaaagaaauaaauaaaaauuaggauaauuaggauauccaucaccucaaacauuucuuauuuuuuuguguugggauuauuaauuuuuuaacaguuuaaaugcuucagugaggaucauuuauuauugccacauugugagaaaauucugucauuuauuauguuuuucauucuuucagguauuugacaaagaagagcucuuagaguguauucaacagcuugugaaauuggaucaagaaugggucccauauucaacaucugcuagucuguauauucguccuacauucauuggaacugaggugcaaacugacucuuuauuuugggguacuuugcugggcaaguuauuauuguuuauuguuguuugaaacuucuagcauauaguuugcaguagccccccaguagcaucauuaaugacuucuuccuucugauugucaagauuagagguagcaaacauuuucugugaagcgccaaucaguaaauauuuuuuggcuuuguggccauauaguuucuaauaagaaauuagaucccuaccucuuaccauaccccaaaaucaauuauaauucgauuauauacuuaaaugugacaaaauacuaagacguuuauuaagaaauacaaaauaucucugugaccuuagguaggaaaugauuuuuuuuuuuugaggucucucucugguuuuuuuuuuuugcccacguugucgcuuaggcuggggugcagugaugcaaucacggcugacugcagcuuugaccuccugggcucaagugauccuccugccucagcuucccaaguagcuaguacuacaggcaugugcuaccaugccuagcuaauuuuuaaauuuuuuguagagaugaugucucacucuguuguccuggcuggucucaaacuccuggccucuagcaauccucccaccuuggccucccaaaguccugggauuacaggcaugagccacuucaccugaccggagaggauucuuaaacucugccauuuuaguacuaaagcagccauagacagcacauaaaugaguaaaugcagugcuguuugccuugcccaauuaagacuagucauuauuuucuaaguuuacaagugcagugccucccauuguggcaguacuucucugagguagaaaugguuuuaaaauuuaggggagggagagcugcuaauuuucauuuucaugaggucuugggauuacuuggcauggagugagaauggagguuccccuucccacauagaaaaauggugaaaauaaaguucacagugggaguuaaggaaggaaauugaagagcugggaugguagguuuaaauaacaugaccuuaugauuuccuggugggucacagucucuugguugggugcccuugugaauaaaggcauggauugggcaugccuggaggggccaaggccuuuugagcggacgaguauguuuauaugaagacccugucaccugucucugguaucugcuaggcagcuguggcuugagagugugauauugagggauaauugauggaaggagauugaauguggcuggcagguaaagagauagggaacauauggagauauuuagaauaagagagugugagauagagcgcuuuugcuauagccuagccauucuguucucuacuaaguguugcgggguuaccagguuuucuacuaggcuguaugaaugcaaaagguagagagauauauagggccauggaauaaauaccgaaguguuuucuuugguauccuugauaccuuucgaaagccguguaaggaucuagauaaugaauuucgugaauugcagucucucugacaaguuuuaaagaauaggaacaauuuuaaaaagucaucuacuuccauaaguuuuuugacauuuuaagauaauugaauuuuuuuuuuucagcuuuuaaguuccaggguacaugugcagguagguguguuauauagguaaauguaagccauggugguuugcuguacaaaucaacccaucaccuagguauuaagcccagcauccauuagcuauucuuccugaugcucuuccuccucccgccccuuccgacagacccuaguaugugcugcucccugcaugugcccauguguucucauuguucagcucccacuuauaagagaacaugcaguguuugguuuucuuuuaauauuauuuuuaacuuuaugauaggaaggaguacuuuuuaaaguugguugaaacauuguuacugaucucaaagcacuaccuuccaguuauucugagauacuuuuucagucuaagaucugauacuccuauuccugguuuguugagaguuuuugucaugaauggauguuggauuuugucaauugcuuuuuuugaaucucuugacaugauuaugugguuuuguacuuuauuacauuauuaaugaaugaauuauaucaauuuauuuuuggauguuaaaucaaccuuauuuuccuaagcuaaauccuacuuggucauugugaauaauccauuuuuuuaucuugcuauauucaguuugcuaauauuuuaagaauuuuuguuucacuguucaugaaauauauugaucuaguuuucauuuuucuuuucuuucuuuuuuuuuuuuuuuuuuacaucucccuccucuuccucuugaucuaguuuucuaauacagcugcacuccaacuuacgaugguccuacuuaggaguuuuugacuguaugauguuugaaaacaauaugaguuuaguagaaacuuacuuugaguacacauaccauucuguuuuuuugcuuuuaguacaguauucaauaaauuaugugagauaaccaauacuuuauuauaaaauaauacacuuuuagaugauucugcccuaccauaggcuaauguaauuguucugagcacauuuaagauaggauaagcuaagauacgauggauguuugguagguuagguauauuaaaugcauuuucaccuuaaggauauuuucaacuuaggaugaguuuauugaguuguaaccccaucacaaguugaggaacaucuauguaucuaauuccaugauucaguaaauucuuuagacugccaaaauccuguaaucuagaguuagacaagaucuuaaaucagguuuugugguccaucuuguagucaugaucauucucacuauuagggaauucuuaacuuuuugcauuugaaucaccgagguguuauuuaaaauacacauauggaauccaagcuccagagacucugaguagaucuggugagugauugugaugccugcccacauucaagaaccuuaguacaaaagcccugcugaaugguucucuuucacuauacacucuaucaacuuauguacuugaucacacuuuggaccucaaaaucaauaauuuuuaaaaaucuacuuccuaaguugugagguacgaauugaaggaaauaaugaauacuauuuggggagucaacauuauuuauuaacgaauaccauuuggggagccgacauuauuuauauuugguugguauauuuguaucaacuaucauuuucuaauuaaugguauaggcagaauaaaccaucacuugugauucagaaaggaacaugauacaaauaacauccaauaauguauauggauuuaaauagaucugcccccuacagauguuacgcaauucauguugguaaugaucauucauuagguuuucgugguggcuacauuugauaugugaaguacuggcuggaagacuggugccaguagcuucagguuugcugggauucuuucaucagagaugacuagcuuuacuuaucuuuuuauguugcauguuucuaugaugggccuauccugucauugucuucauaguauaauugcaagcucaacucugucaguuaugugauuuuuuuuuuuuuuuugguccugucuugcuuuuggcugacuucuauauguuuuuauuucauguccuuuucauaguuagauuaacugggucuuauguccaagagauauuuugauuucuuugaaugaauaaaucuauguuaggcuacuguauuagguuuuauagacaccuaguugaucacuuguguccagucucuauucccugguaugguaguugcuguguuuauagaacauugaggauucuacaauggacacauugguguugggccccagcccagacccaaaucgaaauuucuagagccaggaucagagacucugcauucaacaaacucuccagagauuucauaaccacuuuuaaaggacucaccaucccaaaccuuguuaaggaaugaaauauaugucugccaguaauuucagugcuuuaagucauugaaagcugaacuuuuaauggcaccaaaguggaaauauuuauauaauugaaagcuaaacuucauccuaauggcaguguugaguucacuuccauaggcccugauauaacagucuaauauuauuguuuuucacauaaaauaagauucagucacugccauauaauuagggaguggcucugcuauuggauggacuuaaaauauuucauuauguuugccaagcucugucucuuuacauguuuuauaauuaacugauccuucauuuuuauuuuguuuuauuuuauuuuugagauagagucucgcuugguugcccaggcuggagugcaauggugcaaucuuggcucauugcaaccucugcuucccagguucaagugauucuccugccucagccuccugauuagcggggacuacaggugcgugccaccaugcccagcuaauuuuuguacuuuuaguagagacgggguuucaccauguuggccaggcuggucccaaacuccugaccucagguguucugcccaccucggccucccaaagugcuggauuacaggcaugagccaccaugcccggccuccuucauuuuuaauaaucuucauagauacauacuuguuguacuaauguuuuugugcaguuccucaugauaaauaauuaaaucaauuacuaaaauccuuauagauuuaugaugauaauaaauggaaguguguauuauugaaacauguuuaauuaacuguucauauauaaccagugaguagggauuggcaauuaaaaauaccaggcuaccagugcauggaaauuugaagaaaacaacaaccugaaauucagaauacuccaaaaucugaaacuuuuugagcacugacaugacuaaaaaugcucauuggagcauuucagauuucauuuuuucagauuagggaugcugaauugguaagcauaaugcagauuaauccaaaaucugaaaaaaauccuaaaucaaaaacaguuuuggucagaagcuuuguggauaagggauaguccaagcuuuuuggacugaagcuuuuuggauaagguauagccuauaauacauaaauacauaauacaggauaaucacugaccugaauguauagcaucaguaugguacacaaauauuuaaauccauguacuuuguuggauauuauguuauauaaacuucuuguaaaaaguuuagagaguaaaaucauucacauuaccaaaagauuucucauauuuauaaaaaggauuauagcagcauuuuaaucaguaucuccuaaaguauuuauuuauggguuguuaaaucuaaaagagaaacuacagucuggagggcucuaaacuacugcugauuacauaucaguugggaauuaagagaaaaucucagaucauaauauuuaaauaaaaacauuuacaugaaugauuucuaaguuuucacuuuacuagacaagaaacuaaaauuauaugacugucauguucaauauuggauacuuaacaacacuacauccaaggaagccagguuuugcugauuuuaaccucguccuguugaguaacuccaugcagguacagugguacaaacacauguggacacacagacccagaccuuuauuuccucggggauucugguaaguguagaggugucuugaccauagucaauagcagaaauaugcacaaccacaagcucugaaauuccauuugauuguugcucuuagccuuccacuuuuuaggcauaugucagucccauuucaucccacccacucucuccauuugggaggugguagagugagacaauacugaacuauaccagggcugagaauaagugucuuugaaaagggucgaaucugugaugcuagagacagcccuggaaacugucaggaguuagcccaaccaggacugugaccagaucccaggcuguccaccacagauuugcaggcuaccugcagaugugacuuuuucaaauguacucaaagacaagcugacuuuggcuaaugcagaaauuaauuaauuccucuuuuucaguaaacuuuauccuccuacacuuagauugucuguaaguacaucucuggaguugagcucaacuagaaagaagcugucugcauuuaguuaauaccagcauuggaugcacacaauauaauuugaauaauguagagcaacauuuuaaucaucucucauaagcaguuuccccauuugcaacuuccugggaaaucuuacauuaugaaauguucauuagaacucccauuuuaaaacccugcugccauuuugugagugggcagaagaaaggcuggagaugagauuugucugucucaaaugauucacuccuucauuucugguucacuccacagggagcuuaaggacaugugcguuucauagacaugccuuucuuuuccuuuuaucaccuuguuaaaucuuaagauugaacauacaauucagccuguaaucauaucaauucccaugaaaaauauuuuccuuauucacugccucuauuugugcuuauacaucugaucaucuuuuuccuuuacuuuacaauuaguuucuaugaacagaagaaucugaaagauuuaaagacuaguuagcacagcagcaauuuauaaaucauuaauuuggguacugucuauacauuuaauguguucuuuuucauaguccuaugugaaauacauauacauauauauauauuccacuguuuauaaacaauauucaguuuuauuugcauaacucaauauauuuuauauuaacagcuccguuuuuagugucuuaagacaucgagucuguuuuuagagauacagucuauuugccuugauuuuagccuguuauaaucagcuuauuauuaucuggccacucuuaccagugaguaucaucuugaggcuguucuugcucauuucaacuugucacaggggauguuuuuuacucuuuggaguuuagguacaccagguuauuaauuaugcuccugauucaugguacuuccaucauggggcauauaaggucccugucuuuguuuuauucccuucuaucuucauucaccacucucauuuccucucucuccacuagaaauaauucucaggaaucaaauuaauauuauucuggcuuauauguguuuuuaaaaaucucaucgcuuuuuauacauguaauuuuaauuuauguaagagacuuuguccuacagauuucauuguguuucuucucuuuuucgcccagcacuguguguuccauuucuauccagucuacuauguguacaucaaguccaucauuucuaacuguugcauaguucaugaugcgaggcaucuuccacauuguaucccaauucccuaacuggaaucccaguucccugcuaccucacacaaugcuccagugaacagcuggaaaaucauacaacccaaggaauuauugaaagugauuauaucccagcaaaaggcccaggcccaucuuacacuuccaccccaagaagguacugcuacuuuucgggaauggccuggucuccuuggcgaaauuggcauuugaucuguucucaucacugucgucuggcaucagaagugaccccacuugucaggcacuguacucagugcuuuccaugcacuaacucugauaacaaucuuuuuuuuuucuuuuuuugagacagagucuugcucuguugcccaggcuggagugcaguugugugaucucagcucacugcaaccuccaccucccaaauucaagcgauucuccugccucagccuccccaguagcugggacuacaggcgugcaccacuacaccuggcuaauuuuuguauuuuuaguagagaugggguuucaccauguuggccaggcuggucuugaaauccugaccucaggugauccacuugaccucccaaagugcuggaauugcaggcaagagccacugagcuuggccugauaacaaucuugugagcaggugcuuaugcaguauuuuagggaugugaaaguaagguccaaagcggugaaauaagagccuguauucucuuaaccuccaucccgcaacaucuuuuaugugucagucccugcacuaagucuagggauacugugcugagcaaaaacuaucuucuugcuuucacagagcucagugucuggcagggggucagacuuucauaauauaaacccacuaaaugagugcauauugauggcggucacugcugugaagaagugggaaugguuagcauggaaacauagccccaaugggggcgacuaaguucuuucccaucucauucuacuaugucuacuuucaucucuacuuuuuucuuuucugagcuaucagcuuucuugcucucaacuauauuugauguauuuaaccagauuuuauauauuguauuauguauuuuauaacauguauauauaucauauaacauacacauauacauacauacacacagccaauuaagucucaaguucaauuacaaugcuucuaaguuuaggacuauucauuuucauuuuggcagagaaauuaucugguaaaaaauucaaguagaaccaaagguauacaauagaugggaaguuuccuuuucacucucacacucucauuuccauccaggguucuacaauucaucuccuuccaagcaauuccuauugccagcuuuucuuauacccuuucagaaauacacacacacacacacacacauauauacacacacacacacacacccuuacauguguuuguacauuaucucucuuuuuacaaaauuggcagugauucuuuguccuguuucugccacuacucaaaaauuuuaaaacaaauuacacaccuauaaacauacaauuuaaagaaaagagugaaagugaaaaucuaaggacccagcacaugguuaagaugagagcaugauggguucaauggaaagccuuuguguaccuuucuccuuugccuccguucccucuccaauagagucaaccacguuggagguuauagcacuuccuucuuuauguccccccaucucccaucugguaugguauucucuuuuacugcagauggacauuuuggcagacauauguaguugcuucucuuugguauuuaccuaggaguugaagugcugggucacaggguguauguauauuucacuuuaguagauacugcuguuguaggacuuucuccuuaguuuagcuaaagaugggguccuugucccaaggccaugaaaaauuaggcucgcagacaauuugaaaggugagaauaauggaacuuauugggaaaaaagggaaacagggacuccccacaaagccaggguccugcuagcaugcuuccugccuugcagauugaaucccagguaccacccaggaagaggaggggccaggcuccuccccacugugaauggugugaccgucuguggcuccccagugugcacuccucccagugugcaggccgguuggaguuucucuggggucuucuucccacuuggcugucucacugccaaacucccaaagugcuuauaccaguuuacucucccaucagugguguauguauuugcuucauuucuuugccaauacugauacugucuuauuaacuuuccucauucuaauguauacagucuuguguuauuugugguuuaauuucccugagaaccaauuauguugaguaccuuuucauagguuuaccagcuacagaaguccucuugugaagugccuuugcaagucuuuugucuuuuuaauuuuuugcaucuuuguauauucuagguauaaauccuuugauacauauaucacaaauaacuuccuagucuauggcaaauccuauguuggauaaacguacugcaaauaguuucccagucuguggcuagcuucugugucugugucuugcuuugucacuuucuuacugauaucuuuugaugaacagaaguacuuaguuuuaaaguaguuaaaguuuucuuuauguuuuauacuuuuuaugcauuuuaaagaaauuuuuuguuacuccaaggucauacagguuaaauaaauucuuacuccaagaacauucuuuuaaaguuuugcuuuuuuucauuuaaaugaaauccauaugaaagugaacuuuguuaucaaguaacauauacaauuucuuuuauuuuucugcacggagaccaaguugucccaucaccauuuauugaguggucuauccuuuccucacugauuacagugccaguuuugauaugucauguuuccauagaugaagaauauuuuggggcucucuaucuguaccuuccuuuuuaaaaaauauaaauaguggugauacuaugaacaauuuuguuuguauuauuguuuuuugcacuuaaaauuugucuuggagaucuuuucauuuuggcacauacggauacaccccuauuuuuuuuuccauuuuccuagaugugggguauccauuggacauauguaccguacugaauuuaauauagaaugucauaaauuacaagauguaacauuauuuuauacacugagauggagaaucaaacugcaacgcaguacuucccugaucauccugagugauucaugaguuaguuauacuagccucuuauuucuuugagguguacguuuucugagggaaucugccauuucuccugccaugaguugcauugcuuggcucgugauaggcauuuuuauuuuugcauguaauuuuguaacaaaugcuaacacugcuuuaucuucuuuuuguuuuuguuuauugagacggagucuugcucuguuucccaggcuggagugcaguggugcaaucucggcucacugcaaccucugucucccagguucaagcgauucuccugccucagccuccugaguagcugggauuacaggcaugugccaccaugcucggcuacuuuuuguauuuuuuguagagaugggguuucaccauguuggucaggcuugucuugaacuccugaccucaggugaucugccccacucagccucccaaagugcugggauuacaggugugagccaccagccagcuuuaucuuuuuaaagguuucuuccuauuguggguuucauuagagggcuugguuguugcuuugcaagaaaacauugacuugcuuuuguuuaauagucuuauaaauauuuguuucacuaacaucaaauacaugccaugcuccugcuuuugagcuuuucugugcaguaacuuuucuucucagugcuaaaucauaaguuuuuaaagacauuuaacauggcacacucaacaugugucaccaaugcccauagccacuggaaguaucaucagugucaacagcuaugacguuuggcaaugacagcuuugccauaacugcugcuuagccaauaacaauuguggaaugcugaguccagaucucaaacauguuaaagguaaaaaaaaaaaaaaaaaaaagauauuuucgagucuguaaaacaugguagcguauccggaauugguggguucuuggucucacugacuucaagaaugaagccauggacccucgcgguaaguguuacaguucuuaaaggugucgugucuggaguuuguuccuucugauguucagauguguucggaguuucuuccuucugguagguucguggucucguuggcucaggagugaagcugcggaccuuugcggugaguguugcagcucuuaaggcggcaugucuggaguuguucguuccuugcgguggguucguggucucgcuggcuucaggagugaagcugcagaccuucccagugaguguuacagcucauaaaggcaguguggacccaaagagugagcagcagcaagauuuacugcaaagagcgagagaacaaagcuuccacaguauggaaggggaccccagcagguugccacugcuggcucaggcagccugcuuuuauucucuuaucuggccccacccacauccugcugauugguccauuuuacagagagcugauuggucuguuuugucagggugcugauuggugcauuuacaaucccugagcuagacacaaaaguucuccaccuccccacuggauuagcuagauaaagaguguugauugauguauuuacaaacccugagcuagacacagagugcugacuggugcauuuacaaaccuugagcuagauacagagcgccgauugguguauuuacaaucucuuagccagacguaaagauucuccaaguccccacuagacucaggagcccagcuggcuucacccaguguaucuugcaccagggcugcagguggagcugccugccagucccgcgccgugcacccgcacuccucagcccucgggcuguugaugggaccaggcacuguggaguggggguggcacucgucagggagacucaggccgcacaggaucccacagcgguggcggggggcgggaggcucaggcauggcaggcugcaggucccgagcccugcccugcagggaggcagcuaaggccuggcgagaaaucuggcccggcgagaaaucuagcgcggcgccggugggccagcacugcugggggacccggugcacccuccgcagcugcuggccugggugcuaagccccucacugcccggggcuggcagggccagccggucgcuccgaauguggggccugccaagcccacucccacccggaacuccagcuggcccacaagcaccaugcgcagcccggguucccgcccaugccucucccuccacaccucccugcaaacugagggagccagcuccggccuuggccagcccagagaauggcucccacagugcagcggcaggcugaagggcuccucaagcgcggucagaaugggcgccgaggccgaggaggcaccgagagcgagugagggcugggagggcugccagcacugucaucucucaguagcauaauuuauauaaccagucucuuguugauuaaccauuauauuauugauacaacaaauauaagaacuguuacuaguaaauugaguaaagcaggaaaauuaaauuuggucucuuacugaucaaccauuauuagauuguugauaacaacgguuauaauguugaucaaccguuauauuguugauacaauuauauuugauguauuuaaccagauuuuauauauuauauucuauauuuuauaacauguauauguaucauauaacauacacauauacauacacacacacagccaauauaauuucacucucaguuucuuguuaaucaacuauuauauuguugauacaacaaauauaagaacuguuacuaguaaauugaauaaagcaggaaaauuacauuugggagccuuaaagauguagguuuucuucaagaaauuuauguuauaguuauauccccuguugcaugugaagacauacauucaaggauacuuacugcagcucacacaauuugcugauagguuggaugugggugugagagaagagaugcuguuuuccuuuugggcgauggcaacuggauaguaaucaguuacuaagauggagaagaaugagaaagaagucuuuuuuuguuuguuuguuggagugauauggguagaauaaagaguuaaaacagucaugcauguagguacuauagaugugaaagucuauuauucaggggagaguuuggaauuuaagggauagauucuugucuuuaagcauaaaaaugccuuugaaggugagaaacuagauuacaucuuuaaggggagaacuguagauagagaugaaaagaaggcaaggacuaaccccuggggcaggucagcauuuagaagaaagggaguuuguaaaaugcuaagcugucugagaaguagcagccugcaagguagaaagaaaaacaagagagguuuaguggacuggaaaccaagugaaccuggaaaccacaagcagcuguggcaaauccugccacagugagaugaggccugagaacugaguauuggauuugucaauguggaaggccuuggugaucuugauaagcauguguuaguaggguggugggguugcaguguuugggauuugagagagaaugagagaauggguagcugugaugcugaauauguaua[450 bp omitted]gccuagucaacugagccaaacuggauauaaccacaaggucaaaggcaggagccagugaggagaucuugguuuugaggucauuccuggugcgauaauaaccauccuguagcauuuucuugucacuuagagaaggcauuagcaaacuuuuuuuguaauggucuuaauaguaaauauuuuugacuuuguaggcuauauagcuacucaccucugcuuuuauaguacaaaagcagccauagacaauucauaaauaaaugaacauguuccaauaaaagcaauaaaaacaggcagcagucugaaguuugucgacuccugauuuggaaucauuccagaaagugaaauaaaagcauggcuucuuuuuuuuuuuugagacaagguccugcucugucacccaggcuggaguacaguggugucaucauagcucacuacagcuuugaccugcugggcucaaguaauccucccaccucagccuccugagugucuaggauuacaggcaugugacaucacaccuggcugauuuuuaaauuuuuuguauugauggggucuugcuauguugccaaggcucaccucaaacuccuggucucaagugauucuccugccccaggauucccaaagugcuggaauuaaaggugggggccacugugcccagccaaagcauggccuuucuaagggugacucacuguagcaccuccugaguacuuuccuaucaaguauccuggaccacuuuuuaaauaauucauucuaaaauccauauuuaggauugauuccaaauuugccaaccuguauuucccaaauaacuggcaugauaauucuugucuuuuucccaaaugcucauuuuccacucuucaaacguugaguguugacugaaguucuguggucauguuuacagucauuuuuaugcucuuuguauuguacauauggaauguauuuaccauuucuguuagcaaugauuucuugcaaaaacaauaacacuugcuaguuuugcgugcuuaaaaauaucgagcccuggcgcucucuacauauuaucuaauguaauccuuauauuaacccugugaguagucauuaucacuucuuuuacacaggaggaaguuagagaagaguguuaaguguucuuuuagucuuuuccacuuugucuuuaguuuucucuuagcuguucuuuuaaauucuaaggucauucuuaucuaaaaacuuaaaagaguugaucagccuuuuuaucaaguguuaaauuuauaccaucuuuuuucuuugaacagggcuggcaaauaaaccuggauuuaucccuuagcccuguuacagcaagucucagaaaauuuggacuucagcuuccccagugauacauuuucaaaugccuauguauggauugcccauuaguuuauuggcuagaacuaaaggaaaucaggcaagagacaaaggacauuuucucuagggugucagucaaugcaaaauguuaggacuagcaucagauuuuuuuuuuuuuacaaaugaaaauaauugaagugugguagaaguuccucuaguucuggcaguccuaaauauuguuaacugaagaaugauggggcucauaaauuuggaaaggagagagaggggaaaagagaacgggaauuuaugcugagcaggguggcuaaguauauauauucaacaggcuauaggaggagcuauuaguauucacgaagggguggcacacacauacauaguaggcuaacguguaugcagcaugcaucacaagucacuuugggguggagccuuaacauuuaauguauuacaguuagggccuauacaucaaaaggugaagcagaggacacgaaagcccucuguguucagccucuguagacuggccagaaccacucuguggucagaggucucuuaucaggaaagaauucuuguuguuguguugaaacugcaaaagggaggggcagugucaggcaggugguugauaccagucuuucagaagcacugguuucuguuuaacuuuuagagaagaaagcuuaauuggaguguuacuggaaagggauaccagucuagaccacaagagaggauucuuggaucucacacaagaaagaauucagggugaguccacagaguaagaucaaaucaaguuuauuagagaaguagagaaagaaaagaauggcugcuccauaagcagagcagcacugaaggcuucugguuggcuauuuuuaugguuauuucuugauuauaugcuaagcaagggguggauuauucaugaauuuuccuggaaagggguggggaauucccagaacugaggguuucucuuucuuuuagaccauauaggguaaguucuggauguugccauggcauuuguaaacugccauggcacuggugggaaugucuuuuagcaugcuaaugcauuauaaauagccuaagauaagcugugaggaugaccagaggucaauuuccucaccaucuuaguuuuggcuggcuucuuuacugcuuccuguuuuuucaguggguucuuugugaccuguaucugucuuguaauguccuaucucauccuguaacuaagaaugccugaccucuuaggaauggagcacagguggucucagcucauuuuaucuauccccuauucaagauggaguugcucugguuuaaauaguucugacauauuuuccccaauacccccaaagggacccuuaaucccaaaauuugcagacagaugaagauccaucuucuguagcuucuucuggcugaauacaggugaugauauuuuugcguaacuauucaggguagagaggagcucagugagaaagcaucaguauggugaaggccauuccuaacucccgaguucucacaaaaggugauaucuggaagauuaauaaguguucaauuuaagaaaacguugaguagucuuauccugcauugcuacacaaagaguaccacagcaauauauucuacaacaguaaagcaaaauaaguauaauuaucccaacuaaacuaaauaacaagccuuuccaugaacuaggcaguuguuggaaccaagcuuauaugggguugcuagccaauuccaacacauguucagaauuaaaauacugauccagauauuuauguuacccuucuguuucuucugagcagcagcuagagaucacugguugguucauaggaacaaacagggucaaucuaaauggcagaaaaaacucgaaacaaugaaugggacuagaguugaauaacaaguauaccauaguuucugaaacauaauuuuucucucuccagucucccauuucuauugaaaacaaaucaugguaggacugauuuguuugcacaguaagcuuuagucuuauuaugcuuggccugguuauuuguauaaagcauagcaauaauaauuauuugccacguaggcuuuuuaaaaauugacuuugauguaacuuuguuccauaagaaaucucagauuagacuuucuaaagccuugagcugagacacagauuuaucugugccugcaaauacuuguaugaguugugugaauucuccuuuugagaucccaagauaacuggagcuccuaggccugucagaaagugacauucuuuacuuaccacaggucaggaacccuguaaaggaauugaauagacaagguaugaggccagcuuuucccagaggcuuucaucaguucuguaagucaacuuugauuccuuaaagcaaucuguuuauauuugaaagaaugccauuccagucaaagcccugguaaaacaggcagugucucuaauuguguccuguuacaaaggaaaacagauuuuuauugcacauaugcaaauuacuaugcugccauaaguuaagaauacucacaaauaguuuucaaauucuugagaaaucagguagaaagaaauaugcuccaaaguuuucucauaggaguauaauuuacucaauuuuuaacaacuguaaauagcucaaaaaaaaagguuucuugacucugaaaaaugaaacaaaggaucagcaacauuuuaagcaaaaagucacuagaagguuauuuuguucuuuuauuaguuuaguccaugcuguuaauuccuguuugcucaauauuuaugaacauauugguuucccaagggagacucuugaaaguuuuuuuccucucuaucuuaauggcacacuuuacaaaauuuuucagaaaccugcauuuaagagcccucuaucugauuauaaaccaucuuuuaaagaggaucaaaacaagacaacaauuuucuguggauaacauaaagucuuaggaaagccgugguuaaagacacaauugacuagaaauuuugguuacuucuguggcauacaacaauuuuacauaacaguuauaauuauuacugauaacauaaacuaagucauaucagaauuuaggaguuucccauaauuuuggagcacauaccaauaacauauuuauacaaauacaacucaaagaaagcuaaacaccauuucauauuugacagugcuuccuguaugauuuuaauauaccaaguaagccaaauaugucauuuuuggacuuaaggggaccucauaucuaaaguauugaccagaucaggaaaaggcauaauauagaauuugauuuuggaaaguuugucaaauaucaaagauuuaaaacacuugauauuauaaaaucgaaucccaggucacuguaaagucauuuauuuagccaaaaugauaauacaaagauuuuccaaaagcaaaauccuuuuuuuuuuuuuuuuuuuuugagacgagucuggcucugucgcccagcuggaguucaguggcgccaucucggcucacugcaagcuccgucucccggguucacaccauucuccugccucagccuccgggguagcugggacuacaggcacccgccacuacgcuuggcuaauuuuuuuguguuuuuaguagagacgggguuucaccauguuagccaggauggucuccaucuucugaccucgugauccacccgccucagccucccaaagugcugguauuacaggcgugagccacugcgcccagcaagcaaaauccuuuacucauugauagagggaagacagcuuuccaaacaaugucucacuuuuucuucuuuauuuuguuguuuauucaaaaggcaaacaaaaaucuuccaugaucuuuuaauauuacaugaaaauuuuguucaagagagaaagccaaauuucaucuuugcauuaaugaaugucaaauccaauucuuaagaaaaccuuguagacaaauuauucaaucuuaaucaauuuuaccaugagauaagauucucauaaaccuuuuguaguccuuuacaauuuuuuuuuguuguuguuaaagagcagauuaaugcucuaagaaaacccuguugugcuuuuauuccaauguucuauuuauggaaaaacugaauaauacccuuuaacuuuagcuaauauuuuaacacacagaauuucuuuuacaagauuaauuuucacugaccucccacaacuuacucaaaccuuuagcuuuauccuauguaacuuaaaacagucuuuuaacucuguaaacuaggcaauaagaccacauucccaugccuucuuauaaucuuuuaccaaaaacacauucuauuuuccuuacacgccuugcagguaacacuguuucucugguagccucaauuacaugugcuacaauguuaacucuuagcaacuuuuauauuuggugaaaagucugauaaauaagugguuuuaauuauguaccagguguggagccuaggacgccagacagaagugcagauaaggucugagucuuuccagcauagcuagggggcauggccaacuccacauguccccaggcccuaccuagaaucuaauggcuccaaagcaggugaguugaacaauuaucaaguuaaagaagcaguuuauggcauugaagcauucagcaaaucuaauuuaaucugaccuaauuuagaccagaugucuaaauuuugaagacauuuuuauuuuaccaauauauuugauucucuuuauuucccaaagauuauuaaagucccaugaauuaaaagguguuaaaguuuuuauuuuucugacaaaauauucaauuuaagugcuuauuuuucaagccaauuaauuagagcucuuuucuaugcauaucacacauacaacacacaaaaauacacagacagaagacccaguagcuguuaauuuuuucauuugccagcuuuuaagaaucuuaauuggauuacuggcuucaggguggagcaacguguggggacagagccgggaaaacaugcaguuucuggggccuaauaaacaggugcaguuagaaggcaaaacagauuccccaaaauuacagaucucauuuuuauauuggauucuggaucccaaaaagagggaaucagcccauccccucugggaguuuuggaagguguagaagaauguuuccauaccuucuagguggccaagagcaugcuucucugauccaaacgugcacagagugggguauuccccuauaacugcuauuagccuucccuuaaagcauauuuccugccuaguuauuacacaccaagguuaaaagcucucccauaaugcaaaguaauuucugauaccccuacaaguaaaaaacauuagguaacacaaugcaaaucagagcaaugccuuggauuuugagagggauuugcuugccuucaauuccugggguuccaugaggaaaacagauuuuucccaaaauggagccuguggugcucccucaguuuuuucuaaggaagcccaggcuguuagaaaugaucuuagguccucucaaugugggcaucaagaguggcaagaaaacaaaaugagaaaaacaauucaguugacugagaagaaaaaacuuuuaucuagaaaaaaaucaauauaaaaccugccagauagauagauagauagauaaucuuggacaucacuuuuaauuaagcugacuuuuaaccaaaucucuuauuaucagacucuagccaggacaaacagcuaauauuucuggcuuuugaacuuuaccaaaaguaaccucccaggugaaaccaauaagccuuaacuaagguuaugauuuaaccacaggugugggagguauuuucaaagaggugguaagcaguuuuuacaagaucuggaaccuccaaacauagcucagagaaaggaagauucaagacagggagucagaaguuguucaugaggggaagauaauuaauaaauggcaaaggucacauagauaucaaaccagaaaggacucauucccgaagcuaggaauugaauccaggccaccacugugaaauagcaaagccuuaguuacugagcugcaguacugcacagucuccauugcuccuccgagaaggagccuagagcagccaauuuugagcuugcaaaggcuuuuaacugcucaagauaauuuuuaggacuaauugacaggaaccccaaaauucacacccucuggauggcagagaucaggagaaaguacccccacgugguuacaaggucaagcuuucaaggacauaaaacaagacgagagggaaacuucauccaguuuuuguuucagggaccugcagaaaaguuuguaacugaccaguuugcgggccagcuugaagaccagauuuguaggauuccuaggccugcauucuauccuguggcuagcuagggcugccauaauagaauauuacagacuaggcagcuucaaccacagguguuuauuuucucacugcuccaaagucuagaaguccaagaugagggugccuguaaagcugauuucugguaagagcucuccuggcuuguagauggccaccuucucccuauguccucucugggccuuuccucuaucuggccaagggagcuaucucuggugucuuuuccucuucuuauaaggacagcaggccuauggauuaaggccucacuuucaugucuucauuuaaguuuaauuaccucuuuaaaggcccgauguccaaauacagucacaccguggguuaggauuucaacauaggaauuuuagggacacaauucaacccauaauaggagggcauuggaaggagaguguuccaggcagaggaaguagugcaguagagcauauggaaguaggaaagugaggagcaauggaagggguucaguaugguuugagcgugggguguguagagggugaaggcuauuucacccagugcaguaagcucuaucauccacaccgggguuuuacagugggagaaaggaggguguuuauuugcaggucaagaagcaaacagaaucagggagcucaugcuuaagaccugaacuccacaguggcuuacauguaaggugcagagguuacaggcaaaggcaucaaucaacacauggaagccauauauugguuuggccuaaaaaggugggauauccugaaguaggggcuuacagguuacagguaaauccaaauauuuucugauuugcacauuguuuaaggaaggggauauuugucuaaagaugggaucagcaggccaggugugguggcucaugcuuguaaccucagcacuuugaaaggcugaagaaggaggguaacuugaggccaggauuucaagaccagccuagucaacauggcaagacucugucucuaaaaaaaauaaaaaagaaaaaaagaaaaagaaaaaaaauaaagauggaaucagcagaaaggaauguuaggucuggcccaugggcggacuuccuccagacuucucagaaagaaauuuaagacaaagaauggugccaggcgugguaguucacgccuguaaucccagcacuuugggaggcugaggaggguggaucacuugaggucagggauuugagaccagccuggccaacauggugaaaccccaucucuacuaaaaauacaaaaacuagccgggugugguggugcacgccuguaaucccagcuccucaggaggcugaggcaggagaaucgcuugaaccugggagguggagguugcagugagccaagauugcgccacugcacuccacccugggcaagagagcgagacuugagacuccaucuaaaaaaacaaaauggaaaacaaagaauggugauaauucaguccucaauuccuuuucuuuuuuuuuucuuucuuuuuuuuuuuuuuuaacugcuccugcggagcagggcuaccucauagccaguauguccagaguugucucaguucccucguuaucuguggucuggaggauccauaugauggugauccagguucugaaaaacaacucuggaacaucuguuaagauguuaucuuuaguuucuauaggaaaccaaacaucuucugacucugaccuccuuggugauuauuuuaagcuacuguuucccuuuuugcuuaucgaguugcucauuuacuucucaaggcuagcaggaugacuggacuuucucuugaaggaacucaagcuguuccuuuauuuuuaugcucaggggcggggggcacucagcaggucccuaagagguauccccgcugugucucacuaugggugaaggcucagcgggaagaaagcuagauaccaguuggaacucucuuaaaguaaggagaucuuggguacuuuauuaauauuuuuuucaagcuuugguaaaguaugaaauaacucuggauuaagaggagaagaacuagaacuuaauaaccaugacauuugggcaaauuguuugaagccucaguuuccucaaccuaaaaauaggaauuauaacuuuuugaauuguucuguuguaugagauaaugacagugaaauauuuuggagccaaaaagcaaugcauacuauuggggguuauuauuauuuuuugaucuuucagcaagccagcuauaguagcuuuuccuauauaaacacaguaugaauucagugcccucgcuuuccugacccucacagcauucaagcccuguauggaccgcugagcucucccuugaagcaccccuuaguccaguauucuuuacuauuuuccccuuuaacaauuuaaacuucuuucaaaacaacuggcaguaguuuuuuaaaaaagaaaacaggcuacucuucaaauuaaaaaaaaaauugucuugcuuuaggaaaaauguucuucugucuuuuccaauuaucuuauuucuucugccucucaucugccuugccuaggcagaauuauucucaagccugcacaugcugcugugccucucuggcuucuaggccaaaacauaggcuaauaguacucuucucagcucacugagcucuuuccugccgucauucaaaucaccucugaaauccugccuuuugauaaaguaauuucugacugaucagaggaaagugaugauuuucucugugacaugucuuuuuauuuuccaucacacucagugucuuguccuucuaugcaacauauccauguauuuaaaaacccuuguauauguauuugccauguauuugugagguauagcucgugaaguaaaaaaagucuuuauuuuuuuaaacacaucaucauuucagcuucaaagucaauguggucucuugagaaguuaaauaugcugcauuugaaauuuuauguuucucauuuuucauguuuuuuuuuaaagccccuuuuaauuccucauguauuugaauauuccaggaagcuaguagaguaaaaagccaaaguguuaaaguguuuauaaggaaugugacucaucgaaauugacucacacaauucaucagcuauugucauccauauguucucauuauuuauguggcuuuugcuuuauuuaaucagaugacugaacuuaucaucgugggauuuugcuuguaguuguuuaauauuauauaauaaaauacucuugugugaaacaaguuaauugacuuuuuuuaauuaaaaaaaauuuaugugagagucaggaguuacaugugcaaguuuguuacauggguauauguugugauacaaagauuuuagcuucuaaggaucucauugcccaaguagugaacguaguacacuauagguaguauuucuaaacacuuuuccccucccccucuuuuggaaucccuaguguuuauuguucccaucuuugugucuauauguaccuaaugcuuagcucucacuuauaagugcggacgugugauauuuugguuuucuguuucuguguuaauucauuuaggauagagagacuccagcugcagcuguguugcuacaaaugacaugaguucauucuuuuuuauggcugcauaguauuccaugguuuauauguaucacauuuucuuuauucaguccaccauugauggucaccuggguugauuccaugucuuuguuguuguggacagggcugugauaaacauaugagugcaguuaccuuuuuuuguauaacaguucauaauaaaauacucuuaacaguagcacagaauuuagauugcuuuucaggcuagaagggauaauugaaacauagaaaaaaauaaugacuccuaagcauagaaacagacccaaucauaaagcucucuuccucucuuucugccuaguguuagaucuuauucauugucuuaaagcacugugaccauuuucagugaaaucacaguuuuauucaugaaaagacaaugaauugguguaaguaaucauuugaggaugaaggugacuagucugugaucaacaccaguacuugaaguacuuguaaaacaugaauugaccuugguuaaauugcagaaaauaaaguauuaguauacauaaacacauuuucucucagcauugaaaaguuauagucuauaauuuaccugcuugcuaagaauaaaaauauuacuuagagguuuaucaagaccuuuuuucuacaaauggauuuaauguacagaauuauuccauuuucuaucugugcucuguauacuaccaccuaguggaauaaaaugcaaauuuaccugucaaaaucaggagaagaaaaugaaccaggggaaauuuauuucaggaaaaaauuuucauaacacguuauuguuacuucuuuuaguauaauguaguuugcauaaaauacauuaguuuggagugaaaaaagucccagccauuuuugugauagcuauuaaaaugcuauuaguuuguccacaaauaagcuauucuauucagaaacuuagaagcuagguaaauuauugagaugaugccagcauauuauaucucuaaauuauguuaagaagcuucucuaaauuccucaucacuaggguguauuaguccauuuucacacugcuauaaagaacuaccugagacuggguaauuuaugaagaaaagagguuuaauugacucacaguucugcaggcuuaacaggaagcaugacugggagaccucaggaaacauacaguggaagaaggugaaagggaagcaaggaccuucucauggcagcaggagagggagagcacaggggaagugccacacacuuuuaaaccaucagaucucaggagaacucacucacucucacaagcacagcagggaggaaauucacccccacgauccuaucaucucacacugggccccuccuccaauuugacaugagauaugggcagggacacaaauccaaaccguaucauaggauuuguuaaaaaaaucuaacauguucugcuucaaggcacccaugaaaugaaggugucauuucuuaacugagagguuaaauaaaagugcagagauaagaugguuaaguuuuaucguagcugggaagaaaagcggguguguguauuaugcuuagguuuuuccucccaaacaaugaaacccaaaaaggcaaaugaagcuuuaaggcgcuuuauccuuuacugguaggaugguccuccuuuaaucuucagucucuguuaaagaacaaacacaagcuaacaaucaaaaccuguuguugcuugcugacggauuucucuaacauagucuuccaucaaccaucauagguuuguuguggccacccaggcccuuuggucgucauguucccauggaaugcuaaugaaauuaccuucccauuuccuaaggugacaugccuuucagauggcauuggugugugcuuguguaaacacauuuuuuugugcucaugaauauuuuaccugccugauuuuggugaucugaguguugagcagugggugagggaugguggggcaauggguaguaaggggaaguuuaauugaaguucagauaaaaauaucccuccagaaacauuacaaagccacaaaaucagcugaaguugagucuucuauuguaaagauucucuuucuucuccugacagauccccauuccuauccagguagaccaggcucuagugaagauuggacacaagugguuuauaucccgaagcucuuaaccuaagaguccugccuuguuuuuuuacuucauguggucuuauauugcugaggauagcccagugaucauuucuaccuuaauauguagccuucaaaacguugggucucucaguuuucuuccuuaauaaacaaugaacccuaauuauuuauaacugcucuugugauggaggaauuggcaugauuuugcauugugggcuucuggcuuuacaguguuugugggaaagauggucuucuaucuuuguuauuuauaagucauucauucccuguuuuuuugaagauauuguuaaauaaaaaaacuucagcugaauuaaauuuaaaaguuuuuaauugagcaaagaaccauucucaauucgggcagccuucccauccagaguagucccugugacuucagugcagccacaugguggaagaggauuuauggacagaggaaggaaagugacauacaggaaacagaaaagagauucagaaacagcugaauugguuauaacucagcguuugccuuauuugaacaugguuugaacaguuggccacguuugauuggccaaaacucaguaauuggcacaagaguaggcuaccaucuguuuauaauguccacuuagguuauaguucaugaugugcaaagaaaccuuuaagcugagcuuaaaauguaaugaggcagcuguaggcuaaacuugauuuaacaguacuuaucccucuguugaaauugcacucuugcuaccugcuaguugaugugggcaggugugcuaaugacacauucgccugcaccuaccaccugcugaagacccugccauguccugaagcagucacuuaggcuaugaaacagaaggaugaguuagagaaguaaauauuauauuuuaccccccaaagccuaaaaccaugucuagguucuccccuuucucaauucccaaucaugcaaccuugaaagguguuauauagauaguuguuagaaauaugucuguccuccaaaacccuacuaacacgcaaaaauggacaaaucuagcuuuuuugcuaaaauccuaacaacucagaaagcaaagcaaaaugaaauguauguacuccauucucaggauuuccuucuuaaaaaccacuaggcuuuguguaacucaauuuuaaaaguaugguaauagcuccuguaauucgauggcuucuucugggagacagauauaaaucuauucuagacuuuaagacugguguccacauuuuaaguuacaguuguauguacuucuacuuuguugcagccuucucuuggagucaagaagccuaccaaagcccugcucuuuguacucuugagcccagugggaccuuauuuuucaaguggaaccuuuaauccagugucccugugggccaaucccaaguauguaagagccuggaaagguggaacuggggacugcaagaugggaggguaaguaaaucugugucucugucuaaaggaaagacaccuucaugaccauuuaguuagugccauuucacuucaguaugaacacauauaauacuuuucaaacuuuaaugcucauuguguuucaugguuaauuuucaguuuaaucuuucagcaagccagcuguaguagcuuuuccuauauaaacgcaguaugaauucagugcccucgcuuuuagaugugcuaguuuaaaggauagcccauggcccuuuguaagggagaaacacuggauaugauaucuagggaagaacugaaguaagaaacuacaacaagcaucacaucggugcuuuggauaaacuuccccugggcgcuggucucuggcugcaggcugacggcuggcauuaaaaagcaucugguccugggacccaggcucucaguuggcuccagggagucaugucuggggaaggugcccgcuucacugaagugcugucuucauugccacagauuguggccacaccugcugccaacuggcugcgggacagcccugcuuuggcucugucaggccagucucauaggccauauguagcuggcaggaaauaaaagagcauuugaaaaguguuggacgauuucagggguggacuuggccaugaguugggaaugccccuaugggugaacgagaauaacugguuuaagcagcauggguucuugcuuugcauguaucaaauggugcuguuugcauacucagggcagcagcuguccuagaaggugacuccauggcagucuugugggcccugguaggacauuuagguccaggaggcaggggagagucacaugacgugcugcugggguauuagaggcaaugaccacuggcuuugaccccucuguagucuugcuguauuuccuuuuucuuuucucuccucaccuacccaaauuaaaaaagaacgguuauaaaagucauccccacuggcaacuuuagcaacugcauucccucaauggguagagaaauccaaauggagugcauuaaaacuaggaagucuauucuccuucuggcuuagagcacaccuuccuguguccuaggcuagccagguugaaaacuccuuuuuuugacucuugauuucuuuuuuuacugguucaaacuucuucgcagagcaugugccuauguaccacugcauaccauauauauaccauauauagagaguaaauaaacagucuugaugaaaaguaauaaggaaaaaguuucccuguuuaaaauauugcuuucuagcuccccgaccuguuuaggaaaaagauaaccuggggacacagaaauugcagggcaaucuuuauuaaccgguauuugggcagguuguaauuuauuuuguaaacaaugauuuaaugcacuauugcagaauacaugaucacuguaggccaguuaaaaauuaauguuuucaguaccacacagagugaacccuaauguaaacuguggacuuguggaccacacuaaugcaagaugauaauaagaagaaaaacugagaggguguucgggaagggguauaauaggggaauucuguuaccuuuugcucaauuucucugugaaucuaaaaguacucuaaaauaauaaaaucuauuauaaaaauauuugauucauuaggcucagguggacuaugauccauggaaauugacuugaaaucucuuaggaaaggaagagaccggagaagaaaguauugaacucauaaauuaaaaauggcaagagggaaggugguaaccaaaaggaugggcauuuaaccuauaugccuaucacuuccaaaaaguucuagggccgucuccuccuaugcuucugaccuggagagguacaaggggaacaaaauauuccgcauuuaauauuauccuguugaguuggcaaagacauuuggagucaacuuuaguuuuguguauuauuacaucuguaaaccuaauuaagucaacaguuacccuugacaccuguagucaacugguauuauuaaauaacuauugagucucauaaagucaagaacuuucugcuuucuaucuaagugaaucuagggcagagacugagcaucaggauucuuuagcaugcagccaagcuugagaagcacugagcuagagaaaggucuugcacuguagaaacagcuuuaguuccaggugauuccuugguuaauuugggaggaauaaggcuuucugucacucucucucucuuucucucuuuuucucucucucuugcacaugcacacgugcacacacacacacaaauuaucucucuuaguuuuuucuuuuuuccuugcauucugauucugcauuuaagaguacaagcuuugaagucagaaagaccuggcuuaaaaaccuaacugucauaauggugcguaaaugucguuauagauuuguccaaacccauagaauguacaccaggaaugaacacuaaugaaaacucuagacuucaggugauaaugguaugucaaugugguucauuaauuucagcaaauguaccacucuggugugaggcauugguaaugguagaaacuauucauuuggauggggagaaagggauaugggaaaucuuuguacuugccuuucaguuuuggugggaaccuaaaacugcucugaaaaaaaccugaagucuuuaaaaacaaaccaaccuaauugccuugggcauguuacuuaacugcucuauguaucaguuuccucauuuuuaaaguugaggcaauaauaccuugcacagauuaagugagauaauagaaagugccuaggauaguacuuggcauauagaaagcucucagcaaaugcaguaugauaaccuaaugguuaaaagcuuggguuuaggagucaaaugucugggaguuacacacuuaacuaucugugagaucuucuacaacugaauccucucuccaagucuuccaaugaacaauaaagucuaggguuguuuuuagaugacucaaugaaauaauguaguuaaguacuuagcacccagucuggcagguauggguugcauaucucuuaucugaaaugcuugggaccagauguguuuuggauuucaaauuuuggaguauuucucuuugggcaucccuaauccaaaaaauucgaaauccaaauugagcaucauguuggcaccgaaaaaguuuuagauuuuagagcauuucaaaguuuuaaauuagggauccucaaccuguaguaaacucucacagucacugauguugugagguuuucucacuuucucauuucauuuccuggacucucuuuaucuuagaagaaaucaguuaaauuuuacauaauagaauuuauucuuuuggagggauguauuuaauaugucuauucucccagauaaccuauuuaaaaccauauugaaauguuucuaugucaacagcuuucuuacuuuuucauuuuucuguuuccuccaagaacauguuucucuuaugaauauuggcagcacaugggcgggaacccaacuauauuaccaugguaucaguuauccuguggacauuaauaauacagcuuacaccugugagagaacucugggaaaauuaaaacuuguuugggggaauaaagaccaucuacagaauauaauaauacaucaaucaaucaauuaaaacuuaaacauaaaaaacccuuuucuuuucagugcauugaaauagucacugucuuuaauccucuuuccuugcucagugcuucaugaagcugaggagccaugguuuuaauucagcuacacuuucagaaauguguaugcauuuguauuuagaagcuucuuugaaaggcuaaauauucauccuguaagaauucucuauguguuuuuuaauacagucuaaagggcauuuuguauaugaaaaaauaauuuauuuucagguaggguaaaacuucacugcuucacuacuucguaguugugucuacgaaugagaaaaaauucaaauaaaauaguuauuauuauuaguuuuuagagaugcagucuugcuguguugcccaggcuggucugggacuucuggccucaagccauccuccugccucgguguccugagucacugggauuacaggcaugagccaccacaccccacugaaauaguuauuuuuuaaaaaacuuaauuucauuaggauguaacagucucauguaacucauccuuuggcuuuuauuguuauuauuuauuuuuuccaagcaacccaaugagauauauaaagcagauauuuuuaucugccagauaauuaaaugagggaaaaauaaggacuaacuugcuuaaguucacauauaccaaauaguggaaaugcaagagcuguccucaggucuguuaacaacaaaccuguggucuuucuaccagacguccccugcaaucugguuuauacucauuauuaaaaagcauuuguaauuuaacucaguuaucuauuuacuaucaguuaugaauaaggauuauuugacuuuuuauggucauuaaacaauagcuuccuaucuguugucuuugucuuuuuaauuuuuauuuauuuuauuguuuuuuuaauagcuuccuaucuguauaccagacuugcuucaucuccacauugaccaagaauuuauauuuugucaucuguauuuagaagcauauguuuuaagcgucuuuuaauggcucuuuuuuuuuuuuugcugggaggggacagucucgcucugucuccuaggcuggagugcaguggcaccaucucagcucacugcaaccuccgccucccuggugugaguggugcuccugccucagccucccgaguaggugggauuacaggcgugguccaccaaacccagcuaguuuuuuauauuuuugguagagacaggguuucaccauguuagccaggcuggucuggaacuccugaccucaaguaacuugcccaccucagccucccaaagugcugagauuacagguaugagccacugugccuggcccuuuuaaggacucuuuuuuuuuuuuuuuuuuuuuuugagacagucucacucugucgcucagacuggagugcaguggcgcgaucucggcucacugcaagcuccaccucccggguucacgccauucuccugccucagccucccgaguagcugggacuacaggcgccagccaccacgcccggauaauuuuuaguauuuuuaguagagacgagguuucaccguguuagccaggauggucucaaucuccugaccucaugauccggccgucucgccucccaaagugcugggauuacaggcgugagccaccgcgccuggcccuuuuaaggacucuuaacauuaccuuggugugagucaaccucaucgugcuccaauggcaaucaccauaguaugaugucuauuuuccacagcuuacuggaauauuucagcuauuagucaauauucuuucaguugcaagucagaaaaccaacuugaaauuauuauuuauuuauuuauuuauuuuuuugagacggaauuuugcucuuguugcccaggcuggagugccauggcacaaucucggcucacugcaaccuccgccucccgaguucaagcaauucuccugccucagccuccagaguagcugggauuacaggcaugggccaccacucccggcuaauuuuuuuguuauuuuuaguagagacgggguuucuccauguuggucaggauggucucaaacucccaaccucaggugaucugcccaccucagccucccaaagugcugggauuacaggcaugagccaccgugcccggccuggaaaugaucuuaagcagacaagggcuuaugaaacuaggaugcuaggggcuaaagcaauuauuuccaaguuucuuguguccuuugcacaucccccuuuuucuucccuucuuccucugccucuggucagagcuucuggcuccauguuggccuagggcucucccacuucagccgcuuucuucugugaaguguggugaucauggacacagccgaccccaguuuuacagcauaccaaguaagcaaccccagaagggagaaaaugccuguauuucagguuauagacauuaaaaugagugaaugcacccaaaaaaggaaucaugugacugucuuagguuauaugcccacccuuuaacucagcugcagcagggcaagaugcuauauugucaucaguugugguagggcaagaugcuauauuaucaguccaagcagaaugacauagcucuauagaaagacuauguuuuuauaagaguauggaauauagugcagaugaaaacaguagauauacacuaacauguggcucuaauguuuaauuuuuauuuuuuuugagacagagucucacugugucacccaggcuggagugcaguggugcuaucuuggcucacugcaacuuuugccucccgaguuaagaugauucuccucccucagccucccuagcagcugagauuauaggcacccgccaccacgcccagcuaauucuuguauuuucaguagagacaugguuucaccauguuggccgggcuggucucgaacuccugaccucagugauccgcccaucuuaggcuccuaaagugcuaggauuacagacauaagccaccgcgccuggccucaugcucaacuuuuauuuagacaacaguacaaauuguaauuuuacccagauguaaaagagucuaagagaccuaaauagauauuuugugguagauuacauuaauguaauguaauguaauguaggaguuuuacauuacuacauuuguaguuguuuuaguuguuuuucauuguuuguuucuguguauuucuggggauuucauggugcaacaggaggacuagaguuuauucccgaucccugacugucuuacggcaguacuucucagaccuacugaguuauacaaccagggguguagggaggcaagcagucaucacauuuauuugaggacucucauguuuugucuaaaauauucauccuuauuuuauaauauacuccauaauuuucccauauaaguuuagauaaaagaugauaccuuaaaaguauuauaacacuaaauugucauuccgggaaaaugugcuguguuccuuucauuuuaaauaaucugagaugaauggugcaggcugagaaaaauaggcuuuugaaauacuuuuuggucaacaucgagacuuuuaacauuuguccuaucuuuuaggggaauuuagacauugggcauuauguauuccuuggauacauuaaaagguguuagauaagagcgcucacacuugcugcucuucuauugcaacuugacagaaguuacuucucuaaaccuuaguuucucaucugaacaauggaaauaaugauagugucuaucucauaguauuggugugagauuuaaaugaaauaauucauguaaaauugcuugguguguggaaacauaguaacuuuuaacuguucucauuaacuuggcuauuuaccuguguucuucuaucauuacauuucaaguuaaaauuucaagguuucacguuguucucucuccaaugaaugcaguuaaaucacuuagauuuucuaaugaguuuuccuuuaauguuaugcaguugacuagagaguguauauauauuaagaacauaauaccuucacuauguccacaugugaauuaagagcuugaggcuaucagaggguagaagaugagggaguggggaugaaguauguuuguaaccuguguauuuucucuuucuuaaaggaauuacggcucaucucuuuuugcccaaugugaagcaguagauaaugggugucagcagguccuguggcucuauggagaggaccaucagaucacugaagugggaacuaugaaucuuuuucuuuacuggauaaaugaagauggagguaauccacucagauuucacugugugcauuucucagucauuuucaacaggaccagaaagacaagagcuagaaacuuaguacaagggaguaaguagcacaguuccaaaggcuaaguaaggacuacugugcuuuugcugcccaaauagacacaaguuucuuuuuuuucuuucuuucuuuuuuaaagagguggagucucacuaugucacccaggcugcagugcaauggugugaucucagcucacugcacccugguucaagcaauucuccugccucagccucccgaguagcugggauugcaggagccugccaccaugcccagcuaauuuuuguauuuuuuuuuuuaguagagauaggguuucaccauguuggucaggcuggucuugaacuccugaccucaggugauccaccggccuuggccucccaaagugcugggauuacaggugugagccacugcacccggccgaguuucgauuuaaagaagcucuagagguuuuuuguuuuucguuuuuuguuuuucuggcucuagauguacugauuauugagauacugagaugucacauuaagggauuuaaguuaccaugauuggaagauuugcuuccuuaucccuucugcaguuccccaacaauuuuccuaucugaacaccuugcauugagacacaggucucagaucaggucaauggucauucaccauauaccguauauaaaaugcuagaguaauaaaugcaguguacugauucuacuggaaggauuuuguguacucucuggcuguaauuguuuuaacaauuguugccuuuucuacauauuuugaaaauguaucacaaucucuccaaauuuacucuagaacucaaucugauuaaagagcaccauuuuaaaagauaaaucaauguaucuugggauuguaacuagauccugguucauucaagacaauuucauauauccacuauagauaucaauauuucucuauuaucuuuaauauccugaguacucauuacuuuucuuugcuguuuuuuuuuauuaguuggcagagaccauagggguucagugaaguguuggcaacguguaugauauugaauuaaauggccaacggugggagaaaaacaggcauuuauuucuauuagaauuuugauaaucauaccaaauuuagaagcguauuuuuagacuuguuuacauucuuagguuguucauuucacaguaguaauuauagagacuagaaauauaaaugauguuuccaaauacuuaugaagucucaguguuaguaguuucaauuaaauuuuuuaaaaugcaguuuauauuugaaaguagcuacaguagccucucuugcucuaauguuauuuggcuacaaaaagaggaaaaugguaauuuagauguggcugaauucagagcuaaguacuaauuuuaguguuaguugcagagacuaacaagaugagucuuauacugcagucagagguagaauaaacagaagauauggugaguaagccuuguccugggcuuggccauugguaguccuuggcauaugaaaaaccagauacagaucauucucauccuuccauuccugcuguuuguacuuggcacuguuugaaaauaaaauuuauacaggaauauuuaugauuuauaaauuugaguuacuguaugugacauauaacaaaagcuacacuuggaagauuguagccaguguugaccucugcacuuagaagauaauaggccgauucaacccuucuucccaucugcccacucuuacccccaccccaaacuccaccaaaaaaccacacagcucaaaacaaaaacaguuacaucauucagaggugguaccaucauuauuuuuauggaugggagaugucagaauuuaaguacacucugaaucagagcuacaugauuuaaccagaaacaccagaaacuguccugguggaaaauuguucuuuauccaaacaauaaucaugaaacauuuccaccauggcuuuuaaaggucagaauagaaaugagugaguuugucuucugccucuugcaaaauauacaagaccuuaagacuguuaguuacuauucagauuaugguugccugggauaacuuuaguuuuaauauacuccuucacuuuggggauguucaucuaacagaacaaauaaaauucagaauaaggagaaaggaaauagaauauauauuugaaguaaauagaauguuaggaaaaaccuuugggcuaaaaaaaaagacaugcaauucugaaguaacuuugauuuauaucauaugauuuuaagaaaauacaaugaacaaacgaguugaaaaucagcacaauacugauuuucacaaacguuaccgauaggagguauaaacagaguucuuucgguaauagccugccgucuuuucaugagcgcccacacacacugcuccuguugguugagauggcuggugcaggaagguggauggggugguggauaguguguguucaaagcacagugcugugcacagucacuauguguggcacucagcuuguaacucaugggaguuuugauuucaguaacagcacccaugguggcaagaucacacaucaucacucuguugaugaguaauuuaacccauacgcuugcuauucaccauuugaacaaagcauuguaucauauccuggacccuggagauacccugaaaaauaagacccaggccuugugguugaguucacagucacuuugggaaaacaaccacagcagugaaucucgguauugcucaggccacaucaugagucuucucggacacgucaggcguguauacggacucgacuuggagcacucuuccucagaugucuguaccgcuugcucuuugacauccuccaaaucuuugcuuacaaaucccauucucagucuggcuuuccuugagcucuuaaucaaaaucauaaacuccauuucccauuucuccucagcauuccagcauucuccauugcuuuuccuucuuuguuucccccuguguagucuaacauacuaucaacacaauaaauguuuaccugugucuauuagaaaguaagcagggagauaugucaguuuuguucacugcuguauucauagagcuuaaaacgguaaacagcacucaauauguauuuguagaauaaauggcuaauugugcugaugguguuuagggcacuuaugcagaccuacauuccugguuuccauuaguguuugacuuugggaagucacagaugaauccugcuguuauugcuucuaaauuccucaucuccuaaaaaugacuucuuugucaaaaacaagcugcauuuguagguucuguuuuccucauguugggcaaucuggagugauuucuggcucuuguaaguauguuugugguugcagaggaaaaugaauauuucucacccaaauguugucaugucaucaucucugucuggcaaccagagaagcagauguucuguuccuugaccucaggcuagugguuacaguucuggguguuaaacauguuucacaaaacagcacuugcacaugcggggcugcuguuuucauuuaacuucauguagucucagggcucagcaagcuuuaggaaagguccgguuugggggcacuggaaguguguguguguguguacauauauauacacacacaaauagauccauacauuuauguaucuaguuggcuagcuauugcaaaacacauguuuauuuugagaucaucaacacuucuaaacaugacaaagaguagcccuaagaacauugccaagaacaaauuuucuccuuuccagaaagcaauuuucagcagaugauuuucagaaacaaaauucaaaaaagccauacugcuguauccuagcaaagauaacuuauucguuuauuuuuuacucaaaaacauuuauuauauacacucugggcuaggcacaaugcccaguuuugaggauagaaggaugaagauagaguuugguauuccagauagagcuugauuguugggcaugucugauguaaccccaguggagugggcgagccuagaaccaccauguauugagggagagggugguggccucagugucaggacucacuagauucagacuccugggugucagaaguggggaggaaagggagaugcugagugccagaggguacuguaaggagagcuugugcagcugauggaucaugcaugaugccugugaacaauuguccuacuagaccucacaguaguuagggaugucugcagucaucucacaguagagcaguagcucagcuuuggaguuuuguuucuugaaugucuucuuuuuuaaccguacacgugcuugagcucacucugauaagcccauuacauuugaaucucagagagcaaaggcagcaucuccauacuuguugcugaugcuccaccagguuugaaaaucacuaaagauagacucuuaggcugggugcgguggcucacaucuguaaucucagcacuuugggaggccgaagugggcagaucaucugagcucaggaguucgagaccagccugaccaacauggugaaaccccgucucuacuaaaaauacaaaaauuagccaggcgugguggcgcguaccuguaaucccagcuacucaggaggcugaggcaggagaaucacuugacccugggaggcagagggugcagugagcugagauggugccacugcacuccagccuggguaaccuaaaaaaaaaaaaaaaaaaaaaaaauuagacuuuccaagggcagcguggaagcagugaccagccugaguaggcacgcacacuucuuggggauagccuccuccauagcauucuuagaagguuugguaaugaccaguuuuucugaguaagacccuaucuacauuauucuaauuaguaaccaccuuucaucugcuaagguaaauuuucacuucagaauauuccucuuaagaccaugcaauaacucuuacuguuuguugguggaaaaccaucucauuauuuuacugguuaaggguaaacugaagaugauuagauaacuuuccuuccuucccuccccccuuccucccuuccuucucuuucuuccuuccuuucucccucccucccucccucucucuuucuuuccuucucucuuucuuuucuuuucuuuuuucuuucuuucuuucuuuuuucuuucuuccuuccuucguuccuuccucccucccucccucucucucuuucuuucuuucucuuuucuuucuuucuuucuuucuuucuuucuuucuuucuuucuuucuuucucucuuucuuuucuuucuuucuuucuuucucuuucucuuuccuuccuuccuuccuuucuuucucucucucuccuuccuuccuuccuucuuuccuuccuuccuucuuuccuuccuuccuucuuucuucuuuuuuuaaauaagggucuaccugaagugugaacugauuugggaaauuugaucaugcagaacaguaaaauuuucuuuauguuuguugcuagcaaaauugugaugguuuuuuaaaaaaauggcuauugauaauaaggcaugccuaauguagugaaaguuugaaaaugucccaauuucugauugacagaagaagaacuggcaacuccuccacuagauggcaucauucuuccaggagugacaaggcggugcauucuggaccuggcacaucagugggugggugccuuugauaugaacaacuuuuguaagccugaaauaaaaaauaaucaaaauaagcccagccuaguguugaaauaauauccugugguuccaaccaauguuaucuaaucuuuaaauucuaacgugaaugaaaaguauucuucuagaagggcuuucuuggcaagacuauuaaaauaaguauuguugauagcaagggcagagagaaaccaguuuagcaagaugucauaguggagaaguauucuaguaguagucucagucuaccagguaucucccaccaacuuuugucugguucauaccugaugugcuuccauccagacauuccuuaacuucccaagucuguguugcuuccaaauggcaaugauacuucuuccuuuccuuuauuuauaccaguguaaccaugcuugccguagaaaugaaauaauuucacugacauauaaauguuuacuaauauaacauuauugguuugacugccuucuuuuucucucuguccuacccccauccuccaaaauucauauacaugccuauuuuaaaaucagaacaugcaagcaaauguaaaguuguuuucaguagacuuucaaauucgugugacacaggcaagcauauuaaacaauuugguggaccgggugcagugguucaugccuauaauucuagcauuuugggaggccaaggcaggaggaucacuuaagcccaggaauucgagaccagccugggcaacauagugagaccccgaaucuacaaaaaaaucaaaaacauuagcugaacauggugguacaugccuguagucccagcuacuuggaggggcugaggugggaggauggcauaagaucuggaggucaaggucgcagugagcuaugaucaagccacugcacuacagccugaauacagggugagaccaugucucuaaaaguaaauuaaauaaauaaauaaauaaauaaauaaauaaauaaauaaauaaaauaaaauuuaaaaagguuugguuuuggaaaugacguaauguauucaagacaaauuauugaaugaauugggugucugguaaagguucuuggauggaacuuuugacccagguguuaaaauggucuccaaagaacaugaaaaggcuuugagcuuacuguggucaaagaguacuaguaguaauaggacaaauguuuagaaacacacacguuaucuaggagcauaccagcaugguuucucuggaaaagacuuucaaaauagaugaaaugugcuauaaauaauucuacaaaacccugaaguagacaagacccaacugcuacaugcuggcuggcgcauugggcaugacauuuacaaaccguugguauaauuuucaaacagcuugcccuguccuaaauauguuugcaauuggaaagauauuuuugaagcucaguaauuuuuguuuuauuaaagaaaaauaucaaccaaguacagaagguucgacgacaaguugcaaguggaaauacuuucccacacuaaugauuugcuagcaugaaaaauagguuauuauggaggaaauuuuuucuugacuucauagcuguaauuuauuuuaaaagcuauuuuaaaacaugagacgugaaaugccaagaggcauguagggggucaccacuauuugccagauaggggaaauuguccaaagauaaguaagggugagcagagcaaaaacaauucugcuuauuuacaaaagaguuuucuuuucuuuucuuuuucaggacacagaacucagcuuguuuucaauuaauuugccugauuuucugcaguucauuuacuuuugaacaacauaauugcaauuguagacugagagaaauugaaacuuucaaagagccauauuucuauugcagauauauuuuccugcucuuccaaaucuacuuacagcaugaguucuucuuuuaaauauucaaauauuuugaauauugccaagagcuuugauuuccauuuuuaucucuuguggguuuauaaauuaagaaaaaauacucaucuuauuuuuuuaaaccucucuauuuuuauugcccuuuauucaaauaacuuguugacaaacuuugaacuugaaccacugagguaaaagaacaagaauuaaacagauaguuuaaacacauagcuuaaaaggaucuuuuucccauuuccuauccuugagcaaagaauauauucaaacacuuuggcagaagucaaugagguuauaccacuaauuccaugaugaaaaucaacugaaugugauacugaaagagaaggaagagaauugucacuguaaagucaacuguuagucauauuaggaaaaaaaauacauacaauacaauuucucaaauaaaguccaaauauacauucaacguuuaaaaauaaugaguauuucagauauuugaacucagucuguucuuuauuccauaaaagauauagguaagccgugcacaguggcucacaacuauaaucccagcacuuuggcacuuugggaggcugaggugggaggaucacaugagcccagccugggcaacauagggagaccccuaucuuuacaaaauaaaauauaaaauauaaaaccuaguugggcauggcagcauacaccuguagucccaggugcucaggagacugagacaggaggaucacuugggccugggaggucgaggcugcaaugagccaagauuaugccacugcauuccagccugggugacagggcaagacccugucuuaaaaaaaaaaaaaaaagaaagagacaaacguagaaagaguaccaaauuuggagccaaucagaucagaccuggguucaaauugaguuucugucacuuacuuccuuuguggcccuggagaugcccuucaaccuccuugaaccuuaguuuccucaucuguaaaauggggaugauaguacucacccuuaaaauuacagaacuuggcauaauagcgggugcuugauaaaugguagcuauaauuauuaauauuauauaauacauuguucuccuuuaugguaaaguagguuuuaagacacugauuuuuuuguuuuguuuuguuuuuggagacagagucucacuccgucacccaggcuggacugcagugacgugaucuugguucacugcaaccucugccuccugaguucaagcgauucuccugccucagccuccugaguagcugggauuacaggcacccgccaccaugccuggcuaauuuuuguauuuuuaguagagacaggguuuuaccagguuggccaggcuggucucaaacuccugaccucaaguaaucugccugccucagccuccccaaaugcagagauuacaggcaugagccaccgugcccggccuaagacacuguuaacacggagcaugcaucaagcagcauuugggaugcaucaauuuugugagacuuuauacaaguuaacaaauaagaaggcaaaaaagaaggcauauguuaaaguauaccaugugucuuguggugauaaucuuauauuuuauauucugauaaucucauauauaaaucugugaccuugaaguagguuacuuaacaccucgauguguucaccaguaagauggugugccacuuccagcuuucccuuaaaggaugauugugaccuugucuaagugcaaucagaauguuaagcagaacaguaaguauugcaauuguuuugcaugccuuuuccuuuaaaauauacuuguuauuuuuuauauuccaugcagggugaauuuaaggugucagagagauaccucaccauggaugacuugacaacagcccuggaggggaacagagugagagagauguuuggcucugguacagccuguguuguuugcccaguuucugauauacuguacaaaggcgagguacgacaaguauuuccucauuuccuaucauuuccaaucacauuaaauuacauuuaauuuaaguguaugaauaaaauuguaucuggacccagacccaagaugcaaaaguuuugucguuguuguuguuuuucuuuauuuuaaagagauggagucucgcuguguugcccaggcuggagugcaguggcuauucacuggugugaucauagcucacugcagccucaaacuccugggcucacgcaauccuucugcuucagccuccugaguugcugggauuacaggagugcgccaccgcaccaugcuaggucuuuuuuguuguuguuuuuguuuuuuaacuuggcacuacaaaaaaaauaacugggacaguuuauccagaugaaacuguauuagcauauaucuacuauguuuccagugauuucauguaagcuuaaacauggugggaaguuaguuuuguccuuggacacguguaagaucugucuuaccuacaugucgggauuggagcuaugccgacagucuucuacucuucucucuuccuuccuaccagcucacuagggaaggcucuauagguaguuacauuucaguuucugguuaaccaaaaguacuuccaaaccacuggauuaggaauggcaaauaguuauggaaaaugcauucgaguggucaaucccuugauuuuuuuuuacuauuaaugcuguuaucauuaauaguaaguagaccacuuuacaagaauuauucauuggcaaaccuggugcauuuacuaaaaucuuacaaaaggaauuugaggauuugguuggaagaaauguucuccucuuaguaaauuagucugauuuuauaugugccauacuuuuguuuucuugucaaauuguuuugcuuuucacuuuauaacaaagcuccaauacuuaugauuaacauuggcaucuaacuuuauaacuuaaaggcauguaaguauuagucuuauaaugugaacuggcuuaaguuauucauauuauagcagauccuugaacaacacagggauuaggggugucaacccccaugcaguugaaaaauccacauacaacuuuuuuuguuuguuuguuuuuuuaaacggggucuuucucugucaccuguacuggagugcaggggcacaaucucggcucacugcaaccuccgccucccaagcucaagcgauccucucaccucagucucccaaguagcugggaccacaggugugcaccaccacacccagcuaauuuuaguauuuuuuguagagacgggguuucaagauguuucacaggcuggucucaaacucuugaguucaagugauucaccugccuugaccucccaaagugcugguauuacaggcgugagucaccaugcccggcccacauauaacuuuugacuucccaaaaacuuaacuacuaguagccugcuguucaccggaagccuuaucaacaacaaaaacagucgauuggcacauauuuuguauguuauguauguuauauauguauucuuacaauaaaguaaguuacgaaaaucauggggaagggaaaauauauuuacuauucauuacauggaaguggaucaucauaaaggucuucauccucauuguccaucauguugaguaggcugaggaggaggaggaggaggagggauuggucuugcuguuuuaggaguggcagaggcagaagaaaguccacguauaagugaacuuguguaguucaaacccguguuguucaagugucaaccguaaaugcaaacuccacugguuuucaaauuuuacuuuagaguuauuuucccucagcugauuggaguuuugcucaacuccucugacuuuaauaauggcugcuucauuuguugagguuuuagaacuugcuuuuaagggauugcucuugacauaauugcaucaacagauagacuguuucaugggagaagaauuguucuguuucaugucaauacuuacauugauaagaaugcaucaagguaaugugauccauccacugaaguugucauuaggccagauuuuuuuuaaguugaauuauuauuucacuucuagaaauaagaaguuuauaaaguuuagcauaauuuuaaugauccaggcuuaggaagcauuuacagccaaaaaguaaguauauauaauuaucauauuauacuaaaggguauaauaugaaaaguguuugagagcacagacuaucuccuaaaaucaaacuaucaaaaccugcaagccagcaaggcaugaguaggcaugacucagauacaaauuagaagcaugaaaucucuuucagccaugcauuuaaucaugcuauccaauauuguggagguaguggccccuggaaguuuaccuugggccagagauagguauagaagccccuuuuaugaagucauagacuugcuuuaauuuaugcucccagaaugacuugcauuaaacuguggcaaaauaucuuugaguucucauauuagccagaggguuaauauguagaagacaaucauucauccuuacagauucucagaaucuuggaagagguaggguucuuuaaguuuagccacuauuuuagguaacuguagcuccuccuugguucuucaaaugauccugaaggcugguauacaaaccaguuaugcccuaaaauuaauugguagguaggcaauguauaaccugucauuggcuaguuuuuauucaaauuuuggauaugaaagucuuuggcauaaggugcuagcacucagagucaguagguuuuagugcuauuccuuaacuucaguggaauugccuuaguauagcagaauugcuugagugucuuaucuguuaucaccauauacaugaguacccucaaauuaucucauuucccuuucuuuuguagacaauacacauuccaacuauggagaaugguccuaagcuggcaagccgcaucuugagcaaauuaacugauauccagguaaagcuuuucuuuucuuuucuuuucuuuccuuuucuuuucuuuuuuuuaugucaccuuauuucugucagagcuuacaacuaaauuauauuucaaugaagaggauuaaauaauacaauuugagaucaauaaguuaaauuuaaggaagauauucccaacacaaugugugggcaugagcaaagcagaaaugggaaagaagauguauguuuuaaaaaaagaaagaaaauauuguucaggacuccacauuacuuaacauuaaaaaauagauguaauuuuugguaacauuuaaaaaucucauuaagaaggauaacauaacuuuuguuaaaaaaaggaagaaaaaauuugaaaguagaagcaacuucaggaagaaaauuacagugcaugugauuccaacacugagauauaaucacuguuaauuuuuuaugucuuuuuauuuuugagcuggaguuucacucuuguugcccaggcuggaguacgauggcacgaucuuggcucacugcaaccucugccucccggguucaagcaauuuuccuaccucagccucccgaguagcugggauuauaggugugcgccaccaugcccagcuaauuuuuguguuuuuaguagagaugggauuucaccauguuggccaggcuggucuugaacuccugaccuaagguaauccaccugccuuggccuccuaaauuguugggauuacaggcaugaaccacugugcccugccauuuuuugaugucuuaaccuucaauauuuuguaagcauuuauauacuuuauuuauuuauuuauuuauuuauuuauuuauuuacuuauuuauuuuugagacuaagucucgcugugucacccaggcuggagaacaguggcaugaucucagcucacuacaaccuccaccuccuggguucaagcgauucuucugccucagccucccgaguagcugggauuacaggucucaugccaccguucccggcuaauuuuuguauuuuuaguagagaugagguuuugcccuguuggccaggcuggucuugaacucuugaccucaggugauccacccgccuuggcuucccaaagugcugggauuacagccgugagccaccaugcccagccaguauacuuuuagauaguuauuuuuuccuaacaaaaugggaucauauuguacauaauuuuguuacauguuuuuucacugaauaaaugcuuugcuuuuuuauaucaauaaguaguuuucuccaacaccauuuauaaaguuuaauugaauuccauuauauugauguaccauaauuuuuuuaaaaaauuauauuauugaacauuuauguuguuggcaauuuuuuuuucacuaguauggacaguacauccucgauuacuuccuaaggauaaaucugggaucaaagaguauacacgucuauuuuuucauacugcuaacuuuguuuugccuauuuuuuuucugagcaauaaucuacaguaaugccucaucaggcaguuaagcaggcaugcuaaauaccagauaacacugggcuacucagaaaagagauuauccuguaauuugcaagcauuucacaaguuagaagacuuuguugaagccaguuacuauccuugucaauuaguaaaaauauccaagagggccugagacuuacauugaaaaguaaaauaaaguuugaucauuugagugaugucggauggcauuaagucaugaaacuaagugaaacuuaaagguggcugagaaugcaacaggccuccagagagcaauggagguccuuggguagugauaaaaauggcauuucuggcugggugcaguggcucacaccuauaaucccaacacuaugggaggccaagacaggaggaucgcuugaggccagguguucaagacuagccuaggcaacauagugagaaccuuccucuaaaaaaagggaaauaaaauaaaaauaaaaguuuaaaagagaguuuaaaaggcaguuuuaaaagagacuuacucagcaaguuuucugccaaauuuacaguauuaaaaagaaagaaaguguguuuuuguuucuguuuguuuuuuugagacagagucuuacucuguugcucaggcuggggugcaguggugcaaucucagcucacugcaaccccugccuccuggguucaagugauucuugugccucagccucccacacagcagggauuaugggcaugcaccaucaugccuggcuaauuuuuguauuuuuaguagagucgagguuucgccauguuggccaggcuggucucaaacuccuagccucaagugauuugcccaccuuagccucccaaagugcugagauuacaggcaugagccaccgcacccuggccuugauugugguuuuuuaaucaaugagcugccauacuucugcucuccagcaaagguuuucuaugagaauuuucuguaagcuaaguaaaggaauaucuuaauauuggaagaaauaaaauuuagucagaguuguuuucuaccuuuguacacagcaacacuuacaaguaauuugaagaguagcuaauaaaaauuucugcauggauggcuuaggcauuuuaauuuuuuuaagguugccugaguaaaucugaaaauaauaaauuauuacaguuuugcucaaauaaagaacacaaauagaacaaaaaauacauaacuggcuagauuacaugaaagccuuuuuccaaaacagagguuuagaggccagggcaaauaggcaggaaaaauaaauaaagggcauccaaauuggaaaagaagaaguuaaauuagcuuucuuagcagaugacauuaucuuacaccuagaaaaaccuaaagacucccucaaaaaaccuguagaacugauaaaugaauucaguaaaguugcaggauauaaaaucaacauauaaaaaucaguagaauuuauauaugcuaacagugaacaaucugaaaaagaaaucaagaaagcaaucccauuuauaauagccacaaaaaguauaaaauaccuaggaaucaaucuaaccaaagacaugagagaucuauacaaggaaaaguauaaaacuaugauuuaaaaaauugaagaaaacacacaaagguggaaagauauuccauauucauggauuggaagaauuaauuuuguuaaaaugacuauacuacacaaagcaauuuacagauucaaugcaaucccuauuaaaauacugaugacuuucuucacagaaauagaaaaaacaauccuaaaauguauauggagcuaaaaagaccccaaauagccaaagcaaucuugagcaaaaagaacaaaguuagaaucaccacacuaccuuacuucaaaauuuauuauaaaacuauaauaaccaaaacagcauaguacugauauaaaaacagacauaguagaccagugggacagaauagagaacccagauaccuaaguccacauguuuacaaccaacucaucuuugacaaaggugccaagaacuguaacggggaagacagucuuuucaauaaauggugcugggaaaauuggauaauuauaugcagaagaaugaaacuagauucgcuucucuuaccauacacagaaaucaaaugaaaguauauuaaugacuugaaucuuagaccugaaacuaugaaauuacuugaagaaaacauuaaggaaaugcuucaggacauuggucuaagcaaagaucucauucugucacucaggcuggaguguaguggcaugaaccuggcucauuguggcauugaccuccugggcucaagcaauucucccaccuuggcuuuccauguagcuagaaccacaggugcaugccaccacauuccacuaauuuuuaaauuuuuuguagagauggagucucaccaucuugcccaggcuggucucgaacuccugaacucaagggauccuccugucucagccucccaaagugcugagauuacuagcauaagccacugucccuggccagcgaagauuucuuauguaagaccugaaaaagcauaggcuaucaaagcaaaaauaggcaauugggauuaugucaagcuggaaagcuucuccacagcaaagaaaacaauccacaaagggaauagauuacccaaagaauggaugaaaauauuugcaaacuaucaaucugacaagggauuaauaaccagagucuauaaggagcucaaacaacuguauaggaaaaaucuaguaaucugguuuuaaaaugggcaugagaccugauuagaaaacucaacagaaaaaaaaauuugauuaaaaauggauaaaagaucugaauggacauuucucaaaagaagacagacaaauggccaggagguacaugaaaaaaugcgcaacaucacuaauuaucagagaaaugcaaaacaaaaccacaauguaaaauccacuugcccuaguuaaaauggcuuguauuaaaaaaaaaaaaaaaaacaggcaauaacagaugcugggaggauguggagaaagggaaccaucauauauuguugguugaaauauaaauaguacagccacuauggagaacaguauggaggguccuccaaaaauaaaaguagaacuagaacuuccgugugauccagcaauucuaccaccggguauauauccaaaagaaaaaaauuaguauaucaaagagauaucugcacucccauguuuauugcaauaguauucacaauagccaagauauggaauuaaccuaaaugucugucaacagauaaauggauaaagagaauguggcauaaagauauauauauauauauauauacacacacacacacacacacacacaaugugguacuauucagccauaaaaaagaaugaaauccugucauuugcagcaacauguauggaacuggaggccauuuuguuaagugaaauaagcgagggaccgaaagacaaacaucacauguucucaugcaggugcuaaaaaaguagauccuaugaagacagagaguagauuagagguuaccagaggccgagaaggggagugggaaguagaggauaaaggaaaaaaacaagaauauaaauguauuuauuaccauuaaacugaacauuuaaaaauuguaaagaugguaaauuauauauguguauuuuaucuuaauuaaaauuuuaaaaaucaggaguuuagaaauuuuuaagagaagugugcccauagugauaagaaagaaagacccuuuuggaaaauuuucuugaacaaauuauacaguauuuucuuaaacaaauuguacauucuguagcaguuaauacaccaaauaagauuucaggguuaccucuuggagauuguaugaaauaaaaacauuuaggugggcaugauggcucauuccuguaauccuaaaacuuugggaggcugaugcaggaacaauacuugaggcuaguacuucaagacgagccuaggcaacauaguaagacccagucuccacaaaacaaccaaaaaaaauagcaagugugguggcacacaccuguaguuccagcuacucaggaggcugaggcaggaggaacacuugaggccaggaaugugagacugcagugggcuaugauugugccacagcacuccacuccagccuucacuguagaaagagacccugucucgaaaggaaggagggagggagggagggagggagggagggagggaaugaaggaaggaaggaaggaaggaaggaaggaaggaaauguaaacucauuugauuuggcuguaaaggauuaauagaaaaggaaaacguagucacuaggcugagaaaaauugaacucuauugaauugguauaaagaucuaaguggagguguuuggcagacaugaucaugaagcuuucacugaggaaggaaacucuaggaggcaaaagcagaaaugcaacucaucaaaauugaaauggugacaaaauaugugcauucaaaccugaaagugacugaaagagaagcccaaacacacaauuuugggguaagaugggaaaccauuaccaaaguucucagaaagagcauuuuuaaaaguaagauuauagaagccaaaaggauauguaguagucuguucucacacugcuguaacgaacuaccugagacuggguaguuuguaaagaaaagagguuuuauugacgcucaguucugcaggccauacaggagacauggcuggggaggccucaggaaacuuacagucauggcggaaggcaaaggggaagccaguacauauuacauggugggaacaggaggaggagagggagggugggaggugccacucacuuuuuaaaacaaacagaucuccuuagaacucacucacuaucaugagaacagcaagggggagguuugcucccaugaugcaauuaccugacaccaggcccuuccuccaacaugggggauuacaauuccacaugagauuuggguggggacacaaauucaaaccauaucagaauguuagugacuaaaguaaauguucuuguuuaacucuuuaauguguauauugagugcaagccauaugcaggggcuauucuagguacuggugguuuacucaagaaaaagggggcaaaaaaaugaagaagguggccaggcaugguggcuuacgccuguaaucccaacacuuugggagacugagacgugagaauugcuugagcccaggaguuugagaucagccugguaacauggcaaaucccugucucuacaaaaaaaugcaaacaaacaaacaaacaaacaaacaaauuaaucgggcauggugucacaugucuguagucccagcuacagguugaggugggaagaugccuuaagccuagggagguugaggcugcagucagccaugauagcaccacugcacuccagccugggcaacagagugagaccccaucugaaaaaaaaagaagucaaaacaaaugaaaaaaaaaaaaaagucaaaacaaauauucaguguaaaugugagaccauguaaaaaaguuuaaaaguaaaauauauaguuuaagcagaggaugggagacggggaaaaaaccuuuucucccuaacuuuauauacucccucuauaaauuagugcuuauggccaauaagaaaugaauaauuucuuuuuucaccguugguaguaaaguauaaugguaguuaacacaaaaaacuaaaugauauauucagaaccucauacuaaacaaagaaacaaaggcaugcaaucacaggacagguggaaacagugguucugaacuaaccacaaaccagaacuaccaaaugugcuacaaauuguuuaguaacaaaggaccaucccuucagaauugaagagcacgucucaguuaucucaugccuaugugcauggaacuuaaagucucaaaauuacucuuacaagauggcaaauugaggcugucagcuaagcuccuagauugucuguuucuccaagaaaaauaaauuucaguaauuauuaaggaaaaagcauagaauugcaucauguuuuacauuucauuacuuuuggcaugacaugggagcauggauguuuucuacaaagugcucugauaaauugaagaagaggccaacaacagccaccgaaaaaaccuucaagauucuugccaguauggcucaggggaaaaauucccucauaaccacagauuugacuuuucaacuucuguacuucugcauaugaguaauaaucucugagguuaaguauucaucccauuuagcuaauuguccacauaacucccugggucuuagauugcucuauaaauaccuccuaagagaagaauuuuucaaaugacaguuucguuuuuccuuuuucuucuuuuaaagcaacaaagaaaagcacgucuguguuuauauuuaaccaaacuuaaacuuggagagcauuggccguguugucgacguguuucuuuucucuacuguuaaauuccuuacuguuccaguuacucaccaucauacucaccuuugccucugccacuugggguccucuguucugcaguuguguucugcucucugaugccuccagguuuugcugcaccuucuagaaauugcucaccuggauaaggccuuggcuguccuuuaugacucaucucguucagaagccuuuugaaucucucuugaagaauauucccuuugcucaguccaaauacacauucacucacuugaaugcugcuucuuccuccaguuucacagugcuggggaugaucccguaaggccuuuaaauuacauuauaauuagucaugcacuucucucugcucuggggcuguuugaaucguucacucucuuuauaccuccaguguucagcacagagccuaggguauaaugcguaugcaguaauguuucuugaaggagugaaugggcaagugaaacaccaaacaaauacuaaagagcaaaacauguauugcucuuguauauuaacacauuccgagaagagaugggaggaaggucuugaauaauaucaaauuauuucuuaagagaucuugauuuagauuuuuuucaaaaugagauacauguugacacugcugucaacaaauaaucacauaaaagcuagagccuggcuuuuaaguaucagggggagcaugugugaauaaucagcauugcugcuguugaagcuccauaaagugggaagcagcgacugcaaagauccagagauggacaucugaagcauaggaaaggggcagcuugaaugagauaggagcaggaucuguauugauugcaggucaccagauagaauuaaaaaaaucuauguucucacuaguggcuacaguuuucaaggacaaaugacuauuagugguuauuguauuuuucuuguuuucaauggagcagcuccaugacuuaguuacauaagaaguuaaaggcuccacccccuucccuaccaaugucuuaagcuguccuccgugugcauacaaacuuuguuuccagacugcccucgugugacucagucccuggaccagcuucccagccccuucuguuuccagcacauccuccuccacguguuacaggauuacaaagcuuugcacagccuuucaauaggguuuagagcaagaaugacagauugcuaccugguaggcagcacugacuauaguuuuauuggcguugcguagagugacugcaugacaugcagguugugcuuuuguuuugccaggaauuuaaaggcauuuagcaaagccguaugaaauuaucugccuuauguaccucgaaugugagguaaugaacuugucauuagucguguuuuaguuuaguguucucgcuggaauuugcaaaagauuaaaauucugcacauuucauuaagucuuccacaugggcucaaaauaccaucccgcaggcucgaccugacuugccacguugcuuugacaccaucucugauuccagugaacaaaacuaaguaagugugacuuacagccgcccuaccaaacauugaaggugugagccugcacuguuguuuuguaaugacaaugacaagaguauaaugacaagaguauaaugacauccuaguccaugaagacauguuuucucuuuucccucccucuauguauacuuacuuacucuuaaggaaauaauauaauuucuauuucugcuuaaaucugccaucucuacuuagaauuauuuucccuugaaaaauuaaauugcauuauccaucagccaaauggaaaaucugauuacuaaaugccuacuucuagacauuaugaauuaccuguaauaucacauuucuugggcacuucucagaaugcuaugauuuuacauaaaagcauaaauuacagaaugagaagaguaaagcuuagugcauauuaugcagguucgcagagugauauguggccuacgacugucauuguaaucaaaauugauuuuugaucauuuauaaaacuaaaacaacuaauugaaagcaaauuuacuuuaacugaugaaauucaagaugaagugacaguagucaugaaucacaguucuguagaucugcuaaaaugccaaugaacuguuauuaauggugaaaguguuuaauauauuaaugggaauccaaguaaggaaaauaaaacacauauuuugcccuuaccuuaagucauguugacaucauacauaaaucagguagaauuugaagauguuucauccagcauucaucaugaagcaacagagucaauagcgggcaguuacagucuguaggcaaugcuuucugguguggauuaugcaagaaacuuacagucauuuggcuuccuuuauuccccuuugcauguaaacuaccaggugguagguagacccauucuuggcugccaguauuuuuaccacuuggauagauucugcucucugaggucuuuaagacaaacacagcacauguacauugugauauaggagaaagaacaucagacagaggcagagaacugggcuugucaaaauuaagggugaccuagagccuuaguguccuuauauguaagaugagaagcuuggauuaaaauucauugcuccuuacacuugauuuuuaugcagcagaacuuucuucaaaagagaucacuccuggaaucccaauauacaaaauggauaaaaguaggauuguucugaaguaaagaaguaaaauccagagccccacuuauuugagucaucuccuaccuuuuagaugguuauuaacauuguuucuaguucagaaauucugauguuuuauauuaauuuaaacuaaaguuaaauuaggacuagaagagccauuucgugugaaaauagacauagucugagugauuuaggcaaacccauagugacagauuuaguggccugauacacuggcuuggaaagaucuguuccaagucagucucaauacacaaggcucggugaacacauggcgagcagucuuggugguggucaagaacauggaauuugcugugagagagagcuugguuagggucugggcucuuccaucuguuaacugcaaacuugagcaaguuauucaaucucccuaauauucaguuuucucauucauaaaauggauugauaaugguaccuucuauguacaguuacuguggguauuaaaugagguaauaagccuguaaaacuccuggcaugaugacauuggccuacauuaauugcucacagagugagaacuuauuauaaacacaggcauuuuuguugaaugacugacugauugaaugaaugaauauagaacuagcuuucuauuugugauguauggaauaucucuauuucauuuaauuucauuuugaauauuaaaauucaggcuugcuuuuaaaccaaaguauuugcugaugcaaagaaugaaauucugacuaugauacaguuacauaacuuuugaagaaauaagaaaaaugcuaacacagcaugaacaacuuugauuuagagaacagagucucuguuaaaauccaugggacuugucaacuucauauuuuuguuuaugagcauaaaacacucuuuagugcaugucggaaucauuugaugcuugcugaaucacagguugcuggaacccauccccagauucugauucagucugagaugaggucugggaauuugcauuuuuaacuuguugucuggugaugcugaugcuaguggucugagaauacacuuugaggaucacuuuuucacaguaaaagucacagucauuaagcaaguuaacucaaugagaaaugauaaugaaaaggcauguaccuaaauagauaaaggaccuauaccagcuaugaauuugaguucagcaauaauuguaaaauuuguaauucuuuucagguauuugguuuuuaaaaaacucccuauguaugcuuuuaucuuauguuuuauauggugucccucuuuuccucucuuucucucuaauccaguuuuuaaugugaacauguuuaaugugaaaauguuguucaaagcagaagcgaaccuuuuguguaaccuuggcgguauuaaguuuguuuguaagcuauuucugcccuguuagcuucuguacugaaacacguuuucuugcuuuuguugcaguauggaagagaagagagcgacuggacaauugugcuauccugaauggaaaauagaggauacaauggaaaauagaggauaccaacuguaugcuacugggacagacuguugcauuugaauugugauagauuucuuuggcuaccugugcauaauguaguuuguaguaucaauguguuacaagagugauuguuucuucaugccagagaaaaugaauugcaaucaucaaaugguguuucauaacuugguaguaguaacuuaccuuaccuuaccuagaaaaacauuaauguaagccauauaacaugggauuuuccucaaugauuuuagugccuccuuuuguacuucacucagauacuaaauaguaguuuauucuuuaauauaaguuacauucugcuccucaaacaaaugcaauuuuuuguguguguuugaaagcuaauuugagaaaauuucauagguuacauuuccugcagccuaucuuuauccacagaaaguguuuucuuuuuuuuaaaucaagacuuuuaaaacuggauuuccucccaucacuguuuuuugaagguccuccaaguccguguuaagguaaauaucuguuuucuuccugaugucacagccugagcauacucugugcauuaggaagaccugagugcauuucccaccauuguccuuuccacauuauguuguagcuggcuggcugucaggcgacuacaagacugagggucuugugccuuauagaucuuuguaucccccauggcugacauauaguagguacucaguaaaugguuuuauaaugaaucagugaacauuuugcuucuauagaaguguaccuucuuuguuucuauauuaugaaaccucuuuauuagaauuugugauugauucugacaguguauagauuuaccuuauauugucuuuauuuuccaugagcuacuaagucauuagagauacucugaagcauaguuaguuuaggaaaucacuucauauugauuguauuagaauuaucuuggaauugaagauauaucccuagagcaggggaccccaacccccaggccaugggccacacagcaggaagaggugaguggugggccauugaggagcuucaucuguauuuauggcuacuucccaucacucgaauuaccaccugaacuccaccucuugucagcucaguggcagcauuagauucucauaggagcacaaauccuauugugaacucugcaugcaagggaucuaggcuaugcgcuccuuaugagaaucuaaugcuugaugaccugagguguaacaguuucauccugaaaccacccuucacccugcagucuguggaaaaauugucuuccacaaaacuggucccuggugccaaaaauguuggggaccacugcucuagagagaggucaugauaucauaccaaccaaauggaaaugacaaauguuuuaugucaaguguuaauugcagaaauaaaucuuuuuuuuuuuuuuuugguagaaaacaaagaggcauacucugauuuuuauacucuguuuuugcaggugcucuuuucuuugaauggagauuugaugagcaagugguuaggaugcagggagagcuacuaugggugauauuuuccuuguuuaggagcugugaguuaaaauuguauccuuugugguuuaucuaaggaaagucaaaucuugacagaaaacauuuuuccuuggaaggucaacucucagacauuguauuuugguuucccucaguccucauaacuuccuucuugcugaacauauuuuauucucuuuucagagaaggaaaauaaaaaggauucuaaaaguuugaugcauuggaaaaauuuccuugaggcauuuagcaacacauagaaaaugggcuuugauucuuuuccaaaacuuuuagccauagggucuuuuauagacagggauaguaaaaugaaaauugagaaauauaagaugaaaaggaaugauaaaaauaucuuuuagggggcuuuuaauuggugaucugaaaucuugggagaagcuguucuuuucaggccugaggugcucuugacugucgccugcgcacuguguaccccgagcaacauucuaagggugugcuuucgccuuggcuaacuccuuugaccucauucuucauauaguagucuaggaaaaaguugcagguaauuuaaacugucuagugguacauaguaacuaaauuucuauuccuaugagaaaugagaauuauuuauuugccaucaacacauuuuauacuuugcaucuccaaauuuauuguggcgagacuuguccauugugaaaguuagagaacauuauguuuguaucauuucuuucauaaaaccucaagagcauuuuuaagcccuuuucaucagacccagugaaaacuaaggauagauguuuaaaaacuggaggucuccugauaaggagaacacaauccaccauugucauuuaaguaauaagacaggaaauugaccuugacgcuuucuuguuaaauagauuuaacaggaacaucugcacaucuuuuuuccuugugcacuauuuguuuaauugcaguggauuaauacagcaagagugccacauuauaacuaggcaauuauccauucuucaagacuuaguuauugucacacuaauugaucguuuaaggcauaagauggucuagcauuaggaacaugugaagcuaaucugcucaaaaagaucaacaaauuaauauuguugcugauauuugcauaauuggcugcaauuauuuaauguuuaauuggguugaucaaaugagauucagcaauucacaagugcauuaauauaaacagaacugguggcacuuaaaaugauaaugauuaacuuauauugcauguucucuuccuuucacuuuuuucaguuucuacauuucagaccgagcuugucagcuuuuuugaaaacacaucaguagaaaccaagauuuuaaaaugaagugucaagacaaaggcaaaaccugagcaguuccuaaaaagauuugcuguuagaaauuuucuuuguggcagucauuuauuaaggauucaacucgugauacaccaaaagaagaguugacuucagagauguguuccaugcucucuagcacaggaaugaauaaauuuauaacaccugcuuuagccuuuguuuucaaaagcacaaaggaaaagugaaagggaaagagaaacaagugacugagaagucuuguuaaggaaucagguuuuuucuaccugguaaacauucucuauucuuuucucaaaagauugcuguaagaaaaaauguaagacaaaaaaaaaaaaaaaaaacaaacagaggcagaggcaggcaguagcaagaaagcagagcguaacaucagcuagaugguaacaugcaaugucagcucucuugaagacaugggaaaccuaaguuacaccuuggguuaaaauucuucaccauauuaguuuuguugcuucauaaaauuuaccuaagcaaguggucuugcuugccucaaauccaagcagucuugaacacuuggaggcaauuaaugaguauaucuuagucaaaagaauuguuggagcuuuuuauuaaagcuacaguuucaguucugcuuuuggggaauugugcuaugaaagcagcugccaaaauaagcucauuuauuuucuucaaucccacucagugcucagucacuauauucuguuuccuuuuuuuuuuucaaguugcauauuugguuuccccuuaugauugggaaagaugaauuuucagcagaaaacauuguuuguucacuuucaaagagugauaguuucuaaaacauuuagagcaauaaauauucaucagagguaccaaguaagccggcagaagaguuaaggguuagagaaaucccuuauuucaugucuugacucuaaaauuaucaaaguacuuuuccuuguaauguggauuucuucuuaugcggauaugcaaaaacuucaguuauacguaguaaugcuagcagguaauuuuaguagacauuuuauaacaacugucacuuuguuucgccacauguagaguuuguucagcuauuuuccagauaucuccccacaaaaggaggcaaaggguaccagcuuuucaaugagcauuaccuauuacuuggcaaagaugaugaagacucuauuaauaguucauuugauaaauguugacauaaccaacaauagagauuaggaaguuaguuuuaagaaaucaauggcauauagacauuacccucauggaguuuguauucuacuacuugaacugauuguagcuauaaaagcauaguuagauagcugaauaguuagaucauaagcaaagaaggccagaacacaucucuuaucaagaaaucaaugaauaguuuaucucauuuuuaaagcaacuuuauccuucuuuaauuccuuccuuucuucuagugcaaaacuacuuaauaagguugguguuuagguuaguguucacaccauuccucaucuggugugaauuaccuucucuuucuuuacuauuuacuaccaaccuaguacauguguugacugaauucuuuucaaacaauguugaguuaucauggugcaccuaauaaauuaacaccacagauuacagcauccuugcugauuuucucagcaaagccagauuagauggaaauaaacaaagaaaaugauccuagagugaauuuuucuagaaaauaucuauuaugaaccaugcuguuuaaaguauuagcuugaaggugauggauccagcuauucagaaaauaacuuucauauaaccaugauuuugcacaguaugaggucuuaaauguguggaaagagauaaauuuuuuaucauuaccacaaaccccuuuuaaagauucaaagguggaagaaagugauuuauuuuuucucuucagcauacauauauaaaagacuugucagauguuuaauuuggggagguugauaaugaaacauaucaacagaguauaguaguuauaguaguguuuguggguaaauaauuuccuggggucagacauauauaaacauauuugcuucaaaaugauaaaggcaugaaaucagucuuaaaaauugaaaugggggugaugggggagaaaaagaagaacaaauuugaagugcccuuucaaaucugcuggauacaaguauugaaguuuuaagucaucuuauucugucugaaaguguauuuuucauucuacaauagacccaaucaacaagacguauaacuugaguugcaugauguucaguuuauguaaucuacuguugggaugguaagaauugauguaggcugugguguaagaaugaauuaaaauauaguuucacuggcuuuucucuacauauccacuaucacaauggcuagguuuccuguugcucacuauuggauucuggagaaaaauuuaaugaaagaugauaucagaggaagaauaaguggagguagagaagaaaggaaugauagaggaggggaaaaaaacaaaacauauuuuuguguuauccaaaggagcuuuuuccuuauucugucaagcauugagaucuucuucagcuuucaauguaguugcuaaauacaaauaaugcuacuagguagugacuaaauauagcaaacacuucaucagauauuagaauuaggucacacuauugagguuauaaucugaagguuguguuacauagaaaccacuuuagauuauuaucaacuuggacuaggcuuuauuuuauaauagcauaguaaguaauaucuauugugucauuucuucaaccauuuuauucuaagauccaugaagcuucuugaggccaaauaaaauaauaaguuuagacaagaaguagauugugacuuuuuucccuuagagauacuauuuacuaucuccuauccugauagguggaagguuuacugaauuggaaauugguugacuauuaguuuuuaacuaaaaugugcaauaacacauugcaguuuccucaaacuaguuuccuaugaucauuaaacucauucucaggguuaagaaaggaauguaaauuucugccucaauuuguacuucaucaauaaguuuuugaagagugcagauuuuuagucaggucuuaaaaauaaacucacaaaucuggaugcauuucuaaauucugcaaauguuuccuggggugacuuaacaaggaauaaucccacaauauaccuagcuaccuaauacauggagcuggggcucaacccacuguuuuuaaggauuugcgcuuacuuguggcugaggaaaaauaaguaguucgaggaaguaguuuuuaaaugugagcuuauagauagaaacagaauaucaacuuaauuaugaaauuguuagaaccuguucucuuguaucugaaucugauugcaauuacuauuguacugauagacuccagccauugcaagucucagauaucuuagcuguguagugauucuugaaauucuuuuuaagaaaaauugaguagaaagaaauaaacccuuuguaaaugaggcuuggcuuuugugaaagaucauccgcaggcuauguuaaaaggauuuuagcucacuaaaaguguaauaauggaaauguggaaaauaucguagguaaaggaaacuaccucaugcucugaagguuuuguagaagcacaauuaaacaucuaaaauggcuuuguuacaccagagccaucuggugugaagaacucuauauuuguauguugagagggcauggaauaauuguauuuugcuggcaauagacacauucuuuauuauuugcagauuccucaucaaaucuguaauuaugcacaguuucuguuaucaauaaaacaaaagaauccuguuugugugguuucaugaaaucagcauuguugaaugcaugaaguaauaaugcuaaauuaacauuuuuaugaugucucaagguuucuggucaagggaaguaaauguaggauaguauuuuuacaccaaaaugacacagagagaauugagcacaccagaaagaccagaaaccacaccacuggauagagauucaauauguuucuuuuucaaacauuuggacaagaaaaaaaugggcauuuaaaaauucuuccuuccccugguuauggauuuaucuguaguaaaacuuagcuuugucguuugagauuugcacagaauggggggaguagauuaccucuucccauucauugucauaauggaucuacaucacugauaaacaccauacuucuauaugugguuaacuagcuuuagaauaaaagacacuuuaaaaaguaaaaggccuagagaucuucaaugaagugucccuuuuagccaaaccaggccuugcagaaauuguccucaaaagcaccaagggagaacaaagccaagugcagaauuacccaagggucacacauuuuguauucauuuucuuauaauuugcccaaaugauuugaaguacagcaaaaccugaaguuuugcaaagaguuacuguaaacugaacuuaaaaaugucagagugcucggugacccacuucuccagacccugucaaccugugaaaauauuggccuuuauucagaucucucaagaaguuacgcgcagaguuuggaaggucuaggcaaagguuauuagucaaguguucuuacagugucaacgcucaauucccacaagcgugagaaagagagaccugucauuccugagggugaugacauacauuuacuggagcuuauauaauuuaucagauaagacagcaguuuccuucaggguagaaaguguguuuucuacauugauuuaguacaaaacaaaaagaaaaggggauauuucaaauuuuauaauuauuuuucugcuaagcugauucagugugauuuaagcauauuuuucaaaucaugaaucugauuccauauacauaugugccuuauauugugauaauuuauuuuuaagugaaauaugcuaucauagccugacuuuauguauaguggugacaacuugcaggaucgcauuucuguaaccaaacggccgacagcugagguguagaugcuuccuauggucuguagaauaaucacugggcuuguucucuagcuaugucuguaugcaaucgcgacaguguugaucaaaacccaugaucauucucuccaaaggucuuugucacuaagccacuagggauucugaaaaguucgugagcugaaacaaauaaauugaguuggaagauu

SEQ ID NO: 191707 - RNA, 42834 nt, Homo sapiens
uuagcauuuuuuucaaaauagggauuuauuauaaaaacuauacaaacuuuuuaucacucacaaaugaugaaaaauuuuaaacaauuaguauccucccuccaaaauaguguguucugucuuuacagucuucacuggcagugcauucagauaguauagaaaauaacaaacauuccauauaacuuugucccuacaguaaauaauuuuuuaaaacuuuucaucaaguuucaguguuacugaaguuaauuauagacaguaaggauuacagaauaagcaguaaauggucaccugcacuguauuuuucaaagcaaaaauuguuuuauauuuucuauguuguuuuauccugccccaaacacuuaaagcaaaaguuaaauauuuuuccaguuaccugaaacuucaaaaaucuauuguacuuugaaaaaacuuuaaaaagcagcaucauuuaaauagugguuaacucauaaacguguaugcaacaacauuccacaacccuaauaccacucaggccugcagagucaccagcucacaauaauucagugcucugaaagcuggggggaaagccccugaguaguaaguaugcaacccagggugucgggugcuuucuuguggugaaacaagggugucaaaacugaggggacucuccaagguccuaaugaaaagcagcuccucuaaacaccugaauccuuuuugacuccauucucaucacuuuaaggaugaagccuuucuguacaaaggcuuuguacagaaauuauuaaaaacuauauuuuacacuaaugcuaacagcuaauugagcagaaagaacuaugaaguacaaauuuuucuaagguuuucuuauuaauggcaauacagacuuuuuuuuuuuuugagacggagucucgcucuguugcccaggguggagugcaguggcgugaucuuggcucacugcaaccucugccuccuggguucaagcgauucuccugccucagccucccgaguagcugggauuacaggcaccugccacaauacccagcuaauuuuuguauuuuuaguagagacaggguguaguaguauauauucuacuauacuauaguagagaccacuauguuggccaggcuggucucgaacuccugaccccaggugauccacccgccucgaccucccaaaaugcugggauuacagguuugagccaccgcaccuggucggcaauauagauuaagguggggguuauuuccuaaaaacaaaaguaauccauaugucaucuaaugcaguuaaauuaaagaucaccuguugacacuauuugaaaaggccuugaaaaaaaaaagggggccauuauuuggaauauaaaucacccuuauaaaauucuauuaucuauauaaauuggccuauuuucaaauaauaauuuagcuauuucaauuaccauuuuaagcaauaaaaggcaaaaacaaagggaaccuacugaauuguacacuuaaacaugaauaagaagguaaauuucauguguauuuuaucacaacuuaaaaauuuuaaaaaauacugaaaaaaaaacaaaggguaacuuuuggauaauguaugauacuaagaagggcaugcaacuaaguaaucagacugcuuuuaguaagaaaauaaguuuuuuuuuuuuuuaauuucucgagacagggucucugucacccaagcuggagugcagugacacaaucaaggcucacuguagccucaaucuucagggcuccagggauccucccaucucagucuccuugggagcugggaguaggcaugugccaccaugccuggcuaauuuuuuaauuuuuuuguagagauggggucuugucauguugcccaugucggucucaaacuccugggcucaagcgauacucccaccuuggcuucccaguauugggauuacaggugugagccaccaugucuggcuugcuucucuuuuuguauucuaaaauucaaaggccuaaguaucaaaucccuaaaucuccaaauacugucacagauaaagacucaauaauaaacucccuccgaaaguuuagacaggcucaggugagagacuuguuucaagggguuauaaaaagaaacaccagugcucugcagaagaaucaguuuuuaauuuuuuuaauguaucuauuuaauggaauaaguugaucauagauuuguaaaccaaaagguaauuucucaaguauuuggaaauaagaaaaagccucccuaccaccaaccuuuuggucaucuuucucauucucuuacaaucauccuaauccccuaguacacccuuaccauauaucaauaagggcaccauaauauuaugcaaagaacagauauauaugccugaucucuuauuagacuugcaccagagacuguugaaccacuccaggcaugaacuccaaagcugaggcacacugaccaagccccugggcaucuacagaagcaaaggcguucucucuccagcuggcugcuccuucuggaagagcccuuuaaucuggguuaaucggccauagagccucucucucaauggaggaaugugguagcuaggguccagaauguuugucacucggcgcucucucucuugcuuccauaacuuguauggguggggagggaagaacggucguccucucucucuucgaaucuguaacguaauuccacuuacagccagcaugccccauacugccaggauaaugaagucuaaaaaacaguagaaaaaguacaguuugaacucuaguauuuuaaaaucuaacauaauaauacaacccuucauggacuaaaucuguauauuccuuucuaauagacuuucuggugaguuaguccaaacacauauguaguuccucaguuacaaaccaaggaaucaguagggaagccacagucuuauuuuugaaacuaggaauuuucuauuacaggcauuugaaaguccagacagguuguaaaaaaaucaguuguuuggauccuuggccuuccaacauuauguaacaaguacccacaguuguuuguguguuuuuucagaggggguucggggaggaaggcagugaucuaguuacacuucacauauguacaucauggaacaucagauuccaccacgcucauuucuuucccauuccacucuacauggggcccuacugcacucacaguguagguauaggaaugcaugaaaagauucaaccaaucguacucagcuucuaguaaagcuucuagcuuggcaaaacacugucugguacuuaaaacuugcaagaguuuuaagguuuucaaggauuucaaggucucuaccaucaaccucuuauccaaagggaaagcucuggauaguaaagggaaagauuugcccuaaaauaaaaucacaacaaucacaauugugcuuaugcaauauaucuucaauucuaggacaugcuuuuucacucuccacaugucaacauuucugaagucaacauaucuuacaaucugaacaauucaugugguagucauuuuuuucuucaaaaaauuuauagaaaaucuguaauggauagaaucuuacaagugagggaaacuauaugcuuacuaauuaaaaacucuuucaacuagcaaacugcaugcuucauuaaaggagggaaacaagggaauaacuuaacauuaaaucagguugucauucucaucccuuauuccauccccacccauaagucucaaacaucuuuacugucaguauuuuucuccccucugagaaugaccagguaaaccuaaauaaucuuggaaauuucuuaaugaaauucauuuaguagauuuuuaucuucaucuuaaaauuuuaaaugcuuuacucccaugauccugaguuaucauaacagaggguucucacagcauuguaugcuguguucccuccuuuugucccaguugacuuucuuuaaauuuaguuuccaagugcucugguuagcauaggugggucaagacuccuacugugcugucacacugguuuuuggauuuaagagucuuaccauuaguuugaaaaggcacauuugugaaagcucuguggaaauccuuguugagcgcucucuugaguacguucaaagugauguaggaaaggcuuguggaccaguaacugucaauggcuaaaaccaccgaauaggagccaaugacuccacaagucaguauguucagcuguggaagaguggaagaguuuaggcaucauccauguuagaacaaaaauaguuuauaacucuccacuggcuucaaucacaggcaaucacaucugcucccucaggcaugaaaaaggaccagacccacucagagcugaacagaaguucccuggaaagauaaacugaaaacaaccuucaacauccauaugaguucuuaaaacacaguucagcuuauccaaauacuauggaaaauaucuuccauaugaaggaacuucaacaauaaaaucuaauuagaggaagaaucacucuucugaagccaguugaaacuaaugacccaucagguugguguacuagaguaagcacuaccuucucugcucccacuguuaaaagcauauugacugugaugcuccauuugguggaaaaaaaagaaaaaaacaaacaccaugugguaaucauaaauagaacuucguuuucacaguaacaaggcuauuuagaaucagucaucugauacagguaacacagcccuccccagugaauaaaacaugcaaaaugaugaaauaagugaucagcugaacacacaggauaacauaaucaauaaaucuaacuuuugaugaaacacuuacuauucuuaggcagcccaugaaaacuacuggaaugaggauagcuaugcaagagaaagugacccagaauacaccaucaucaugaaaaaucuuuagguuuccugaaaaagcaaaaagaaacuaagaguaaacaacagcuuuaccaaguuagaguugguuucuuggaacaucugaacacagauauacaucaaagccuuaaaguaacaaccagggaauauguuggcaacuagaaaugaauucuaauuuucuucauuuaacugucaauacaaucuucuuugaaggauguguucuagaaggugggugggaggaaccaagcaggucaacgcucugcacuuauuaacaaaaucauuuagaagacacuggaauaguccaagcucuuccauucacuagcucugugaacuugagccucaguuuccuaacccucaaaaugacauugaauuauaucuccaagcucuaaaucaccuguuagcucuacauugcugacuucaugauuucauacugcaaaauaaaaaauacaaguaaaaggcauucaaaguuaagccaugaacccaauguaaacagugaguccacuuaacagauuuuuaccgucaaagcauguccugucaugccacugcacacugugacaugugauuuccucauguaucaggaaagaggaaccaaccaacuaucugcucuucccaaacccuucuccugcugcuggacucuaaaaugcugcacaacuuaggccgacccagaacaaauauaugagaacuccucuuuauaaauuaaguuuaaaaagcaagaauaggcugacugcuguuuaauacugacacuggcaccaccauucaguccaucuguaaauggccccauaccucaagaccuacauauccaggucagaguggaagacugggagucccuaggcuacaggacuggaccuugagacuccauauucucugaagccaacagcaauaugccauugaggugaacuuauagauucuauucucuaguuuaacuauauuaaccuucacaaaauacauauguggcuuucuuguaaaaggcuuucaagaaaucuaaguauugaaaauaguuacgaugcaugcaugugaagaacggacccuuucagagaauaagcucauugcuucccacauaaggugaaaacuagcaaucuaaucagauuguaguggucagccaaauauuuuuuaaaugcuaaugcuuaaaaauauggguaggccucuuggccgggcaugguggcucacgccuguaaucccaacacuuugggaggccgaggugaacagaucacuugaggucaggaguuugagaccagccuggccaauauggagaaaccccaucucuacuaaaaauauaaaaaugagcugagcaugguagugugugccuauaaucccagcuacucaggaggcugaggcaggaaaaucacuugaacucgggagguggagguugcagugaacugagacugcgcgacugcacucuagccugggagacagagugagacuccgucucaggaaaaaaauaauguguguguguguguguguguguguauguguguguguguauacauauauagguaggccaggugcaguggcucaagccuguaaucccaacacuuugggaggccgaggugggaggacugccugagcccaguuuaagaccacccuaggcaacagugagacucugucucuacuaaaaauaaaagcuuaccaggcauggcagcacacaccuguagucccagcuacuugggaggcugauguaagaggauggcuugagccuuagaguuugagguugcagugagcuaugauagugucacugcaguccagcaugggugacagaaagagauccugucucuaaaaaauaaaaauauggguuugcacccacuagcauugaggagaugaucacucuaacgguccuugagcuaugagauaguucauaaacaaacauauauaaaggguauaugcuaaaauuauuuuuaccaauaggaauaguuaugucaaaaaguuuagagacaacugcucuagacuacuuuauaaaguugaaaauuaagagaccucuuuauuucuguuuucucauuccucacaucuauccuaugagauaguuucacagaugauggaacaaaguuucaauacaucguccaagguuauaagcuagaaagggaacuagugacagagccagaaugcauauagaagguuuuuuccugacuuuauaauuuaugcucauucuccucaugaaaaguacauuaaauuacuagaaauuauaaccuaucaucccuccauccucuaagcauuaacaaaagaggggaagcccauuaaguaguaguugguuuuuguggucuuuuuguuuuguuuuugagacagggucuuguucagucgcccaggcuggagugcaauggcaccaucauagcucacugcagccucaaccucccggguucaagcaauccucuagccucagccucccagaguagcugagaccacaggugugcacuacaacaccuggcuaauuuuuuuuuuuuuuuuuucaguagagauggggaaucacuauguugcccaggcuggucucaaacuugagcucaagcaauccucccacuuggucucccaaagugcugggauuauaggcaugagccaccaugcucagccauuaggaaguauuuuauuuagcacauguaggguagagccuugaaucuguauuucaaaaacauccccaugugaaucugucauuucgccaagccuacacaacacugcuuuucaucagacuauccaguagucuuagaaaaaaaaagucuucagagagacaagggacacaugacuuguacucuauuauauccugcauucucuauagaguugacagccucaugaaauggcuauuuuuaugucuaacagucccaucaacuuuauucuaguauuuuaagaacauugucacagaaaggaaacaaccaaauagaauacuuuugaguacagaugcuguuuuuguuuguuuuugacaauaaucaggaaauguaaguuauuaaacaauggcaaagaaaguuaacuuauaaguuaaccagauuuuaaaaacugauagcaauugaauuacuuuuuaaaaacaccaaaaaaaccccagaaccagcccugugcuacugccccagggugauuaaguaccugagggacaccugggguuuggcagcggaugggaguggagguugaggguacaacagaagaccagaaacaaaguaccagguuccccgacucagcugccaucagagccuuuaccuccuuauuuccuuuaccuccauuauuucuaauaaacacauaccacuuaucacaacaaauagauacaaagcuaccucuaaagacauucuauauuucaucuacugugccuuugaggaaggagggacuuuuacuaguccuggugcugucugaaagugucacaccaucaaugcagauuuccagaacuccacaggagaagcacugacaugcaacaccacuccaggaugcaaauccaauuaggcaguauucaaacagucacucgaacacacaaaacaucuguuacauaucgccuacccaguggaguaaagaaagucacugacgagaugaggaaccccagcacuaguccaacacagagcaugcagaucgagaggauuccaaaucgccaccacacagcuaccaagaacauuccaccgacgcuuccagugacagcugucagaaucagauucacuguacaaagagagaggaugaacugcuggauaaccggcaguacuuccaaccgcgugccuuagacauacaauaccguuaccagugccagcuucagcuuucuguaggucaggcacugagggcucuucaguggugccaugaagccagcauagagcaacccucucuagggaggggucugggcugagacaaggaaauuagcuagggagcuaaaccucacagggccagugacaggcuuggcuugucaauaaauugggauugagaaggaaaaguugacaagcauucuguuaaacauaaugggguagggagguaucuguuuucagguaaagaaaaccucaacauuuugcuuguuguacaucucauaucuucaacauaucacauagccagaacacaggucuauaaucaauauggccccuccuuucccuaaguaccaaggaauucaccauacagauuaaaaacccagaaggucugaaugaguaguucagaaaagguguucagagacuagauggaccauuauuuuacauaaguaauaggcugucacacacaauauaggccaaacuguagaaggaaaggugaaguaaaacacagcaccugccuucuugaauacccaguuaaacuauauaauuuucacuuaccaucauacuugauaggugucagucuuguaaucaguauauaaaagaagaaucccaugaugauaaagccuaugaagaauaauucuaaguggcaaaccaccaggaaaggaaaaaagcaaaacaacaaaagcuaugguuaagcacccuuuuuacagugcaauuuaaauauuuaaucuacaaauacaugcuuaagcuccuggaauuuacauguuacagcauucagaagaaaaaaaaaaucuaaaaggcagaagaaauucagcagccaugggaguaauuauuauuaaacagauacaauauuaaaguaccaacuacaggauacacuuucuuguauauaggucaguuuccauuguuaaauuguuauuuguucauuucauagcucauuuuaauauauuuauguuuucugcuuaaaauaagaauagcacuuugucacguguaugugauacgaaauuacacauuaaauuuuaauaguuuuguaagcagaaauaaaauguaaaagguaaaagaaacccaaacugucccaaagcaaaauauaacuuuuauaucuucuuuuaauucauccuauccuguuuagaaugaucaaucauuaccuucauccauuaaaacaccugguaaugcaaguauacagauaacuuuguucccacaaauaagccuaauccugaucauggaggccauagcucuaccuauuuucuuaaauucuucacagcuguucuugguaauacuuguacuguaucucaauuucaauaaauauaaaaugauacauaucaacacaccaaaaaaacccagagugaggcaugguggcuugugccuguagucucagcuacuugggaggcugaggugggaggaucacuugaggcuaggaaugugaggcuguagugcacuauaauuguaccugugaacagccacuacacugcacuccagccuaggagacacagugagacuccaucucuuuaaaaagaaaaaaaaaaagcuagugauaacuuugagaccacagcuuagcaacuaaguucuuuguuacagaaucauucuacauguugagauauuauauauucuuuacaauacucucuucccaauuaauaaaaaaagugucauaauagcaggaaaggaguugcuauuucaaacaauuuaacauaaguuuaaagagcuuuauuagaucaggauuacauuugagcuaccuugaugcucaguuauacaacuuguugauuaaauaaggauuuuuuaauaaucgaaaacaucacuuauauaaaaagcagcccaaauaauucaaaccaauucagugagcaugauuuacaucccaguucuucaguguguuucacugauguugaugcuggcauucccuuuggcaucugaaucucucaggacugagcagacauuucaaacucacuguacacugcagccccauagccugauucaugugaaaccaagucaaucgccaucaccaauauccacacauauuuuuacaaagacaaccaacuucuuuuuuuuuuuucuugagacaggaucuuacucugucauccaggcuggagugcaguggcacaaucuuggcucacugcaaccucugccucccgggcucaagcaauccucccaccucagccuccccauguagcugggacuacaggcacacaccaucaagccuggcuaauuuuuuguauuuuuuggagaaacagggucucaccgaguuacccagguuggucucaaacuccugagcucaagcagucugccugccucagccucccaaagugcugggauuacaggugugagccaccacacacagccccaauuugucuuuaauuuuuugguagagaagggaucucacuauguugccuagacuuguuucaaacuccuggccucacacaguccucucaccucagcuucccaaagugcugggauuacaggcaugagccacugagcccggcccugacaaccaaugucuaaucucgguuaucuuuagucaacuaacagaucuagcagcugauaaaauucacugcauaauuguauuccccuguuaauaagagaagguuauacuccgcuguagggagaauagaaaaaaauaaaaaugcauugcaacucaguagacucacgacuacaagaccccagcuacaaaucuaugaagauaguagagauaaguaagugcuuacucuccucacaggucauuccccagcaacacugaaaagacugcaaaauggaaauagcaacuacauuggacauaauaccuguuuuccagaaucuguguccaaagaaacaaaugaagaaaccaagcagggcaaaaagagugaagaacacuuuggaagacacucuuccuaaaaaauaaugaaaauuuaguggauaauacauccaauuugauacuuuguauuaauauuuauagaacgaaccuucaucaaaaaagcuaagugaacugacauaauuuaucccauacauguauauuacaaauuuaucuuuaaaauacucuugccaccccuaaugaaugaaccuauguagacaaucaauaucaacaacugcugcuauaacaaaaagagaauccagacaauauaugcuugcugauagcgguauggaacacuuccuaugacauauuccuggguaaaguggagagaaacagagagagaguguuccuaaaacaaauaauccuguuucuucaacaaauaaacugcauggacaaaagguggcagggagugggggggaggugguggggguggguggagggagaauacagguuaaaagagauuuaaaagacacaucaacuaaauacuguguauagaucucaucugcaaccugauucaaacaaacuguggaaaacaauugagaugacuccagaagcaaacucuggcuguuaauuugaugcuauuaaagaaauauuuucaauauuuuaaaaugaaaauuauguuaaugacacggugguucuauuuuuuaagugcuuaucuuuaagguauacauacugaaauauuugugaguaacaugaugaccagggauuugcuuuaaaauaauccagugauaaaggagggugaugagguggagaggcagagaagcagguacagcacagcugaaacaagauaauggccauaaaucaaaauuguuaaggcuggauaauugguguauggaggcucgcugaaguuuuucacaauaaaaaauuuaaaccgaaacucacaauuuaaaaacauguauuacacuuauaaguuauuuauuauaauauuuauuacacauacacaaauuacuaccagucuuaucaauuauacauauugccuuggagaaaaauguugcauuacaaccaaugaugaagcacgguaucauuuaguuuacugaagagaaaaauaugcucacuaaauucaucacccaccaucaugagauaaacccaagaaaauaaucccugaacuaaaacccaaaacaagacaucuauacaaucucaugcuaaaauaaaacaaggcugccacaaaucaaaauacauaaaaugccuaagagugcucagaauggagaaaccaugaagacauacaguaaaauaagaaacacagacagaagagcagaauucacaggggauauaauaccuaaauaucagcuuuucugagaauaaggagcccauaagaaagauuaaacaacagccgggugcaguggcucacgccuauaaucccagcacuuugggaggccgaggugggcggaucacuugaggucaggaguuugagaugagccuggccaacauggugagaaccccgucuacuaaaaauacaaaaauuagccaggccugguggcacaugccuguagucccagcuacuccagaggcugaggcaggagaauugcuugaacccaggaagcagagguugcagugagccaaggaucaggccauugcacuccagccuggaugucgcagccagacuccaucucaaaaacaaaaaacgaaaaacaaaaaaaaaaaacccagaaagauuaaacgaaagauaaaaacaccacauuguuuauuucagaccugugguugacuaucauucuagaauuuaauuuuuacaccaaaaccauuaaauuugcugggaugauuuucucaaaugaaaaucccgugaacuuuucagcaaguauaaucaccaagacagcaaggucuuccaacccaauaaaaacuaagacacaguuagauacucuuccauaacauuagaggggaacuaaauccccuaucacaauaccaggaaggagggagagaaacaauuauacaaguaaaaugagaggguauggaagguuccaucaaaagcagaaucuacgauaaaacaagacauaaaacaggcauucacucugggggaaugaaaggagugaauagacuaggacaggagcaaguugaagguuaaagugucuuuaacuaugacaguauugcuaaggguuaugaaccacagggcaagguuuuaguuaggaggcaauauggauauagucucccuacuccaagcucaggaaaagcacucuaauacucaucaaucuugaaaaugagaguaacaauagaacuaacaucacuaggaagguucaacuuugggcgggaagaacaacuggaucagagcucucugucuccuaagccuaacagagagagacaggccugggggccuuucuauuuagaaggggcuuuugcaugaaggguucaagggaaagaaauggaggaacccagacauacuucaguccaucgguuaaaaauauauggccaggcgcaguggcucacgccuguaaucccagcacuuugggaggcugaggcggguggaucacuugaggccaggaguucaagaccagccuggccaauauggugaaaccccaucucaacuaaaaauacaaaaauuagucaggcaagguggcgcacaccuguaggacuuugggaggccgaggcgggcauaucaccugaggucaggaguucaagaccaaccuggccaacaugguuggucaggucucuacuaaaaauacaaaaauuagcaggguguggugguacacgccuauaaucccagauacucuggaggcugagguacgugaauuacuugaaccugagaggcagugguugcagugagcugagaucaugccacugcacuccagccugggugacaagagugagacugucaaaaaaaaaaaaaaaaaaaaaaaaaaaaaaaauauauauauauauauauauauauauacacacacacaaacauaucugccaaggucucuugcauuguaucccucaaggaucuugaguggaagauugucuugaguggaagacugaguggugacaaagagccuuugcuuggccaaauuucuuuuucguuuuuuuuuuuuuuuuuuuuuuuuugagacagagucucgcucugccgcccaggcuagagugcaguggcgcgaucuuggcucacugccagcuccgccucccggguucacaccauucuccugccucugccucagccucccuaguagcugggacuacaggcgcccaccaccaugcccggcuaauguuuuguauuguuuuuuuuuuuaguagagacgggguuucacuguguuagccaggauggucucgaucuccugaccucgugauccgcccgccuuggccucccaaagugcugggauuacaggcgugagccaccgcacccggccugcuuggccaaauuucagucuccugaacccccuccuaggcccaucugcgcacaucuuuguaaaauccagcuucagcaagaacucugauaagucagcuuagcaagaauccccuaugcuugauaucaaaucacccucgauaucuaaucgaguucuucauccuccaccauccaucccccaggugaugucugaccacccuggucugucuucaguaagaauccccuuaggucagugcagacagaaugcccccuugccccucauguuuccucuuagaaauuuuccauccacugacucccacccuacugcuuggcuacaaauucccaguagcccauguuguacucaagaguugggcccaaucucucuuccccacugcaaaauuccaucacaguggucccuaugccuauuguaauacuaccccccaccuugaauaaaaucuuccucacugugcuuuaacuagugucacugauuuuuuuuuucuuuaacagcgggauacggcucuagcagagguagagaaccauaaucucucgcuugaacacaacuaauagacuuucuucuuuagagcaaagcuccuugaaagagcuacuugaacuuucuccaguuucugugcucccagcuccuauuuguucuugaauaugcuccagucaggcgccuaccccaccucuccacugcaacagcucucacugguaccaauggccuccauguugcuaaauccaagggucauuuucagucucuuucuuagcugaccuaucagcagcaucugccaaaguugauuacucucucuuccaugcaauacugucuccccuuggcuucaacauacaucacuuuccuuuuaccaaucuggcugcagcuucucagcccauugguaggaucuucaauuuccuaagcucuaaacauuggagcacccagggcucaguccucagaccccucccuuuucucuaagucacacugagugugccugccucucccaccuccccuuccaccucugccuccccuuuauagauaacaccauuuagcaugaggccuuaaaugccauauauucagucugaagauuuccaagaugcucuccagcuaagacuuuccucugaauuccaggcuuauauauauaaucaaccaucaguuaaacaucugcacauaaaugcucaauaggguucucaaacugaacuuguccaaaacugaacucuuaauguauccucccaaccuucuccuccaacagugcuucccaccucagcgaauggucgcucucucucuccaguugcucaggccaaaaacuacaaaguccuuuacaccucuuucucucaaaccccucauccaauccaucaguacacuguacuccaaacauauccagccacucaugagccaaaucuggaacaauuugaacaugaaaauaaaugauaguaaaggauuucauccagagaauaaaauaggaaucuacagguccagguuuaaaauaaauacauggauaaauaaauggcaggggagggaaaacccuuccucagagcaggauggcaacaaauaaacauagaaggagugauacauuagagaaacaccauuuggcaaccaccuaguaauaaauguuucaggcaaagaucacuggaugccaaaacuagcaagugagaguuugagaaugggauauuuacugacacucgaaguaccuccccuaaagacacuuaaaaaaaggaacaguuacuucaguggagaaacuuggcaagacaccaauaaccaagucaucaaggaugucaccaccaguaaagagacaaauaaauaaagagacaagugucuccugagaaggacacaucacuuccuuuguauuccugccaaaaaagcauaaucaaaauuuaauuaugaggaaauaucaaaguaacccaaauugaagacauucuaaaaaaaauaaauauucuguacuucucaaaaaagucaaggucuuaaaagauuaaaauuaaaaaaaaaaaaaaagacuuguuccagauuauacaacuauaaagagacacaucgguuaaaugcaaugugggauccuaaacugaacccuggacaggggaaaaaaaaauuuguugacggggagacggggucucacucuguugcccaggcuggagugcagaagcacaaucacggcucacugcagccucaaccuuccugggcucaggugaucuucccaccuuagacuaccaaguagcuggaacgacaggcaugugccaccgcacccagcuaauuuuuguauuuuuuguagagacggaguuucgccauguugcccaggcuggucuugaacucuggagcucaagcaauccgcccaucuugaccucccaaugugcugggauuacaggcgugagacacugcacccagccaaaaauaauuuuuuuuuacuuauaaaggacacuauuggaacaacuaguaaaugugcuaacgugugaauuaaauaacuacuguaucaguguuagcuucguaauuuugauaauuuuacuaugguuauguaaggaaauaaauacagaaguauuuaauggcaaaaaggucuuuaugucugcaacuuacucucauaugguucagagaagaaaauuguguguguguguguguguguguguguguguguguguacguaucuauacauacacagucggccccugaacaacacggguuugaacugcauggguccacuuacauacagacuuuuuuucaguaaaagucacacugagugugccugccucuccuaccuccccuuccaccucugccaccccugagacagcaacaacaaccccuccucuuccuccuccuguuccuauucaaugugaagacgaugaagaugaaggccuuuaugaugauccacucucacuuaaugaauaguaaauauacuuucucuuccuuaugauuuccuuaaugacauuuacuuuucucuagcucauuuuauuguaagacuauagucuaugauaaauauaacauacaaaauauguguuaaucaaguauuuauguaaucaauaaggcuucucuggucaacacuaggcuaauaguaguuaauuuuggggaagucaaaguuauacacgggugggguaugguggcuuaugccuguaaucccagcacuuugggaggccaaggcggguggaucacuugaggccaggaguuugagaccagccuggccaacauggugaaaccccgacucuacuaaaaauacaaaaauuagccagggaugguggugugugcuuguuaaucccagcuacucaggaggcugaggcaggagaaucacuugaaccugggaggcagagguugcagugggccaagaucaugccacugcacuccagauugggcaacaggagugaaacuaugucucagaaaaaaagaaaagaguuauacacagguuuucaacugcacaggagucggcucccccacaaccccuacacuguucaaaggucaauugcauauagagagagaagaagagagaaugaaaagcaaauagccuaauacauuaagcuuugaggaaucuggaugaagauuauacagaaauucuuuauacuauuuuugcauauuuucugagaaaccauuucaagauaaacugcuaaauacacacacacacacacacaccccucacaacaccuucacugcccccauucuaccuaaccuaguuaucucuccccuggauuacuucaguggccuccuaaccaaucugcauuucugcucuugccuccgucuuuucucaaaaagcagccagugaucucauuaaaauaucuuagaucauggcaccauuugcucaaaaccuuccaaugccuuucccuuucauucagaauagaagcaaaaucccauacuacagucuacaaggccacacacaggcugccugccccugcaccucucaccucaccucuacuuccuuugcccuccucguucuccugcaaccccugucaucacugcaguucuucacacccucagacaggcucccaggugcaggcccucauccuggcugcucccucugccugguacaugccacacccagguacgugcguggugcaucaaggacugcccuggccaugcuaucuaucucaaauuuuccucuuacuggcauguguuaucucccuuuccuacuuuauuuaucuucuuagcacucaccauuuucucacguauuacauauuuuauaaauuuaucuugucugucucaucucccucacuauaauauaagcuccagaacaaguauuuuugcuguuuuguuuacugcuaugucccagugccuagaacagagaguggaauaacguaggggcucaaaagguauguguugaaugaaugagaacuagacaaaagcauuaucugcaaggccaaaggagaauuuguaaaaguuuaaagccacauacucaccuagggaagcacaacuacccucuccugccucaaagcugcaagcguaugugugagcaggaauguaggcagcagauguauuuagaaacgggucccaaacaaugacauuguauaugacaccuugucccgggagggaggagaaggaaacacuugucuuaucauuagcuguuaggguaaccaccugaagccaaaaauaacacaugauuaguguuuaggggauuuuuuuaagcuauucugugauaaucccaccuacguguaauauuaaaugguauauucauaaauuauaauucuugcuuaaaauauacaccaacccauuuaauauggucaaaaggccaucuuacaugguuuguaugugcuaauguaaacaagcucucacacaaaaugcuuccaaagguuuuuuuuaauaguuuaaggaaaaugcgauauaaacaauguauaaaugcuaguuacgaccaugaaaaaaguuuuuucaccucugcuagacuauaaacaaggaugggaacuguauuucucuugugcacugcucuuuccucaguguacagcccaaugccuaacacagaggauguguccaauguuagccacagacuaacgcagacagucuguuaacaucucgcagacaguacccacuuauuuuugucuaacagucucugaaacaagaaaauauuacaugagguuuuguuauguaguaguaguucuuuuuuuuuuuuuuuuuuuuuugagacggagucucgcucugucgcccaggccggacugcggacugcaguggcgcaaucucggcucacugcaagcuccgcuucccggguucacgccauucuccugccucagccuccccaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccaguaguucuuaacuucagaaauuccauuguaaacuauaaaauagaagaaacaaaugcuuuauagaaccauaauaccuauguuccuacuaauuugagaaaaauaaauauuaggguuuuaggagaaaauuauuaugagcccuccuacaucagacuaccauuguuuaaaaauacugcuuagccuucaauaacuugcuuccugggcaaaggucugguaaaguucaacaaacuguuaauauuacucccaaguuacaaugaaaaguuuaaaccagacagaaaaguugaaugaauaacacaauaaauagacuauauacugccuaauaucaacaauuguuaauauuuuacauuugcuucucuaucacuaguuucuccccaacucuacuuuuuuccugcugaaaguaaguuacagauaucaugacauuucacuucuaaacacuucacugugcauguccuaccacaguguuucucaaauuuaacgugcuugugaaucgcagggggcagucuuguuaaaagguagaucugauucuuaggucagcgugguacuagcaauugugccuuucuagaaagcucucagaugaugccaaugcuaugcaaacaccuaccacacucugaguaacaaguuacucaguacagauguaagucuaaguacagacuuacaaggggguuacaucaggauaaacccaucguaaagucaaaaugcauuuaauguaccucacccaccaaacauuauggcuuuacccuagccuaccuuaaaugugcucagaacacuuacauuagauucaguugaacaaaaucaucuaacacaaaggcuauuuuauuuuuuuauuauuauuauuauuauuauugagacggaaugucgcucuguugcccaggcuggagugcaguggcacgaucaucucggcucacugcaagcucugccucccagguucacgccauucuccugccucagccuccugaguagcugggacuacaggcgcccgccaccaccacuacgcccagcuaauuuuuuguauuuuuaguagagacaggguuucacccuguuagccaggaugggcucgaucuccugaccuugugauccucccgccuuggccucccaaagugcugggauuacaggcgugagccaccauguccggcccacaaaugcuauuuuauaauaaaguguuuaauugcuuauguaauuuauugaauacaguacacuguaaaauguuagcuauuacccgugugguuaagcaggagcgauggcucacugccacugcucagcguugcaagaguaucauacuguauauugcuagcucaggaaauuaucaaaacuaaaaucaaaagaucauaagucaaaccaucauaagucagggaccaucuguauaagaauauucuccuauauaacaauaccuuagcucaccuacgaaaaugaauaauuucuuauuagcuaauaaaugauccagauuuucccuaaugucuuuuuuuuuuuuuuuuuuuuuugagacagggucucacucugucgcccaggcuacagugcaguggcgugaucucagcuuacugcaacuucucccaggcucaagcgauccucccaccucagccuccucaauaucugggacuacaggcacgcaccaccacgccuggaacuuuuugguuuuuuuaguggcugugagguuuugccacguugcccaggcuggucucaaacuccugagcucaagugaucugcccuccuuagccucccaaagugcugggauuacaggugugugccacuguuccuggcuccuaacaucuuuucuagcuuuucuccuucuuacccaagaucaaaccaaguuccaugcaugguguuuacggccaaucucaguaauccagagcagucugucccaccuuucucucccagcuacccaaugacuguagaagaugugaagucaguauucucauaaaguauuccacaauuuugugucuaacuuauucuuuuaucccccauauuuccuguaaauagggaauccaauggacuaaauucagguuagacauuuuuugcuagaauauaccacaggugauggugauaaugucagacugcacuacauaagcacguaauacaggcugauccauuuucagugaaacuagcuuugcccaccuggaauagguggagacuauaaggucacuccauguuaaagugguucuccuuuuacaaugagaauuaaucuaaggaugcuacuuagacacccuagaaauauccuguuccccaaaaaccuuucaccugcugauccuugcuggaauuauuucauugagggucacaaaauggugaucaucuaauucuauuauuucuucuacauauauuagccagcacucuucugcaaagagcuuucucucaccaacuggggaagaauuaguuccuccuuuaaaaaggcaagcuaaauuucuuuaucaauuuuuagaguaauuugcuguaagagucuccuccagugguggcaacugaggaagguuucauuuguauuuauucaaggcugacaaccacagucuuuuucuugauucuugaacugccccaaauuuggcagugcaagccccuucaaacaggcuccugaaucucuuugacauacccucauuagucuuugaggguuuccccacauucugguacaaaauauucuuuuaacuaaaaguuuaaaaguaaccuacaaaaagccuauuauacaaguucuuauauucuucauaaaaauaauaauaguauuaaaaugucauaucuaauaaagcaacuaauaaacuuuacuaacagagcuucuuauuuugugaauaagcacaaugacgcugucuagaaaaacuccacccaucaaccauuagacugaaggaugaccucauauauuauauugcuguuaggcacuuuucaagacauaaagauaaaauccugcccuccacaaaaaugaucuauugcagugagucucaaaauuuaauaugcauaaaaaucaccugagggcuggagugcaacagcaccaucugggcucauugcaaccuccaccuccuggguucaaacaauucuccugccucagccucccaaguagcugguauuacaggcaucuaccaacaugccuggcuaauuuuuguauuuuuaguagagacacgguuucaccauguuggacaggcuggucucaaacuccugaccucaggugauccacccgccucggccucccaaagugcugggauuacaggcgugagccacugcacccagucagaaucaccugagggauauaaaaugcaaauucugauucaguaguuccaggguggaguuuaagaauuacaauucucacaaacuccccagugaugccaaugccacugguccaugguccacaccuggggagcaaggguuuacauggauucaaaagcucagagaagaauuuuacuccaaguuagacuuugaguuuggguucaaauaugaaugccaauguguauauccuuaagcaguuucucauuauuuuuuucucaaaacaauguaaucuucauacuugccaaaaauguuuacccaguagucgugggaguacacagaaaauuaccaccuccuuccauucacauuucagauuaccaagucacagauguggcugcaacuaaaacguaacauaauuuacaugcaucuccucaaaggccaacaucauuuugagauaucaccagcaaagacucccaagaugauaacaaaagagaauaaagugagugucccccaaaaaggagaaaagaguaaagaaauaagauccugguagcuucuccccuucucaacucugacaaaggugucacaauccagccacacaaaucaugggacucagauuuaccuugagagcacuggccuucaccuggggcacacugaccauccucugcagaugcuucagcaacaucuccucagugaggucauucucaggcagaaaauacugauagacaucauacugcaaccuccaccuggaguccuggucugucccagcgucacauggugggggaucuacgccucuaaagucaaccaacaaaaugaaacaucagucucuuguggugcaagucccaucuauaaaaaggaaccaagagcccuaauuucaaacacuugcaacaauaauuacaauuuaacaguucaccuuuugcaguggcaacaauugguauucugaagaaaaguaaugcacuguuauggacugaauguuugugucuccccaaaauuaauaugcugagacccucacucccagugugaugauauuaggaggugggaccuuuggaagguaauuaggucaugaaggugaagcccuaaugaaucgaauuacugcccucauaaaggagaucccagagagcccucuagccuucuuucugucauguguggacacaaugacaacccagcagucuguaaccuggacgagaaccuucaccagaacucaacugugcuggcauccugaucguggacuucuacccucuagaaccaugagaaagaaguuuauaagccacccagucugugcuacuuuguuacagcaccacaaacuaagacaaacaccaacaggcaaaggugauuacauaacuggauucugauaucagucaggccuagaguaaaauacuacagcucuggggaggcaaaaaaauuuuuuuuaaaaaaaagcugggugcaguggcuuaugccuguaaucccagcacuuugggaggcugaagcaggaggauugcuugagcuaagaaguucaagaccagccagggcaacauagaaagaccucaucuuugauuuaaaaaaaaaaaaaagaagaagaauauagcagauuugucauuuguuagcaaguaggguaaccuccauaaccccuagggaaacuuucuguaaaauaacagcaauugcccuucuucauaaaauuguuaggauuaaauggcaaagaacauaacaacacucagcaccacggacaaugcacaggaagcauucaaguguucucaaauguuagcuaucauuacuauuaaagcagaaacugaggcacagcuuuaauuaaaacaaugaaucuuuauaaaaauaaaaggauguuucagggcuacugagugcuaucuauauuuaaagugcuuuauaaaaaccaggauguauuuucaagcucauaauagacucacaucuggcucuucaaauaaaaagaguucacaagaaugaagugggaaaauauuaacuguaaaugacaguccaaauauuaauagugaaguuuaaauuacaucaauuccccccaaaaauuaacucaauuuuacuacagagaauuagggacuugagagagcuggucaaaucuacacaacugucgucauguauauucuaaaagcauuucucagacaugggagacagacguaccucgcauagccuagguuugcuggggcaaacuugauagucguuucaaagaaauuauacuccaaguaaauguugggaucaauaucuaaaucgaacuccaaauuacagccuccagggacaggaucuggauaagaaauagggaaguuacuaaacaaacaauuccuacauauccaaaucauacucagaaaaacagaacucuaucuacucuuacaaaaacuucccaaauagaaguuaaauauaaacguagagcuucuagucguauacuauuucaugaacugagguuaaagaggguagaguuaacugagguucagggcccuagagcagggcagagccaaaauuuucuguaaaaggccuaauaguauuuuaggcuuugucagucugauggucucugcaguaacuacccaccccaguccuuguggcaggaaagcagccacaggcaauacguacaggaagaggcauagcuguguuucaguaaaacuuuauguacaaaaacaggcagcaagcuggaucuggcucauggucuguaguuugccaaccuuuccucuagaguuaaaaagaucggcuauugguugacuacuucuggccagguuuggaaugcagauacacaguguguauauauguuucaauaucauguuggaaucuuccuccaaauucuaugcucuucuuucauacucuccuuuuucugcacuuauggaucuuuaccacaccacaaaugguauguaugccagcugaagcuccucuguucauaauuuuucuuuguacacuguccuugacgcaagccuuaauuaagucuaugguuucuuaucagguaauuagccuuuuguuauagcuaacauuuccuaucuucuacuccaguaaucuucuggauucucccuccuuuccuaacuagcgcucccucuccuucccuuuacccccaagcuuuaagaguagucuaaauuuauucaccucaccuucacuccuccaucccuguugugccacuaaagugacucucauaaagggccaccgcugacuccuacuugcucuagcauacggacacuuucagucaguucucuugaccucuccguagacuguaacuuaccacuuccuuuuuuuuuuuuuuuuuuuugagacggagucuugcucuaucacccaagcuggagugaaguggcgcaaucucagcucacugcaaccucugcccaccggguucaagcaauucuccugccgcagccuccugaguaccugggauuguaggcaccugccaccacaccugacuaauuuuuguauuuuuaguagagauagaguuucgccauguuggccaggcuagucucaaacucccgauuauauaaauuauaccugcaaccugcuucggccucccaaagugcugggauuacaggugugagccaccgugcccggccugcucccuuuuaaaggcagaaacuccaggcuuucuuccuaccuucuugacuacuccacaguguugugcuuauuccucaggaguuauuauccaccagaaacagugccugacacauaguaggcacuaguaaaguauuugcuaugauuuuuuugcccuaaauauccaaguacaugccuggauaaucucacucacugccacagcuuuuauuaacagcuauuuaguugggaaucuaaucucaccccuccacuccaggcccuuauuuaaauuauguacucugcauuuccauccaaauguccuacaagcaucucagacugugucccaaacugaagucaucaccuacuccgucccaccucccaaaacauccagcaccaccauaacccuguuccuacaccuauuuuguaucacuauuucccugcugcccaaauaggaaaccuaugcuucccucuuauacuccauaaccaccagucauuguguuguaucaauuccaccuucuggauaucucaaauccugcuccucuucuccaucccgccucucauggccucuguucagauccucauuucucauuuugugcugaguccugacucugcugcgcccucuccaauccauccccacacuacuucuagaguuagcuuucuaagagaugaaauggacuacaccauuccucugcuuaaaaacucuaugccuccuuagaaccuaccucgaaauaaaguacaaaccucaaauuguaugcaaggcccuccacacuccagcugcagccacacucacaacgugccauucuccaaaucauuuuucuucaugacgucgagcuuacugcuucugcuuagaacaacuaaacuguuaaggacuaugucuugccuuaacuauuacugcuucuccaagggcucccuaaauguuuuucgaaugaauaaacauguucuccuagucacuaccugagcuuucagucaucgugcuaauucucuuacuauaaaauauuucugauuauaggcugggcgcaguggcucaugccugcaaucccagcacuuugggaggcugaggcgggcgaaucacaaggucaggaguucgagaccagccuggccaacauggugaaacgccaucucuacuaaaaauacaaaaaauuagcugggccugguggcgggcgccuguaaucccagcuacuugggaggcugaggcaggagaaucgcuugaacccgggaggcagagguugcagugagccgagaucgcgccacuacacuccagccugggugacagugcgagacuccaucucaaaaaaaaaaaauccgauuauauaaauuauacuugcaacaaacaaucucaauaggauaauuuuccuuaaaguuucaugaacacauuccauauuccaaagaguaagagggaggagaagacagaaggguuaccucuuucugaguaggagaguaggauagccauauucuggacaggcuguaugccugaaguccccaaguaccaagugcauguacucugcucuggucuaaggaugaaaaccaguccacuggcagugccuguuuccgaggaauuggaaaggagagucugcaguccagaagaaacauugucaugaauaggaagucgaccaaaacauaaauuacugagcugauccagugugcauguccuauuccaaaucuucccaaaacaaauagaaaaaaaaaaccuuccuuaaauaaccagggaauucuuuucaucucuauguucacaugcccacacauauacauggaaaaagcauucuugaaaaauauacgauugucuuaguuaaggcugcuauaacaaaguaccacagguaaggugguuauaaacaacagaaauuuauuuucgcaauucuagagucuggugguucaugauagcggugccaacacagucggguucugaugaaagcugucuuauaggcugaagacucccaacuucuuguuguauccucacaugacagagaaagggcaagaaacauaucuggggucccuuuuauaaggccacuaaucccauucaugagggcucuaaaugggggcccaugaccuaaucacuucccaaagacuccacuuccuaauauaacacacugaggaugaguauuucaacugugaauuuugugaagacacaaacauucugucuguaaaaauaaucuuugaucaggaauagcagaugcacagugaaauucccaaguguuucaauuaauuugaauuaagauuuacuaugucaaauaauguuuuaucuuaguuucuaagaccacuaggacaaaaacaugagaccuggccccaaggaguucaguuuucgagguaccuuuuaaauuguguuauaacugacaaacuauaaacuguacauaaaguauaauuuuucuuuuuuuuugagauggagucucgcucugucacccaggcuagagugcaguggcgcgaucucagcuuacuacaagcuccgccucccggguucacgccauucuccugucucagccucccaaguagcugggacuacaggcgccugccaccacaccuggcuaauuuuuuguacuuuuaguagagacgagguuucaccauguuagccaggauggucuugaucuccugaccucgugauccgccagcaucagccucccaaagugcugggauuacaggcgugagccaccgugcccggcccauaaaguauacuuuuaaguguugauauacagacaccugugaaaccauuaccacaaucaaaauagcaaauguaugcaucaccccaaguuuccuugugccccuuccuaauccuuccucacacacuuccucucuaccaucccccacucccaucugcuuggaaaguuuuuugaauaauaaaaugcuaagcuaaaagguaacagacucaagagguucuaucaaagcuaaggaaaugggaaggaaaagguagcagaguaguuucaauuugauaagcauaagaaagaaugacucaaauauuaauugauaaaugaucaagucaacaguuucaaagagccaauugccaucacgacucaaaaaaaacaaaagugccacacuuuauuaggaagggcacaggaaacagaagcacuucucuuuacacagaccacucacuuccugagccaugugcaguucuggccaucaucuucuaaguaauauaacagugggaacuaaaggcaguccaagaaauaaaaugauaauuaaggacaacuaagacccuuucugcauagaaaucaaggcccaagaugcugccagcuaggucuguuuuaucacuggugaugcugacaucucuuuauccaaguucugcuuccucagauguagaaauaggcaucacuacuaauuuguugagcuuuaaugagaauuaaccauauggaaaccaaacacagggguuccuaacugggggccugagagucugaguuuuugaagggccccaugaaauuuuauauuuauauuugaguccauagacuugagcagucuauggcuccaggagcuuaagaaccacuggccuaggacauagcaggcguucaacaaauauaaacccuuauuucacccauccucucucuuuuccuucaaauguugucuugcuguaaugucauuaggaagaaacacacuguuugucaauuaaaaauuguuuuaauagaucuaguuaaaaaagagaagaagaaagaacucaucuaugugccauuuuacuaagucuccuauguaagagucugaauaggaagcugucuuuugaauucagugccauaaaaaacuuggccuccccugaggaacuggcaugcuccuuccuuucuaaggaaguuaugaaauuuaacaugcuuuaccuucugcuuuagcugcaaagaacuugggcaaauucgacguaugugugacaucgguaucucuuguaauuaauacuauuuauuccuuuccuuuuuuccuaagcugaauucuuccauuucuagucuauuaacuaccccccuacacacauaccccacaacacacacgcacacacgugcacaaccacaugcacacaauuuccaaaccucuaugguaggggaaagaaggcaggaauaaaaauacacaaaauaguaagaaagauagugugaccaaugccucuaauauuauauaugggcuggggcgcaguggcucaugccugcaaucccagcacuuugggaugcccagacaggcggaucacuugaggccaggaguucaagaccagccugggcaacagagcaaaaccccaucucuacaaaaaaaaaauguuaaaaauuagccaaguguggugacaugugccuguaguuccaggaucacuuaagaccaggaauuugagccaugaucacacgaccacauuccggcgugggugauggagugagaucuuaucucuaaaaaaaaaaauaaaaauuuuaaaaauuuacauaugaauuagauuaagacagaauuguuuaccaaauuccagaauauuauaauauaggcuuaggacaaauaaaaagaaguauaacuucauacaaggugaaaugcauguauuggucuagggcaucauagagacuaaaugcagauagauuguaaaagauuauauaaauggcagacucuucauagcuuaaacuaacccagagaauuuuaaaaacuuucuaaggcugagguugagguuaagggguuuagugaugacaucuauaauagaguccuuaauacugcuggaggcauagcacagggcuggaugaacugagcacuauaauuuuuuuguuguuugcgugacagaguccaaagaauaaaguugauauuauaggguucuugguaaaguucaauacuauagcuaaacaacaaugaaaacccauuaaacauauauucucagguaaaaguuauuaaggccccacuaaaguaagaaaaugaaaaggugggaauucacgaagaaaacuugccugcauaguggugacauuugucacagggugcccuucuccccagcucagcucuccauuaccccuuuuuaggucagagacugccacacucaagaaaggccugagauacucucagucacuaacuugaaaacauccuaucuugauuuuuuaaaauuuaagacauaagaucauaaacauaaaagagauagagauaucaaauucuaaugcucauacuaaauaccagacccccaaaauauagaaaugauuuuuacuaaaauaauucuuugcacuuaccggagaaaaggaaacaguuguauucugauacugugaguguauuuggaaaauaagaaaagucacauugcuugaaauaucaugcaaaauagcuuccucuggaaagggccuauugagcucgaaguaucuaaauuuccccacagaaaauucaauaagaccuacaacgagauaaacuuuucauuacaacacuuguacucucauaucaauuugcagaaaucauauucauaaaugaauguggaauuuaauccucagaaaaacuccuugagguaaauaugguuauugcuccuauuucacugcuaaagacaauguggcuuaaaaagugaugcagcccauccagggucauccagccagugaaugguagagcucagaacuaaaaugcaagagguauuucaaaagguaugcugaagacaggcuccuggaacccagagaaacuuccccucugguagcagcaauaacaaugaucucuggaacagagucccugaauuuaaagaugacaauccuguggggcuacuaacaaucaugaaugugcugguguuaaagaaccauaaccgucuagugaauucugaagucagcguagcccgaagagacacagguggcugcaauuuaauaccgguguuuaccagcugugugauuuuaggcacguuccuuaaauccccuuaagccucaauuuccucaucugucuaauggagacugcaaaggaaggugaaaucaauacugacaaaaauguccaaugagcacccacaccaggcacugcacauaaaauugugaaccacaggcauucuggaaaagagagcuuuuguuugcuuaaggaucaaacugaguccauaaaaaagauagguuauaacaagaacaguuuuucaacaccuccuccaggccugucccaucugucuacuugccuccauggucugcaucucacugacucuguccccacuucucugugauguguuucugccagcugcacaccagcucaucuuuuuucaaucuaacucucaaauaauccuuuaauuagguugcuuuuacuccugugcgguccuggauuccuaccccaccccccauccuacagucaguaucugucugcaugaacagcagaaaagaucccaaguuucacauaagcagucuuggggguucaauucuaaacaaacagacaaaagauuuagauuaaauauagaugaaaaggaauugaugaaaaaagauuauaauucacccgagucccauaguggaacugucauguuuuauuuuagaagguaauuagagucagugggcgguaaaacauuucagauacuaaauaacuuaauaacacauucuuauauaccaugucccaaaaaggucaauuuucaacacuuuuuuuuuuaauacgaaagcuccacuggaugauuuaaaaccaaacagaaccaaaaaaaucaagaaugaguagccuguggaagaacagccaaaaaaaagacacaaauaguguuaagacuagaauaaucuuaaccucuauauauuuucccuaagcucugugaugcuacauuacauucauaacuuaauguuuuuuuaaaaaaaugauagaauaaaacguuacaauuucauuucuaaaacucuagagaaaauuguaauaguuuuaacaaugacaaaugaagauagcauauuuccuauuuaugguaccagaaagacauuuuacauuuuaaauggaccaaacuccagcuggaacagagguuaaaauauuaaggaauggccaauagaaucuggguagggaagucuggaaaaaguuugugugcacguguuuuuucuuuuuaaaaagaaacaagaaaaacauguuuauauuuuccaggccuucccauuaucaugauuauuuuauuagaaaagcaaauuauacauaaaacuauauggauuucaguaaauuacacuaaaaauguuucauuuauugcccuucaaguuuggucccauccaucaugcauccuccaagucuuaaaaauucccacccguauuggcaguaucagucugcuuuccuagaaauuaaucagauuucuauccuuucacuguucacagcauucaacucacuuacuauccugccuuuucuagucuacaucuucaguuuuuccuuuuuguucucauuuucccuauuuggcaauauuuauaagguacucauggacuaggcacucuaguuguugggcaccaugaucaaaacugacacaaacaaauucauaaagguuauccaaggcuucuguaauuaucacuuaaauuugcccuuugauauuauuuuagaaaauguucuaauaauccucaugucuaucucccaugacaugagccuuccaucagaacaguauacagaaccuuuaaaagcccuggaagagacugaagccaucaacuagagaagccuucaugguaaacuuuucuuaaccuucccuuaaccuaucacccaggaugaggaugaaucacaacucaaaaauacuuggagaaacaaaacuuuggaaagacaguacggaaacacagaaccauggaaacuaaaauacauuguuaaacaacugaugacuugacaaaauaaguagggggguauuaaaagcagguaucucuuggaguauauuuuaacugauuuuuuuuuuuuuuugagauggagucucacucugacaccuagguggagugcaguggcgcaaucuuagcucacugaaauuuccaccuccagguucaagcaauucuccugccucaaccuccugaguaccugggauuacaggcaugugccaccacgccuggcuaauuuuuguauuuuuaguagagacgggguuucacuauguuggccaggcuagucucgaacuccugaccucaagcgauccgcccaucucagccucccaaagugcugggauuacaagcaugagcuacccugcccggcugauuuuucuuuuuuuuacacuuguccuucuuuuucuuuuucuuuuuuuuuuuuuuuuugagacagagucuugcucugucgccaggcuggagugcaguggcgcaaucuuagcucacugaaaucuccaccuccagguucaagcaauucuccugccucaaccuccugaguaccugggauuacaggcaugugccaccacgcucggcuaauuuuuuguauuuuuaguagggacuggguuucacuauguuggccaggcuggucucaaucucuugaccucgugauccgcccaccugggccucccaaaguguugggauuacaagcaugagccaccacgccaggccaacucuacauuuuaaauguuuauaaaauaggaacacacacuagaaaaaaaaagggacaaaaugggacauucucucaacauucugucacuguuuugcuuucccuuaaaaugguaauauuuuucuagaaaauauauaauccuuauaaaaggugcuaaauaaacagaaagucaacuccuccagcaaguacaauguacagaaaucaccacugcuaacaguugggauauaucuuuuagggcuuaggcagauauaagcaugcauauuuccgcauagauggaaaaagauauaaauauguuugauauugcccauuuaacaggucuuauauaucuuuccauagcaacacagauaaugcuagcuuuaccauuuuaaaagcuacagaguauuccauucuggguauguaccauaauuauucacccaaucuccuauuaaugaacaucuaggcuguuaccauuauagcaugaauaauaaauuaauaagaaauaaaauaguucugauuuuguggaagacuauuccagaaagcguaugugucaggcaauaaaucuauuugagagaguuuuugcugugacaguguaacagaugaccuuugaccuuaaaugguuaaacuguaccuaaaaagucuuguucuagucuaagauauccagaaauaaaaacaaauagaccaugugagaauacacaaugauuaggaccaaaaauuaaucugcagucuuugcuucugaauucuucuucaagaaauauaccugaauuucaggaauaauuacaacuuucaucuguuauuuccuggauuucccaaaagcuacaggaaaaugaugccucaucaucuuccuuuccucaaaugccuacagugcgaaccaggcagaagccaggaaauaaaagggagggacacuguauacauuauguaaaaccuggucacuugacaaaauagguagggguauuaagaggaaguaucucuggggguguauuuuaagugauuuuuuuucuuuucauuacacauuucuuuauuucuuaaauuucuauagugaccauaagguguccuuuucauaagaaauuauaauacagugauuauacacccuggcuauccauuacaaucaucuggaggggauuaaaaaaaaaacagaacacugcugccugggacccucuccagaugaguuaaaucaaaaucccuggggcuaagguccagguaucaauuaaaaaacaaauauccauuaaauacuaugcagagaaauacagaaaguuuacacacccaugaauuaaccagcaccuaaacagcauucuagcaucuuaguggucccccuguggccccucccaaucacaucuucuuuccuccccagagggaaauaggguccuaaguucaaacacuaggaauuuauuuggacgaauucaauugaauagaauuuacagcacaauuuuuguguguuuggcuucuuuaaaaucagcauuauguuugugcaauucauuccagcugcuauagguagcuauaacucauuaccauaauuguauacuucaugaaauaacaugccacaauuaucuguucuacuguuaauaaacaucuguauuucugguuuagaguuauaaauaacucuaaacauuuucugugcaugucuuuugguacacgcauauacacauuuuuguuggguggaaccugugaguagaauuaucagguaauaggguauucucaucuucaguagauacugccagucuuccaacaauguuuugccaauguauaccgcaucaacuuacuguaggaaaguguuccaauugcccagaagucucaccaacaccugguaucauucauuuaucugcugaguauauagugguaucucauugugauuuuaauucgcacuucccuaauuacucauggguguuaagaaaccuuugcuuugcuuauuugcuauuuggauauccucuuugugaaacagucuguucgagucuuuuacacauauuaaaaauggaacuguccuucuucaauuuuaggaguuuuuaauacaucauagauaugaguauucugacagauacguugcgaauauauucucccacucuuguugcuugucuuuucacucuguuaccuuuagauuaacaguuuucauuuuagcagucaauuucagguuuuuccuuuaugauuagucccuuuugugucauuuuaaagaaaucuuugucaacauauaccaagaucaugaagauacauucccauguuaacuuccagaaguuuguuuuaucuuucacauuuagagcuaaaaaucaagcugaugcugauuuuuacacaugguguaagauagaggucacaguucauuguuucauauguucaucuacuugacagcaaccuucacuaaaaauaccacccuguaguaccccauguucucucacuuauaaaugggagcuauguaauguguacacaugggccuacacuguggacugauagacauugaagacugaggaaggugggagggggccugaagaugagaaauuacuuaaugaguacaauguacauaauuccagugauggauacacuaaaagcccugacuucacugcacaauauauccuguaccuacacuugugcuccauaaguuuauacaaauaaaauaauuuaaaaauaccaccaucuccccacccuacugcuuugcaguuccaccuuucacauaagucaagugaacauauguguuugcuucuagagucucaauugcauucuacuggcuuauuugucuagcuauagacaccaauccuaacacaaauauuacaacucucuuaacuccugcuccaaauuuguucuuccuccucaaauuuaucuugacuauuucugauccuuuacauuuccauauaaguuuuagaaaucagccugucaauauccacacacacacaaaaaaaccugcugggauuuugauugggauggcccugaauauauacauuaauuuaggaagaaaugauaccuuuaaaauaucuuuaucuuuagaauuuuguaaucuaugaauuuccgauauuccucuauuucuuuaguuucucaauuuaucuaaagaauguugagauguauuauguuauuuucucuguagaggucuuuacauaucccaugauuaucaucccagaauacguaauguuucuugaggcuauuuuaaauguacuuuuucuuuucuuuaauuuuauuucuuaacguuuuguagagaugaggucuugcuauauugaucagacuggucuugaacucuuggccccaagagauccucccccacucagucuuccaaagugcugggauuacagacggaaccacagcacccgacccugcuuuuucuuuuaaaugucuauuucuagcugucucuucaccaauauaucuuuuauaaaaaguucuccauguaauucuaauguuuagcuggguuugagaacuccuaacauaguguuugauaaacaagcaaaggauaaauauguauuuuuuucccagucuuaguuaucucuaaccuaacaucugugugaaaauacuuuggcaguguaacccuggcaaucuaacauccauuguacaauuuuuuucagaagauugcuuuaaccaaaccaguugugguuugauuccuggcugugcaggauuuugucauuuuugauguuccaacgucuaacacaguauagucaccuaacuggcauacaguaaauguuuguuaaaugaugccugaacuaugugaccucaggcaaguaauguacuuccucugggcuucaguucccucaaaguaaaauugagguaacugugcugccaucaguuggcugcugaaaguaucaaacaaaugggaaacaacuuuuaaacugcccaaggcuacacaauaaagcaucauuuauuaauuuccauuagcuuuccugugcuucacacauucaucuccuuauugaaagaaaagaaagaaagaaagacaaucaggcacucagagcagcccuacgaaaaaauuagugggaagaaaggaacuaacauguacagggcauucacagaaauuccaggcacaucauaagcauuacguugagaaagagacuuccgaagagugacaacaaaagauacugaaagucaagacaacuuaaacagcucagucugguagaaacucauuuaauuucugcucauaaaaacagauuuagcaaaagaagacacauacucaaaaaauauccugaagaagcuaacaggaauuuaacuucaccucuaaggcauauggaaaaggauuuauuagaagcauuuuaugaggcauaauuauaucuuaugacuugcagaguaggaggaaaaaagacagcacaucaaaagauauuacaaagcaaauggcuaacaucaaguuggggcacuuacauuagcuuuccucuaaaaagaaauggcuuuuuuugccaucugaccuauaguagggacuugaaacaauuuuucacacccaucuuccauucuuacccagaaucacuuuuucuuuccaauaauuccacuuuaaaaagagcugcccaauccuaauacuuuccuuuuucuuuccgaaucagauccuaaucuggcaaccauaaaaauuuccaacucuuccuuuuuacuauuuuacuaaaauuuacuucuacuguuuguguuucaacacaacaaccaaauucuaagagaaauccaucauagccuagucuucauaauucucuucacauuaaaaacaaaaaugguucagcuacuugaguuggucagcagucaaccgccccucccaauuucucauuguuaucuucuuacaaauguucaauagcccuaaagguugaaagggaacacaaaaaugaacauauuagcuucacacacuuuuuagagaaagacagcacuugcaacuaaccaugaacagccugcuaccuugguaaagcaucaucaauagcaagaagacugaaaggcccaaaugaugcugugcucaaguccaauuacuaugaaauuccacgggaguuacuggauaugaaucuaaacaaaugaaagauguuaaaggcagcagugaacugggacuccaagagaagggaaaacugcuuaaaaguaugauccaucucaugugccuacuggucacagaaagcacccuccucagacauucuaggaacuccaucugccacguuccaagauuuauuuagcauucaggccacuacagaagucaugcaaguuagcucauccugccaaagauggguaaauccuccuaaauuacagcagaugcucaauuucuucaguuuguaugguuaucagaauuaucaucaucaaacaucaauccagccauuuucuaggaggauuaugcaaguccugaacuauguccuucuaccuuucuauacugauuuuuagcugauagauguggagaauaucagcuuuuauuaucacucagcaguuaaguccccacauugucccucuucugcacagaaugacaauaccaaugcaaggcaaaaagaauaacauugaggaauaucagugcuauaaucauagcaaagaggcaaaaagcagugucugaaaaaaauuaauuucucaauuuauucauauuuuuuaacuuuuguauaaaaauuucuagguauuaaauacuaacaccaaguagaaagaaaaaguucuggacgccugcucuccugacucaggggcuggccucgaucaacuaaaaacucuaauaucucaaauucuucaccuguuaaaauagagauagcaucucuucuaccuccaucauaaggcuauuuugaagaaugaggauucacagaaggauuaaguacaaagcaccaugccauguaagauauucuuauuggaagacagcuuuacggaaguggaaggacuaugaaauuugcagggagacucaccuggguucaaguccuaucuguaacccuagcagcuguucauuuguuccucugacaagggaggaagaucauuacauuguagggugguggggauuaaauaacacugcacguggaaagcaccuggcacacacuauacagagugaauguuagugcccuauuauaagcaagguuuuucugcaaaaaaaaaaguugcccuuuucagcuuuggccucaguccuauauacaaagauccuagaauucaguuugcacaagggcuuuucaaagauaagugcauagcaacacaaucacauuauucagaaaauauuauguuucagaacugcaacuagucuauuaaccucaaaacaaaacagaaugugcuuaguuucauggaaaagcacaugaugaucugccuggcacaacuagugccuuuuacauuuuauauuaacaaaccaugagcuguugcccaaacccauucaccaagcacaagacuuacaaucuaacaucccauucugaguucucacugagaugaacaagaauuaccugaaaucggccgggcgcgguggcucaugccuguaaucccagcacucugggaggccaaggcgggcagaucacgaggucaggaguucgagaccagccugaacaacauggugaaaccccgccuguacuaaaaauacaaaaacuagcugggugugguggcgggcgccuguaaucccagcuacucuggaggcugaggcaggagaauugcuugaacccgggugucggagguugcagucagccaagaucaugccacugcacuccagccuaggcgacagagcgagacuccgucaaaaaaaaaaaaaaaaaaagucaccugaaaucaucaaaaaugguguacucauagggagccaagcccgggcauguugcuucuuggcucccacaggugaauuugaaguggcaauagaacuucguugauucuuguuuuucucauuuuaguuuuacucucuauuaaauuguuauuuuuuacaguucauuuauggaugacaaguuauuuccuguugguagcugcaaugauugggaauuuugugaucucuguaaacgaauuaauaucucauagagaucuauuuccuguuggauaugagacaacagagaacacaguuuuuguccauuugucuuuuuuaaggucaaaucgauuagaaauuucuugcccucaaguaaggagaacaacucugauaccuggacuggcaagcuuuuguguuucuguguuuauuuuucauuuguggcugaacuuguagaauugaggguauacacauucuaucuguaugucuauguaucuguaauucagaaaguccuuuauuucucauugugaguauggaauguuuuccugucuccagaugguauuaauaaauuagaugguaaaggcucuuuaaaaauaaagccucauuauggguucauuuucccucucaaacucuguagaacauaaccaguuugaaaagccucuagauuuggggguguaaaaauuccaugcagcuugagagccaucagucauuaagccgcuaguuccaccccaagucuugcuguccagaagcucagacaguccacugggcagcaaagaggcgcuuuaguaaguugaauuaaagccacaaacauggcugcucccuaagggagauaauacuguguuaaaaaaagagaauuauuuaucucuucccauuuccuccgcuaaaugaggagguuaauaguaagaccuccuuagccaugaguguuuccgcugcaggaaacaccauucgugccgguucuggacucaccacccagcguguaccaacgcccccagcaccaucucccugcuaggcugacagaccccuggcggauuuugaccucgcaagaaaugcaaaagcaacuuuggguugcagaagccaggcgccccgaccuuacccucgcuggaauucccgaagaccucggcugcaccagccacccgguguucggaugccagcaccgcuacgaccagcagcugcaggaaccccauugcugccugggccgggcugggcccacgccagggcuggggagaggugcgggcgugcgcgccggggccccgcagccucgcccacgcuaucccggggcgcccgcaucgggcgccaucgcccgccaggugcagacgcuucgcaccugccagcuccgcagccgccggcgcgcgccccgccgaacuccuagccccagcgagagguuuccucuuccggcaccugacccccaacgcgcguucccgc

SEQ ID NO: 191708 - RNA, 110409 nt, Homo sapiens
ugggaguacuuucacguuuaauacgcaagggcauaaaauagaauguuaggaaacaauuuggauuuuuuucccuaaaauauaggugacuaugggcuaguuuacaacuuuccuucucucacugaaauaaaaauacauaguuaaggaauagggacgaauacauaacaggugacauuugacaguuugggcauauuccuuguuacuuucuaaucuugagaaucacaguuugcuguuuuagagguaucugagagguuccagauaaaaagcgauggcuaaaugcucuuaaacuuugagcgugcuggaugcucuaaaguaggagaggaauuuauaacagaagcuuacaaugaagaaccagacauuccgagccaucugagaucuugcaaugagaaggcgccaggcgauaaggaagagggcaguauuaaagagguagugaauauuucggagccuagggaacagacagacauaaccaaaguuaaaacuaccagauacccaaccacauuaucugaagauaaauauguguuuuccuggauaugacuggcaaguauuuaugaagugcucagaguauuugauauaacuuggccaauugguuucugcgucuuucauuuccacagcauucuugcugaauagucagauuucuaccauauuucccuaauuucucuuauaccucucuccacuugaaacuauuuacaagcaugacuagcauaaucuuguaaauauacuuuggucauguuaccacaucauaaaucuucacugguucuuguucauuagaagguaaauucuaaaguucuuggcuugcuauucaagguuccuccuuccuguuuugcaagcuacuuuuuuauccuuaucaucucugcacuacagauccucugcuucuaccaggauuauaccagagugcuagaauuccuugucccucagggauuacgacugaaagaaauuuaagaaaguugaaaaaauugaggagugacuuuuuucuagguuaaauagcauaaucaggucuccugccuguuggguauuuauaucccauuaugacagagugugguagaagaaacaaauuuggguucaaaucuggcucuuagacuuacuaugcaauuaccaugggcaaguuauuugcuguguuuaaaucuagauaucugccucauaaaaaugggguaacaaaaguaauacuugccucauagagguguggugaagucuaaaugaaacuguguuacaggguagaguauggagugcaggaccuguaauguaguaaaugcucaagaaauguucauucuccucugcacaaauguuaugucugguauaaagucgaugcacaguaggugcucaauaaauauuaacugacugauuauacuuaccuuuuuaagcguugcuuugcuuuugggaucccagccauauccucuuucaauaaguauuuuuuaacucccaaaacauaauuuucaauguauuccaaccaguucaacuggcgcacgucaaaguugaauaccugagaggcaagagagauuauagauugccagaauugcagugcuggacagucacuuuguccacuugagguuucuucuacauagacgagugaccuucaauuugggagacauagguuggacccucuccaaaggagagauuauuugagucauuauuucaaagguacugauaauauggauuacuauuuacauaggaauauuuaaacauggaucaaacacaaacacuucacauuucuugugagggagauuuaaaggaaauaguauuacauagucuggugaaaacuuaugguuggcuugguauauauuucagcuaaccgaggaguaauuauuuuuaaaagugauagaauaauauguuagugaccaaaacauaaaugaugcaacuuucccuuuccucuuaaauuuugguguuaucccuuuguucuaccauccuuuccuacagcauuaccauuucauuaugcagauuaaacuuugggaagcaaagccuuaaggaauaaguuaccagaauuuauauuuaagaagagagugauugguagugaaagaaaaaaggagugaucacaacaugggggaggaguagggaagaaggagaaggaagagauugaucuguuuagggagagaaguugugccacauagaagacagauacagagagugacaauaaagaaaaaugauuaaaaaauuuuuaagguaucuuugaggaagagaaaagaaaaacacuugcauaaccaaaaauguauucuuuuuuugguuuguuauggaaaagcuggaguaaagauuugaauugcauuccauagauuuuauuuuuuguguacuuugaaaaugaugcugagcugacacaggaucaggagguggcccagauuuauauggauuacaaauggagauaggaugaguuaggaagagaaaccugauaggucauucuugagccauccagggaucuuuucaaaaucuccauauaaagggccuaauuggagaaagaaagggagggaaaugaucuucaaauauauuagaaaaaauaguuuugauugaauauaaagaacuuagggcacuaaaacuuguuaguagaaagagugucaagaagauucugguaucaucucuggaaauauuucaaguauuagguauucuuggagaguuugguaugacccuguuaucaaauaaaagauugcaucagugaguggauuugguucaauagaguuuuauuucauguauuuggagagaauggccuggaaaauggacuugugcuagcauuuaaaaagucuaauauuuauaaaucuuagcaaguggaggguguguuuaaggugcuuuuguccuuccaauugggcacucuucucucuccuuggacauacagcacucucagaucacuuuuugucuauucaucccuggacauuaaaaaaaaaaaaaagccuaucuuuaguggagaguuucacguacagugaaagaaaguugcucguuacucuuaacuuacuuaacuucuggugaggccucacuaggaaggacuuuaauagcuaaaauggcuuaauucaaauaaaugauauuccuagaacaacaagaaugauguuccuuugaauggcacaaaguagacauucaauaaauacuugcuauuaaugaauuauagaauuuaggucaaauuaauuuaaauauuaauuuugaacaccaaaaguguuucuuuuuuguuacacaacaauuuauucuauuuagucuguauauaagcuuuacaugaauaugaccaaaguaaacucuuaguuuccuuuuuucagacaaucagucuuugaucgaggcuuagaugguaccaaauaaaaggcauauauuaucaaaaccaaaaagccaaucaccacuaaaggucaaguuuguuaacuuuaaaauggcuacacgauuuucugagaaucucuuggguuuaauucauaaauugcaucuuuccuccagagucuauauuuagcucuuuuucucuucaggaaauauuacacuucuaaagaauguaauugaauuugacaucuuaaagauuuaguaguucucuaaggcuacucgauucuuucuccuuuauaugcaaauuaaauguuauauuuuaaucacagaaaaccaucuuagaacucggaggaaaguaacuaaauauuauuaucccuauuuaacauucuaggcauucaguaaacauuuaauaaugagcccuuugcugauucauugugcauauugcuuuugcuuuauccucucaacuugcauggagaaacaugacaagaaauaacuuuuuaaaaaucauaaaugggccaggcgugguggcucaugccuguaaucucaacacuuugggaggucgaggcgggcagaucaccugaggucaggaguucaagacccgccugaccaauaucgugauaccccgucuguacuaaaaauacaaaaauuagccaggcgucguggcaugcgccuguagucgcagcuacuugggagguugagacaggagacgcgcuugaacccgggaggcggagguugcagugagccaagaucuugccacugcacuccagccugggcaacagagcaagacauggucucaaaaaaaaaaaaaaaaaagucauaaauguauuugcuuuagauaacuuuuucuaauucauucuuccuuuugaacaacgaguccuaugaaacuauauuuuccuuuucacuuuacuaccagaaagcucaagaacaaauucacugcuuaaauuaacuacagcaacuuaguaggaucuuguagauuauguaugggcauucucuuuuuaaauuuuuagcugugacuucauauucugauucauauuuuccuugguuuugcauuuuauuuuauuucuauuuuguucuuucauuauauguauuuuuuugcaagauaccucaaaccuuugugagauuuggaguauuaauaaagagagcagaugcgauuguuccagagagcuucaaagacuuguccaaaagcugaauugcuuuuugaaagaaauuccauuaucacuuugauuggauaugguuuucauaguaucauuaauauugcuuagucauucauauaagcagaggcuuuuauuuuuauaguguuuaacauuucuaaguuugauuucaaaguggcccuguucagaauccugauuccauauggcaauucaaacugaauuuugagccacaccagaauuugguaauuacauuuaguacuauuacuuuugcuaagauauuuuugagagcauauguuaaauccacugaagcuuugauucuuuuucauaaaauuuugaaagguuaaaauaguaaaaugucagaaaugaaaccaagcucauuaccuuuugaguuauuucggcaggaaaauuccauggagaaaauacauaaggauaagccuacauagaguuuaaagcuaaauuuuaaaagaacuuacaauagcuugaauuuguugauuuguuuuugauuuauaaacuggcuuaaucaucauuucaaacacuaguuugaagaauuuugucuauaugugauauguaaacauuucugaauaacuauuucaugucacuuugagagggagcaaugauuucagauaaaauaucccucuaaaucuugccuuuugugccuaauauaauauuuauuguauuugacauggauaaugcuuaggaaauaauucuagggcuuggauuugaaucacacucaguaaguuugguauguagaagugaaacccuuagcuggcaagcaaggucaguuagccaucugauauauuguuuuuuuuucuuuuuuuuaauuauuauuauauuuuaaguuuuaggauacgugugcauaacgugcaggcuuguuacauauguauacaugugccauguuggugugcugcacgcauuaacucgucauuuagcauuacguauaucuccuaaugcuaucccuccccccuccccccacuccacaacaggccccggugugugauguuccccuuccuguguccauguguucucauuguucaauucccaccuaugagugagaacaugcgguguuugguuuuuuguccuugcgauaguuugcugagaaugaugguuuccagcuucauccaugucccuacaaaggacaugaacucauuuuuuaugguugcauaguauuccaugguguauaugugccacauuuucuuuauccaguccaucauuguuggacauuuggguugguuccaagucuuugccauugugacuagugccacaauaaacauaugucuuuauagcagcaugauuuauaauccuuuggguauauacccaguaaugggauggcugggucaaaugguauuucuagcucuagaucccugaggaaucgccacaccaacuuccacaaugguugaacuaguuuacagucccaccaacaguguaaaaguguuccuauuucuccacauccucuccagcaucuguuguuuccugacuuuuuaaugauugccauucuaacuggugugagaugguaucucauugugguuuugauuugcauuucucugauggccagugaugaugagcauuuuuucauguguuuuuuggcugcauaaaugucuucuuuugagaagugucuguucauauccuuagcccacuuuuugaugggguuguuuguuuuuuucuuguaaauuuguuugaguucauuguagauucuggauauuagcccuuugucagaugaguagguugcaaaaauuuucucccauucuguagguugccuguuuacucugauggugguuucuuuugcugugcagaagcucuuuaguuuaauuagaucccauuugucaauuuuggcuuuuguugccauugcuuuugguguuuuagacaugaaguccuuccccaugccuguguccugaaugguauugccuagguuuucuucuaggguuuuuaugguuuuaggucuaacguguaagucuuuaauccaucuugaauugauuuuuguauaagguguaaggaagggauccaguuucagcuuucuccauauggcuagccaguuuucccagcaccauuuauuaaauagggaauccuuuccccauuucuuguuuuugucagguuugucaaagaucagauaguuguagauaugcagcauuguuucugagggcucuguucuguuccauuggucucuaucucuguuuuggugccaguaccaugcuguuuugguuacuguagccuuguaguauaguuugaagucagguagccugaugccuccaguuuuguucuuuugguuuaggauugacuuggcaaugcgggcucuuuuuugguuccauaugaacuuuaaaguaguuuuuuccaauucugugaagaaagucuuugguagcuugauggggauggcauugaaucuauaaauuaccuugggcaguauggccauuuucacgauauugauucuuccuacccaugagcauggaauguucuuccauuuguuuguaucuucuuuuauuucauugagcagugguuuguaguuuuccuugaagagguccuucauaucccuuguaaguuggauuccuagguauuuuauucucuuuguagcaauuaugaauggguguuuacucaugauuuggcucuccauuugucugucauugguguauagguauacuugugauuuuugcacauugaguuuuuauccugagacuuugcugaaguugcuuaucagcuuaaggagauuuugggcugagaugaugggguuuucuagauaaacaaucaugucaucugcaaacagggacaauuugacuuccucuuuuccuaauugaaugcccuuuauuuccuucuccugccugauugcccuggccagaacuuccaacacuauguugaauaggaguggugagagagggcaucccugucuugugccaguuuucaaagggaaugcuuccaguuuuuguccauucaguaugauauuggcuguggguuuuucauagauagcucuuauuauuuugagauacgucccaucaauaccuaauuuauugagaguuuuuagcaugaaguguuguugaauuuugucaaaggccuuuucuccgucuauugagcuaaucaugugguuuaugucuuugguucaguuuauaugcaggauuacguuuauugauuuucauauguugaaccagccuugcaucccagggaugaagcccacuugaucaugguggauaagcuuuuugauguguugcuggauuugguuugccaguauuuuauugaggauuuuugcaucaauguucaucaaggauauuggucuaaaauucucuuuuuuuguugugucucugccaggcuuugguaucaggaugaugcuggccucauaaaaugaguuagggaggauucccucuuuuucuauugauuggaauaguuucagaaggaaugguaccagguccuccucguaacucugguagaauucggcugugaauccaucugguccuggacuuuuuuugguugguaagcuauuaauuauugccucaauuucagagccuguuauuggucuauucagagauucagcuucuuccugguuuagucuugggaggguguaugugucgaggaauuuauccauuucuucuagauuuucuaguuuauuugcauagagguguuuauaguauucucugaugguaguuuguauuucugugggaucgguggugauauccccuuugucauuuuuuauugcgucuauuugauucuucucucuuuucuucuuuauuagucuugcuagcagucuaucaauuuuguugaucuuuucaaaaaaccagcuccuggauucacugauuuuuugaaggguuuuuuugggucucuauuuccuucaguucugcucugcucuuaguuguuucuugccuucugcuagcuuuugaauguguuugcucuugcuucucuaguucuuuuaauugugauguuagggugucaauuuuagaucuuucuugcuuucucuugugggcauuuagugcuauaaauuucccucuacacacugcuuugaaugugucccagaaauucugguauguugugucuuuguucucguugguuucaaagaaugucuuuauuucugccuucauuucguuauguacccaguagucacugaggagcagguuguucaguucccauguaguugagugguuuugagugaguuuccuaauccugaguucuaguuugauugcacuauggucugagagacaguucauuauaauuucuguucuuuuacauuugcugaggaguguuuuacuuccaacuauguggucaauuuuggaauaggugugguguggugcuggaaauaauguauauucuguugauuugggguggagaguucuguagaugucuauuaggucugcuuggugcagagcugaguucaauuccuggauauccuuguuaacuuucugugucauugaucugucuaauguugacagugggguguuaaagucccccauuauuauuguaugggagucuaagucucuuuguaggucacuaagggcuugcuuuaugaaucugggugcuccuguauugggugcauauauauuuaggauaguuagcucuucuugcugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccaucccuuuauuuugagccuaugugugucucugcacaugagauggguuuccugaauacagcacacugaugguucuugacucuuuauccaauuugccagucugugccuuuuaauuggagcauuuagcccauuuacauuuaagguuaguauuguuaugugugaauuugagccugucaucaugauguuagcugguuauuuugcucguuaguugaugcaguuucuuccuagccuugaugauccuuacaauuuggcauguuuuugcaguggcugguaucaguuguuccuuuccauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaauguugaaugucggcccccacucucuucuggcuuguagaguuucugccgagagaucaucuguuagucugaugggcuucccuuuguggguaacccgaccuuucucucuggcugcucuuaacacuuuuuuccuucauuucaacuuuggugaaucugacaauuauguguuuuggaguugcucuucucgaggaguaucuuuguggcauucucuguauuuccugaauuugaauguuggccugccuugcuagauuggggaaguucuccuggauaauacccugcagaguguuuuccaucuugguuccauucuccccgucacuuucagguacaccaaucagacguagauuuggucuuuucacauagucccauauuucuuggaggcuuuggucguuucuuuuuauucuuuuuucucuaaacuucucuucacgcuucauuucauucauuucgucuuccaucgcugacacccuuucuuccaguugaucgcaucgguuacugaggcuugugcauucgucacguaguucucgagccuuggcuuucagcuccaucagcuccuuuaaggacuugucugcauuggguauucuaguuauccauucgucuaauuuuuuuuucaaaguuuuuaacuucuuugccauugguucgaacuuccuccuuuagcucagaguaauuugaucuucugaagccuuccucucucaacucgucaaagucauucucuguccagcuuuguuccguugccggugaggagcugcguuccuuuggaggaagagaggcacucugauuuuuagcguuuccgguuuuucuacucuguuuuuuccccaucuuugugguuuuaucuaccuuuggucuuugaugauggugacauacagauggguuuuugguguggauguccuuucuguuuguuaguuuuccuucuaacagucaggacccucagcugcaggucuguuggaguuuacuggagguccacuccagacccuguuugccuggguaucagcagcgguggcugcagaacagcggauauuggugaaccguaaauucugcugccugaucauuccucuggaaguuuugucucagaggaguaccuggccgugugaugugucaguccgccccuacuggggggugccucccaguuaggcuacuugggggucagggacccacuugaggaggcagucugcccauucucagaucucaagcugcgugcuggaggaaccacuacucucuucaaagcugucagacagggacauuuaagacugcagagguuauugcugucuuuuguuugucugugcccugcccccagagguggagccuacagaggcaggcgggccuccuugaucuguggugggcuccacccaguuugagcuuccaggccgcuuuguuuaccuacucaggccugagcaauggcgggcgugccucccccagccucacugcugccuugcaguuugaucucagacugcugugcuagcaaugagugaggcuccaugggcauaggacccuccaagccaugugcucccgcacauggugugccauuuguuaagcccguuggaagagcgaauaggaacagcuccagucuacagcuaccagcgugagcgacgcagaagacgggugauuucugcauuuccaacugagguaccggguucaucucacuggggagugccggacagugggugcaggacagugggugaagugcaccgugcgugagccgaagcagggcaaggcgucgccucacccaggaagugcaaggggucagggaauucccuuuccuagucaaagaaaggggugacagaugacaccuggaaaauacagccaucugauauuuacuccccagugugacuugguuucuucuacaugcugucagguacaaaauaaaacaaaagauacauuuuagaaaauuguuucuuagugggaaaugucaaucaauauggagugaaaaccuuaaaauuuaguuaaaaacgggauacaugacugagaaaaaggcuaggaacauguauaauauacaaaagaauuucagaauaugcaaagauuuuaggacuuauccuuugugacugccaagaaguuaaagaaauaaguggugcuggugcuaaggaauuaaacugaagaccugucuugagaaaugaaagucugaacuguuguagagaaauccuauagagagggagaucgacgaugcagcacugaugaagggaggucugaggugaggcagagugcauagguguagggauuagcuuuaacaagguaaggaaggaacuguagcugggagaggcagaacaauuuugauuggacaagaauaguggaugauugaguuuauaagcaauaaaaucauuauuuuucauugaagucauaugcuguggcagauaagggaagaacacagccacccagagguacugaggguuuguagaaaugauaacuaucaaggagugacaaaacgauugaagugcaguagauaaaacauguuggcagaucagcaguuaaagauuuaaccaaaguccaagaaccuacauuucuuacuuacauuaaacuuguuuccuacggugguguugauagcauugacugauuuucuuagaaaaacaaagcaaaacaaaaucugugucuauaaccaaacgucuuauucauucaucagcuuuccaaaucaaauaauucuaaauuccaagugaguagcauuuuccuggugcuuaagucagugcucuacuuacucucuggucuucaggacucagcucagacaucagcauuucuguauuguacgugcuccauucccaacuccgguugaugaaauacuccaacauggaaacaguucuuaaaagccgauucaugagcuuugucauccugagauaaccaucagauaggaguaaauaucagcgcaccacuucccugucacucuacagggauguaugagaaauuauuuuuaagaaaauacaaaaauuaucccugucuaccacuccucauuaaaauucuucuucuuuuuucuccuuccacauuaacucucuauucauucaacagaaaaagaaaagggcuggaucuaaaggagcuuguucuguuaggcauuuaauaccagacuccuuuucuaacaccuauuucucaagaauagcaaaccuauuuuaaaagugagccaacuauucagcuugaaugacauacuguucauuuuuugaauucugauguagacaauuagaaaacuuucucaucuuucuuuuugagacagggucuuacucugucacccaggcuggagcgcaguggggcccagcuaauuuuuuguauauuuuguagauaggguuuugccauguugcccaggcuggucuugaacuccugggcucaagggagccagcugccuuggccucccaaaguguugggauugcaggcaugagccacugcaccuggccuuauuucucauuuuuauuguacuuucuuguauuuuaagaaguugauaggaucugaggucuuaguauguaacuuuugggcagaaguguugacuguauuaguguuuguugaaucaaaagcaguugucaaucauaguggagauuaaaaaaaaaaaaaacuucuuguugauaaccuauucuguguuaggcacaguccugauacuuucacaaaguauucucucugcuaauuuugauaucaucuuuguuagguaagucugcaguuuuacaaaugaguaacauaagcuuaagauaaaaagugucaaagucaaauuccaacccaguuuuaacugaccucaaaaaaccugcgcuguguaaucucacuacccugugucccauuacacaagaugaaccacacuguccaaucuuguggucaggacuuggaccagaucuucuuugugcaccucccaacuuuauaacaauuuacaaaaaacuuucauauacaaucuuacuugauccuaacaauauggcuguaagauagucaggauguauauuauguaucuccauuuuacagagagauuaugcucaaggucccauagcuaauccccaaccuaggucuuuuagcuacaagucacuuuuggccuguaaagcacuugauuuguaguuaaccagucuuggcaguagugauuacuauaguuggcucaguaauuaugaugcuauuguggggauuuggucuuacuucuggucaaaguuaaugcccauguacuuaaugacucaugagguauuucucuuacuguaucauaggaaauuucuuaggcaugagguagacaucauugugccugauauaagcaccauaauaggguuccacuuuacuauuaucuaaaucuuuagucauucuccaacucugaugcaauugauaugauuucaauacauuuauuuuaauuguuaaaaauaacgguuggacaugauaucauuggauguacagaacuauaucaaccuaaugauauguuuuagaaaauauacuuguauuacucccagauagagaaggucuuuauuguuugucugagacagggucucgcuuuauugcccaggcuguagugcaguggcucaaucaugacucacugcagccuugaccuccuggguucaagcaaucuucugccucagacuccugaguagcugggacuacaggcacaugccaccaugccuggacaacguuuuuaaauuuuauuuuuguagugauggggucucacuauguugccuagucuggucuugaaguccugggcuuaagugauacuccuuccucagccuccaaaauugcugggguuacaggugugagccaccacacccagccaagaaggucuucuuaauacccaaaaugcaaaagcugaaggaaaacaaugauugauucauuuuaccacauaaaaauuuuaaacaucuuuaguauuaauagggauuauuauauucuaagcacucauauuaaacuauauaaaauagguuacgauuacugugcccauuuuacagaauaggaaguuaggauuuagagagaugaaguaauuuagggcucuaauggcuaaauuggugaagccaggauuuaaauccuauaagccugacuccaaacuccauguuccuaagcccugcauuauauguaucuucacucauauuacaaaaagcuuuauagucaaagcuaaaaagaaacagaccuggagaaaauauaugaaauauguauucacacacacauguucccauacauuaauaaggacaacccaauaggaaaauagggagcagaagcaggcagcacacagaggggaaaacuuaaauguccaauaaaugaaugaaaguccagccccuccagcaaucaugaaugcaaaucaaaaaaacaaaaagaugucauuccuuaugaguuugacaauucagaaguugauuuuuacaaaguauucuuacccccauuaagaggguaagacauacuguuuuguaccccuuggccgggcgcgguggcucaugccuguaaucccagcacuuugggaggccgaggcgggugacuugcuugaggucaggaguucgagaccagccuggucaagaucgugaaaccccaucucugcuaaaaauacaaaaauuagccaggcacaguggcgggcgccuguaaucccagcuacucgagaggcugaggcaggagaaucgcuugaacccaggaggcagagguugcagugcgcugagaucucgccacugcacucuagccuaggugacaaagcaagacuccaucucaaaaaaaaaagaaaaaagaaaaagaaaaaaaaaagacuuuuguacccuucauacacuguugugguagugccaauugacagucucuuccuuagggagggucaccuggcacuagucacaaacuccacauacucuucaauccagcagucucccuccucagcauccucuccugacacaggcacauucuacaaagaggcaugcacacugauauucauugcccuauuugcaguagaaaaaaaagacaacaccgggcagaaugacuuagauuuucauggaaaauuaguggaaaaaguuguaaaauauguacaauugauuuauauacacacauaccccccuacugcaaagcaaacuauguacguccauauauggauguaaaagcauaggagaguauacacaagcacaccuggagcaggaaagggucuagaaggauuucagcuuuuucugccauaaagauuauugcuaaaauacauaccacacaacaaaccaacccauuucccacaaauauuacuguuugacuucucacaagauacauauagauuuuuauugugucucuuccuucuguguuucucuuuuuuccuaacugaacuuuguucuuuaugcaggcccucuuccaauccugauauauuuuaaaaccuuuagcauuucugccuacaauauuuggguuuucuucuuuuccugucuuuauuuaauaagccccauacaaauauuuuccccauaaucacaauguuuccuuuucaccuugcucaagaacugaguuaugagcuccaaaugaggucuuuaaaaauuuagauaaacucuacauuggcuaaguuuuagucauuugcacugcuaauaaagaugacaaacacgcugaagaagacuuccucccuuauaaaggggcuagcacagaaggcaauacuguucauacuucugauucuugaucacgagaauugccuuaggcaauuauaacaaugacuccucugacacauaauauuauucaagcgagacagauaaaggcguauguccugugucacacagcuagguggugacagcugccuuagcaucagcacacuguguucccucuaauuucuucacucaucucuagguggcaguaaaucugguuccgaauacugacuuugagacucggcuuucuccacauccuuccugucacuuccuuugagacuaauucagauucuuuccuuagcuucuauuuccccauuuguaaaauugggaugaugaggacaucuuccuuggguagcugugacaaugaaaaugggaucaucaugcaucagccuuagccccacgagugccacaguaaacucucaguaagugagguugucaucauuauuguauauuuaagauuaucuaccuauucagaaaacccuagugacagagucucaauugcuuuucuuuucgcaugaaugauuacuugcugaauucaucaaccucuuuaacauuuaccuuccuuuauugugcuggaacauuuuuaaugucuuuuguggcuucucacuaugacugcuuuguucaaaacuuauacaggucgaguauccuuuaugugaaauacuugggccagaaguguuuuggguuuugauuguuuucagauuuuggaauauuugcauauauguaaugagcuaucuuggggaugggacccaugucuaaacacaaaauucauuucuguuucauacacacuuagccauauacacagagccugaagguaaucuuacauaauauuuuaaauaauuuuauguaugaaacaguuuugaaugucuuuugacugugacccaucacaugagguaagguauguggaauuuuccacuuguggcaucaugucagcacucaaaacguuuuggauuuuggagaauuucagauuuuggauuuucagauuagguguguucaaucuguauauauggguaagauucaguugucuccuuuaauccucggcugaaggaagcacuaaagauuuuggggccuuaaucucccaugcagugacacucucaaagccauugacucagcuucucaccugggcuuccuuccagugagccgcagauagcagucauagauaauggcaggggcccgguggcugaccgcauuccaguacugugaugugaagcuguugcugguaaaauuagcauuuggccuccugaaaggucucucaaaugggauuuuuucaaagguugccaagacuuggacuccuggggaaaaaagaaaguaagugcuagaggagaaaaggagaauauaaguccaucauaguggaaagcauuuguaaugggucaaaacaauaaagacgaaggauuugcuguguagagucaagaaucaauuucugagaacaauauaaagauuuuugugcugggcaaaugguuaucugcaaacugaaacagugugaauggguuaauaauuggauucuuuaguugaagcauuuacuguaaaacaaacuauuggggaaacacuugucaauacaaggagguacuguucagaaaaacaugaaucugccuuuaauucuaaggucauccagucuauucugaaagccccaagacagaggcgagagaccuuauuucccuggcuggaccauuacuuucagaaccauuuagaaaguuucuuaacauuuuauuugaaucuuuauuaaagguuuaaguaaaagauuguaaagauucucaaggcaagauuucuuuguguuagucuacuucaaauacuucucugggaauauguuagacucaauuguccacucugguauccagaguuuuauucauaauaguauuuuucuuuuuauauuauuacuuagauuaagcuuaagaacuuuuuauguacauuugugaauucaguaguuguuuccaaaagauauucauuugaauucaauuuuauuuaauguauguagguuuuuuuucaaagcauaugccuaagcucauuauucaauuaugaugauaucacuuauuaugguaauaugauuauugcccuccuuaaaaaaauaccagcuaaaaucugucugaaaauauaaauccuauacaaagaagagucucaagaaucaccugguucauaggcauuuauugaaacauuuguggcauuauuaaaacauuugguucugauagcguaagagauucugaucucaacacugacauucugauguauauauccauauaccuguucaacauuuccaucuggauguguaauagacauucacauuuaacagcucuaaaauuggccuccugauacucccacuaccaaccacccccuucccaaugcauacacaaacuugcuucuucacuaaucuucuaccucuaaccaaaugguaauucaguuuuuuuaguaguucagccaaaaacuuuggggucauccuugauucuucucuuuaacaacccacacacaauucaacaaaaucuaucagccuucuguuugaaaaauacccagaaucauaauuuccaccuucugugucucugauccaaaccacuacuguagccuggaguguugcaguacuguccuaaauggucucugccacuacccuuguacuccuacagucugaccuccauguggcagccggagugauucuuguaaaauguaacucagaauauauuacagauacuucuccauucagagcccuucaguggaaucucaucucauuuggaggcaaagccauggucuggaaggcuuugcacacucugcauccucacucucucugcccaccacucugacuuuaucuccuaccauccucccccucagugcuucugcugcagccauacuggccuccuugcuguccuugaauaugauuaaagagcuguagcacuuauuguuucuucaacuuggaauaucuccuccacaugucccucugauuugcccccucacuucuuucaggucucugcuaagaugacaccuuaucagggagacuuuccuuggccaucacauauaaaauagcagccuucccacaucacuauuuacuucuuuagucuguuuuauuuuuuugcagucucucaaccauaucugauguauauuucuccuuuuuaagauuuaaguaccauaacaaaauuuugucuguuuuguuucaaccuauauaguaccuugaaaguggcuggcagguaaucagugcccaauaaauauuuuuugaguaaaugaaugaauaaauagcucagcaacauacaauuacuuuccauuuccuaaauccauaccaauccuucuuuuagucauuacaaauacauuuauuuagcauuuaacacuugcuaggcauugugguaggugcugagguaaaaaaauaauaauaauauauaugauauauucccugucuuuaaggaauuggcaauuuggugggagguguggacaguuuaugauugcaauauuuugccugaguauucugcuagagaucagugcagaguauucugcucuggaggaagacaaaagaagccucuagcucugucugggugccaggaaggggaggggugaggcuggguuaggaaaggcuuucugagaaagcuguccaaaugguaauagcaagcguuuacugaaauguucaccguucuaaucacugugcuaagcacuuuaucucauuaaauccucccaagagcucccuggaauagaauaauuauuauucucauugacagauaaaaaaaaaaaaaaagaucuacagggagaaacugagugacuuuuucaaguugauacaacuaguaaguaguggagucuacuaaaugguaggacccauaccagcauauaacaucugugugggcauggauuucuguuuagugauguauccauagcccaagaauaaugccuauuuaaugaauacaggagugaaugaaugagcuaagauuugaauccaagucuauuagaucuuaaagcccaagacuuuuaaccauuaagcuacugucuuucugaucugaaggacaaguagaaauucaugcacauguagaaaguuuaauuuggcaauugaaaacugcacuucuacauccucauaggucaaagaagaauuuaaaugaaaaaugcuuaaugcuuagagaguaauaacauaaacaucauacaacuaaaugugugggauacagccaaaguggcauuugagcgaaauauaaagccauaaaugcauguauuagaaaagccgaauauucgugagcuauauuucuaaguuaaagagaagaaagaaauaaucaaagaaaacaggaggaaggagaaaauagagauaaggcaauauaucaaugcaguagaaaaugaagcaacauaauaaagaaucaauaaagccagaaguugguucuuugaaaaaaauaauaaacccuuuggagaagacacacaacuauuaugaauuaaaagagaaacauaauuauaaauacaguuuaggacaaaaaaauugauguaaugugaaaaauuuuaugugaauacauuuuaaaacaaauuauuagaaaaagagacaaauauaauuuacuaaaacugauuccaguagaaacugaaagccugcaaaauucuuuaacuauugaagcaauacagaauccuuucacaacaaaauuacaaauccagauaauuuauagguaauuuuaccaaguuuccaaggaauagauugcuccaauauuacacaaacacuuucagacaauagaaaacaacaagggaaauauuagcaaacugaauuaaacagaauauaaaaaagauaauaugcuaugaccaacuuggguuuauccuaaaaauggcaggauaguuuaaaauuugaagagucucaagaaucaccgguucauaggcauuuauuaaaacauauguggcauuauuaaaacauuugguucugugcauaaccaaaaguuaugcacagguugauagcauaagagauucugauaucccauguucaccgacccagcugucugucacuccuuguaaugucaccugaggcuauguauguucaaccuccuauggcauggcuacugcuccuaguaggaagcauuuugaucccucuuaacccugguaggaaacacaaacuaauuuaauuugaaugcaacaucagauuaauuaguaauaucuuccagaaaugcuauauuagaugggaaucuagaacagagccuuggcacaggaagaaacaauguuguaucagccaacaauguuugcuauagguguaagaggaggagagaaaaauaccugcaugccagguauuuuccauucuuggaaaagcauuuuucaauucaaagccuauuauaaaaugagccacagugucuagcugcccugcaauagaacucucaguguggcaccauggcuuaccacuggaauguguagagguaguguuaccuauguaacagggaaagaaagugugcauuaguagguaguaagaaauccuacagaauagccaaacucccuacuuuaacuuucuaccaucauuagauguuuaaguuguacucaacucuauuuccaugguuuuauacauugaacagauccaauccuuuacauucagacagaucaaucauuuguauaguacaggguuucucuguuucaccaagcaucaagaaucaucuagaugcuuauuaaacauauaguuuccucagcaccacccaagaccuuggucccaggguucaaggaaucuggguguuguuuuuauuucucccauagugcuuccuauucacuuuuacaaaucgcuaguggagugguuauugcacaccugagaggcaagcugcauaaauuaaugaucaguaugauggacucaauaacaaaggauuaauaucaccuaacuuuucuaucucauuggucauugaugaugucgcauucucagugacauaucaagaagggaagggguguguguaggagccauugcuccaacagggaggaguauuucaguauuuuaucacugacauucuuuauaacugccaacuuuugcuuuguuucaucauuuuuaaaaucgcuauagccaauggaccccuuacugcuuacaaucuuguacauguugccacugacuccuuucuuugguaaccacaguacauucuaguuaacuaucacacauuuacaauuucucauuauuuugucucuuuacuuacuuuuugucuuucuccccauauaagcucuaagcuccaugacacacuuugucaacuuuuucucugugccagacacuaguaauuauagaguuacauagcuaaaguacuuacccauuuugugccaauugcagggauucauguuaccagauguaaugugguagacuaauguugacuuaggucuggaaaaugaaauaaaaauuagauaaguacaacaaaauagaaaacuaaugagagaaaaauaaggaaaaauaauauuuagacagagugguuucaguaauucaucugauuaaggcaaccuaugaaaggcuuccaucguucauucuuucucuggguuaauaagcaaaauggaagaagacuaggaaaagcaugugugugugugugugugugugugugugaaagagauguuaaauaggagugacauauuauggaguacauauaugugaguucacauaagaaaaauuuaauuuacuaacagacccaaauauaugaacaaccuauuuuuuuuccuuuguaccaggaagcuuccccacacaucgugacugaacuuuuggcauuuaccagaguucaauuaaaaaaaaauucugucauuucaucagcuucuaucuccuuugcccuaaaagagaaagcugaauuuuagacuacugaauagaaagaaaagccuuuugguuaucaagaauuuuaugguuaagugauuuaaagguuuuauuacuuuaugaguagccaaguacuaaacuguauuuauaaaacaacucaaugcauauaugauggcauauuaggaacucuauaaaauauugaaauacgcacuuucacacauuuggggucuuguacaaugaaaugccuauauuuggaaaaugggccuaauauauucacucugccccucaugaagucuuugaaagcccacuugagcauccacaccugugaacugcaguauaccauccuacagcuagcaugagauugacgacuguaucaacuggaauuacgucugccacagccauuggaguagcuuuuauggcccgaagaaacccuuucccagucugcauaggaaaaagaacauaaaauauuaaaccaggucuuaaauaauagcuggggcuaaaguauguaucaucaaacugguuauacuagugcaauaagugaaaacagcuaacauugauccacugcuuaccagguucuuaugcuaagucugacuuccucagccuauccuaccuucccagccaagugcaugcgucuccagcauuuucaugaacuacuaguguuccucacguuccuuuagggaauaaaauuccucaaauuugugagagguuaauaaacucaauuaacaaacaccaagaauaaacuuuuacaucuuaaaaauuaauucauaagacauguuaagaauuaagguuauacaaauuucccauuaauuuucccauuaauauuuguuuaccauuuccuugaugauuuuguuuucugcuaggguuuauuaacuuacaagcaauaguaggcacuaaaaguuuaagaaauacuuauuugaaaaacauuaauuggugaaauuccaccauuaauaaaagaaaacuuuuuuuuuggcuuggaaaaauugccuuauuauuuacuuuuuauucaguaucuuaguucaccucacagaucacugauguuauauagaugcaagaauuaggaauuauucauguuaauaauugguugaguuuaugaaauugauucuuugugcuuugcauguuuccaacauugauuugcaacgauuagcacuuucuuauguuacucaguucuguuuucuuauaacuagcuccccuucuuuuggacauaagaaaccaauuuagaacauuuuagaaaauguaaauaaauauguagcuuugcauguaaugaaagccguuuugggaucacguuaaaauaaugauguucuaagucacuaaacguucaccccaacugaacuuuuguagaagaaagaguugaaggcaggugggaagcagaaagaaaggggcugcuagaaaaaucagaaaucggaaggaagaucuuugucacuguuauaauucacugucucauaucuguauugcaauucauguugaaccuaguucugggaggaacagagucagagucugaaucgcagucuaaaucccuaauaaaauuuaaacucauuuagaucacugauuuccuauucauuguacagaagaaugaagugggguuuagacccuaaaugcuucagugugagcugugaagccccacagcuuggcuggaucaaucuggacuucgggcagaugcgcacuaagggcugcuuaccuagaggagccacguuucuccugguaagauauuauugaaaagauguugccuauauucauggauuuuuguauuugaaaaauuugcuccaauugguaguucucuuucuuguauucauuaaaaauuauugauguauaucucuuuucuacacacgcacauaaacucuuacauguguuuuauaaucaagaauuuaauaaucuuugaagauauuuuuacugcauccucaauucacugcacuaauucaugagauuauaaacugcaaaaaggaggaaauacccccaucuugugguaacuaaagaaaaguccuugaugcucaaagacuucaaaaauaaaacuccuaaauaguaacugauagcacauuaccucuguuuuucugauaaaaaauucucaaagaauaauuucauccugccuguauauuacaaucagaacaauuaaaauaauaugccucaguuauuaguaaaguaacauuuauguuuuuggaucaaugaagcuaagccagcacuaagaauuuuguuacuauuucucuacuacauuucagggaguuauuucuucaucauuauacauaccgcaauaaugauuccauuagguccauuuauauuaucaacccaacccuaaaagaaagaagauuucuauugguuacacauuucagaaaauuguuuuaucuuuggaacaucugcagucuaaucuuaauaaauuucaaacaagagcacugagaucccagccaauagaacuaucuaauucaguauuauuaagaucucaaaagauaauggcaaagcauuggccauuuucuguacuuuauuugacugugcaaaaauuagaauuuugccaggauuguuuuucuuagcaggaaucaugaaugguuuugugguguuuuaugaccucuuauggacuaaauuggaccuuguccuuauaucaugaucugcuaagcaauucaccaaccauacuucuccaccuuaguccugauuucagccuccuuaggagaacauugaaaacaugauuuguguuaauggcccauuucuuaacauuuuuuaccagcuauagaguccaugccagauauauauacauauauauauauaugugugugugugugugugugugugugugugucugugugucuguguguauauugacuuacuuaaagauguuacagagauuauauuuaagagcagcuagagggaaauguguuuuuaaguuuguuucuuaagaccuaagccauucagcugaccuuauuaugucucuuuacguuacaguauaaaagucaaaugugugaguauaacaggagaggagagagaagagaggagaagaugaagggauuaauauuuguugagccuuuuaguagggaccacuccucauacauugucucaucaaaucaacucuccauaguaucuguccuguuuuauggaagggacaacucaaaaauguugcauuaccaguaaguaguggagcuggaauuuaucuaccccaaagcuucacagacuugcuuucaagaagaugguauaauucaaaguacuuucaaaaggucaugacaguauacugagguuuaaaaaaaauuaguauuccuaaacugagauccuucugugagcuuugaaacucuuguuuacccuggcaguuguaauacuaccaauuuggccaucaaggacauucugguaugcuuaaacuauaguaggaaagccaagauaugaaaccaucacccaugugaauuuugagacuagaguaguuagaagcuaauuuaagcucuccguccaacucuagggcagucaagauaacugccagaggagccacaugcuggguaaauccugaacccaaaguggaauuuugcccuaguauaauggguucauauucgauuggcugcacuuagcuauaaauccugaggaggagaagaagaaagacaucagaaaguaauuggacuagaagaaccuuaguuuggaagcaaaacacagaauccagguaagugggcuuacugggaaaggcuccugccaaguugcucccacaauggagggccuuaugauggcaauguucagguuccugcucucuugcugcaccaccauuucucccaaggccuugguguagguauaaauauugggccaaucucugaucagcuuggguguaaucucgucaauaauagcaucgucuaaccaccuaaaagguagaguaaagagaauucuaguaacauauguuagacaauaaaccaaaaggaaaaugugagacacaaucaaacaaaacuuccaccuuuuagccucgguucuggaauucagaacagucacaugauaccaaguuugaguguguaccugcucaaagcaugcaugagcuuuuugcucuucacugcuaagcccaaucuuauccuaugcccucccauccaaacagauagguagguagguagguagguaggcaggcagguagguagauagaccgauagaaucaauagcaauacuacuuuauuacgaaugauagcauaggacuauuaguacuacuuuauuaguauuacuuuagcacuacugcuacuuuaucaguacugauuacuacuuuauuguaguaguacuaaauuagaacuuuaguacuauauuagagauuauuauuacuuuacuuccucucuagcaagcucauaaguacacucauugaacacauauuugagucccagucauucucccaguagugugcugcaugcuguguucagggaguuagaggcugucauccaaggugcuucaguggcagcccuacucaguguuguccgauaaaaauccagugcaguaauccugaagccuuuagcuuuaaauuuuaaaaauuccacucaaugcaaaucaaaucaaagugacuacuuuuggcacuuacagucuguuuuagcaaaccuauguaaugcauuuugaaggucuguuuagagucuaugcuaauaacuugaaaauuaucuccagagauuuccagugaauucugaagucugucaaguggggugauuauagugcucugaaauagcuucaaaaucacgauuauugacuacuccuacuuacaagauaauguaucaugaauaaccaaguuaccauagcaucagccuaaucuuucuuaaaaauaugucagaaccacuugauaaccccaaagucuaucuacaccucucuaagaaagcaacaaaaguauugucaauuauauauuuaacauucuucuagcugacagaucuaugugguuaaaucauugauauaacauagcuuuuuaaaaauuaagcugccgaaauaugcuagugugauuuuucuaaucaaugugguauauuuauuucuauuuuauagaacagaacagaacuauacuauuuugauuguagaaaaucuucacuguuaccacuuugcugacaugacaaauuuuugagcagcuaagaugugcaugauguuaagacuuauucagaaucacaacuuucaauuuuaaugccucauuugauccugagguagaacaugggcaucgacuauaauguuuccacuuuucuugcuuugcuucuauuagugcugaguguguucuggauacucaaaugucuuuuuauuugaauugaauagagaaagauugagggguucuagaauuaaaaacaacuucaacuacauagaaauaucuaggauauuuuaauuauauggucaccugggggcugggaaagaauauaggaugaugcagacaccucuccaucuuaacaguccuaccacuaucucauuucauuuggugggucaacaguggauugacugaccugagaccauuuucucucaccugcaaaaauauauaguuuaugaaaaccaggucuugagggaauaaagcuuaauuucaauaaagcuguaaaaaaaaaaaaaccuaggaaacaucagagcccaauaaugugcagggauuguaugucacauggcuaguaccaguugcugucauuaauguugggguacauggaaaggauaauauuuggggggauaggggccuuauaaagcuuggugaguuugcuugucuuagaaaauuuugguuucguagauuucugacagcacgcaugcaagaaauuuuaauauucuauagaugacuugccucugcuacucucagcuacaccuguauuccacuguuuuaucuuuucauuccaauuguacuugugaaaauggcaauaauuauacugauucuaaauucucauaagaguaaacaggaauauaaauuaccuaguuccaauuguacuugugaaaauggcaauaauuauacucauucuaaauuaucauaaggguaaacaggaauauucacaacugcauuuaagcucuuugauaaaacaaaaugagccaauaaaccuaaggcauuguuauuuuuuaauaaaacaaccagugagcaugcaucuuuguagguaauaguuaguuuuaaagugucauuucuggccaagugcggugacucaaaccuguaaucucagcacuuugggaggcugaggaaggaggaucguuugaguccaggaguuugagaccagccugggcaacauaauaacacccugccucuacaaaaaaaauguaaaaaaauuaauggggcaugguggugugcaccugcaguuccagcuacucaggaggcugaggcaggaggauugcuugagcuugggaguuggaggcuccaaugagccauaauugugccaccauacuccagcuugggugacagagacccugucucaaaaaaauaaaauaaauaaaaauaaaaauaaacaaauaaaacaaauaaaaauaaaauaucacuuauaauacagccaaacagaccaucugaagcucauccagccacuuccuagguucagaggagauuaguguaauaaacaugcacauccacugguugggccaagccauucuuaggacuuaaacacucaauucaggguugcugcugcuguuuguucucaauuuguuuuuaaaacaguaaauaaguuagcauagauaaaaaacacauauaaaccaaaauacaugucugaaauuaaucuaaauguccuccaguauacucaagaagauguuuugaacccaugggucucaaauucuaaacuugaauugcuucagaagaagcauaaagucauugaaaauuucagaaagcaguauguauaugucuauguguguucacauauacacacauacacaauuucuucuaaauauuaucaauuuugguuucaaacuuauugaaucaacaugauuauaucauuaaugguuuauuuauguauuuacugaaugaauuaccaagaggcauauguauuuccccuccccugauacccucaauuuucuuaugcaacaagugggcaagccuaguaguuuaucaggaaaucuguuagagaguaaguaguggacacacugucuuaugauaauguuugcucucucuuucuccaggguagauuaugucauucucuugauuguuguaguuaucaaguuguauuugcuuaugugucugucuccccacuggacagacagugaguccagaagaucagggauuaugauuuuuaucacugugucuaaucaccuuucugcccccaggagccagcugccuuauucaguaaaugcauguucuuccacaugauaaucuugauuggccaauuucuauacuauguaagguuuugggaagcagagauggacaaugaugagagaaaguggaugaacucaaaagaagacgagguuguagggagaaugugggaaaggaaggaagggguuaucuuuuagagcaggaagcaaaauuggaaguaaaguguccaguggcaauggugaaaaguguugaccaaccucguuuuggugaagguggcuucaaggucaacuuaaacuuuccagugggaagcaggguauuucugagccuaaugcuuauggagaauuggccucuguauuucccucaagacuuuuacggagcaccuagccaggcucaaacaugagccagaugcugaauacccugccaauggccugccauuugaaaauuacucaguuugguuaagaaacaauuuaaucuuauucugguuuguaauuuaaagccugcuaauaucaaaguacacagaauucucauuuuuacuuagcuacauagaugucauuuugaagcugugccauccugaaauuaaaagcacaagugcuagaaucagcuuucaccguuccccuagaagaggucagcuuuuuuaguguuaacaauguguucuauagcacgaaggcaaaaaagacuacuuucuaacaucugaccuccuuucauaucucccagaggacugugauaagggccacugcugcuggcugugggggccuccauuccccugccucucacaccugcacccucagugcacacgccaccuuuccuuuuucacauggcagcuuagcugugucuucuggugacuguguagccucagaagcaugguuuuuaguagguacagaucuacuaggaacuuuccauuaaagcuucuaagaacugaaagacaacaggaggcaaggagagcaggagaaagagggagcauagagauaaagaagauaaaugauccucauuucaaaugaagacugcucagugaaaaaccuccuuaagguagucuuucccaaacuugccugcucauaaauaugaauuacacagggccccugggaaaaauccagauuccuggguaccauuuuagaaucacuaaauacaucugcagaguuaagagucugauaaucuguauuuucaacaugcccuggaaauuccaacagucgggcaaaucagggaaucacuaauuuaaaagaaguccacuccauaaacuuaagucauugagauuugaauauaucaggauuagcucucaaaaacgcauugcuucauggaguaaaauuucaacagaauugaauuuuaaaagaauuaaaucccugguacuagaaaugcaaaacaugacaaguaugcauguucuaaucuggaguuaauuugauaggugcaaccccauaugcaaagcaguagccauguccuauuguuuuuuucuuucccaaaacauggagauguuuuuuauaccuguugccucacccucauucuagucuuccauacuacuccucucugguaaugggucucgcuuccuccgucuacucccuaugcuaauccacugccucccccggccccuggcuauauuaauauuccugaagcccacuuucaucaguauuuuuccaugaugaaaacaaaugagcaaacaaccccaaauuacacacaaaaaugcaugcgcacacauggcccuccuucaauggaucucuacugcauagagaauuaaauacaauuccucugcaugguaugcaaaaucuccacaguauggcccauccuccccuccagcuugaucucuaacuucuucccuacacguaacacaugcgcugccaagauggacuacuggcugugucccaaacacgccuggguuucccagcuccagcugcccugccaggcacgugugcacaucucaccuauccacacucuauccacucuuccaagucuucucauaugccucccuccacuccaccagacuuaauaugaccuguuuccccaccaccacacguguauaauucugccguguucuauuugucuuggauacgagcucuuuggaacauagucuauaucuuaagaaagcaccuuuuuuuuuuuuuuuuuuuuuuuuuuccuuugagauggagucucgcucugucgcccaggcuggagggcaguggcacaaucucucggcucacuucaagcucugccucccggguucacgccauucuccugccucagccucccgaguagcugggaguacaggcgcccaccaccacgcccggcuaauuuuuuguauuuuuaguagagacgggguuucaccgcguuagccaggauggucucgaucugaccucguaauccgcccaacccagccucccaaagugcugggauuacaggcuugagccacugcacgcagcgagaaagcaccuuuuaaucucuaccacugccaaguacgugaguagacuggaaagaccaugggcuucagaaucaaguggccauggauaaaaauugugucugagagacuuucaaggaguuacuuagccauuuugagcuuuuugcuccgugauuaguauagcagugauaauaauaucaaccuuacaauauuacguuauggaauuaaaugucuguggaagugucuuccucacaguaauugcucaauaaugauucauguccucccuucccuucuuaauucagauuuauuuacauaugcucaauagagcaauaaauauuugugauuccauuuuucuaguaccugcuuccaguuauuucagguuuuuauacaggcacaaaagcccuuuucuucuacacugcuuucccuaagaggaguuaccuugaccuaaaaaauaaggaaagcaccaaccauaaaacccugccuuucuuggucaguuaugugcauuuuaaaaaauaaacauucuacauaagcuguuauucuggaaaacuggaauuucacuggcaaucccugauccauuuaugcacauaaauuuccaaagguaaauauaccaacuaggcagaagcuggcaauaugaagguagagcugagucagaaugggaaccgguggcugggaugaggggcagaagacaacuacagauauaagagccaggaaaaugagucgcuaaacacugauuaacggccaggcuugucauacucauuaaaagcauuaacuccugauuuaaguuauuuuuaaaauauauuucugcuaaugugcuaaaguuuuuguacuaacuucaucuuucuggaauauuucagggccaagguaaugcuaaaaguuuuuagauaggggcuaaagaaagggagcucaggccugacagucucagcauacaggauggauagaaaauggggggagcugaaugagcagagacuuuaggccugcaaagguugggaccaggauguaagcaugggguucaaguucacagucccauuauuaacaacacugagcaguaccacugcugcccaagcaaacaggaaagguccgggccaaaaaugcauauccuucuuuauuucccagaacuggaauucccauucaacugauuuucuggaaaaauaaaguuucauuuuacgucgucauggugauuuucuugagaauauaaugccaagaguacagcuucaagaucaucuuguugucuaacgccugguuccuuauaaauaaauaaauaagaacugcugaauuacuaagagcaauggcagccacuagaccccuugaaguuacuguuaacaacaacaacaacaacaacaacaacaacuuucccccaggcauuucucuguugcacugaaagaaaggaaaacucccaggggaaauagaaaccuaaaaaccuuggaaaauaauuccauuuuaacacagaccaauuacuaaauagagaauuacucaaagaaacaaaguauuuuccuaaaacaaagaaacuaaaccuggauuuaggugaauugauauuuauucagaaugauuuuuaauguuguuauucuaaaacuuccaaaaauuccaucugguauaggagucguugaaauagucguagaucaugguauaguuggugagggguugcuggguuuuauuuaaagugcuauucaaaaguuaacauacagguuucauucaaaguuuaagaagaaaaaaaugaacaaccagaaacaaggguaagauguggggauauggauagauauuuuauacauaagacuucugcaucccaaaauaucagcuuguuacagaauucugucaucuauucuugcuucagucaaaacaaacaaacaaaaacagucaaaacaguaugaacaauaaucgucuaugccaccaaaagcuuuucauucauucagugagcauugagucccuagcuggagaugcaaagaggagcaagaaauauucucuucuguugagaagcucauugucuaauguagaauguagauaagcaaccagacauucagaaugaccuguguuacaagcaauaauacagcugaacacuggguacuaugggagcacuugggaagggugccuaagccagagagcuucgcuggggagccuugauaucugaguaagaauuaaccaggugaagcagaaggggaacuaagcucuagggacaaacagaguuucgagugcaaaggcaggcagaguaugaggagggaaggccuuacuucuuugugacugcagcaugaaaguaaggggaggacugagagagaugaggcuggauaggugguccuggauguccuaauuaauucugaauuagcaaauaauaaguaugacuuuucccuguuuuuuaaaaaaacuuaguuccuuaauugcacccagaauuuaucuguugagauaaaauaauuucauuccuaguucuaauuaguugcuuaaauaauuguuauccuuggagagcaguaaaugacagauggagguuaaaaauuuuguacaaaugucaguuacaguuuguucauaaaucauguagcaauuaccugccuugucugguugacauauacuugagggaggauggaaagugcugaaugccugaagauaaaucagcucuuccucugggaggugaguuuauucuucuuugaaaccuagggguauuuagugucuggauauaguuugggaggaagugguauggaguaccuagagaagcccuucacuaugggugaacucuuacuucuuuucuuuucuuuuucuuucuuuuuuuuuuuuuuuuuuuuuugagacaaaguuuugcucuuguugaccaggcuggggugcaauggugcaaucucagcucacugcaaccuccaccuccuggauucaagcaauucuacugccucagccucccaaguagcugagauuacaggcaugugccaccacaccuagcuaauuuuuuguauuuaguagagacaggguuucaccauguuggucaggcuggucucgaacuccugaccucgggugauccacccaccucggccucccaaagugcugggauuacaggcauaagccaacacaccuggccucuuacuucuuuucucugaugaacucucaggcucuuuugcuaccucaaauugcacuaugaccugucagguguuagagagaucagcaguggagaaagucccaggaaacaaucuggaaucaaaaggggucugccccucuccuggacauaucaaauaugaaaacaucacauuuaccaagagacaacaccauaagaggguaacugacagaaaccaauuccauccugaaaaugcucugaggcuuuaaacauacuuuauugucuagacuuugggccucagaauacaccugcuuuuucucccacuauccugaugaacucugcacucuaaaauuuuucucuguaccaauuuagcaaaccuccauuuauuagcaacuuuaaccuccagauccuuuagaugacuuucauucuucuuuguccuggauauuuuuacaugacagacaaaaauaucuauucucagagcuggaggagauaaaaauguuugcccugaagguaaugaacucuugauuuagcuaaaacuuuuuaaagaguauauauuaaauauaaauacaguauuauauaaaauuauaaugugacaaauucauugugaaauaguccauuuuucugcuauaauacuuuuuauauaguuuuuuacaaaaaaaaaaaacaagguaaacuuaguaaaauggagcagaagaauaaagaagcagaaaacaaacuuauucuaagaccugagcuguguuuuaagaugaaagugguuucugcucauuggcaagaagagaaaaauccuagacauuauuucucuugcauccuaggacaguaaagaaagugugucucagccaaauaagucaagagacugucaccuucugccagaucuuggagcaauucuuauucuucauuaguucuuuuuuuuuuuuuuuuuuuugagacggaguuucacucuuguugcccaggcuggagugcaacggcacaaucucggcucauugcaaccucugccucccagguucaagcgauucuccccagguucaagugauucuccugccucagccucccaaguaccugggauuacaggcgccugccaccacauccagcuaauuuuuguauuuuaggcuggucuugaacucuuggacucaggugauccacccgccucagccucccaaagugcugggauuacaggcgugagccaccacccccagccucuaguucuuuuuuaugaauuauuugauuaagugcuguuaaacacucccuagcacugcaauaaguguuuuauauaacuuuuuucaaccucacaacuauaaaaugggcccauuuuacaaaugaaggacuuggggcucagagagggcaaggaauuugcucagucacacagguaguuacugguggagcuaugccaaacucacgucagucugaaucagacauuuuucuucugaacuuuuauacuauacauuauacuugcuuuauccagugacaaugcuaaguucauuaagaagugagaaacaacuucuauguauaguauucccaaguaccucaugcaauccuacgcaauuccacaaaauguuuaagaauuuucuaucccccuucucuuuuagcaguauauuccccaccagaacuagcagggacaagguagcuaaggcuagcaccguuucaaaacauuuugcuucaaaaguguuugacuucaucaucucauuaauagcuacaaagaaucaaagagaacaaaggaacuuauucuacccgccccuugauccuuuuauuagaccaacuuacucaagggaaucaaugauuuuuuuuggcuccacagggcacggauagauaacuucaucgaugugcuucagguuacaauuugaauaggcaguagagauauguauaaaggcuuccagcuuuggcaucugacuagccauaagcaagagcugccggguggcagugacguuaaguugcacagcaugucuagagaagauuaagcagaaggaaauacaaugaaguaagucaguaucaugccuugcuauaacugcaccuacuccaauaacuggcauaccuaucagauuuugguggccgcaccaaaacaccaggaagagaaggaugggucauggcuacacaguuaugugauacucggaauguuuuauguagugaugauguguuuugugcacauaaauccuauucacugacacacuguacauauaucuagaggacaauugguucuaaucaaccggaaaaagaauuacaauacucugaauuuauaaaggugcuucuauaggcagccauuaaaagaacacaaacauguaaauuaagcaucuaacugaagaaguuggaaaauguaaauaaacuggaggggagcaacaguacauuuuuuaaaggagcaauguaaguugcucuuguaaagauccaggcaagacaugaaaauugaugucaaaaucuaaaauugcagcuaguagaaugcaaagcuauauaaacaguaugugauaacaaugaaauaguucauuccaggaauacaugguuuaucaaauaccaggaaacuuacuaauuuaauuuaacucaaaugagaaaaacuauauaagaaucuauauguauuuugaaaaguuuaaaaugacauuuaauuuccauuuccaauuuaguuaaacaaauucacuagaacuggugaaaagcuaggagcacugcuuguaacgucagugguaggaauaaugccuacaaucacacuacuacuuaacauuguucugaaguccuagccuuggaauuaauuagaaaaauaaaauuaaagaacagauauagauacuaaaaagacagccacaaaaauuacugucggauuauauaauugcauacauggaaaacagaagcagcuuuuuaaaaaaacugaaauguacuauaauucaguaagguguccacugauaaaaauuacguuaaaaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaauuacguaaaaaaucacuagcugcuuguauauaaacaaaaauuagagaagaaaagggaagaaauguccaaaguugaacguuuaaaauauaucaaauucaucauaaaugaauauauaauaacaaaaaacaaauaaaaaauugaauaaaaugggaaaacauauuguucuuggaugggaagaaugaauauuuuaaauauacuaaauguuuuuaaaguauucuacauauacaagguaauucuaaucaaacucccaaguauucuacauaugcaagguaauucuaaucaaacucccaagauuuuuaaaaaccuggcaaaauuaucuuaaauuuaaucaggaaguauaugcaaagagaacaguaaggaaaauucuauaaaaauggaaguguggcugggcacgguggcucacgccuguaaucccagcacuuuaggaggccgaggcgggcggaucaccugaggucaggaguucaagaccagccuggccaugauugugaaaccccgucucuaccaaaaauacaaaaauuagcuaggcaugguggugggugccuguagucccagcuacauggggaggcugaggcaaaagaaucacuugaacccaggagguggagguugcagugagccaagaucacgccaaugcacuccagccugggcaacagagcgaaacuccaucucaaaagaaaaaaauacagugcugugaguaugcuugcucuaauauaauagaaauuacaguaauuaaaaugauacaguacuggaagugaaagccugauuuaauguaacaaaauaguuuaaaaacugaaauuuaguuuaagagcuuuauaucagauaaagaguaaaaauaaaauauuuaacaaauauuguucaaaaacuaaccauguggcagaaaaaaaaaauaaagcugcuuuacuuucacaucugcaucacucuucuuacagaauuggcccguacuccucuuucuagguaaauacuuuauaaauggaucaaaaaucuaaauguaaaaaugaaaccauaaaaauacuaggagaaauuauaaauaacugcauaaauaauugacuugaaagacauuugauaaauuguuaaaauaguuucagccuuauaaaagaugaagaauuuaauggccaggcacaguggcucacgccuguaaucccagcacuuugggaggccaaggcggguggaucaccugaggucaggaguuugagaccagccuggccaacaugaugaaacuccgucucuacuaaaaauacaaaaauauuagccgagcgugguggcaggcacccguaaucccaacuacuugggaggcugaggcaggagaaucgcuugaacccaggaggcggagguugcagugagccaagauccugccauugcacuccaacuugggcaacaagaacgaaacugucucaacaacaaaaaaaaaauuaagaauuacugugcugaaacuuucaagaagucuuaauaagaaaaaaauguuucaauagaaaaauaggcaaagaacaucaauaggcauuucacaaagaacaaaaugccaauaagcauuuaaauaucauuagccuuuguaaucaucaaagaaauacaaaucagaacaugugcuaccauuuccauuauccuauuagcaacauuaaaauaauuuaaaaauuauaguauuauuuugugacuguaaaaaugagcauucaugugcacagagacaguguaaguggacaccacauuuuuggagagcaauuuagcauuaugugugaaaaugcaaacuguucauaaccuggguaacaucugauauguaucugauaauuguacuucuaggaauuuaucucaagaagagcacacaaaggggugaaaaauacacaugcacacagauguucauugcaguguuguuaauagugaaaaauuaaaacaauccaaauguccaccgacauagaacugguuuaauauauuauauauauauguacaauggaaugucauguaaucauuacaaauuauaauagaauauuuauugacaaugauagauaucaaaaaauauaauugagcagguugcaaaacaucauucucgcuaggaugccauuuucuuccaguaaaauugaacauacaccuauguaaucauagauacauaaagaaaaauuggagugaauauucuccacaauaguaaaugguuguuucuagauggugggauuuuggaggaguuuugcuucuuuguaugucuuuuuuguuuagaguguauuucuuuuuuuuuacagaaacuaugaagaaauuuacaugcacacauauguauacaagccaugagagggaaaugggaauguaccugagagugucgucaaagcguacaguggcugcacagugaaauauuauguuuguacaggagagaagcuccugcauguccucuuugcugauggcaaagucauucugauugagaucugcauaaauagcucugaucuucucaugcacauuuggacaaacuucuuugacuuucucaaauagcugaaacauaaauauagaucaauauacaaaaaauagcaccaucauuaucacauuguucuuguuuauaacaaccugcuuaauuauacucaaaaacugguuuuaguuguaauaacauuacuuaaagaagacaucuggcugggcaugguggcauaugccuguaaucucagcacuuugggaagccaaagcagggagaucacuugagcccaggaguucgacaccagccugcgcaacaugguaaaaaccugucucuacuaaaaauacaaaaaauuagccaggcaugguggugugugccuguagucccaacugcuugggaggcugagaugggaggaucccuugauugauuaauauuagaaaaacuguuaaagaucuuucuggaagagucagaaugaccucuuuguugagaaugugcccaggacacuuuaucaaccuuaucaaucccagaugucaaaagcauugaggacugaccuaacuuccaaaugaucuucagaauugcaguaacacaccacugaaaaggcuggcccuacagugcagaaaaaugguagacagaauugaaauauguuaacuugccagaucaauauguggauuucuucccuuuccuagucaucuucauuaaauccucagaauggcuucugaacaugcucuugccugauacaaaugagacaugauuucucugacuacuugagaucaacuuuuuauuacccaauaaaaacacccugggguacaucucuuccagaaagaucuuuaacaguuuuucuaauauuaaucaaucauaagcaugcuaaauguuuucuucuagagucagauguuuucccucuugauaguuaauguuaauuguacaacaaacauauguugaauauuuuuggguaagcuuaucuaaaauuuguauaauuuucucuuuuuugguaacugaauuuggagaagacucuuuuugagucuacaugauauauuuuauucacuagaaauuuacuuaggguucuguggacucuuucacuuuggccugugaagacuucugacuacuggaaagcaagaaguaggagaugguuucagcauccacccuucucacgaugggguuccuuacauaugauguaaguagucauauuuagauuuucuuuugccuuugguuuuuaugacuuuaaaagacagaaguuacugcuauuccauauuauacuuucagacaaccugugcaacguugaacagcaccaagaucccauauuugcauuacuuuucaggagaucauuacaauuuuaggaaauaauguuccaaucuguguuguaucuguugcauuguauuuucaaucaagaaugcauaucugaaugaacauaguacaauuuuuuaaaagucugaguuuucugauuuagauaguaguugauaauguuccacugaaauaaaucaaugaauuggcugcaucaauucaaaccacaguacuaaaugaggauuccauuuuacuacauuagccuugcuuaauaauaggacuugcccugucaggaaucucaccauaccccuauagcuucuaaaauaauacucuuuaauagugccauguccugaauagagugacagagauggcagccaacuggaauccaacaggucagugguuuuggucuuuucauaacgcuguccacaaagugaacugcauuggaaucacuaguagcauaauuaaaauguauauuccuggguccuaucccauacccacuaaauaagaaauuacuagggcacacccaggaaucuguauuucacaccaagucccccaauugauuuuaaggcaugcaaaugaugagaauuucuccauuuagagugcaaacacggaccauugcagaugaauaacugcauacaacucauuucccuuuauaacugcccagagcaaucuucgcaucaguagcuuucaaacuguaggcaugaaaaaucaaagaaccugguuaaaaauuauuucuuuauuccacccucagagacccuggcucaguaguuuuguguguaaccuaggaaauuguauuucuuaaccgccucugcagguggaucugaugguccagguaccauaauugggaaacacugacucugaaaaauucaugucuguucuuaaauucagggcuuauauuucccccucuaguuuguaaacuccuugauucuuuuuuucuuuuguagggaaacucuuucuauuuuucuuuaauuucuguggguacauaguagguauauauauuuaugggguacaugagauguuuuuauacagguaugcuauaugaaauaagcacaucauggagaagggguaucuaucccuucaagcauuuauccuuugaguuacaagcaauccaauuauacucuuuaaauuauuuuaaaauguaccauuauuauugacuauagucacccuauugugcuaucaaauaguaggucuuauuaauucuucuauuguuugccacccuuuaccauucccauccacccccucccacuugccuucccagccucugguaaccauccuucuacucuuuauguccaugaguucaauuguuuugauuuuuguaccugacaaauaagugaaaacaugcaauguuugucuuucugugccugguucauuucacuuagcauaaugaccuccauuuccauccauguuguugcaaaugacugaaucccauucuuuuugauggcugaguaguacuccauuguguauauguaccacauuuucuuuauccauucaucuauugauggacacuuagguggcuuccaaaucuuagcuagugugagcaguacugcaacaaauaugggagugcagauaccucuuugagauacugauuuccuuuuuguuggguauauaccuugcagugggacugcuggaucauaugguauuucuuucuuuuuuuuuuuuucucagacagagucucacucugucacccaggcuggagugcaguggcacaaucuuggcucacuacaaccuucaccuucugaguucaagugauucucuugccucagccuccugaguagcugggauuacaaguaugcaccaccaugucuggccaauuuuuguauuuuuaguagagaugggguuucgcuacguuggccaggcugaucuugaacucccgaccuccagugauccacccgucucagccucccaaagugcugggauuacaggcaugagccaccacaccuggcccauaugguauuucuauuguuuuuugaggaacaugcaaacuguucuccguagugguuguacuaauuuacauuccuaccaacagcauaugaggguuccuuuugcuccacaucauugacaacauuuuuuauugccuaucuuuuggauauaagccauuuuaacuggggugaaauaauaucucauuguaguuuugauuugcaugucuaaugaucagugauguugagcaccuuuuuauaugccuguuugucuuuuguaugucuucuuuugagaaaugguuauucaaauauuuugcucauuuuuugaucggauuauuauacuuuuuacuguauaguuguuugagcuccuuauguauucugguuauuaauccuuuaucagauagguuguuugcaaauauuuucccccauucuguggcuugucucuucacuuuguugauuguauccuuugcuguguagaagcuuuuuaacuugaugugaucccauuuguccauucuugcuuugguugccugugcuugugggguauugcucaauaaauuuuugcccagaccaacguccuggagauuuucccaaauguuuucuuguaguaguuucauaguuugaagucuuagaucuaagucuuuaauccauuuugauuugauuuuuguauauggagagagauagaggucuaguuucauucugcuguaucuggauaucguuuucccaacaccauuuauugaagaggcugucuuuucugcaguguauauucuuggcaccuuugucaaaagaguucacuguagguguguggauuuuuuucugaguucucuauucuguucuauuggucugugugucuguuuuuaugcugguaccaugcuauuuugguuaccauagcuuuguaguauaauuugaagucaaguaaugugauuccuccaguuuuauucuuuuuugcucagguuagcuuuggcuauucucagucuuuugcgguuccaaauaaauuuuaggauuguuuuuuucuauuucuaugaauaauguuacugauauuuugauaaggauugcacugaaucuguacacugcuuuggaugguaguauggacauuuuaacaauauugauucuucuaauccaugaacauggaauacuuuucuaguuuuugguguccucuucaauuucauucaucaguguuuuauaguuuucauuauagagaucuuucacuucucuggucaaguuaauuccuagguauuuaauuuuauguguggcuauuuuaaaggcuuuuuaaaaaauuucuuuguaaacuccuugauucuuauucaucucuuuaugccugacaguaugccauucauugaaaagacucaaauuuugcuuauugaauuaaaauuaauuccuguaagaucaguaauagaacuauuacuacaauagaauggaagccugauuccugaaguuuguaugacugugaugagagauagcagauagcgacugcuaaacgaggacacaaguguuuccugaguccucuauauuaacugccagugggagcuugaaguaauguaauuucuccagucuuuauagcagaccuucuauuuuuauaauaaugacaagacugaagggacaagaugaaauggugcaaauggaaccuggauaagcaccagcucuucuaaaaaaaauuuucuuuuugguguguuuguugcuaaugugagagauuaaaguaagaaaaauagaugaaaucaaaaugaguaaagaaaaaacagaauuucagaaauuucauugaaagcccaccaauaaagaacaauauaauuauuuuaaauucuaagagcuuauccuguuucuucucauugcauaaacucauauucucuacuugauggcacaagacugagagguaaauaguuggaaagcugcucaccaucaucaaaacucaagcagagggauugcuguugauccauuuuaggaaaccuuguucuuuacaagaguaggacacauuucuguggucacugaaagauacagcugaaaggugaucuaagcauuucagauuggaaacuuugggaguguuccauugacuugccauuacacaggcaaguauuucucuccuuaauuuguuuuuaaacauaagauacucuucuaauuauaugaauaguuacuuguagcccagaggcaacagagaaacugcaaacucuuaaguaagaaaauucagcagaaagagaaaaccagaaaaaaaaauuugucugguuuaaauaaacuccuuggguaugacuucuguagucagacaucaagacugcauuuuuauuagaaguaggaauuggggugggggcauuacauuuauauaaugcuuuugaaacaauccagaggccuuuaacauggucucuuacaaugaacuaguuagccacaugaccucauuuuguaaguauccacaggagauuugcccucuacuuccuggggcucauugaagguaaucuaaucuuuucuaaucaugagaaucuuugaucuuuaaucauuuuacuacgucuuucucuucaaaaagucuuucucuucaaaaauaacuacauuauguagucccaauaacccaccaaaauuugcuuaauuuuuuuuggaaaauaaaugaguaagguugcuuaaacuaaggggcaaucucuguggaauauuuggugucccaaggugaaagagacacuguaauuuuuuuuagagaauuuuuagagugcugaguaaaaacaaaucaaugaauucugcaaauuagcuuuaaguugaaaacaaacacaaauaaguucguuaauuuaagcaaaaaccauuauacccaauguacagauuaacaaaaauucacaaaauguuaaaauuguugcuaguucacuaguaacucucauaagauguaaaggauuaaucuagacguuuuuagugcuuuagcgaagaccguuucuauaacuccauaaggcagcaugguguaguaguauggcugucaacuuucggcauauagcaggguugcccaggaaguugcucaaacaaacaaaccuauguccugacccugaagauucucauucaacaguuauuaguccaagcuugggcaucuaucuuuucuuugaacauggucucuaguaauucugauauacccugaaguugagaaccauugguguauuggaaagagcucaggcccuuaggagucaugaaauauuauauuugaauucugauucugccauugauuugcuaugugacugggggaaguuacuuaccucucugggucauuguguuuuugcauauuuaucuaaaaugccaaccaccugacuaucguauucugugaccucagagaauuaagcauauauuaugcuguucuuaaagacaauuuugcauuuaaaaucguauucugugaccucagagaauuaagcauauauuuugcuguucuuaaagacaauuuugcacuuaaaaucguauucugugaccucagagauuuaagcauauauuaugcuauucuuaaagacaauuuuguauuuaacaaaauuuuaguucacuuuacauaauauucuacaauaaaugcuaaaggcaacacagugcuugauucaucaucugguuauguuuucuuuuccccacaccaaagaucaauuucacaguccuuugagaauuguuucuugcaucugggcaggaaaagagcuaggguggcuaggaagauggagaccaaacuuaagauuauuucuacucuccaacagaacugguggcaucucugcauuauccaugcuagaggauggaaaaaacacugauauuaacucagaaauggcaagcaauaguuucacuuuccucaugauauugucaucgaggaagaaauuuccuaggggaggcaaugcaguacaauagggaaaguauggacuuagagauuagagaccugcauuccaauuuugcuguaucacuuggcacaaauuacauaaccuuggagagaugacaacuguaucucaucugugauguaggaauaggcauacugcagagauuucugaggauucguguaaugaaagucagauguuugucauagugcccaccgcuuuguaguucccuaauaauaggaaaauucccuuucuacuuccacagcaauacuccauuuccaaaaacugcugaucagaaagcuguguuguguguguguguaugugugugugugugugugugugugucuguguguguguugggucaugccaacguuucugauuuuauccugugauccagauacuucuaagaacaaaauguaugccaaaaucauguugaaccucauggcuugguaacuuuuuuuaaugaaauuaguaugggcaauuugaagcuuuuuuuaagacugaagcucugucaccaggcuggagugcaguggugugaucucggcucacuccaaccuccaccucccagguucaagugauucuccugcgucagccucccaaguagcugggacuacaggcacgugccacuacacccagcuaauuuuuguauuuuuaguagagacgggguuucauuauguuggccagaauggucucgaucuccucaccuugugaucugucugccucgaccucccaaagugcugggauuacaggcaugagccaccaagcccggccaauuugaagcuuuuaagaaaaagacuuaaugugauuggaagagauuuuuuuccuuccuuccuucccuccuucccucccuuccuucuucccuuccucccuuccuuccuuccuuaaaguaaauggccugcaggggagagguugaacauccuucagcugaucugacuugaguaacaggaaaacugaaaacugcuuacacuagaggccucuugcuuuuugugggauaguuucuuaguccuuuggaggggcggggcguaaaacaguaauggaacacaacuggcuuuggaaguuuaaaugcaaauauuuccaauuuuggaaguuuuaaugcaaauguuuccaauugccuuugccuuauguagagauuuaacagaaucauuaaugucaaucagaaauucauuuuuggaaguugagaacaagcagcuuuuauacagcgaagcaugaacacacuuuuuuuucccuacaaaagagucugaaaauuaacaagaaacuuagcaguaaugcggccgggcgcgguggcucacgccuguaaucccagcacuuugggaggcagaggcaggcagaucaugaggucaggagaucgagaccauccuggcuaacacagugaaaccccgccucuacuaaaaauacaaaaaauuagccgggcgugguggcgggcgccuguagucccagcuacucgggaggcuaaggcaggagaauggcgugaacccgggagguggagcuugcagugagccgagaucgcgccacugcacuccagccugggcgacagagcgagacuccaucucaaaacaaacaaacaaacaaacaaacaaaacaguaaugcuucuacugugugcuucuuucauuggugggcuuuucuuugaagauguuuucuaauucaaaguuuuuuguuuuguuuuuguuuucuuaguucgaaguuaauuuguuuaccucuuaaagauuaauuuaucuaagccuucugggaacugccagugauagucucaaaaggauucaauaaacuaguucauaaaaugucccugucuucuauugucuuaaaucuaaucauguucugugaacuguggacccaguguguaacccugcgugauuuaucacccagaguucucuacuguauuucaaaguugauuuaccucaggggcaacugaggguuuacugaguaauucagauuuuuccagagaaacugguuugaaggauccagugcaaccugccuagcucugucuuuguuuauaaacccacuuacuggugauaucauucaagauagucccucucuaaaaaccuugaauuuugucuggucuucucggaugaggaauucucaaccugguacaaucucauucuaacucuucucuuauauacuaaguacucaaacuauauacuuuacuauaacuuaacaggaaaagguugaccauuuuugguauuaucucaaugauacauuuuucagugucugagcucacacucauuccuaaguagcuacaucacuuuuaauaauuucuacuacuuaggguuuuauucccuugguauagauacuguccuuucaauguuuucuuaaggaauuauugagaguagauuauuagcaacuuaagauccuaaacagauagacgugggacaugguuguuguaaaaagaaacauaucgguaagacacuaggaaacucgaaaugcuuucaacauuucuuugaacuuuacuacugaaugauuuauuugcaacucauuaucugguauaguggggaaaagccauccaugucuuuuuaagccaagacauauuuaagacaauaauaaagcuaaaauaucaauugcacuaucuacauuugcuuuugacacaaugaaaagcugauugguucauaauuacaugagcauauuuuccauaaguaagagaugaaacagcagcucggaaacccuuggucuguggugagcauguucacauuucaacacacgaaauuuggugugcgaaauuuaccuagcagcuccucagauuuuaugaaaaacuagaugauaauuuuuuaaaaagcaauguugaauacuuagaaucauauuucuaauaaaaauaagucaaacuauuuaauuuugauaaacaguuucaaaacuaaaaaugaacugaacuuauacuugaugacauaauuuuguaaauucaugauugauuucugccuuauucugauuuauuuacuacuuuacaagauagguguuucuuuucuuccacuguaaaaguguaauguguucaucguauuuggaaaauguggaagauagaagauuacuguucuuauuuuuucacuauuauaaaggguaauuuuuccucaccauagaaguagcauaaucauaauucuaauuugaaaauuugaaaaugcaaaaaaauuguaauccaagaucacaacaacauuuagggcuaauaguugagauuauacugaauauaguuuugcaucuguuuuugcaccaauauauuacaaggcuuuuugugucauuuacuauuuuauaaaacaugauucuuaaugccuggauacuugucuaacacuuguauauauuguuuauuuagucauuccucuauuguggaacauuuaaauuggauccaaguuuacuauaaguaauacuacaauaaaaauaucuauacauuauuuguggugucucuggcuguugucuuggagugacaccuuaauuaucuuugugagaaaguccucaagaauccugccauuaauucauauacuuuccccccacugguaugucccuuuaagugcucugaaaauacuuaagaaacuuaguaauaagaaagaaaauuaaucuucuuuuucgauucuucacuucuaguucucuguggccaauggauuuuuuaaaaucccuuugucuagagcaucucccauuuaauaguuucucuuugacagcagggaaacuggaagucagaugugauaucuaugcauaccauaaaaggaaaagaaggaagcagaugucugaauuuugauacauagaacagauguccuuuugaucacauuuccugggggauguaguuguaaucaaaggccaacugguaacauuuuugguuacuauguuuuaaaaaaaaauuuccaagccucacauagcugacaugguuuauuaccuucaggaacacuguaguacuugcagugaguuagaauucauucauuauuaugugugacuggagagauguauugcuuaaaagcuauaccaggcccuacuuaggaauaaguuacaacugcauuaaaucacucuguuugugucaaacucguuaaaguuaaauggcagaaucuagagggggacuugauuaacaugagauaauaaauauuugcagaaucugaugccuaccagaagaaacucugacccagacaggaucauugcauaagagguugguuuuagaaguagaguuggcugaaauuaaagucucgagugacaugaagacaguguuaaagauaaauccaaacucuucuuuauugcuugacacuuuuccaaucagcauugacuucauuccuggcaagcugauguaacauggugaguucuaccucauuuuauacuuuauuugguuaggauaugggggaggggguaaaggugcagguugguuauuuaaaaugugcagucaccuccaccaacuuuccaauauagggcuauuacuuaagggaauacacccauaaaacuuugauuuucuaguaauucugcuuuugugcauuccuaauuuaagacucagugagggugaaagaguuuuagauuuggcaaacacugcacuauuuucuugaauuuuuuggauuugcuaaaaccaauaacaaauuuauuacccaauuuuuuuuuccuuuaacuuuuccguguguugccacugaauccuccacaucugguucagugcuugacacuuaguaggcacucagccaacacuuauugaaugaacaaguuuaaugcauuccaguuuuuuuuuuuuuuuaggugauguugugccuaauguauacaccuucuuucuuucacuucuucauuaauccuuuuguucaugucuuuuacuuaugccaagcugucacauugugugcaugaaccaaacgauuuauuuuuucucccacagccccagaguccgcaaaugacagaccuuaaaccuaaaacacccauuaguuuccgucuuuacucuugcagaaugaguuaugaagccaaagaucgcaagaagagcacacuucuuaacagccacuucagaggugacagccagggaauaagaaauaaggaagaacuuuccagaggauggagccaccacaaauaauaauggaaaagaagguuccucccagagauuagauuuagaggcuauuuaaggaauuuccccacucccaguguaggaagcuucucaauacucgcuaaucaggauuuccuuaugguuauauucuagggacugcugcuugccugccugucuucucuuuuuugaauagaaggugucuuuguuuguuugauuuuauuuuuucuucaacuucgcuguucuacaaugacaagagauagaacagagacauuuucuaccucaacauugggaggcagaaaauucaccuuuuuauccaagaauaccaaaccagaagcugaaauaucuggaucugauagagaggauagucuauucccccuuggacuuuggacuggaugcaauaaugguaugagacccugggguaggaaugagugucuucuaugugugggaaagagaggaaagcagauauuuggcgaccuaaaaagaaggccauggcagaaccucauuaguuguucaacaauccuauuuuccuuuucuccuggacacacagcuaugcauuuuccagccauccuugugguuagaugcccagugacaguucugagaauggaauauggacagaugugauaggcacuucugggccugggccacaaaaaccuuccacaugauguccagugccucuuuuaccccacugacaguuuuuuauugucauccagagagaccuuggaugguuuagaagccauguguagaagauggcaaccuucccuuagcauggauccuugaaugacuguggagugcaaugccuucuaccaauuacaccuacuguguuugagaaucaaauuucauuuguauuaagcuacugauuugggggguuuaucuccuucagcacccacauuaguacaacucaugcagaauggagaguuaaugugaacacauauggcacagacuggugaaaccuaggacuuuaagaugauagaugaauuucugauuauacuuuccuuucccgcaaaaaguuuuuuucaaauuaaauguuguaauauaaaugugaauucuuaaauaucuuucuaaugaaaugaugacuaacuauagaaaagagaaugcaggaauauauacauccuugauaagagugugaaacuguuacaggcaaucuagagggucuugccuagggauaacgaacaaaauaacauaccuggguaaaagaaaugagagguuacugauaaaaaacuaacauuuagccgggaguaguggcucaugccuguaaucccaauacuuugggaggccgaggcaggcagaucgccugaggucaggaguuugagacaagccuggccaacauggugaaaccccaucucuaucagaaauacaaaaauuagcuaggcaugguggcgggugccuguaaucccagcuacuugggaggcugaggcaggagaaucacuugaacccgggugguggagguugcagugagcagagauugugccacuccacuccagccugggugacagagcuagacuucaucucaaaaaaaaaaaaaauuauauugcacaauauaaaacauuauuuuauacuuaggaucacauuugaucuuugcaaauccauaugaaauagcuauuauuaucagauacaguuuaugaauaauaaaaacaagacucauauggguuagguaacuaggccauggucucucuaccaagcucuaucucucugauugaggagagaguaucuagagcaucaguguucuuuuuacugccuuaugcuaccucccaguacagguauaacaacuaaaccuacaaguaaccugcaauugaggguuuagacuuuuagcaucuuuaaccauccaaaacauagcugugggaccaaaaagcaaaaaacaguuuacaaaagcccauauuuauugcaccaagaaaaagccaugucugugaaauauugcuuagaauuuguguacuaaacucagcauaaugaauuaacaaacucagugaccucauuuucuccuagauuacaauaaauggaagacuuaaaaugaugagaaaaauaaacacagaaaaccucaauuaacaggguagaggaugaccuauugaaagauugggcauucaugugugggagguaaaggcaaguccugugagugguaggcaguccgaggcaaguguucucucuuuuuguuguuugauucuaaauuuaugacaacugaagaaagggccuuggccuggucuggaucaacuugguauggagcccaugagaaaugaaagaugauucauaaacauaccuaauucaucccaggcaacagcagaaaugaccaugaaaaaugagccaucugagaauucucaacgauucuuggagaaugucauuaauuacauuuuuauuacagggcagggaugcccaagcugacauauggguuacaaaggcaaaguagaauuucccucuauggguuuuguuaauguaaaauauaaauuaauaagcuuuuugcuuuuacuaauaugaaacauacccaucaauuaguugucuucaauucagaaagaacuaaacuagaguucgauaguaucuuaaauccaaaaaauaaaaauaaaaacccaaccagcagccauuugcugaauuccugagugcuuaggagucuccauuucuagucuagcaaaugucuuccaguugcaauuuuaaacauuuuucccagaucuuucaagaaaccuguaauaguaucaaguccagcacacaaagcuagcuuucuguaagcaaucagucucaucuacccaccuuuacuuuauacagccuccuaaauucaaccuuagaauaaaaaguacuuuuuuguuguuaaaagucuguucucuagccaggugugguggcucaugccuguagucccagcacuuugggaggcugagaccagaagauugcuugaaaccaggaguuugagaucagccuguacaauguagugagaccaccaugucuuaaaaaaaaaaaaauuaaaaacaauagcugggcauggugucacauauuuguggucccagcuacuugggaggcugagguggguggaucacgugagcccgggagguugaggcugcagugaacaaugaucaugcagugcccuccagccuuagugauaagagugagaccaugucucagaaauuuaaaaaaagucuauccucugccucuaagggacuuuguuguuauaaaacuacugaaaauuuguauaaauauaucuuauuaaauauaaacauauuuuauuaaaacuauugaaaauauauauaaaccaggugugguggcucacacuuguaauccuagcacuuugggagacugaggcaggaggacuguuugaggccacaaguucaagaccagccuaagcaacauagugagaucccaucuguacaaaaauuugaaaauuagccagcuuuggcagugugugccuguauucccagcaacucaggagguugaggcaagagaauccuuugaacccaggaguuuaagguuacagugagcugauugugaacuguacuccaaccugggcaacagagugagacccuaucucaaaaaaaaaaaaaaaaaaaagaaagaaaauauguacaaaugaauguuuuaaauugaaacaauuacuauagcaccaaaaugcucauucgaugagauggaaauuucuucuuaaaugucuauuucucauuuugcagcaaaggcaugauuauacuucuauaaauuuuugccuuacauagucagauagaagcaugcaaaguaggcagagccuaggcaucuaccugaaagaaaugcccuccugcauuuucuugaacauauuaacucuuccugagcuccaguggcacuaucucuggaguccuuuuccggcagauaauuuuaaagcaggcgucacuuguuauuuucucucucaaauugccguguucuuugucuucacaguacuuuugaaaauacuuaaauauacauguguuucuuaugaaacucguuugccucacuggacuuuaagaucugugaggccaauuccaugccuguuuuauuuucuacuuuauugccccuguuccccaggcacaaagcaauaagugccugacauacauuuggcucucaauaaauacuugucauauuugugugcuuguucaacuuuucucacucuuuuuguguguagguguguacuuucuuguuauuucuggacacuuacggauuuccuuauuuugccucaaggucagcuaugcauuaaaacuauuuuauggccaggcgugauggcucaugccuguaaucccagcacuuugggaggcugagguggguggaucacgaggucaggaguucaagaccagccuggccacgauggugaaaccccgucucuacuaaaacuacaaaaauuagccaggcgcgguggcagaugccuguaaucccagcuacucgggaggcugaggcaggagaaucgcuugaacccagguggcagagguugcagugagcugagauagagccacugcacucuagcagcugggugacagagugagacuccgucucaaaauaaauaaauauuuuauaaaaaacguauuuuaucuauuuuuuuuuuugagacagaguuucacucuguugcccaggcuggagugcaguggcacauacacacacauauauauauauaaucuagagauuuuacauauauauauauauaaaaucuagagguuucuuucaccuuucaaacauagcucauccccauaacuuaaaaaauauaaaaaaauacaauuuuaucugucuugucuuuauuuugaauuuucaauuucaaagggaauacaagcaauaauaucuugaaucucauagauggccaguaacuacuucuugcauaauuccuuauuugcacagagcuuuauccacagccaaucagcgauagcauucuuauauucugaagcauacacaauuuuguagcaaaaacuuuucaguuuugggauacgcagcaauaaaaucaagcacauauuuuuuuccauggaaaaucucuuuacagguaucagauuccauauagugacaagaaaguagauauuugcauagcuaauggcuugugcauuaauaaucaggugauagaaucuguucuuguuacccacaaaauggccauguagacaugguuugugaucuaccguagauguguuuuucaacuauauuauacacaucagauucccuuccucccacaacucuuugagggaaaaauuuaugggaaaaaaaacacuucuuuuuuuggcauaacuuaguauacagccuaacuuaguaaaaagugaggcccuaggaaauagugguaaaagccauaccuuaaauccagaaaggcuugagggcaagagagaaagacgcagagacucccuggguaagcaagguauuauuacagcauuuuacagauaaagaaaccaaggcucagcaaaguauauaucuaguccacuaucacacaacucacaauuggucguauggagauucacacccaggucugucugccucugaagcccaggcuguuaaguaccaucugaucacaacagauaguucucaggugaucuugaaugcugcugauauugggaccacacuuugagaaccacuguucauaaaagucaacagcugacaguaaauagcccaauagugaaaacaggugcugagauuugcaaggcaguuucacagauaaguuacauagaguauaaucacgauuuccagaacaaaagcaauguugccguguuauaaaaaacacugcauugaaagaagcaguagguaaagauuggguugaccacaagacucucugccacaauauuuaucuagaaaugcauaguuggcaacaaagcucccagacuaacacgaaacgucuacuaugugaggaaaacaaaguccagaggugcgaccaagauggccuacuagaagcaggggugauuggaggcucccaucgaaaaacaaacauaacacuuuuacacuguuggugggacuguaaacuaguucaaccauuguggaagucaguguggcgauuccucagggaucuagaacuagaaauaccauuugacccagccaucccauuacuggguauauaccugucaggccucugaccccaagcuaggccaucauauccccagugaccugcacguacacauccagauggccgguuccugccuuaacugaugacauuccaccacaaaagaagugaaaauggccuguuccugccuuaacugaugacaucgucuugugaaauuccuucuccuggcucauccuggcucaaaagcucccccauugaguaccuugugacccccacuccugccugccagagaacaacccaccuuuuuccuuuaccuacccaaauccuauaaaacggccccaccccugucucccuucgcugacucucuuuucggacucagcccgccugcacccagaugauuaaaagcuuuauugcucacacaaagccuguuugguggucucuucacauggacgcgcaugaaauuuggugccaaccugaggucauagguggaucuuucucauggagcaaagagcaggaggacgggauugaucucccagggaggucccccgauccgagucacggcaccaaauuucaugcgcguccauuugaggagaccaccaaacaggcuuugugugagcaacaaggcuguuuauuucaccugggugcaggcgggcugaguccgaaaagagagucagcgaagggagauaggggugggggccguuuuauaggauuuggguagguaaaggaaaaagggggauuguucucuggcgggcaggagugggggucacaagguacucaguggcggagauuuugagccagaaugagccaggagaaggaauuucacaagacaaugucaucaguuaaggcaggaacaggccauuuucacaucuuuugugguggaaugucaucaguuaaggcaggaaccggccagcuggauguguacgugcaggucacaggggauaugauggcuuagcuugggcucagaggccugacaauacccaaaggauuauaagucaugcugcuauaaagacacaugcacauguauguuuauugcggcacuauucacaauagcaaagacuuggaaccaacccaaauguccaauaaugauagacuggauuaagaaaauguggcacauauacaucauggaauacuaggcagccauaaaaaaugaugaguucauguccuuuguagggacacggaugaagcuggaaaccaucauucucagcaaacuaucacaaggacaaaaaaccaaacaccacauguucucacucagaggugggaacugaacaaugagaacacauggacacaggaaggggaacaucacauaccggggccuguugugggguggggggaggggggagggauagcauuaggagauauaccuaauguuaaaugacgaguuaaugggugcagcacaccaacauggcacacguauacauauguaacaaaccugcacacacguacccuaaaacuuaaaguauaauuaaaaaaaagaaaaagaaaaacaaacacaauaaccgugugaauccuucgccagcaacagaguuauccagguucucucaucaaaauugacuagaaggcuggugugacccaccaagagaaggaagagcaguguggugcgguggcccaccugagagccacacggcgaaggggaguccccucuccccagccaagggagguggugagugagcaugcuacccggcccggggaacugcuuuuuccauggaacagugcaaccuaugggucagaagagcccacuccggaacccaggccaccagggccuaccaucccaaccugagaaagugcagauucuuacagccucucagcuaaaaucugcuuaagccuacugaacuccugggggcagaggggcgacgagcccuggcugccaucaccugcugucuaagccauuugagcuccuugggggaggggcagcagccagcacugggacuggcaacugccuaacaggcuaagcucccugggcaggggaaggguggcacccauuucuauagcuccaggcugugcuuuuccccugcuagugccaggaaggcuggauggcuuggucccaagacuuguccccacagcccuacacaccguggcagccacacacacacuguggcagucugcggccagagugccucuucaggccuaacccccacccauccuuccucguuggugggggaggggcuucccugcaggaucuccaauaacucuagccagaggcuuaggaacagaauucugaucucccugguccugagccccuaaggggagagguggcugcagucucuguggaccagcagacuuagccucuccuccugguaguucugaggaaucagggcaacccagacaaguggguuuccccccagugaaacacacccucuccaccaagggacaaagugguucguuaaacgguccuacucccaaugccacaacagggugagaccuuccuacagggguugucagacacucuauacaggagcaauccuacuggcaucaggcuggugccccucgaggucagaggucccaggagaaggagcagggacccaucuuugcugcucuccagccucuuugagugacaucuccaggcacagcagaaaaucagaugaauaaggccugaagcgaaugcccagcaaacugcagcagcccugcagaagaggaaccugaccauugaaagaaaaacaagcagaaagcgacaacaacaucaagaacaacaacaacaaaaaggcccacacaaaaacccuauccaagggucagcagccucaaagacugaaacuagacaaacucacaaagauaagaaagaaucaauggaaaaaaugccaaaaacccaaaaggccagagugccucuucuccuccaaaugaucacaacaucucuccaucaaggaugcagaacuggacggaggaucagauggacaaauugacagaaguaggcuucagaagaugaguaauauaaaacuaugaugagcuaaaggagcauguucuaaccuaaagcaaagaagcuaagaaucuugauaaaaaguuagaggaauugcuaacuagaauaaccaguuuagagaggaacgugaaggaccagauggugcugaaaaacacagcacaacaaugucguaaggcauacacaguuaucagcagcugaaucaacugaguggaagaaaggauaucagaguuuaaagaccaccuuacugaaauaagaugccgacaagaauagagaaaaaggaaugaaaaggaaugaacaaagccuccaagaaauaugggacuucauaaaaagaccaaaccuacaauugauugcaguaccagaaggagacggggagaauggaaacaagcuggaaaacacauuuuaggauauuauccaggaaaaccuccccaaccuagcaagacaggccaacacgcaaauucaggaaaaacagagaacaccauuaagauacuccaugagaagaucaaccccaagaaaacaaagugcauuagggguagauaacugagaaaaacugccugaagagggaucugggaauuuauucuagguuuugguucuaugucauaucagccuuuuaagaaccauuaguuaucccgaaggcaguguggggcaggagcaagugugcuggccuuagagucaggcuguaggguuggaaauccaauuuuuccucuacuagguagaagaccuuugguaaguuaaagcuucaggccucaguuuccccaucuauaaaaugagaauaguaaugguucuuacuucacaggguuauugcaaagauacaugaaguaaggugugaaaagaccuuuggauaguaggugccauguacuaaguauccaguaaauguuagcuguuaggauuauuuugucccacugcugagucaagccaugagaugugaggcuuuuccaauuugcuugaugaugguuuguaacaaaaucguauucuguugcaagcagauaaauuugaucaucaguguuucugggcagucuacaaugugcugugcuaacagauacaugugcaucauagauguuaacauuccuacacacuggaaaggagauuguaaaaaaaggaacucugaauuuucuuauugccaaucuuaugucacccccuauauuccaaagugcauuaugaacaacauauguacauuuucucauuuaguuccuaugaaauuaguuguuguuuuuauuuaaaacauuggaaaguuugaaaaucuaaaaucugaagguuaagaggugauaugacaacaaauucauaagccagaauuugaacccagauauguuugagacccaagguuauacugccuugaaauuuauaaauuaaaacaugagagaauaugcauaaugucuuuuuuuuccgagaggagagaggguuugauauccaaaugcucauucacagauguaauauuuuauuuccaauguuuuuaccuuagaagaacuuauuggauaauagaaauaucaaaaguucccauaaauaaaauauauaacagcuaaaccuuguagaguuuagacaacugaaaguaucacugcauggcuacuuaguagucacaucugcucccuaagcaauagaauagaacagaauagaagaauauccaaaaaauuuggggaggaaaucaaccuuaaauuuaaaagaaaauuagugaagaauucagaugaacuugcagcagauauuaaggcugaagcauccacucagggaguuugaguauuuugauaauuaguaguuuccagacauagacaaucucaccugcccuggacugaaacuaagcacucuuuucccuccuuugggaaaacaccgauuuccaccagcagcuuguugcugucuuguuuugucugccuuccucuaccugugcagguagccugguccccacuugcaauaugagacuauaagagaacauuguagugaaucaucuugcccuaaggcauugcccaucacacacgcuuuccuauaaggcauaccuuacugucuaggaucuggaaaacccucugcugcagugucuggccagccuugggccucacaaggauguaaaugacuuucaggucugggcuggugcgaaacagcuucuccaucagcacuuugcccagaaagccuguggcccccgugaugagaauggacuugccgccauagaaagcugcaauuguggacaugauuccucccuuucuuuuauagcuccugaaagagguuccugaaaaggaagagaaauaacaaaagauuacaucuucagaaguucucauauucaaagucacuuaaaauguuucuguugcuuccaagagcuuugaaugcagaaaaaaauaggucagacagugagagcaucguggcuuuuaagcaauacgacucauuccaaucaauauuuauugaguucucucuacaugcuagacuuuaugccaggaacugugagcaagaaaugagaaagacaugauuccugcuuucaaggaauugcuugcagucuaauggaggaggcagacaauaaagagacuguuaaauacaauauaguaagugcuaaaacaaagggagaccugagagggguacauagaagcaucuggaaauuucaaagugucugugacaucugagcugaagcuuggaaggcagagaagggcuggggucauggugucccaggccaaggaaagagcaagggcaaaggugcagugguguggcacagcgugcuuaggggaaauaaagggaugcaguguuacaggacauaaaugagaagguuaggacuggcccagcaguuugugaaaccaaagcuuagaacagcuaucagguuuuuuaaaauuaugauguaauuagaguuugaguuucagauuuauuuagagaaaauacuggaauaaauaauuguugcgggaagucaaggaccuuaaacagagggaccggcugaagccauggcagaagaacguggauugugaagauuucauagacauuuauuaguuucucaaauuaauacuuuuauaauuuauuaugccugucuuuacugcaaucucuaaacauaaauuguaaagauuucauggacacuuaucacuuccccagucaauacccuggugauuuccuaugccugucuuuacuuuaaucucuuaauccugucagcugaggaggauguaugucgccucaggacccuguaauaauugcauuaacugcacaaauuguacagcauguguguuugagcaauaugaaaucuaggcaccuugaaaaaagaacaggauaacagaaauuguucagggaauaagagaaauaaccuuaaacucugacugccagugagcugggaggaacagagccauauuucucuucuuucaaaagcaaaugggagaaauauugcugaauucuuuuucucagcaaagaacaucccugagaaggagaauacgcgccuggagguauaggccuaugaacggcccccccaaggugcaccugucuuuuauggucaagacucuaggggugaaauagaccccagucuccuauagcacucccaggcuuauuaggaagaggaaauucccgccuaauaauuuuggucagaccgguugcugucaaaauccugucuccugauaagauguuaucaaugacaauggugcccgaaacuucauuagaaauuuuaauuucaccuugguccugugguccugagaucuugcccugccuccacuugccuugugauauucuauuaccuuguaaaggacuugaugucugugacccacaccuauuugcacacucccuccccuuuugaaaaucccuaauaaaaacuugcugguuuuugcggcuuguggggcaucauggaaccuaccgacaugugaugucucccccggaugcccagcuuuaaaauuucucucuuuuguacucugucccuuuauuucucaagcuggcugaugcuuaaggaaaauagaaaagaaccuacggggcagguuccccaauaaauaauauaguuuuguuaaucucuuccuugaguugaaaaugugucuaggucaagugccaccuuuuucccccuuauaugcugcucaggggguagagacacugaaaagcaaagguagaggaggcugaaaagggaggccaccgaccacagguuuuggugugcccugaaauagcuugggcugcaaugcaaggcuugguuuguccacauaaguccuguguuuccagaagugcugagaaaaaaugaaucugguagcaggaagccagaugcaacucuugcugcagaaacgcaccaugaaguguuuugucuuucaguucugguuggagauaauugauuggagacagcagcagagagcuuugaacuaaacagugcuggagguguggggaagaucuuccuuucuguccacucacuuugucaacuguagaaaggccucaacugccuauguggacaggguuuggauggauccugcagaacagcuccagggacuggcccugacaucagggcuuauaaagaagaaaaaaacaacuagaagugucaacacccugcucuccaacucugguccagaaugcucugcuaguaacuccuuaagcaacaaugacucuucguagucauaauuuauauuugaagaucuugaguccauguucuuagacagaauucuuugccuuuggggaauuauuuacuaaaaaaauuuuucagcaccuaccauuccagacucuaugcuaaguucugaagacacgcagaugaacaaagcagacuguuccuugcugucacucuagcaggggaggccagcaaugcaaagucaaauaaacauauaaacaagaucauagacugcugcacaugcuaugaaguaaguaaaacaggggucaaugacagaaaucacacccaaucaucaaugcuauucauuuuaggaaaucuggauuucaaaucacauuagcuguguucacugaguuacuguuugagcucccuuuguugaggguggauaagagaaauacuaugaagaacacuuuuggaucuuguuuuugucauguuacauaauguuacaugaguauauuacaauucacccagugacuuccucaagaauuuagcacuuggaaacaguauuaaacauucuugccuugccugcuuuggagcucagaaaaguaguguccccaaguuaggagggcagaauagcacccaagauuagcauucaaguucuaagcaagacuguuugaaguaaaaucccaguucuaccacuuauuagcugugugaccucaggaaauuacuaaucucucugugccucaguuacuuaucaggaaaauguagaaaacaaaaguauccacuuaauagugcugugguaaggauggaaugagugaauacaugcaaaacucuuagcaauauacauugccuauagcauagacucaaauauuggcuauuagcauagucacugguuuuacauuuuuucuucuuaaugguuucuagcuuuucuuuuuggcauuuauuuuaaauguccugucucguacauuuuguauacccauuuucuuuuguaaauaaaaggagacaauuuaacacucaauaaaucauaacagccaaguauuuucaccaaauauaacuauacuucaugauaaauuuugccuauuucuuuaaaaauguugagguacccuacuucuuuaauaggauauuaggcauaaauaaaugugguuggcacaaaaacagaaggaaaguugaguuuggagagggugacuucccaaccccauuuguucugaagaugucacaugcuucucuuaucauacacucuaguggagucauauuuucuagaaaugcaaauauacuguuaggauauuuugaccccagacacaguuuugcaagguaugaucuaaaauuuuagagauuucuuucuaaaguaagauauaucaaugagccuguaguguuuacauuuuugcugguacauaguagguauauauauuuauaaggcacaugagauauuuugauacaggcaugcaauguguaauaaucacauuagaguaaguggaguacccaucaccucaagcauuuauccauucuuuguguuacaaacaacccaauuauauucuuucaguuauuuuuaaaauugcaauaaauuauuguugacuuagucacccuguuuugauaucaaauacuagauccuauucauucugcuuaauuguauuuuuguucccauuacccacucccuucaacacuaucccucucagccacugcuaaccauccuuuuauucucuuuguccaugaguucaauuguuuuaauuuuuaguuccuacaaauaagugagaacaugucaaguuugucuuucuguaccugguuuacuucacuuaauauaauguccuccaucuauauuguugcaaauaacaggaucucauucuuuuuauggcugaauaguacuccauuguguauauuuaccacauuuucuuuauccauucaucuauugauggacacuuggauuguuuucaaaucuuggcuauugugauuaacacugcaauaaauaugggagugcagauaucucuuugauacacugauuuccuuucaucgggguauauaccuagcugugggauugcuggauauguuacauuuuuuguuuuuugaggaaccuccaaacuguuaucuguagugauuguacuaauguacaugccuaccaacaguauaugaggguucauuuuuauccacauccucaucagcauuuguuauugccugucuuuggauaaaagccauuuuaacuggagugagauaauaucucacuguaguuuugauuugcauuucucuaaugaucagugauguugagcaccuuuucauaaaccuguuguccauuuguaugucuucuuuugggaaaugucuauucugaucuuuuacccauuuuuaaguaggauuauuagauuuuguucuauagacuuguuuguguuccuuauauauucugguucuuaaucccuugucagauggauaguuuacaaauauuuucucucauucuguggguggccucuuuacuuuguuguuuguuuccuuugcuguacagaagcauuuaaacuuguaaucccauuugugcauuuuugcuucuguuuguggguauuacucaagaaaucuuugcccagacccauguacuggagacuuucccugauguuuucuuacaguaguuucauaguucgagaucuuauauuuaaguuuuuaauccaauuuguuuugauuuuugcaaauggcaagagauaggggucuaguuucauucuucugcauauagauauccaguuuuccuagcaccauuuauagaagagauuguccuuuccccaauguauguucucggcaccuuugccaaaaaugaauuuacuguagguguguggauuuguuucuagauucucugcucuguucuacuggucuauguuucaguuuuuaugccaguagcauguuguguugcuuacaguaguucuguaguauaauuugaagucaggcaaugugauuccuccaguuuuauucuuuuugcccaggauagcuuuggcagaucugggucuuuugugguuccauauaaauuuuaggguuacuuuuucuauuucugugagaaaugucauugguauuuugauaaggauggcauugaaucuguagauugcuuugcauaguauaggcauuuuaacaauauugacucuuccaacacaugaacauggaauaucuuuccauuuuuguguguguucuugucaauuucuuccaucaauguuuuauagguuuuauuguagagaucuuuuauuucauugguuaauuuguagguauuuaauuuuuuauuuguagcuacuguaaaugggauuaccuucuggacuucuuuuucagaguguccacugugggcauauagaaauacuacugauuuuuauauguugacuugguaucuugcaacuuuacugaauuuguuuaucaguucuaacaguuucuugguggaguguuuagcuuuucaagauauaagaucauaucauaugcaaacaaggcugauuuaacuucuuccuuuccaauuuagcugccuuuucucucuuucucccucucccucuccuccucucucucucucuccuuuauuuauuuauuuauuuauuuauuuauuuauuuauuuauuuugagacaggaucccacuauguugcccacacugcacacuggucucaaacugcugaggucaagcaaugcucccaccuugaccucccaaagugcuaggauuacaggcaagagccaaugcaccuggccuauuucucuugucugauuacucuaguuaggacuuucaguacuauguugaauaacauuggugacaguggucauccuuguuguguuccagaucuuagaggaaaggcuuuucguuuuuccccauucaguaugauacuagcugugggucucauauacagccuuuauuguguugagguauguuccuucuauacccaguuuuuugaguguuuuuaucacaaagggauguugaauuuuaucaaaugcuuuuuucagcauuaacugaaaugaucauaugguuuuuguccuucauucuguugguaugauguaucauauugacugauuugcacauguugagccauccuugccucccuuggauaaauuccaugugaucauggugaaugaucuuuuuaauguguucuugauuucaguuugcuaguauuuuguuggggauuuuugccucaguguucaucagggauauuggcauauaguuuuccuacuuuccuuuuauuccuuugaugugucuuuaucugguuuugguaucaggguaauacugguauuauaaaaugaguuuggaaguauuccuuccuccucuauuuuuuggaauacuuugaguaggauuaguauuuguucuucuuuagaugucugguaaaauucagcagugaagccaucaaauaaugagcuuuucuuugcugggagaguuuuuaauguggcuuuggccucauuacuuguuauuggucuaugcagguuuugaauuuguucauggcucaaucuacuggauugaaccaguucucucagcuggacugagagaaauuuauucuuaguacguuguacauguuuaggaauguacaaccuaccaagaauaaauuucucucaguccagcuuucacuguaucccauagguuucgguaugcuguguuuccauuuucauuuguuucauguaaauuuucaauuucuucauugacccacuggucauucaggagcauauuguuuaauuucuauguguuuguauaguuuccaaaauuggucuuguuguugacuucuacuuuuacuccauuguggccagagaagaugcuugauauuauuuccauuuuuuaaaauguuuuaagaccuguuuugugaccuaauauauggucuauccuugagaaugauccauguucugaggagaagaauguguauucuguagcuguuggaugaaguguucuguaaauaucuauuaggacuauuugaucuacagugcagauuaaguucaauguuucuuuauugaguuucugucugagaggucuguccaaugcugaaggugggguguugaagccucugcuauuauuguauugagggcuauauuucucuuuagcucuaauaauauuugcuuuauauaucuggggggcuccaguguugggugcauauauauuuacaauuauuauauccuauugcugguucaacaucuuuaucauuauauaaugacauucuuugucucuucucauaguuuuugucuugaaaucuauuuugucugguauaaauauagcuauaaguguuauuuuuugguuuccauuagcaugaaauaucuuuuuccaucccuuuauuuucaguuuauguguaucuuuauaggugaaguguguuuauuguaggcaacagaucaugaggucuuguuuuuucacccauucagucacucuauaacuuuugauuagagagcauaguccauuuacauucaauguuauuauugauaaguaaugacuucccucugccauuuuguuauuuaguuucugguuguuuuguggucuucucuuccuuccuuccuuccugucuuccuuuuagugaaggugguuuucucugguuguaugauuuaauuucuugcuuuauuuauuuauuuauuuacuuacuuauuuuuugaagauggaauuuugcucuuguugcccaggcuggugugcaguggcacaaucuuggcucaccacaaccucugcuucccggguucaagugauucucuugucucagccuccugaguagcugggauuacaggcgugcgccaccaugccugacuaauuuuguauuuuuaguagaaacgggguuuaucuauguuggucaggcuggucucgaacuccugaucucaggugaucugccugccugggucucucaaagugcugggauuacaggcaugagccaccacgccaagccuuaauuucuugcuuuuuauuuuuaagguauccauuguauguuuuucaauuugcaguuaaugugaggcuugcaaaugcuaucuuauaacccauuauuuuaaacccaugacaacuuaacacugauugcauaaacaaaaaaaaacacacaaaaagaaaacuaauaaaaacucuacacuuuaacuucaucuugccacuuuuuaacuuuuucuuuuuauguauuauuguauuggcuaugucuugaaaaauuguuggaguuauuauuugugauugguucaucauuuagucuuucuacuuaaguguaguuuacacacuacaauuacaguguuguaauauucuguguuuguguacuuauuaccagugagcuuucaguaccuucagaugauuucuucuugcucauuaacauccuuuucucucagauugaagaacugccuuuagcauuuuuauaggacaggucugguguugaugaaaucccucagcuuuuguuugucugggaaggucuuuauuucuccuuugugcuugaagaauauuuuugccagauauucuauucuaggguaaaagauuuuuuucuucagcacuugaaauaugucaugccacucuuuccuggccuguaagguuuucacugaaaagccugcuaccagauguauuggaacuccauuguauguuguuuguuucuuuucucuugcugcuuuuaggauccuuuaucuuugaccuuugggaguuugauuauuauaugucuugagauaaucuucuuugggcuaaagcuacuugguguucuauaaccuccuuauacuuggauauugguaucuuucuuuagguuugggaauuucucuguuauuaucccuuugaguaaacuuucuaccugaucucucucuaccuccucuuuaaggccaaugacucuuacauuugcucuuuugagaucuuguaggcaugcuucauucuuuuuuucuucuuuuaucuuuugucuucucuguguauuuccaaauaaacugucuucaagcucucuaguucuuucuucugcuggaucaacucucauguuaagagacucugaugcauucuucaguaugucaacuacauuuuucagcuccagaauuucugcuugauucuuuaauuauuucgaucucuuuguuaaauguaucugauaguauucuaaauuccuucucuguguuaccuuggauuggucacuggugccuuauuuaguucguuuagugagguuauguuuuccuggguggucuugaugcuuguggauguucuuugguaucuggauguuuaagcaucagguauuuauuguaauaguugcaguuugggcacauuugcaucaauccuucuugggaaggcuuuccaaguauucagagggaccuagguguugugaucuaugucuuuugucacugcagccuuacugcauuagggaguaccccaaacccagcaacacuguggcuguugcacagucaugaagguacugccuugguggccuugggggccuuggguaagauccaagagaauucccuggauuaccaggcagagacucuuguuuucuucccuuacuuugccccaaacaaacugagccugucucccuucaggguggugagcuuuuccuggacccagguagguccacagaugccuuccuggagccagggccuggagacaggaaccuuaagaauuuaacuugaugcucuuuucuacauuggcugagcuggcacugaagccacaagacaaaguccuuccuacucuucacuccccuguccucaagcagaaggagucuguccccacagcugucacagccagaaaugcacugggucacaccugaagccagcacagcucugaaucucaccuaaggcccagaguccaaauauuucccaaacacaauaaauccuguggcagaguacacugagugcuuugacaggaaaacaaaacauaagccaguaucuucuggcccucauuacccaauugucaugaggagguggcagaggaguuguguccaugauuuuaaucaauuuaagucauucugaaaaaugucaaaaggaauuccuccccucaggacaaagcugcaucagagauguuucuucuaccucuugccuccacauucaagauauggcuugauuccucguugcagaaaagccuauauaucaaguuggcacaaaaauaauugcaguguuugccauuacuuucaauggcaaaaauuuggcucccugaaauccaauuucauauguuacaacuuuguuaagucuaggaauuguuaacucauaauauaacucaauaaaauaauuacauuaauuauuuuuuaaacuaaaauaguuuuacagucaauaauagcacauaugcaacucuagaaggucccccuucuacuuuacaacagcucacugggucauggccuccuuucauauuuucucagacuacuaaugcagagagcagaggauaauuuccuaccccucaugcucaugauaugguuugugagaagucuaagucacuuugacaaucuccagaauacuaacacacccaagcauccuauauaauguaugguaucggauggcugaaugaaaaaaagaaaaaagagagugagucugcguauuuuuacugaaugcuuacaugugucaggcacugucuaggcauggggguuagcaaugaacaggcuuuaugcagguuagauuuuucauuucucuucugguguaaagaucaccaauuuuccaugguuaugaauagagagaguuuugucuccuuuuggugauaaaaugagccuguucuaauuccuagagaacaaauguuaaaauauuaaaucauuauagguguguuagguuauacauuuguugcagguuucagcauaugggaacuuuauucuuuaggugguucuuauggaaaauaaaaaaauuaagauucaaacgcauaagaaagacaaauuuauccaaaugucuucguaguccacuggagagaaacauuuuugaaaagaaacaagaugauuuuccucucaggaauguuacucuugaccaaggauuuuuuaucuuggcacuauugacauuuugggccagaucauucucuguugugaagguuguccagugcaacguaggaugcuuagcagcauccccggccuuccuucauuagaugcgaaaaauuacuacacccaccugacccuaucugccaggcgugaugaccaaaaauuucuccaggcuuugcuaaaggugauccagugggaaaaauuccuucugucaaugaaccauuuuucuagaaccuucuuuaauuuucauuucauaccagcacauucuuuaacaaguccaaauucaagacuuaaauuucugccuaugaagcuaaguacaaacaugaccuccuaccaaucucuacuuuaugauaaaucauucauaacuaauuacauagacccaagcaaauuacacguauggaaaaucuugauaauauucaaaguggagaugaaggaagauuuuucaagagagaaacuucccacuuuucauuuucaccaaguuuuuuucagugucugugcuauaaaugcauccauaaucccagcucucacaaaacuuaagcuucucaauuucauucaaccaaaucuauuauggacaaauucaaaaaagaaugacgauugagccagcauagggucagcugagaaaaaagccauuuagcauuaguugcuguauauggaugacucuauacauaaucaagucaauuucauuuucagauaauucuguuggcuuuuuuaaggcucaaagaaaauacuguguguugagagacaucucauacagaaaaauggaguuuuggcuggcaauaggcaugauaauaugaguugauuauaucaaacaaagucauugcuauuuugugaaaaucaguaaauggaaguuguucuguucaucaaaauuaaacauugaaauucuuucaauaauuauguuaggagaagcauuuacaaaauaauauucaaaauaaugucaaugaaaaaaauuuauacauauauuuauguaaugucuauuacauaucccugcgauuuuuuuguuucguuuuuugagauggagucucgcucugucacccagacuggagugcaguggugcgaucucggcucacugcaaucucugccuccaggguucaagcaauucuccugucucagccucccgaguagcugggacuacaggcaccugccacuacgccuggcuaauuuuugcauuuuuuuuuuuuuuuaaguaaagacaagguuuaaccuuguuggucaggcuagucucgaauuccugaccucaggugauccacccgccucagccucccaaagugcuggaauuacaugcgugagccacugugcccagccccugugauuuuuaucgguggaaaagauuggagaggagugaaauaaaugagaguaguuguauaacacugugguaggauuaaggcuauagagcuuugcuuccugucucuacuauguuuucaugauuuucaaaaggcaauuuagguagggugugaugucucacgucuguaauccuguggccggaauugguggguucuuggucucacugacuucaagaaugaagccccggacccucguggugaguguuacaguucuuaaagguggcguguccggaguuuguuccuucugauguucagauguguucggaguuucuuccuucugguggguucguggucucgcuggcucaggagugaagcugcagaccuucgaggugaguguuacagcucuuaaggcggcgcgucuggaguuguucauuccucccggugggcucguggucucgcuggcuucaggagugaagcugcagaccuucgcagugaguguuacagcucauaaaggcaguguggacccaaagagugagcaguagcaagauuuauugcaaagagcgaaagaacaaagcuuccacagcguggaagaggaccccagcggguugccacugcuggcuugggcagccugcuuuuauucucuuaucuggccccacccacauccugcugauugguggagcccaguggucuguuuugacagggcgcugauuggugcauuuacaaucccugagcuagacacaaagguucuccacguccccaccagauuagcuagauacagaguguccacacaaagguucuccaaggccccaccagaguagcuagauacagugugucaauuggugcauucacaaacccugagcuagacacagggugcugauugguguguuuacaaaccuugagcuagauacagagugccuauugguguauuuacaaucccugagcuagacacaaagguucuccacguccccaccagacucaggagcccagcuggcuucacccaguggaucccgcacucggucuacagauggagcuaccugccagucccgcgccgugcacccgcacuccucaguccuuggguggucgaugggacugggugcccuggagcaggggguggcgcucgucgaggaggcuggggccccacaggagaccacggaggaggugggaggcuuaggcauggcaggcugcaggucccgagcccugucccacaggaaggcagcuaaggcccggugagaaauccagugcagcgccguugggcuggcacugcugggggacccaguacacccuccucggcagcuggccugggugcuaagcccuucauugccggggcuggcagggccggccgagugcuccgagugcagggcccgccaagcccacgcccacccggaacuccagcuggcccgcaagugccacgcacagccucuguucccgcccgcgccucucccuccacaccucccugcaaggugagggagugggcucuggccuuggccagcccagaaaggggcucccacagugcagcggugggcugaagggcuccucaagugccgccaaagugggagcccaggcagaggaagugcugagagugagcgagggcugugaggacugccagcaggcugucaccucuaaauccuagcacuuugggaggcugaggcacaaggaucgcuugaugccaggaguuugagaccagacuaggcauuauagugagaccccgucucuacuaaaaaugaaaagcuuaguagggcaugguagcacaugccuguaaucucagcuacuaggaaggcugagccgggaggauuccuugggcccaggaguucaaggcugcagugagcuaugauggcgccacugcccucuagccugggugacaaagcaggaccccauguuuuaaaaaaaacaauaauaauuuuagauauaauaaggccgggugcaguggcucacgcuuguaauccuagcacucugggaggccgagguggguggaucaccugaggucaggaguuuaugacuagccuggcuaacaugaugaaacccugucucuacuaaaaaauacaaaaaauuagccaggcaugguggugggcaccuguaaucccagcaacucaggaggcugaguggguagaauugcuugaacccaggagucagagguugaagugagcugagacugugccaccgcacucaagccugggugacacagugagacuccaucucaaaaaaagaaauaaauaaaauaaaaauaauaagauaaacugaaaaggcaauuuaauaauacuuacuuuaaaaagaauuucuuagaaaguaguaaaauuagccagacaugguggugcaugccuguaauccgagcuacuugggaggcugagacaggagaaucgcauguaccugggaggcagaaguugcagugagcugagauugugcuauugcacaccagccugggcaacaagaacgaaacuccaucucaaaaaagaaaaagaaaaaaaaagaaaaaagaaaguagugauagccaguauuuuauagucucuacuuuugcugugggcacuaggaguauaaaaaaauuugcaaaacaugcuuccuuaguuuaagauauauuuaaguuauuuuuaaaaguguggcccaacugacauuacuaaacauugucaugggcuuaacugugucucccuaaaauucauguguugaagcccuagccuacagugugauaguauuuggaaaaaggaacuuuagaagguuauuaagguuaaaugaggucaccagggugggucccuaaucucauaggacugauguccucauaagcagagggagggacaccagagagcucucuaggcagacacagagaaaggcuaugugaggacacagggagaauaauaggcaauagucugcaagccaggaagaaaggccuuaccagaaacuaauuuuaucaccaccuugaucuugaauucuagccuccagaacugugagaauauaagggucuguugauuaagcaacccauucugguauagucugguauucuguuauggaaguccaagcaaaguaauacacacacaaaugcaucugaauagagauguaaauuuuuuugacuagugagucaaauaaugcaucacaaucauugauaucaacuauuuaauuucuggaguaaacuuuuuuuuuuuuuuuugagacagucuugcucuuucacccaggcuggagugcaguggugcaaucucuacucacugcaaccuccgccuccuggguucaagugauucucaugccucagccucccaaguagcugggauuagaggugcccaccaccaugccaggcuaauauuuuguauuuuuaguagagaugggguuucaccauguuggccacgcuagucucgaacuccugaccucaagugaucugccugccucggccucccaaagugcugggauuacaggcaugagcuaccauggccagccuggaguaaacuuuuauaaugaagcaaauguagcuguuucauguucccauuuuguagcauaauagugugaucuuaguucuugguuuucacacacuugugacaauacggccagguauuuuaugaugaaauacaaagaccuaauugauccaagccuugaaaauguauauaucaggcugggcacaauggcacacuccuguaaucccagcuacucaagagacugaagcaugaggauugcuugagcucaggaguuugggaccgcccuaaaauagcaagauccccuugcuuaaagcaaacaaaaacaauuguauaucagucacauaucuguuugucaaacacuuaaugaaaaaauguuuuaaucuagauuucuuucuuuuuuugcuuuaauuuccugaguauaccccaaauuauucaauucagcaauuaacuuagguacuuuucacugugggcuuguuauauauaguuuuuccaggagaauuuuuaaguuccugguaaaggaauauuaacucccaggggaauuguggacagcuguugggaacagcccucacuaauuggauuagcaauacuccauagucaagaaaaaccaauuuggaaauggucccagcuggggagagauagucaaagcuggucuuaagaacaccaaauuuagcaaucaccucaauacauucuucuuagauugcuucugcuuagcacauuaauaagucuuuuuuaaaaaaaucaaguuuaagagaaaugaagaagaaaagaauauaaccuaaauccaccauuucaauauaauagauuaaacacauguauugaaugucuacuaugugcuacacacuauguuaagcguagccaaugaaugucuaaacauccuugcuaaauguaaagcauuauaaaaaugcaagcuguuguuaauauuguuuguaaaagguaagucaaacagcauuagccuaugaagaugauaaaaugauauugagaaccacaguuaaauguaaauuuugaugcuuuuuauuugcucugggugauuuauaaauuggaucagcuuacaaauaaaagauugguugaucuauuaaaacccaaugagaacaggaguucaacugaauggauaguaagccaacacauuuuuuuaugcuuugcuuagaauuaaaggcuuuuucaaauagauuaucauuguauuaguuuagaguucuccagagaaaugaccaauacauauacauagauauauguaucuauauauauagguguauguguauauacauacauaucuaucuaucuaucuaucuguccaucuaucuagauaucuaucuaucuaucuagauagauagauaucuguauagauagauauagauauauagauaucuaucuagauagauauagauauauagauaucuaucuagauagauauagauaucgauauauagauaucuaucuagauagauaucgauauauagauaucuaucuagauagauaucgauauauagauaccuaucuagauagauagauagagagagagauagggagagaaagaaucauuuacuuuaagaagucgucucacacaguuguggaggcuuggcaaguuuaaaaucugcagguuaggcuagcaggguggagacccagggaagaguugcaguuugaauccaaaggacaucuguugguauaauuucuuuuggcucugggaagaugagucuuuguuccauacggcuuucaacagauuggaugaggcccacccacauaaugaaggguaaccugcuucacucaaaguucaccaauuuaaauguuagucucauccagaagcaccuucacagaaauauccagaauaacuuugaccaaauaccugggcacuacugcccagccaaguugacacauaaaauuaaccaucacaaguccaccccgugucaacuuggcaaccauuugccucucuuuaaaccauacuuaaugucaauaacaagguuauaauuccaucuaacauaaauacaacuauccugcauacaaccaaaaacgcacuaacccuuuccccagaagaggaugcaaagcucuugguugauguuuacuuuuuuucgugauaucuguaacuuaaauccuaugauggaaaguuaauaauccucaaauacuacaauaaaaagucgacacauguugcaugauaagcggacaaaagaggaaagaaagaaauauuugcuauauacacacauauucauaacaaaguaaggaagaaauauucaugauuaugacaguccucauuucuguaacuggucucauggucauagcugguauuuauagcuaccuucuuccacuauucauuccauguucccuuuuccuucaguaagcacuccagguagucauaauucuuuaccucgugggaugacccaaaccuucauuccugaaaggucuggcccauaauaguccugccuggguugggucauugcaauuuuccauugaccuuaauuacagggcaugauaauaccaagaaacacccuaaaggaucuccuguauuucagacagacucuuccuuaccuccacuguggaguagcaguuccauuuuccccuaguagucaugguugaccaccccaacccaguaauaguaacucccuucuuugcuuguucauccagagucaugaggaucucaaaguuuccaguggcagugcuaacuuccaguucaguggaauuauuguuaggucucuuuguggcagcauuucucccucucgaacuaagaccuucaagcuagcagagcauaaugucauagggacaggaaaaaauuuucuagugggucacuagggguaauaaauagugagugaugccacucugacauucaccccuugaucuuggacccaugaauccuggcucugggagaaacagcaccauauauuagacacugauucagagcaugugcagcuuucuggagagccuugcacaauccgugauggugguauuggucucuaaucuuuccaagaaugugguauugcuuuugguuuacuauuuuucuagauagaggcaguucuaguuguuucuucuuagccuuucccaccauaaugcccucacuccacaagucagggaacuaauguauggauucugccaguugcucaggauaucuuuuccaguuaugcauucuggaacuagagaaaagaccacaguacagguuaggggucucacugggucuacugugagacagaucuaaacuaaaacugcauugaucaccugaccuccuauucugaguggagggccacaaugauguuuaggguuuccuagaauuagugucaguucagaccagucuccaguuaucccucaaaagucugguuauuuccuuuuuucccaacucacagucucccuaguaaagggccaagggugccuuuggggaagucugggagaaagauuaaguuuaaauuuuuuggcaguguaucaggguccuuccucaagggaccuggccccaacuucauucaaaagguucuaggucuguaaacuggcucaagucugggaauugaucaguggcgccaugauuaucuguuuugaugagucaagcuacacuuuuuguucaguugaccuugaacuuuucuguuuauacagaucaaguaagauuaauagacuucucuauccacuucacuucuaggaacauccuaaucaacuagccaaugccacaggucucuucaagucagacucuucugauugcuguuuugacucugcuguucauuacaguaacaugcccaccuccucuuugaaaauugagugccacuacuuggccccugccacccuaggauccaauuacucccauugcaguuagguuuuccaauucagugacaggagcuuccacuguaaauucuguuuuucaggaagggugaucacagagcuccucuaggaugcuggggcuccccgcacaaauuuauuucuguggcccagccaaguuuacacaaaauuaauccauuauauuuucuccuaacacauucacuauauguaggacuucucucacauuuuuagugaacagaauucuugcuugauggcuuggcagcuaaauguaaaauacuuauugauggaaagggaguuguauugauuugauuugaaauuauuucuuuugucuauuuuucaccuaaacuguucauuacugaaauaaugccaucuuucaaaaauuauucuauuucuagaccgucucaguguaacuaacaaaauaaauaauaugagguauaagauagguguaaugauaagaauacugugcuagaaaccagaaaacuuggacauucaaucugaucuauuacuaacucuucauguaaaucugaaucuugaaucucuaaagaucugagauucaguuuucucuucuauuaaauaaaauucuaacuaucccacagagcugccuuaauaaucaaauaaaguaauaaccaggagagauugguuggaccaauggauccaacuggucugaccagaacagaaucuggucagauccagcuauuuugcuccuggaucuaacuaccuagugguuauguauuaauacauacauagugaagacacaucuuguuacccugaccaacuaaacacuugaaacagagacuguauuuuuguuucauauuagccgucacacacuaaccagcacagaacaaugcaaaguagcucaauaacuauuguugaaucaaugaaugaaugaaucaagacugaaaguacagaaaggagguggugcacaaaugcuagugagcauucgagucacuuggaaaacuuucuaaagaucacucuuuacuagaucucauuuucugagauuuuaauuaaggaaggcugagauaaggcccagguagaugcauuuuaaugaacauucccacugauucggaaguaagagguaagagaaauugguguagggaauuugacugagucuguucucauuccagaucaugucuuguaccuuagaauauauccuuaauauaagccuguguugccccuaugauuuggaguuuuuuacccuuaaaacuaauaauaauaaaauaaucugcuuacuugauaauuuacauuucuaaugauaguagcaaauggauacuaucagaagcagcagagcaugacuccaguucaggccacauucuaagucuaaguuucuaguugcacuaaaguaauugugauggaaagaaacuucuaccuauuuacuaugaacaucaaagaucacagaugucacacauaacaauacauguauuagaagagguggaauguagagauacccuuucaaaugaauaacucaaaguuuuaaaaaguauuuucccuuuggguucuuacuuccugauguuaaaaguugaaacaaauggcuauuuaaugauguugaaaaauguaguguaaaugcaugcacagauaauagaauagcauaccaacgauuaauaaacuuauuguacuacuauugcaugaaaaacuguugcgggaagucagggaccccaaacggagggaccggcugaagccauggcagaagaacguggauugugaagauuuuauggacauuuauuaguugcccaaauuaauacuuuuauaauuucuuaugccugucuuuacugcaaucucuaaacauaaauuguaaagauuucauggacacuuaucacuuccccaaucaauacccuggugauuuccuaugccugucuuuacuuuaaucucuuaauccugucagcugaggaggauauaugucaucucaggacccuguaauaauugcacuaacugcacaaauuguacagcauguguguuugagcaauaugaaaucugggcaccuugaaaaaagaacaggauaacagaaauuguucagggaauagcagagauacccuuaaacucugaccgccggugagccgggcggaacagagccauauaucucuucuuucaaaagcaaaugggagaaauauugcugaauucuuuuucucagcaaggaacaucccugggaaagagaauacacaccugggggugggucucuaaacuggccccgcugggcguggccaucuuuuauggucgagacugcaggggugaaauagaucccagucucccauagugcucccaggcuuauuaggaagaggaaauucccgccuaauaauuuuggucagaccaguugcugucaaaacccugucuccugauaagauguuaucaaugacaauggugcccgaaacuucauuagcaauuuuaauuuugcccuggucuugugguccugugguccugugaucucgcccugccuccacuugccuugugguauucuauuaccuuguaaaguacuugaugucugugacccacaucuauuugcacacucccuccccuuuugaaaaucccuaauaaaaacuugcugguuuuuguggcuuguggggcaucacggaaccuaccgacaugugaugucuccccuggacgcccagcuuaaaaauuucucucuuuuguacucugucccuuuauuucucaagcuggccgaugcuuaaggaaaauagaaaagaacuuaugugaauauuggggcagguuccccgauauacccuuaaaaguaauaauaauaaaauaaucugguuacuugauaauuuacauuucuaaugauaguagcaaauggauaauaucagaagcagcagagcuucacuccaguucaggccacauucuaaguuucuaguugcacuaaaguaauugugauucaaagaaauuucuaccuauuuacuaugaacaucaaaggucacagaugucacacauaacaauacauguauuagaagagguggaauguagagauauccuuucaaaugaauaacucaaaguuuuaaaaaguauuuucccuuuggguucuuacuuccugauguuaaaaguugaaacaaauggcuacuuaaugauguugaaaaauguaguguaaaugcaugcacagauaauagaauagcauaccaacgauuaauaaacuuauuguacuacuauggcaugaaaaauaucuuaauuucuucucacaagauacggucauuucuucugccacuccuauggguuaagagacuuauacagguuuauccaugcagaguuuagaaauaaaguuggaaauuucuauuucccaguucuuacaacuguaucucaauguguuauucaaccaaggaaauaaaguugguaauuucuguuuccuaguucuuacaaccguaucucaauguguuauucaaccaaggaaaugaaguggaaacaaaauaguuuaaaugugugaagaccuuuaacaaggccuugcuuaaaaggagauugauucagcaccauaaacuaaguccaccaagaagacuauugauucauggaauaacacugaaaaacugcuacaacaucauugcacaaauuacuguuugcaaccaaaagaugauaguggccuagauauaaaaacacauuguucuuuugcagauauguggauuaagagaauuuguuaaugucaaugauuagacacaguauuuauuaacuguaucugucagaagaaaaggcacagcauuaguugcuucauacagugagacuccaggagcuuagucacugccacauaucaaguaauuauuucuugaaccauguggaaaguuacauuuccuaaaaaaguuaauaugaagguuaauuaugugcaaaucaauauaauauaguaaacuggaaauccuuauuuccuaauggaaguuacugaucguaaccugugccaauaaauuggcagucucuuaggaaauaugugaguaaauguaaauacaugauuuggaaauaugcaguuaguucuguauguuaguuauuaguuauuaugaaauauuaugaaauauuaugaauuaugaaauaacuaauaaaguuauuaguucuuuaugaagaacaaaugaugaauuaaagcuaauaauuucccuaccaaaauugucuccauaggaacuuguuccauguuagaagaacaauaaacuucaaauaguauacuuauuuuucucugguaauaugcaauucuauuuaaaaaucagcaaaaguuuuaggcauuugucuuuaagagaagguacucacagaucugcaaaaauuacuucuuaauaguguuaaacugugaguaguagcuacaguacauaagacuaaaaauacaagaauuuaauuuuuucauauuauuaagucugcuguuuuauggucuacacucugcgauauaguucuuaauuugacccuuuauuuuagaauuuauaugcugaugcaauuuauuauugaccuguuuuguauauagggcaaauaucuguguuuauuuuguuuaucgaucuaaagugaauuuugauuuccuuuugauuucuguguaucucacucuaagcuauuguaaagguguggagcuaagggaaagacagaagaauuccaagucuaaauuccugccuauuuucugagggccugccuccagucagaaagaggugaaauuagaagaggugaaauguugagauaucuuuucaaaucaauaacugaaaguuuuuaaaacuugaucuuuuuuuuucucugaguucuugcuuuccaguguuaaaaguugaaacaaauggcuuuuuaaaugauguuuaaaaauauagugcaaaugcaugcacagauaauagaauagcauaccaaugauuaauaaacuuauuguauuacccuggcaugaaaggguuagaucucaaagcauccuaauuuccauguaccaugauaguaaaaaggaaaauuugauguauauauuaaaaaaauauaaaacuauaacuauauauaccuagcuauacuuauauaauuauauauagcauauuauguauaacaauaucauauaauauuaaaauaguaaggugacuauaggaaggaauuuuagcuccuuuuagugaugaauaguaaaucauuuguguauugugaagcugguuuugaauaagaaguauuauuggagaugugggaaugcaagaagguauuugggguagugauguugggaaagcaaggggagaugagaaaguccgauguguauucuaagugcaaaguauggcuguagaaauuaguuccugggaggaaagcaaagaaucccaggcuagaagaauagaugacaacagaagauggaaauccaaugccagcauaaagagguagauuuuuauagggacuggauauuucugagcaauaaaauuauaaugaccagaagaggcugagaaugagacaagaaacacaucuggagucuauuucaaugauccaggccagagguauugaggaguugaacuggggcaaggaguagugguucucauacuuuaacgcaaaucagaaagaaccaucugggaaguuuacuuauuaaacuugcagauuuggagaccccccaagcccaaccccauucugauucaggggaugacuaauuuaaugaguacugacacauaaauaaagcagauguggguuugaauuuuagcucuaccacuuacuagcuaugaucuuaggcaaaugacaggccauaccaguugcuauuuccucauuuguaaaguaagaacaauauuauugggaagacuuacuuuaaaagggcagacagggccaggcgcaguggcucacgccuguaaucccagcacuuuuggaggcugaggugggcggaucacgaggucaagagauugagaccauccuggccaacguggugaaaccccgucucuuacuaaaaauacaaaaaucagcugggacugguggcgcaugccuguagucccagcuacucgggaggcugaggcaggaaaaucgcuugaacccgggagacggagguugcagugagccaagaucaugccacugcacuccagcauggccguagagugagacuccaucucaaaaaaaaaaaaaagugcggacagaaacuggcguguuuuacaguugagucaaugaggcuggaauggaagggaugggugguagaaacacuggaaggacaaugugcuuuuucucuuaaacucuuaucauauuugaucuuguauauuuguguccaugauuuucugcuguacaaguucuuuaaggguagagacuuuagucauuguuguauagccuagauaguguaauugaaugaauaaguucugucagaucuugucucuagcugcauuuguguucaucaucgauuucauaucauaugcuuggguucuuuagggugggaacaauagauucacuuugcaucucuagugccugggaagcucucaguguccaaucaaugcuguuuaagagaaugaauaaacgaggaaauggauggauaaauggauguuuggaggaugaagugcacacuaguaauggcugaaugcuaggccgggucucuuuucucugaaauccuggucuccagggucucugcuacacaaaaugcaagaagcucugccugucacuuugagauauacaguuccuaagagguugugugaaccaacuggcuuggaacauauuucuguuaaaucacuggaagaaauuuagcauuuagaguucaaaguuggcaccacuucacacugacacuaauaagaagcuacuuuaugucaccaugucaccuuucuuuccuguucacugaacaaggcuuuaaaauuguauuuaauguguucauuggcacauucuuuccugaauucagcauuuuuggagcaugaagugaccaaaauagucauuuuugauuuuguauaaguucuaugaugaaucauuugauuauuuuuaacucaaucagauauugggagcacuggugaaaaaagaacauacaggaauauccaaaugacauagcagauaauaggaaagguaaugucuacuaucaccacaauagcuauuugauauaaguugggaaauucauucauucauucauucauucauucaacugcugauuaaauguacacuauguuccagggauugugcuacaugcuggggauacuaugaugaacgagacaccaccuguucaguaugaggugcuuugucucucaucuuuuaaagguucuuauuauugaguuuuuaacaacugcagaugccuuuaaacucauugauauuccaagaagaauacauccugaacucaacaugauguuaaagacuuacuagagcccuggaguuucuuuuggacuuuaacaguuccuagaagagaaaugaaugggauggcaguuucagacuuuccuaaggaauucagagguauuaggccuauaacugcuacaccauuccaacgcuggcauaauuccacagaaaaugaccaggauauaucaacauaaccugagcuucuccacaucugcccauuucuaauccaagacuccaacacugagaucaagaaaaacauaccagauagcagugguuucaaacacuugaugaguuauauuauuuacugagcaccugcuacaugacugcucucugaugaaugcuucauugaaacugaauuuacaaaugagaaauaaaaaugaaaauaauaaaauagaacuuugaccuacaaccgguagcaacuugcccaggaaaccaaccccuuaucuguaauaaacaauccaggaagccagccugcuauaagucagacuugcaggaaaccagauugcuaucuccagugacaauccaggaagauaaaugaucauuucuguaacaacuggccccaaacugacaagacuuaauuacugacagcuucccuaauuuuggccccacuuccaaguuaacaccaaccacagaaaaucaaaaauacauccccuaaccaaucacgcagggugccccaccucuagcuggccugcuuauagcuuccccaugcaacagccuccaaucagggcagagcugaagccuucccguuuuccacuauaaugcuuucccacucuccugcgugccuuugagucucugcuaaaauguuaagugaugguggcugacucccuugcuguagcaagcuuggaacaacuagccuuucuuuuucucauuugguagauuuucauuuaguuccacauaacuauuauacccauuuuuacagauaaggggauuuauaaagauuagcuuuuaaaugggccacacaagaagcagagcaagaguuggaaccugaucucccucauuccaaaguuauccuauuaacuaguauccaaauguagaaaagaaaagagagguuuuuccuuuacuguccucugccauaccuacucugucauuuugaguacuuuccucuuuccuugaaagaaagugacucuaauaucggccugcaggccugcugguuuugcagacaaaugcaauucagauacacugguaagaguuuaaggcgauacugaggaugauaauggcaauccuacuucuguauuucuuuaccauagguugaauauaugaacaguugggagcccagcagguggugagacuugaguugcuccuggggaaacaguucucuguacugucacugugucacaggaccacagugcugcucacuucugcugcuucccagugacucaauuagggaauugcacuuaguaagugugggcguuuauguaacuugaaagcauuucaacauaacaugccagcuugagaacacaggauuucagcacaagcuuauucacugagaggacuggguaaacucccuaguauaaugcuguucagaggucaaaaagagaaguggauuaacaauaauuuuuuuaaagaagcuuuuugucuucauuacuacaccuuauuugucauuuugagucacccaguucuaaauggagugaagccaagggaaaggccucaaauacauaaacuuccuuucuagcuccucagaagucuugaagucgugugucacacuggugugacuccuucgguguaaaguggcgugcugagcauuaacacggauguuugcaaacauuugaggcaaggccuaugcucuguguucagacuuagcaccaggagaagcccacauugcucccacauuugccauccucagcugucacagaauacaugggcugaggugauuucucuguagagacucuagugaggaaaggggggauuuguucacagcuucgaugcacgcacccagggggugcuacacccaucagcaauucucucuggaaucaacaauucccuggagcaucugaggugcuccugccuccucggaaaugaaaagcaggaaaaacggcaagcaacccaaguccugcugcuggaauaggcaacaggaaacaggagacuuuucguuuugaagguguuugcccugcuuuuuauuucaaauauugaucugggaaaggaagggagauuuuacauuucauacgucuuuuaaaaagaacucagcaucaaaggaaacauugagaacauugucagguugugauaaagucugcaaaaaacaccucagugugagagaauaaaaaaagaaauaagagaauuagcuggagagauaagaggaaggagagggagaacaaacucauuuuuuuuccugcagagaagggaaaaauacugaguaguauauacacacuaaaacagaaaccaugauguacagaauaacuagaucaaucuaaauaaauaaagaagaucaaucuaaauuuacagaaauuccucuuucacuuucuugagaaagucuuuccagauuuccaucagauacaaaauagaaagccacagcaauauuagaagaagaaaaaaaaagaugaaguggagacauguauacauacacauuuuggcauauguguacauacauacaaaagcauccacacauuauauuuguacacacacauacauuauauguguagcaugugcauagcuuaaucuuucuuuaguacacauucagaguggcacuuucaauacuagcuuuuaaauacacaaugaggccgggugcguggcuuaugccuguaaucccagcacuuugggaggcugagguggguggaucacuugaggucagaaguucgagaccagccuggucaacauggugaaaccccgucucuacuaaaaauacaaaaacuagcuggaugugguagugcaugucuguaauuccagcuacucaggaggcugaggcaggagaaucacuugaacccaggaagcggaggcugcagugagcugagaucgugucacugcacucuagccugggugauggaaugagacucagucucaaaaaaaauauauaaaaaaaaauauacauacacacacacacacaaugacauuccuagugcuuuagagaaacguacauauauuuuuaagauguauaccuugugccugugauuaauuacaaaguucaguuaccuuuuucaaugacuucaucucuggauauaguuacuaaacgcugccugacuacauuccagagaggaguaagagagcuugagugccuggugggagagggaaugcccaugaagcaaacugggcuguggaugaugagacaaggcaguaaauucacauuuucaaauuaaaaaaaaaacaacccauuuugugccaugauuucucugugucaccucaccccuucugggagugcuugcuacacaguuauauuggugguacuuuuggaaaguggagcagcgucggccauuggaagucauauggaaggaggaguccugacagguagugagccaauuagcagggagaggaagaauugcacggaagcaggacuucagagugggaguugauggugaaacuacaaauuggccaggaaucccuggaaaugcagguguaagcucugacuuccagaaugcuuggaaucuggcaugaguuauguuuuugcuuacuaaagggaagguugacuccaaccugucauuaaaauaucugaaauuauacuauuuuguauaaacagugguaagugaaucuuaugagccacgcugucgacagcuggagucaggagaauauaaacauuugucuuuuugauagagaaagagauuuuggaagcucuuggaacgauggaagaugugaaggcuagaaaauuggggcagcagauaccaucucaaacauaggauaaaaguaauguggaaaguaagagccagaugacuggauagugguucucugaaaaggacuaauauaggggcaaagaauaccuaaaucaucuuucuguuuuaaaacauggaaagcuaucuguccuucuuguguagcaacaauaaauaaaauacaacaauaagauuucugucauuaauaaagccagaggauauauauuaaucaucuacuuagaagaauuuucaaaaccugaguucauauauauaaaggauuugccagauuuuaaauuauuauuacauuguugaaggauaauauuucucugccuuugcacuuugaaaaaauauaaaaucuuugguuaugaugacuuugggggacauuuguuuuguggcuuuccagcauuuuccucuacuggucaucaccucacaucaucucuucccacguggguagucuuuugggagcuguuacucaagaugcucugcccucuuagccaagggauaaaauuuuuaacuuugaguaaaaggacacaaaguuuuauacacacacacacacacacacacacacacacaguugauucauuuagcuguggcacauuggccagauaaucuagucaauuaauacuuuucuagauacaaaaaaacaggacuuugauagcucuuaggaaauggaaaggguuuccugcccuuucucaugccaguucucuagccauuccauugauuguguggcuauccccuuuacuuccaguaaauucccuauuuguuuaguuugcuaaggaagguagaauucuaagaugaacccuagugacucacuccguguguaauccccucuccuugugaacaggcagguccuauaacuugcuucuaacaacaauacagcaaagcugauggaccauacuuccaugaguguuacuuauuaugucaaaagugaagagauuucacagaugcaauuaagcuccuuaacugccuuuaaguaauuuaaaggggagauugucuuuggcuggccugaccuaaucaggugaccccuucaaaauaagugacaggcuuucugaagaaagagauuauuuuacuggcuuugaagaagcaagcuuccaugacuucuacaacucacggaagcauggaaacugugagaucauaauuacauguuguuuuaagccacuaaaguuugggucauuuguuauaaaacaauagaaaacuaauacaguuuccuuaguuggcuuauuuugcuuucaaucaaagaacucugauaaaaugugggaucccuggaaaaguuccuugguugaaauauauaaagcauauuuugaucaauaaacaacaaaauaaauuacauuuuucucgggauuaaaugucacaaauguugguuuuuacuuauguacaguuuagcauaaguaaaauagcccuucccucacuaugaucagcuaaacuagcuguuuccaaacauuuugucucaggauuucucuauacucuuaaaauguauuaaguacccucaaagagcuuuuauguaguuccagccaccaauauuuagcauauuagaaaauaaaacagagauauuuuuaaaauauuuauuuauuauuuaaaacauugauaaacuuauugaauguuaaaauaaauaacauauuuuccaagauaaaauacauauauacagagagagagaaaauuggcacuguuuuauauuuuugcaaauaucuuuaauuggguaucuuaguguuaaaauaauuuaacaucuucauugaaacaauuagauuuccauaucuguuucuguaaucaguguguugcucuauauuguuuggguugaaugcaggaaaaaaaucuggccuuacgcauauauguagugggaaaagggaggaguauuuuaaaaagccuuuuuuagauaauuguggauauucuccuuugauaauauacccaaaacuuggcaaauuaugguuucuuaaacugcagugcaauguagaaucuaaaaccauaucagugaacuuuucauauucuguuacauuaaaauccaguggccuaucuugcucauuagaugaauauuuuacccaugcauaauguuuuaacaucgugcauuggucacuuggaaaauaaugguucccugaguuaugcagcucuuccgaauauugacacaucucaucauguaauauaaaaaaugauauuuuuaauaccaucaccaaucucaucuuuuaaauguuggaaagaugucagauucagagugacugacugaaguccuccaaaacucuaauuuucauuugaaaauucaaaguuuaucauuggcaaaaaugcugucuguuauuuuccuaagugacagguucgcauacuuuauuuugagaaaaugucugccaaauacccagaucugaacaauaguuuguuuaccagucauucugucagauaaaaaaugauauuccaugaaaagauucaccuaguucagcugacagcucaaucacacaaguguuuucuuugagacaaccauccuacuuaggaaugcagcagcaguucuuaauacauacuuucuauuucaucacacaaaauauuaaagacaugugcacaagggcugaaaucuaacuauuuucaaauacuccuucaaggacaucuuaaguaaaaccagcaauuuugcuuuuuuaacucugagugccugauaaagaauacaauuaccgcugucccaauucaugguauuuugacccaccauugcuuuugcaccaguagugaaaauaucaacacaguaaaaaaggcaaauaacaucuugguauuuuuaugaaaaugauuuugauccuguagacccuggaaagugccuuagguaccuccaaaaguccgcggaccacacuucaagaacugcugaucuaaacuaucacuugagggcaguauuccaaucacuuugcacuuaacucaaggggaaucuaacaaugcguuucaguuuggguguagaacucauuagauauuuucaagcugaaaaaaauauuuucaaguugauacuguuuauaagcuuggaagucuuuaucuuuaacugauuacacaaauuugccaaaauaaggcaggaaaaaguuucuuuauauuuuagguugggcuagugaugaucaagaauuagaaauaucuucuauaaugaccaagccaccuugcuuuaacuagcuaguuaacgaugacaacacagcuucacuuuagugggguugaugcucuguugcucugguuuucuuauauuucaaaauuuuaggcauuuucaauuuccugucccacaaacaagauacuaaggcccauaguuaccaaaggaaaugauauaauuuugcucuguguccccacccaaaucucaucuggaauuguaauccccaggugucgagggagggaccuauaauccccacaccaaggcagggaagugauuggauuguggaguaguuucccucgugcuguucucgugauagugagugaauucucaugagaucugaugguuuuauaaauaguaguuuuuccugcacuaucacucucuuucucucccaccugcugccagguaagaugugccugcuuccccuuucaccaugauuguaagugcccugaggccuccccagccaugcggaaccaugagucaaucaaacgucuuuccuuuauaaauuacccagucuuggguauuucuuuauagcagugugaaaauggacuaaugaagcaggauccuuccuuuucucagccacauccugguuccccuucuuuggcuuaggguguaauuugcugcuucaaaugguugaggguaauucuugccgaauauuaaaguuuaguaacaaaagcgcaucuguuucuacuagccaugucucuuaauuggcagauuuauucuacaaaagaagauuuccuauuauuuuguuuuguuuuuauugacacauaauugugcauuuuuauaggguacagugugauaguucuauauauguauacaauguauaaugaucaaaucaguguuuuuagcauuuccaucaccucuuacauuuaucauuucuuugcagugagaacauucaaaguacucucuucuagcuauuuuggaauaugcuuuacaauauuguuaaucauacucacccuacugugcaauagaacaccagaacucauuccuuguaccuguuuguaccuguugaccagucucuccuuauuucuuccccccuccuccccuagguuuuguauuuuuuaauucaaccuagaguuuacugaaauuauuggaaaagcaauaugguagugaccagcagcaccuuauuuucugacaaaagucuaacucuuaucucauuugcucccaucacucacuaccuuuuuuuccccagagcugggcacagccucaaauaaagcacaaugucugugcacuguaggugaucaguaaugcugguggaacugacuacaugggccagggcacacucuaaaaaagauaacaugcagugaaaaguucuugcauggcuuauagguuuaccacaggagaaaaaagcucagccauugguaaaucuauauuugcuauagauuuaucuucuugccauggcuuggaauucucagugugccucuuuauuguccacucacuucaggacuuauuacaggaagugcucacuaauagccaauuuucaagugaaugaaauuguggagaaauaccaagagauacauaagaggauuuuuccaccacacacaaagcugcuaaaauugcaaccccagcauggacugcagcgaaaauaugaugggauuuucuaauuggcacuuauuaaaucccagcuauuguuuggaaugucauucugccuagaaacagggucuuuauuuucauucuaguacauuaaucauacccaguuuuucuaugaacaucugucccacugcuaaacacuauagaaugacucauucaggccuucauucaacaagcauuuauuaaguaccuguuauguagccagcaaggggugauagugaauaagaaggaugugaucucugcuuuguaaaauggaaauaacgguugcuaugaggacaaaaugagucaauacaaguacaacacuuagaucaaacuuggcacauaguaaacauacauaaguguuguuuuuauuguucaguucacauucaaagagagaaacauacacucuccaagauauuguaauaaaaugugauauaugcgugaugaauaacuacaauugcuaaggugaguaauugaaauaaauaauaaauaaaauacauaagcuaugaggacaccuuggaugggcauuuaacagauauugaaggcagaaucaugaaaugguuuucugaggagagaguaucugaacugcauuugacaguauaaguaggcauuacuguagucaggagaagaagagugaagggagguguucuaggcagagauaauagcuguaaucaugagcuauaccauaaagggauaaguuuuauccugaagguuaagaguaccacugaagaacuuugaggagggaagugacaugaacagaucugcaauuuagaaaguugaccaguugcaguguggagagugaauuagacaaauagcaacucgaagcaggggaacuggauaacagacuauguguaguaauuuaacagagaaauauagagagccugaaucaaaauauagcugugaaaagggugaaagaagggacagaaauuuaauaagaagaaggcaaaaacaucaggacuuugugacuacuggauguagaaggugaggcugaagagggaugacuuccugguuucugcuuaagauaaguacacaggugcugaugauauugacuaggaaaggggaaaaaagagaacuaucgggucugcugaaaaagauuaugagagaagcuuuaugcaaaauuucuguugcuuuugcauaucuaauaaagcaacuagauauuccaacaagcuuggguuggaaauucuaguuuggagggucagcacaucagugguaacucuaaccaugggacuagaugaguucauccaguggugucauaccaauauuuaagggacagaucgaagaggaagagccuacaaggagcgugagaaagacugaacauagaggagaaagcaaggacacugaagacaaaugagauuucucaucagugucaaauggggcagaagaacuaagugaaauaagaauagggcaauguccaucaguuucaacaacugggacauaauuagcagucauugaaggaggagcuucauugaacuggggagggcagaaauuagacugcagucaguaagauuaaaagcaagugaagcuguggaagcucuauaacaggauaacuuguuccagaagccuagcucuggagggaagaaggagcuagaauggccagaggagguuuguuuauuuuuaugcuuugaaauaugagaaagacuuaaauguauuuuacauugaucuaaaaacaaaauuaauaaugaagaauaggcucuugauacaguaaagacuuagaagcauugauuagcaagaagagaaacaugcaaaugcaauccagagccaaguucaagcauuaaccuaugacacgaggagagacaucuacuaauuugguguaaauacaaauaaaugcaugcaggcaaggaaguugacagaugguacaauuuaucccugggagcucuggauagauuucuuguauuaaggcuacuauuuucuuuugagguagcaauggaugucaugugcugaaaaugguauggaaauuguggguuagagggcuugaggaggauagugaagagugaaggagugaggacugugaaaagaugaccagggcagacagaaguauuaagauucagagucuauccaaaaauuggagaucauuauuggcaucaaucugcaugagcauguaaucuuccacagcugugccuggugugcauaaucaggugcagagaagcuggacauuggaguccuuccaaaguuuggauucuggagguaaaauagggacgguagcaagaaaauggaguguaugguuuaagaaaaugguuuaggagaaugauuaaaaauuaugucaccugggccaguuagaaaugguauugaagccaagaggggacugauagauugagagaaaaugaacaggggcaagagacuggagcacugaauaaggucagagaauaaguauggugaucacaacacagaaagcucuuuucagaagcagaucauugcuugagaaugagauauugaaauucaagauuccagaguugaagcaacucugggugacaagguccauaguguggccaagggaauaauuuucccaugaagagugggaagggcacucugugugugugugugugugugugugugcgcgagcgcguauguguguguguguguguuuguugggucaccugaaucaguguggcaggauuugcaaugaagaggaagauagggacucaggugccaaaacuaugaaagacuauacagagaaauaaccaugauguugauggaugacagugaugcuaaguagacuaauaaucagauggccugaccaaaaaagauggcuggagguauaauguucaggaugcaagaaaaugcugaacacccucuugacaaugaaaaacaaugaacaaccucuauuugauauagcuguagugggaagucguguccuaauggauagucaauuuucaguuaagguaaggagguaaaagaucuaagggacuuccaagagcaugauggaaagauuagcaggaagagaagcaauggggugaauauaacaugaggaagggaagaaaauuaaaaaagaacaugaagaugcgagugggggaaggacagaugacuaaagaaguuuguaauuuggauauuggccaagggugcaaaggaugugagacaggaaagaaccaggauaaagcuguuucagggucaacgcagaccucaggagguguuagaugcugacgauaugcacaggcugaggccuuugcucuaguuuucaaggggaaaguuggugagaaaaugucucugaagaaauguuagucugggauugcuaccaaauaguucagucuugggacccucaucuuauauuggaaacugcacuuguucucuccuagggaucaauuacacaauccaaauucuguccuugagagacucccaaccccuuugagauauguucuuuuucaauuucauaggccauaauaucaugcuuaucuauucuccaaacauuugaaaaucuacauugcaaaaguuucgggaugugcaucuaacugugcccaguguucccacaaauacuguccuguugcaaccucucuuauaugacagugagauucuugauggugaggauuguuucuuuuuuguuucuguauccccagaacuucaggauguccauagugcaugguagguguacauuauguuugccaaaugaaugaagcauacaaauaaauauacuaguaucugcacgcaucauuuucaacagagggaaaagcuguuccucuucguauagaaggcuuaugcccccacuuacauuugaauuccauucucuccagucuucucagagagcuacaugauuaacuauccuuucccucuugcauguaucaaucuucccuucuaaaaacuauuuuuucuuuaaguuucagaaugucucucacaaauuaaugucuccugccuugaccuuaccucugcauuucagaccaugaugggugcacaauugcuuauugacauuucuacuuggauuuuacauaggcaucuuaaucuuaugaccuuuccccugguccuauuccaguuuuuccugucucuaugaaugaaaucacugcccaucuuguuguacaagcuagaaagcugagucaccuuugacaccucccucucuuucaccuccauauugacccacuauggaguccuggcauuugccuccugaauagcuucuaaucuucugccuggucacgucuaccaccaccacaugaccuaagccaccacagugucuugucuggacuguuguauuuccuaacaaauauuccugcauccacucuuacuccuaucaauccccaacuccaaacucguugccagacugcagccagucccaguuuggaacucuuaaucugauaccccaaacucauggauuccuguugcuuuuaggaugagggcugaaaucuccaaagugcuccccaaggccaguguagucuggcccaagccugucucuucagcacauuggacagcauggucuccuaugcuugcuuuggucagauauugacuucuauaaguucaucaaauaugacaaacucuacccaccacaguacuugggauaucuaaaaggcaucucugacuuuacuugacucaaaacaaucuccugaacuaccccucacagucucuucccuucaccauucucccuaucucagugaguaaggcucuauucuaugaguucuuuaauccaaagauguugaggccacccuugacucucuuuuucucacacucaauuuccauuccuuuggcaaaucccaucagcucuaccuucaaaguauauccaaccacaucucugaucacaucucaccaucucugcuuguaccaaacugguccaaaccauuauuguaaaugccucuaaguguuucuugcugcccucaccuuugcagcacuaacagucuauuuuucauaugucagacccggugauccacuucuuugcuaaaacucuccaaggguugccuggcucacaugcaaggcacuggacaauguggccccaugaccucucugauugcauuuccuaucacugcuccuuuucccucucccaucacaacacauacucagacacagugcugucuguucccagaacaugcccaaggaugcucuacugcagcucucagcccucacuccucccccuacccagaggccucccucacucacaguugcaugaucugcugccucagcugaaaggcugaucccuguaauacccaccucaccugcacacucuggacuccuguuuagcucauccuuuccauuucuucacagcacuuaacaccaccugauguaguuuacgucaucuguuucuagucaucuguuuauaguuuaucugucaucuguuuauucagaugacaucuguguaugucaucuguuuaugacaucuguuuauucggucaucuguuuauagucuguuuuuccuucaacuaaaacauaagcucucugugggcaaggaauuuguuuuguucacugcuguauccucagcaccagcacagugccugaaguuguugaaaggcugcaggaagaaugaaugccguucccuuuaucuagaauguucuccagcucuucuguguuuuaucagcucccagucauccuucagaugucagucuaagagucacuuccacagagaagcuuucccugaccuucaguauucugucuaaucugucauuuaagcccuuuccauauacucuuuuuuugugaccacuuaccacaguuguaauguuaugcuuaucuguaugauacaauugauuaugauuauucucuuacuggacuuuaaacuccaugagggcaggaguuuuaauucaucuaucugcuuuugcucaucaugguuuccucugaaaguagugcagagcccagcauuugguagacaauaaagauuccuugaguaaaugaaaaaauggagugaauuaauaaauaaaugaguuaaguaacaaauagauuuggucuuuuuuuuucuuuaguuucuuuuuuaaaaacagaccuaaagcuuacaauucuuugaguuucugacaccuuuauuucgccaaccaauuuauuuuuguuccucaacaccacuuaacuuuucauuuuauuuucuuuaaauugagagaugaaguugucagcagguaggucaugaauuuaaagcaggagugcuagaauaaugauucccaucucagucaccugcagagcuuguuuaacaaucagacuuccaagccucaggccucaguuuuucguaaggaucuauuaagaaagaccagauaacuuucaggagccucauaccuuaucuuauguuguuucuuuauccuuagaagaauuaaaaggagaccauaacucagaaauauaucaauuaucaaacaacaggugaacugcaaauugaagcucagcuugccauacucagcggggaagacaggcuuuagaauacacucuuucuugcauuaaaaugcuuuuaaaaacaagcauuguugaccuaacugcaaagaaugucaaaacugaguaacuacaggaagaacauugcuggguuucugcacgugaagaaaaugaaaaacaaaaaggcccccaaaaccuuaagucuccguguuuuucuucugcucaagauaaagacauuuuuggcugggcacggcaacucaugccuguaaucccagcacuuugggagggcaaggccagcggaucacuugaggucaggaguuugagaccagccuggccaacauggcaaaaccuuuucucuacugaaaacacaaaaauuagccaggcaugguggcgggcaccuguggucccagcuacucaggaguaugaggugggagaauggcuugaacccaggaggcagagacugcagugagucgagacugcgccacugcacugcaaccuggcugauagagccagacucgacuguaaaaacaaacaaacacaaaaaagacugaguuucacuaauauacagaaggucaguaagggacaucuguacuucagagauuauuaagaucugccagaauaugaugaaagcaaauuugaaugaaucauuacaaaaauaaucaaucuuaugacaaguuuucuaaaugaaguuuuaaaaauaauaaaauacuuuaaaauaauaacuuguuuaaaauuuaaaucuuuaaagugacuuuaauucuaagaaagagugccauuuuccagaugaaaaaacagagguaucaccccaauauuguaaaauaaaaaauccugacuuuuuguuguuguuguucauuuguuucauuuggaaacaaagcaaccaacaucaaaggcugcaauguaggacuauuagaacauuuugcugaggagaagguaaauugauuaguaaagauaaugaaguuugaagaaccuacuucuuuuuuuuuuuuuccuuuuuuuuauuauacucuaaguucuaggguacaugugcacaauaugcagguuuguuacauauguauacaugugccauguuggugugcugcacccauuaacucaucauuuacauuagguauaucuccuaaugcuaucucuccccaccuacccccaccccacgauaggccccagugugugauguuccccuuccuguguccaaguguucucauuagaacuuacuucuuaaaaggagaaaaauggaagccaauuuuuuuuuuuuuaccuuagcaaaguauaccaaugaaaugugcaguuuuugguaaguauuuugguucuaguguuaagucuaaaacaaggaaggcuuuaauuacccuaagaaacuaaaugcaacaaaaaaaaucuuaggagaaaaaauuuuuccugcagucaagagaaugcugcuuuuaccgacauuuucuuaucucuuauuucaguauucuugaaaaauugauugauuaauaaggcaauucugucuagguaaaacugccuggagacaaucaguuguuauauuccuguguacagggcaaaaugacaaaaaggauaacgcaggaaaccuuggggcaaguacuguaaauuacagaguaucuggucgauggagaagcaauuaugaaagaaaaaggaccuacuucuuccucauaacugaaaucacccauucauuguuauugacccuaagaaagaugaaagggaggaacgccuguuguuaggagucaaagagauaauaagaaaccauugaaucaggaauaggggaugaaccauuauuuaucuauauugacaauguuuugcuucagauauguugauuguaauguuucuauuuucucucaaauucuuucucacaauguucuaauaacuucuuuuaaaauugcuagucaaaaugccuuaaauaaaauguuuuaccagcucucagcaucaaaggggucaaaucuggugacaaacaccagaaucauaaauauaacaauuauaggcacguaaggugcccugcggaaaacagagcaucuccacacucuaagaaaucucucauuccucccaaagauagaacaaauaauccccuuaaaaagggggaaagugacauuuguuuuacauuuuauuuucuaaucccauuauuuuuuaaaagaucuaaguaaagcaagucuucuaaaaguaugauauuccaccuucuuccuucucauuguguuuuauguaaugcuccaccagguuaugcuuaccaucuuacaaauggcucuagguuuugcucuaaaagaauucaguggugaauucuuuuuguguaauaccauuacacacacaaaaaauguguaacacauugguaaacauuggguaauaccaauucuuuucauguaauaucaucacacaaaaaagcaugguuagaggaauuuagagacacacaggcuuuaaaccaggaugggacuaggacuaaagugauuccaagguggaaugaaaaaaguacaaaaauuaaauaucuaaacucucugauaagaugggcagaagguuauaaaauauaugaccaccccacaagacucaaucaaauguauuagaauuucauuuuggaagugauucaccaccauaaaaaaaguuuguuucccauaguuugaaagaaacucuuauaauuuaaaccuuuuuuucuccccagagcaaaucugcauaugaauuuuugcuguuuaacugcuuagagguacuuuauuaacaaagaucuugucccagggcuuugugagccuucacuauuaaaugaaaaguacaagaguucaaauuugaagacaauucucacauccuauguuauuaauaaauaaagcaagaacacagccugggcuauaggugugaagaagaaagccuucuaauucuccuugcucacaauuuuuuuacucugagucaaauacaaucauaaacuaaacuguauaauagaaccggaaugauaucuaacuuuucagugcaaauaucauccaacaaaauagauaagaaucacuaacauuuauugggcacuuacuauguugcagacaaugucccacacaucaugcaauuauuuuaucauauaaucuuuacaauaacuccaugagguaacauauaaaaaugcucagggcagagagcuuaaguaauuuguacgagucugauugacaucugauugcugggagaaagagcaagaacugucacccaggaucucuaucuccagagccauauagucuccuuuccuguaagaaacuaguaagauauuucuggcuaaguauucucuaggguaaagagcaugcacuuucaccuucacauguguguuauuuccaaaccauaguccuuuguuuggaaaugaagaaagcugcaaucauuuuugaaauugaaaaaaggugaggcuuugugaaggugcacuaaugugauaaacaaagcuguggcagcuccaguggagacagaaaaucauucucuucauuuaccuucgcugcuuguuuauuuuggaauuuccaaguaagcauuugccccauugucuuagggcagcggaaaggcuagguucuauaugaguucugauccuucuuugagguguacucugacuagaaauaguauuacagagcuuauuccagagcaccuucauccaauuuucccacuggaaaaaaauaugcgaauuuuuuagagcauuauguaauugguacugucuuguaacuguaagcuuugaucaacaacaacaacaauaauaauauaguaauaguaacaacaauagcuaacacuuuuugugccaggccuucugcuaggggcuucacauguauuaucccauuuaaccuuuacaauaaucuuaaaaggcagaccucauuauuacagauaagacaacugaggcucaaagaaguuaaacaaauugucuaaacguucuuuauuuacaaaguuaacuaacugcuuuucauauuauuuauuuauuuauugagacagggucucacucugccacccagauuggaguacaguggcaccauuacaggucacuggagccucgaccucccaggcucaagugauccucucaccucagucucccaaguagcuaggacuacgagagugcaccaccacaccuggcuaauucuuuuacuuuuugcagagauggcaucuugcuauguugccaaggcuggucucaaacuuguggccucaaguuuggaggccucaagugggaggcaccugucuuggccucccaagguguuaggauuacaggucugagucacuacacucggcucuaacuacuugugaauucauguuauuuuuauaugccuuugccucaaggaaggauacaaggcaauuaauauucacuugggaacucuucaacuguuccauauaaucaugcauauuucauauuauugcaguaauuccauuugcaauuuaaauacacuauuaucuuuuuaaaacauuacauacgucuaauaagucacugcuuugguauguauagaauuugaacaugucccauagagaagccagaugaagaaaaagaaacaaguaaaauguuuguggaaugaaggcccuguuccaguucgcccauacccagcagaauagaaccaucggccuucugaguacuuugaaguugauuauuuaaugaaaagcaaaaggcaaaaaucuauagucagggacaagauggaauguauaaucucugcuguaaguacaaaaauuaaguuuuguguuuuaauugauuuuccuaggcaaauucaauaaaaugaucaaaugcaauuaaaguaucauauucuucccuggagcucucaaguucccugcuacuuuaaucuauguuugaauccuauaugaaaagccuuagacuauaaauaugcacgagguaugccaaagugacacuuggugauacagaaacuuacugcagaauugaauuucagagacuggaaacaacugucuuccuccauccauccuuccaacccccucaaccccaaaaaguucagcauuucauuucaugcagucauagugaacuuggucaguuuuucuucacucaaaugcuucaacaacuugcaacaauuauuuggcuuggacuucacagcacaaggugaaccaaguacuuauuuuuaaccaauguagaccagauuucuugauucugcuucacagaaaauuagucaucgauuucuuaggauaaaugaguucugcugaucuacagugcagaccaaggaaaaguguaaaugagguaaaaagaccagucucucacccuaagauucauucaguuugucacuccugugaauaacguuagcaacagcugagacugcauuuguugcuugguuuucucuuaccuuuuugucuaguuucucuggcuucagguuccucuaugaccagaauacgagcugagcagacaauguagcagaaaaauuuaaauuacuucuaaagagcaaugagaggggcucucacaguaucccaagaccagcagcuuuucagaagaaccuucagaagaaugguucaucacacuauuauauccccaugccugaagugcagcucaccccaagcugaauugaaaggcucugug

SEQ ID NO: 191709 - RNA, 9408 nt, Homo sapiens
uuaguuuacuuguuuauuuaugcaauacaucaugucuagcuaucaacaaaaaauuacaaggcaugcuaaaagacaaaaaaacagucugaaaagaaaacaagcaucagaaccagacucaguuauggcagacauuuuagaauuaccagaucauaaauuuaaaauaacugauuaacaugcaaagggcucuaaugcgaaaagcauacaacacgcaagaaugaugggugacguaagcagagauagaagcuauaagaaaaaaucaaaaggaagugauagaaguaaaaaacaucgucaggcuggcgugguggcucacaccuguaauccuagcacuuugggaggccaaggcggguggaucaccugaggucaggaguuugagaccggccuggccaacauggcaaaaccccgucucuacuaaaaauacaaaaauuagccaggcaugguggugcacaccuaaaaucccagcuacucuggaggcugagacaggacaaucgcuugauugggggagguggaggcuacagugagccgagacaugagucacugcacuccagccuggacgacagagcugagacuccaucucaaaaaaaaaaaaaagcccagaguucaaggcugcagugcccaaugauuaagccucugaauagccacugcauuccagccugggagcaaagugagacugucucuaaaaaaagaaaaaauauauauauagucuucuucuguuuuguuuuguuuguuuaauucaaaguuacaucacaguuguccucgacuacagaaacagauccagcuacaauguuuaauucuucuccauuacuuaaauuaaaugcugccaccauugaguauggcauuguauaaucauauuccuucagcgguuaaaauagaaaaaaaaaugcagauagagauguguauaauuggcaugcauagaaauacagaaccaguuacaugacaaaaguaaacaaaacucuaaaccuucauauuuuaaaaacaagauuuuccauuuaacaagaauuacauucauuaaacuggagaguaucuccuauagagaaaacuuuuagagucagauccaaacauuacuauauucauacuuggaagcacuuugacaacucaaggcugaaaaccccacacugugcuuguugucaguccacuguuuuccugccuaguagacuccaaaagugaauauucuaccacuuugugcaggugaugcugaaugcuguguccacugaacuggggccgcccagggucaccaaucaguacucgaguucuauagguccagaagcacuucuucagccacugaugaagacuaucugcaaggucuucaucauaaaacauaucgccaagaacaacaaggucccacuuaucuuguuccaaauucaaaauguuuuggauuaaaauaggaaaaggauucagucuguucaauucacaauuuaguguaauagccauuccugcaacuuaaaaaaaaaaaaagcacaaaaugaauugguauaugcuaggcuguuauaauuccauguugauuaaauaauuuagaagaucugcuaacaauauauuuuucuuccuuuuugaugaaaguuguuuuuuaaaguagagaaguauaaagguuaucccaauauaagcuauaccacaauuuccaaauacaugacuggauauccugaaaacaaacaauucaaaacaccuagaaaugcugggacuuuuaggaauauuugcugauuucauuaaccaaaagauuuuguuuuuuuacuguggacagggaaacgagacuugggcuugauugagcauggcaauaaauuagaacugagaccccuuggcugggcgcaguggcucacgccuauaaucccaguacuuugggaggccgaggcggguggaucaccugaggucaggaguucaagaccagccuggccaacauggucaaacccugucucuaauaaaaauacaaaaauuagcugggcaugguggugcaugccuguaaucccagcuacucgggaggcugaggcaggagaaucacuugaacccacgagguggagguugcagugagccaagaccgugccacugcacuccagccugggcaauagagugagacucuguaucaaaaaaaaaaaaagaaaaaaaaagaacugagacuccuuuauaaaauaaagguuuucagccaggcgcgguggcucaugccuguaauccuagcacuuugggaggccaagacgggcagaucacgaggucaggagauugagaccauccugaauaacacggugaaaccccaucucuacuaaaaaugcaaaaaaaaaaaaauuagccaggcaugguggcaggcaccuauagucccagcuacucaggaggcugaggcaggagaauggugugaacccgggaggcggagcuugcagugagcugagauugugcuacugcacuccagccugggugacagagggagacucugucucaaaauaaauaaauaaauaaaauaaaauaaagguuuucaaggacuauauucucagugaaaggguagaccagaagaaaaucagaucaaauaaaaacuuaccugucucagccuggguucuaauggaauaaaaauaacccucaaagacaggucaauacucacuuggguuuggggucaaauaaacacuauuuacauauuucaggaaauuccuagcccauaaauuaacauaagugcuuacucuggaugucuggcagacacaaauccucuugggaaaaaugcaccaucuacucagaccucaggggauuccuacagauaaugucccagugcacagagauucacaauguccaaucacaaaauacauauaacgauaagcuaccacacugagcauguguacauauuuaucccagagaaaaaaaaaagaugagccuuaaauauuuuaaaauaugaauccuuacuagggucuaugucauuggccaagauccuugaugccccacucaucuuagcagcaauagcuguagcuccacauccacucccaagaucuaauacagauuuuccucugacaacaucaggauuauccaaaagauaccuaaauuaaaaaggagaaacaugucucagagagaugaggaaaaauaaauguugggaacaggccccccaaaaucuggccauaaacuggccccaaaacuggcuauaaacaaaaucucugcagcacugugacauguucaugauggccauaacacccacgcuggaaggcuguggguuuaccggaaugagggcaaggaacaccuggccugcccagggcagagaacugcuuaaaggcguucuuaaaccacaaacaauagcaugggcgaucugugccuuaaggacaugcuccugcugcagauaacuaacccaacccaucccuuuauuucagcccaucccuucauuucccauaagggauacuuuuaguuaaucuaauaucuauagaaacaaugcuaaugacuggcuugcuguuaauaaacauguggguaaaucucuguucggggcucucaggucugaaggcugugagacgccugauuucccacuucacaccucuacauuucuguguguguaucuuuaauuccucuagugucacuggguuagggucuccccagccgagcuggucucagcaaauaagagguaugcaaaaaaagaaaaaagaaaagaaaaggaaaagaaagaaaagagaugucuuuagguugacuggacaaaagaaauagugaaaaguagcagaacuugguccaaccuuggcaaguuuggucugacuagagugacacaaaaaguccaucuccagagcugggcagagguggcagaagaaaggaccuagucauuuggucuuucucuucagcaggugugaagcacaguaccacacaacugacugauuaugcuauucaagucaauuuuuuucaaaaaaaaguuguaggcugggcacaguggcuccugccuguaaucccagcacuuugggaggcugagcagguggaucaccugaggucaggaguucgagaccagucuggccaacauggugaaaucccaucucuacuaaaaauacaaaaauuagccaggugugguggcgggcaccugcaaucccagcuacucgggaggcugaggcaggagaauugcuugaacccaggaggcagaggcugcagugaguagagaucaagccauugcacuccagccugggugacagaguaagacucugucucaaaaaaaaaaaaaaagaaagaaagaaaagaaauguauaaauggccaggugugguggcucacgccuguaaucccagcacuuuaggaggcaagguggguggaucaccugaggucaggaguucgagaccagccuggccaacagggugaaaccccgucucuacuaaaaauacaaaauuagccaggcguggugguacaugccuguaaucccagcuacucgggaggcugaggcagagaaucguuugaacccgggaggggaaggcugcagucugccaagauugugccauugcacuccagccugggcaacaagagcaaaacuccaucucaaaaaaaaaaaaaaaaagaaagaaaaagaaauguauaaauacugugccuccuaaaaaccucuuagaagagcacaggccacaaacuuuucugugacuugcauuuuucuugggcuuaacaaaccuugacugguugagacucaugccucagucucucauuucggcugacaaaguauugaauacuuaguauguuccagaaacuaccgagcaccacgaauuaagacugacaaaauacugcuaaaacaaagacuaaaauuaguaaacucaauccaagagucacugucuccucuugacuccaucauagagugauuuuccugcugcuugaaauguaguauaaugaccucucugguaaaacucaaaguccaauucaaccaaggaauuuggacuggagcuaaauaguuaccaaacaagcgaagagggauggagaaacgcugaaauaacaaauuucagcugacucuugaucuucggauuggaguaauaaggaacaguggguacuacugaggcaggagaauggcagaggaagucaggggugaaggggacccguuggacauaggcuagcugaagcaauaccaaaagcaaagcauacaagauagcagaaacaggacauaugaaauaagacaguaagcaguaagagauacgggaguaagcaaugaguuagaacaugcaagauaaggaaaauaaguggaaagggguugcaguagcaauuugguuacaagaacuaaaaguaaagaugagcaauuuugucagaaaagauaaaauaagguuaagcaaggaugcacaauuagcuuaugagaaauaaagugcgguuuaggcacaaugagggaaaggccaggaugagcaauucacuuacgaaaaacaaaguaagguuaagcaagugaggaaaaaacauauaaaaggccaugaacuauaacaaacuggggcugauaccacucgcaggucagccugauccguugcugauugcauucugcuuaacaaacuguuugcugccuugcuacuuguaugugucauguccaauucuuuguugauggcacuaagaaccugggacuugacaucaaccaguuaacacuauggcaaaguagaggcauacaugcccugucuaaauagcugcuacugccaggcacgauggcucaugccuguaaucccagcacuuugggaggccgaggcuggcggaucacuugaggucagggguucgagaccagccuggucaacauggugaaacccugucucuacuaaaaauacaaaauuaagccaggcgcgguggcucacgccuguaaucccagcacuuugggaggccgaggagggcggaucacgaggucagaaguucgagaccagccugaucaacauggugaaaccccaucucuacuaaaaauacaaaaauuagccgggcaugguggcaugagccuguagucccagcuacucaggagggugaggcaggagaauggcgugaacccgggaggcggggcuugcagugagccgagaucacaccacugcacuccagccugggugacagagugagacucugucucaaaaaaaaaaaaaauuuuuuuuuguagagauagggguaucacuauguugccuacgcuggucucaaacucuugacuucaagcuguccuccugcacuggcuuccuaaagcacugggauuacaggcacugcacccaacagaagagggaaacuuugaacagcccacucacucacagcuccuguuuuaugggaaaauaagcaacucuggaaggaaugugagguuuauggagcgacauucacugaauuaaaggagagcgaaaggacuggguguuuagcuuccaucuaggaacucugcaauggucaugcgcuaugaacuaugaaccuccuaacaggugagauuucuggaucacuuauagcuauccagggucuugacagcugacucuaggauuucucuuggggagacaguuacuugggaaaauagcuugauaagcuuggguuagaaugggaaauuacgcaacaaggcaacaaaaaauauggcuaaccugaggcuaggcucagaggcucaugucuguaauaccagcacuuggggagguugaggaggccagauguuuaagaccagccuggacaacauagcaagauccugucucuaccaaaaaaaaaaaaaaaaaagaaagaaagaaaaaagaaaacaacaagacugaguuuugccgguuucuguuuuguuuuugagacaggccaggcgagagugcaguggcaggaucacagcuuacagccucagccucccaaaguacugagacuacaggcaugagccaccacgccuagcauugcucugguuuuuuguagagguuggagggaacugaaaacagcaaagaucuguagcgccuuaaagguuucauuaggguaguaccuagacagggcuuggccuccuggccaguagauugcccaguaaggaucacuguggggccacaggucagcucucucccaccagaauuugcaucugggggucaaaagccgcaacuggauuucaggggugaggcuaccacugcuggugacuucaguguucuccuccaggaaagccuuuaucucaggguccaaaaagcuuccagcuccucuccagggacacuggccacagggaaacaagagaagaccacugcuucgcagagccugcaagaggagaccacagugguuccugugugcuuuccaaccuagacucaaagccaucaguccuuuccccaaacacagguucugucaauguucuguugauaauagcugcuucucaaggagaaugaacaagggugugucucccaacuugaucucaaccggaaccucugacucugaaaaaaaaaagaaaaguaauacugagaauucugaggaagagcaacauuucuagauccuauuacauaauaagaaaauauuggccgggcgcgguggcucacgccuguaaucccugcacuuugggaggccaaggcggguggaucacgaggucagguguucaagaccaguguggccaucauggugaaacccugucucuacuaaaaauacaaaaaauuagccaggcgugguggcggguaccuguaaucucacuacuugagaauugcuugaacccgggaggcggagguugcagugugccgagaucgcaccauugcauuccagccugggcaacaagagcaaaacuccgucucauaaaaaaaaaaaagaaauaaaauauuacaguguauauuacuguaucugaugauucacaugugcaaguucauuucagaugaaagcuuuggugcaucaauugggaaaauccaaucuuuuuaaaugauacuuuucacaagagaauccuuuuaguaauuuaacacaacaaauauacaagcauuugauuuugaaagaauccucaagaaaaugccucuuacaggaaaucagccauacagucauccuucaguauccucaagugauugguuccgguauccccugcuuccaggauaccacaaucagaggauacucaagucccuuauauaaaauggcaucauauuuguauauaaacuaggcauaugcugugguauacuuuacuuuaaaucaucucuggaugacucauaauacuuaauacaacguaaaugcuauauaaguaguuguuacacuauuuuuguguuauuuuuauuguuguaauuuuauauugcuauauuguuauauugugggccaacuguaccuuuaaaguucuuucauaaauuuaacaaaguaggcaugcuugguaacugugaacaaaauaacagaagucuucugucuucaggaagcuuauauucuaguggugggauaaagcaguuaacagggcaaacacaguuuuugccuuuaugaagucuagccaagaguucuggggguuaaugaauuuauaauugucugugggcagagauauauuaauacaaauuauauugacuacucuauuucauuaaagauuguuguaucauaaaacaaugcaaucaagauucagguuuuuuccuuuaaaaauacuguaugcauuuaauuguaauaaaagaacaucaacuccuaaaucucuuucuguaaaaguaucugaugguucgauuuuaccaagccuaaacugaaaagauuugcuccaacagaaaaacaccugugcaauugaucacuaagauuuguuuaaaaauauauauauauagaaaaacacccggauuagaauaaaugagaaugaggaacaacuuaaacacaacuuauacacccaguuguuuggggaccucggaucucuucugcauaaauguuuuaaauggucuuaaauccacuaaaguauuuaggggucaaaaauccaaauccccacaaggggcuggacaucauaaaugagugaugcaggcuggcuguaaaauaacagaggggcuguggcaagcuggagacuguuuucaaacaguucaaaaaggcuaggcaggacaugcugccagauccuccgauuucucaaaaucaucaaaaaaaucuagauauugacacauuagcuuccaccuuuuuuuuuuuuuuuuuuuuuuuuuuugagacagagucucuguugcccaggcuggagugcaguggcgugaucucggcucacugcaaccuccgacucccagguucaagcgauucuccuaccucagccucccgaguccugggauuacaggggcgugccaccacgcccggcuaauuuuuguauuuuuuuuuuuuuuuuuuuuuuuaguagagacgagguuucgccauguuggccagacuggucuggaacuccugaccugaagcgauccuccugccucgaccucccaaagugcugggauuacaggcgcgagccaccacgcccggccagcuucggcuuguaaacaucagcaacucauucaaauaucaaaacacagggcaggucaaaaugcaugucaggucauacauagccugugaacucagcguagacuuccaguggguguuaguuaccccacaucaguguccugggaucguaggggucucucagggccugguaucccacuagacuaauuguuaagcag

SEQ ID NO: 191710 - RNA, 33691 nt, Homo sapiens
gacuuaaacucuggggcccgggaggccgccgguuuucuccccgcuugccggggugguccucuucccuuugucgguaagugugagacgagcaccccgaggucccuccgccuuccgggguccgggcggggcgggggccgggagccgggagccagaggcacucgcgguccgggccugcgcgcggcgcagagcgcuuuuguucugcggcaaagacgcagucgcgggcggccccggaacccgggccucgggccccgccggcucgcgcgucccgccguccgcccaccggagcugggccgggccgccgcgcuugcuucugcccgccgcaccggggccggcccugggccuccgcggaugccgagccuugcaccggagggcgggccucgcuggcuguuuucccucauugccuggcucugcgcgguagaggucgcgaguggcgaaggcuaggacgcauuuugucgaacugcgaggcgcggcuggugaggcggguggguaugagagcugcuuauguuuuuaaggcuuuccugucgcuggagugaaaaagaaaaaucuuuuuuuuuuuuugcuauuucccgaggguucuccuccuccccggcccucuuaagccgaagccuccuggaacagaauugcuguacuggcaucuaucuccaagugguccgcgaacgcuucugcgccggcgaugguuucuguuccucagcaauaguuccuugaggcauuuuuaaaugcacaaacgcauacccaucuuagguguucucgagggacacggauucccuaagcaaacguccuuaggguccugaguucagcagcaaacuuucggggaaucauuuccgugaaaacaauuuauuuguaguacaucgagugcauacugucuuaacauaaggauguguaugagcuugaggcgcauuuucauuuaguggcgggcgggugcauuucaguaggcgggccgcagagcuuguuuggggauugcauuuuucugcuaaauguguuagcuuuaaucauguuucagucacuguuaaugugcaugcauguuaagguuuuagguuuuuuccccugugcagucggauuuuuuucuguuuaauauuaauccaauaaagacaagugcagagauaaaguauuauuguuuugcagugauacuacaauagcggaccuagaggagcgcacauaaauucuaacuuaagugaaugguauuuucaggccagaccuaguuucuauuucuguuacuuaggacacuuaauaagaauucaguaaacuuagcaugcuuucagugcagccauaaaagaaaacaguuuugcacagcagugucauaucuaguaaacacauuagcaugugcucuuuuauuauaaaauguuucuugcugucccuaggaccaaagaaguaaacacuguguggagagggacugacguguuuggagggaaaugggaauguacacgauaauuaaagaguaaaguugugcucaacgguaaguguaucaccucuaagaaacccgcccugauuuaaccaggcgguuauucacacucaacuauggaguaauucaccuauuaccgaauaaaauuacuagcucagugaaucaacaucgguuuuaaauuaaacugugggucacaauggaauugacagcaaagcuugagaagaaauguuguuggcauaguacugaaaaaucaguuguuaaucuuagcaaaauaaggaaagaggucuuugguaagggaauugugguggaaguuaccugggcagaggucugcuucugucugugcuguguuuauuugauuguuuuuauuauauuuuauuacuguugguggcacauaggggaauguggcgcagagcaccacucugggaggaugcuucccgugcagccaaagugaucauguccagggcuuucaucuguaaccacaaaguguguuaggaagucucaccuaaugauuaagaccauggucccuguaaccacacugcuuugguucagaucuuggcuguagcacucagccaacccuggaaaauaaaccucugccuguucucucaucuauaaaauggggacaagcacuaaugucauaggauuguuaugguagaguuacaugaguuucaugcauaucacaguuaaacagcuccugaugcauggcaagugcccaauaaauguuagcuauugucauguuagaggaaauagauuuuguggccugggacauguaaugcugccuuagcagaaauucagcugguucauuuaagcucuaaauuuaugagcuuuuuauugauuaaacccaucacuguagauccucuuagauucucuuuuuuguaggucuuguuuuguuaggaaguaccugucacuacugguccacaucuggauuuaccugcaggcuuguuuggaauaaaaaaugccuccaaauuccuaggcaggacaaacuugccccaaagcuuuguuguucuacauuaucucugugauuguacaggaaucucucuucccuccuagauuaucagugucuuggauauaauuggagcucaaaugcuuagggaauugauuuaauguugcuuaaaacguauuuguaggccaggugugguggcucacgccuauaaugccagcacuuuaagaggcuggggcaggcagaucacuugaggccaggaguucgagaccagcccuggccucaaguuggccaacauggcaaaaccccaucuuuacuaauaauaacaaaaauuagucgggcgugguggcacaugccuguaauccuagcuacucaaguggcugaacccaggagguggagguugcagugaccugaagucaccccaucguacugcagccuggguaacagagcaagauucugucuuuuuaaaaaaaaaaaaaaaaaagcauuugugaaggugaauuucaagaaucuaaucaggccucccucccucccccauuagaggcacacucuauuauguaaaacagacagggaguguauucauuuugagauaaguccaggauaacaguugacuaacccuggcuauagauacgcaaguuaaacauucacuuuggaagaagauugugaagaaagaaucuuggaccuugaggaauucuaaaugcuuuguuggguggcaacuaugcaauacuuacacuauuccuaauaccuuaaguguacuuguaagugaagagcaaaguuggaggcuguugagguaaauaaucucaagugagauuggaacuauacauuuuaugcuccugguuuucaugaucgcaaagauuuaaugacaguaacuuaagauucucuugauguaucaaauuacaagguuucauuuguaaauaaggugauuaaaaugacaaaguguauuaaaagaaauuguauuguccagugaaguuuuaagaaacagaaaccauaaggugauuauuauuuuucaagccccaaaggagaauucauuagaugacauacuuuuaaaguucauggaucagggucgggugcgguggcucaugccuguaaucccagcacuuugggaggccaaggugggcagaucaccugaggucaggaguuggagaccagccuggccaacauggugaagcuccaucucuacuaaaaguacaaaaaauuagccaggcgugguggcacaugccugaaaucccggcuauccgggaggcagagguugcagugagcugagaucgcgccacuguacccuagcucgggugacagagugagacucugucuuagaaaauaaaguccaugggcuggucgcaguggcucacgccuguaaucccagcacuuugggaggccaaggcagguggaucaugaggucaggaaaucgagaccacccuggcuaacaggugaaaccccaaaauuagccaggugugguggcaugcgccuguagucccagcuaacucaggaggcugagauaggagaauugcuugaacccaggaggggagguugcagugagcugagaucacaccacugcacuccagccuggacgacagagcgagacugucucaaaaaaaaaaaaaaaaguucauggagcacaaccuuuggguuuugauggauccaggaucuaaauccaaaagagaguuuuaaagauuugggacacuguaucuuugagcucugcuguccucugcuuugguuuucaggcagaccaucccuccacugggcagcccugacaucuccagaugcaagcagcuucaaguuguucagagcaugccuuuuguaacuauaguuagagauaaaauucauaagccauuuauucacucauuuacacccaguguacaguuucagugguuuuuaguauauucagaguugugcacccaucaccacgucaauuuaagaauauuuuauuacccccaaaauaucuccauacucaauagugguaacuccccauuuucuccaacgcaccuuucccuagguaaccauuaaucuacuucuguagguuugcauauucugaacacuucauauaauugaagucauaauauuuuucauccagcauguuuucaaggcucauuuauguuaacacauguauguuacuucauucguuuuuauuaccagauauuccguuguauggauaugccacuuuugcuuauucuuccaucaguuaacagacguuugacacguuuucacucuuugacuacugugaauagugcagcuaugaucauucauaguguuuauguagacguguauuuuuauuucuuuuggguaaauaccuaggaguggaauuccuugguuaugauaacuguuuaacauuuugaggaacugccaggcuauuauccaaaguagauuuaccacuuuauuuuuuauuuaacuuuuguuuuauguuuggggguacguguguagguuuggggguacguguauagguaaaguugugucauggggguuuguggaacauuauuuaaucacccagguauuaagccuaguacccaauuaguuguuuuuuuuucaaauccucucccuccucccacgcuuugccugcuuauaggccccaguguguugagccccucuacauguccauguguucucaucauuuagcucccacuuaugugugaaagcaugcaauauuugguuuccuguguuaguuugcuaaggauaauguccucuagcuccaagcuccugcaaaggacaugaucucauucuuuuuuuauggcugcauaguauucccuaguguauguguacuguuuucuuuaugcgguuuaccguugaugggcauuuagguugauucugggucuuugcuauugugaauagacaugcacaauuuuauacagcaauguuugagagaugguuggucuacauccauagacacuuaacuuuuauagccauagaagugagccugaagugguagcucauugugguugugauuugcauuuaccugaugauuagucauguuaagcaucuuuuuaugugcauguugauuucuuuggagaaguaucuauucaaaacuuuuggccuuaaauuuguguugucuuuggauugucagguuguaaguuuuuaagauauccuggauucugauccuuccuuacuagggaccauaaaugugaggguuuacuccuggguucuagguucuguuccauugaucaaugccuguccugugucaguacuauauggucuuguuuauuguaguuuugucguuuuguuuuuuuguuuuuuguuuuuaagacugaaucucacuguguugcccagaauggagugcgguggugugaucuuggcucacuguaaccuccgcuuccgauucuucugccucagccuccaaaguagcuaggauuacagacacuugccaccacaccgcgguaauuuuuguauuuuugguagaggcgagguuucaccauguuggccaggcuggucucgaacuucugaccucaagugaucagcgugccucugccucccaaagugcuggaauuacaggcgugagccacugcucccugccggcuacucccuuuucaaccccuccuuuuucugugucaaaguugcugaguggcagucagaaaaugaaaguaccucugauugguccccucccacaaccaaucaggcuaguggcuggccacuacuucauuuacauaacgugaauccaugguaaaccucuagagaguauuuaaacugcagaaaauuauguaacuugacugucuugagccacugcugcccccgcucccacccuguggagugugcuguccuuuaaaauaagucucugcuuuggcugccuugcuugugugguuuguucaguucuuuguucaagacgccaagaaccuggacagcuacccucaacugcaugguuuagaggaacucuucuguuccacugaaggcauuuugucuaucuccaguggcagaaaauugacucacucauaauaggagcgaugaagaagcgauacuucuggccaacauggugaaaagccaucucuacuaaaaauacaaaaauuagcugggcgugguggcgugugccugaaaucccagcugcuggggaggcugaggcaggagaaucgcuuaaacucaggagguggagguugcagugagccaagaucacgccacugcacucuagccuggugacagagcgagacuucgucucaaaaaaaaaaaaaaaaaagaagugauacuucgaauacaguuuuuaccucaacacaguguugucuuaauaugguuuguacccgccugccacacacugaugugucauguauacuugggggugcuugucagcgcuuuucagauauuuaagaucaccagaccucuaguacacgguguguccaaucuuuuggcuucccuaggccacuuuggaagaagaauugucuugggccacacauaaaauacacuaacacuaacaauagcuaaugagcuuuaaaaaaaauugcaaaaaaaaaaucucauaauguuuuaaucaugcuuaugaauuaguguugggccucauucaaagccgucuugggcugcaugcugcccaugggccgcggauuggacaagcuugauuuaguagauguuuccuugaguuggguauccagagggcuccgaaaugaauuacuuggcagaauucucguaggguaacuggcuuccgcuucauguguucucuguugucuuuaauucccauuuuagggaauaauacaaauagaaaacauggucuaaaauuugucucuggcuucucugcucugaaggcacaacagacuagugucaguauucuagccugaaugaugauagucuguugcauuggucugaacuuccugcuggccagucaagaugugugauugccagcacuucaugcuguaccuguguuaacgagucagaaaaaguagagcaauuuauuucucccuuuuuuagggagaaagcccuguggcucucacuggugaagcuugguaguugggauauauuuagcuuacuuggcucugcauggggaacguuugguauguccuccacaauaggugugaucauccugcugggaaucacgauugcaggcacuuuuuaauccaguguugccuaagacaaaguacaauggauuaggauaucugauuggauggccugugguucugaauagaguuuguagcuggauacaugaaagaugggaaggcagaguuguaggugaacagcuucaccguggugcccugaugacuugcucuucucauagaccauggaggcaaagcuuaggcuuaaucacaggcugacccauauucuggcaggacaacccugcagguccuccaagaacaaagugagagaaaagcagcccugugagaaacagucacaaagcaguuucucaucugccuccuugguuucaauugugcauaggacuuuaccaccuugggggguauacuugcuggcuauaaaauggccacaguuugguguucucaucuggcuuggugucaucccguggggcuggggauacugaucuugauuuugcuguuggacuuaguaauauaugaauccauuuggccuuuugcugacugcaguuacagaagcauagagaacuguucugccccuucuaaccacugugcugcaagagggaggauugcgagucuuuguuaauuuguugugauacuuaaaugagauaaaaguauaugaagcauuccacauaguucuuuacauacagauuuucaaauguuaguuguuuauaguaguacagauguaccucagcuuacgauggaguuacauuucgauaaccuguauuaaguagaaaauguaagucaaaaaugggguuuuauagacaugaugggaugggaaaacacaacauccaaaaaacuuagcuaacacaguacaccauugauugguuuuuuguuuuuuuuaaugugccgugggaggggcagcccugcacgcccgcccacccccaccccccacaacaccagccugccuccgcaggggggauuuuuguuuuuuuuguguguguguguguuuuucauugauuguuaaugcucaugaucacguggcugacugggugcuauggcuugcugccaccacccagcguggaagaauaucauacugccuaucacaggcccgggaaaagaucaaaauucaaaguacaauuucugcugaaugccuguaucacuuuugcaucauuguaaagucaaaauuauuaagucauaccauuguauugugguccaggaccaucugggcuuagaaaaauggauucuagaaagccuauuuaaggacugauaggcuaauuuuuucugugacuaaggugacagaaagccagagcuaguacagguugaauaaauuguguuacauuuggaauuccugaaaaguggcuuuuuacacugaauuguuaguauuggugguuuguuaacuuucuacagguaucucuaauuuuucgaaugcuuauguugcaagucagguuuucaaugaaaaauagacuuuacucaguuuaaccauaucaguggauacucuucaaauaaacuuuccuuuguggaacauaagaaguggaacuuaaaaagccauaagggaaguuuucaauuuaaaauaccagagcgaauuuauauauuuuagguauaagaauaguauuuuaauguauauuauuuauuucuuaaguccuacgucuuuuagguacugaaaugcuuacagaugaaaucaugcuaugucugugguuggcauagauagaaaaggaaacagaaguggucaggacuuuuucccaucuauaaguuuacauuaggacuucucuuuuuuuuuuuuuuuugagacggagucucacucuuucgcccaagcuggacugcaguggcgcuaucccggcucacugcaagcuccgccucuuggguucaugccauucuccugccucagccucccgaguagcugggauuacaggcgcccaccaccaugcccggcuaauuuuuuguauuuuuaguagagacgggguuucaccguguuagccaggauggucucgaucuccugaccucgugauccgcccgccucugccucccaaagugcugggauuacaggcgugagccaccgcgcccggccuaggacuucucuuuaaugggguguucagauaauguuuguuuauucagcaaauacugaaaccugcuagacauuaucuacaugcaugugucuuuuggguuggccugaaagacuuuuaugccugucguauuggcuguuaauaguacuuugauucacucugaugauguuccacuuaccuuuaauaaauugucaacccacuuuucuuucccuuuuuugagacagaucuugcugugucauccaggcuggaguacaguggcacuaccauaguccacugcacucucgacuucccaugcucaagugauccuuccaucucagccucccaaguagcugggaauauaggcguguaccaccacgccuagcuaguguuucuauuuuuauuuuuauuuuuuuguagagacugggucuuacuguguugcccaugcugguuuugaacugcuggacucugccucagccucucagcaugcugagauuauaggugugagccaccacaccuggccagugguaaccccuguguauaaaacaauucuuaggcugggauggcuugagccucaggaguucaagaccagccuaggcaacauggagaaaccucaucucuacaaaacauuaaaaaaauuagccacacgguggcauucaccuguagucccagcugcuugggaagcuguggugagagaauugcuugagcccaggagguggaguuggcagugagcugagaucgugccacuacacucuagccuggaugacauagugagacccugucucaaaaaaaauaaaccaaaauucuugcuguggcucaguuuauacuuccauauucuauuucuugcuguuuuaucugaccuacagcagaccuggccaccaugccauauucacaauauuagguucauuuucugguuuguuugguuuucuuuuguuuuugagacggagucuugcucugucgcacagucuggagugcaguggcaugauucccgcucaccacugccucaacccccuggguucauccaaugccucagccccccaaguagcugagaauacaggugugugcuaccacaaugcugcccagguuagucucgaacuucugagcucaagugaucugccugccuuggccucccaaaguucugggauuacaggugugagccacugugcccagccuaggucuauuuucuuauacuucuuucuauucauguguaugugugcuugugcauguguguuuaacauggauaguaauaugguuauuuccuauagguauaauuuuagauuauuuuuugcuuuauaauuuucuguaguaagcccaauuuacaaauaaaggaagcugcuggguugacaacuuuucaguuauuugcauuguguggauauagaauauuuuuuaaauuucacagauauuguuaaucuuagugagaucuuuaauaugaaaguccacauccauaauuaucuuuaugcuuucuugcagcuguuuacuucuaauuauuuccugauucacaaauuaauuuuugcaauucacaacuucaagaauacuuggacuauuggauucaauccauaguaaucugcaaaagaagagaagcagaauuauaccuagaagucuacuaauggacaguuagucacccaccuacauguugagguacucuggaccuuuuucuuucaccucacuggaagggaaugugggugggaauuuaagacaucuacuuccuuguugauuuuccaccuauuuguucuauucauuguugaaaguagggaauugaagucuuccacucuuauuggugaauugugguuuuugcuucuuguauuuugaugcucuuuuagguauuaauaaccuacagaucacauuugacaguuuuaaguaaacaagcuuccagauuaacuugcuuuggggagguauugugauacaagauggugacauccuguccuugaguaaagaaucuuacacauuccucaaauggguauacugauuaaugcauaaccuaacacucaaaagggugcugcuuuauuuguaaaucagguuuuauugaugcaaguuuucuugcacuuagacauuuuagccuauauguugcaaucaguagccaaugauuauaaccucaguauuguauccuccaacgaaaaaagacaauuugaguauuaggagucccccucccuucuccuauaauuucauauaaaagccuuccaacuuguagcggacuccagaacacuuugaacucuguugguaugucuucccagauugauccucacauuuggccuccaguaaaccuuuaucagauuauuucuaccucaagaaccuucguuuuagacaacagugcauauauguuuguaauuguuaccuugauggguugauccuuuuaucauuauaaaaugcaucucuuuaucagcauuuuuugucuuagucuguuuugucugauacuaguauaggcauuccugcuuucuuuuuuugagacggaguuucacucuuguugcccaggcuggagugcaguggcacaaucucagcucacugcagccuccgccucccggauucaagugauucuccugccucauccucccagguagcagggauuacaggcauguaccacuauaccuggcuaauuuuuuguauuugguggagacgggguuucaccagguuggucaggcugguauugaauuccugaucucagguaauccacccaccucggccucccaaaguucugggauuauaggugugagccacugugccuggccugcauuccagcuuucuuguagcuauuugugugauacuuuuucaucauuuuacuuucagucuguguuuuuggaucuaagguauaucucuuggaaacaauaacauauaguuggauaguuuuuaaaauccagacugacauucucugucuuuuggauugugauauuaugaaauauaucucuggucuuuaucccuguuuucaggcauacacuccuaaaauucgagcagucuccaaagugauaaaugucuuuuuuguaugcuaaugaguugacuuauggcugacauccccuaguuucagaauggagggcuggucaccugaaagaccaaggcccgauuaaaggguugggacuuuucagcccuaccccuaauuccugguaccaauugucuaucuuaguccauuuucuguuacuuauagcagaauaacugaaacaggggccuuuaugaagaaaaggaauucauuucuuacaccuuugaaggugcaccugguugagagggagggggugagguuaaguugaucaccaauagccaaugguuuaauuaaucagaucugugcaaugaagccuccauaaaaccggaaaggauagaguuuagaaggcuuuucagguugcugagcagguggagguuccuagaggguggcguacccagggagggcauggaaaugcugugccccuucucaugugaccuugccuucuacaucucuugaacugaauccuugguaauauacuuuauaauaaacugauaagguguuucccugaguucugugagcugcucuaacacgacaaaccaaaggagcgggacaugggaaucccaguuuacagcuggucggucggaagcacagguaaaauaaccugggacuugguguuggcaucagaaguggggggcagucucggcugggcgcaguggcucacgccuguaaucccagcacuuugggaggccgagguggguggaucacgaggucaggagaucgagaccauccuggcuaacauggugaaacccugucucuacuaaaaauacaaaaaauuagccaggcgugguggugggcaccgguaguuccagcuacucaggaggcugaggcaggagaauggcgugaaccugggaggcggagcucgcagugagccaagauggugccacugcacuccagccugggugacagagugagacuccgucucaaaaaaaaaaaaaaaaaaaagugggggcagucuugcaggacugagcccuaaacugaugagaucugacacuaucuucauauagauagucuuggaauuaaaaugaauuagaggacacccaccugguguguacacugcagaacugauugcuuguuauguggggugagacacccacacaucuggugucagaagugugagaaaguuuauuccuacauucucagaauuguuuauauaaaaauguuauuuuuuauauaauuacauuuaccucuaauguuuuacuuuuuguuuuuaugucucgucuuuuuauuccuuucuuauuccuuagugggguuuauuuugcauaaaugaguauuuucuaauguagcauuuuaauuucucuuuguuuuuucuguuuuuaauuucuuuaacgauauuuucacuguauuuuuuguaacuucauggaagcacaaauucuuuuuaaaaguauuuuuuauauuaaacuaucagugauggaggcuggcagagaucuuggggcgagaauuuauucucucagagaaaugguagugauggaccauggaaacuugucuaugguaaucuguguuagaauauauucuugaaaguucuaagaauacauuauauccacaaguagauuaugccauccuagagacugcagcugacccuugaacaaugugaguuugacccauguggauccacauacacauggauuugacuuuuuuuuuuuuaagagaugaggucacucucuguugcccaggcuggagugcaguguacagucauagcacauuacagccucaaacaucugggcucaaacaguccucccaucucugccuccugaguaucugggacugcauccacacacuaccuugucuggcuacacuuggaguuucuucugcaucugccacucuacugccacccuaagucguaaucccuauguuguucaagggucgauuguauuuuccuuucacagucuauuuguguagcuaguaggcaaucuuccaaaaacuucaauuuaggucguuccggagugcuuuucgaguuuucaguuuucuucuaugccagugaaggagagggauggaggaaaaaaaaaaaaccaaauuaacauaaagauaguuucccuuccuacccauaugcucuguauuaauugcuagggcuguguuugagauaggaaaaccaaaacuucuucacacaacugaccacuucaucucuggucaccagaauguauuuggauuucuucccauccgcaaacuguuuuccagcugacaacaacuggguguccuacaauucaauuacauguuggcaucaucuaccuggagaaagcuucagaucccacagguugaggacucagucccacaagacugccccugacuucgccagaccuguacuuuugaccaaccuguuacaaagaggggauugucaagacucccuccguggauuugauuaauuugcuagagcucacagaacucagggaaauaguuuacuuauuauaaagccuauuagaugaagagccagguggaagagaugcaugggggaaugcauaugugagcgcuuccaugcccucuccaggugcugccccacccuacggucaccucuauguuaccagacacuccuguuacucaggagauuacaaaggucucaggagcucugugucaggaaccggguucaaagaccacguauuagugcaaaagauuguauaccccaaucuacaagaguuuuaggugccccgugucuggaaucaugggcagagaccaaguauguauuucuuaucgugggcuacuaugacaguaaugccacagacuggguggagaaauuuauuucucccaguuccggcggcuagaaguccagggucaauauguuugauuucuguucucuugaagcuucucucucaguggcuugcaggugacugucuucuugcuguguccuaacgugguccuuccucugugggccgacaucgcuggugucccucuuccuaugggggauacuagucggauuagagccccacucuaaugaccucacuuaaccaauuaucuccuuaaaggcccuaucuccaaauacacugagggucagggcuuucacuuaugaauuuuggggaggguacaauucaguucaugagacucucuccuccaaguugacguaaaagccaggggacagugagggggacgggcaguuaugaagcaucauuaauucuccuuagaagugcugcuuuucuucugucagugaacacugugacccauucugcuuccaaccuuguggacuagucaaaguagugagaggaacagaguccuaacgccugagaguuguaaaaugagugucagcaugugguggcugccuuuuuuuuuuuuuuuuaacggauagacuuuauuuucuagaagaguuuuagguuuaaagaaaauugaggucaggcauggugguucacgccuguaaucccagcacuuugggaggccaaggcaggcagaucaugaggucaggaguuugagaccaucuuggccaacauggugaaaccccaucucuagcaaaaauauaaaaaaugagucaggcaugguggcgcgcgccuguagucccagcuacucgggaggcugaggcaggagaauugcuugaacccgggagguggagguugcagaucgugccacugcacuccagccugggcgacagagcgagacuccaucugaaaaaaaaagaaaaagaaaacugagcuuauaguacagagcauucccauauaagagcuuuauaggaaccucccaucuccaaaacucuaagguuccacuauuagcaacuuggauuagucauacugauauguuauuauuaaaguccaucacuaacauuagaguuuacucuguauccaaugggucuuacggguuuugauaaaugcuuaauaguaugcaucuacuauuauaagagagcuuuaaaaaauaacuuuaugaaaucaaaacauaccuaagaaaggguacaaaugguaaguguauaaugcaguggauuauguagggaacacacuuguguguaaguaucacccuggucaaaagcagucuucaugcuacuuaacuaccaauugcuauuccaucacacuuuguaaaaaguaccacuacagucccuagaugguugguuuugucuguguuucaaucuuuauauaaauggaaucauggauuauucuuuaaucucuggccuuuuucacucagucuuguguuuguuagauucauguugcauauagccuuuuauuuuuguuacuauaguguuucauuaauaugaauacauuucuauuuuguuuguuuccaguuuuugcuuacugcaccuaaugcugcuggcaguguuauaauuaugcauuucuguuugguacauaccuaggaaugaaacuucuaggucucagggcuugcauuuauuaacccuugguagaugaugccauacgucuuuccaaaguguugguuacuuuaaggaucaugauauacuccuaucaccauuguaggagaguuccauuuguuccauuuucuugccaacaugugguauugagaguugaaaaaauucuagccauuguguauaguauuaccaccuuaugguuuucauuuacauuucugauauucauaauggauuuagcacuuaccaaaaauuuugccauuuaaauauaguugaccauugaauaacauaggaauuaggauaacugacucuugugcaguaaaaaaaauccacauuuaacuuuugacuccgccaaaacuugauuaacaauagcaugcuguucaguggaagccuuaacaguaacauuaaacaguugauaaacacauauuuuguauguuacauguauuauaugcuguauucuuagaauaagcuugagaaaaggaaauuuuauuaagaaaaucauaagggauugggugcggcggaucacaaggucaggaguucgagaccagccuggccaacauggugaaacccugucucuacuaaaaauacaaaauuagccuggcaugguggugggacccuguaaucccugcugcucgggaggcugagacaggagaaucacuugaacccaggaggcagagguugcagugagccgagaucgcaccacugcacuccagucugggugacagagcgagacuccaucucaaaaaaaaaccaaaaucauaagagaauauauuuacuauucauuaaguggaaauggaucaucauaaagguguuuauccucaucacauuuaucuuaacuaggcggaggaggagggaagagaagggguuggucuugcugucuccaggguagcauagacaaaagaaaauccacguauaaguggacccacgcacuucaaagccacguucaaggaucaacuguagugucucauacaguguuuaauuaagcuucaugcuuauuuuuuauugaguugucuacauuuuucuuuuuacguaauucccuauauaggcuggauaugaucucuuugcuauguauugcgaauauaaucuucuagagagugacuuuacuuuuucacuuccuuaaugguguuuuuugauaaacaguggugauuaauuuugaugcaguccguuuuauggaccuuuuuucuuauuguucauugugcccuguuauaggaaccuuccccuaucccgagggcauaaagauauucucauguuuuuuugagauggaguuucgcuuuuguugcccaggcuugagugcgguggugcgaccucggcucacugcaaccuccgccucccugguucaagggauuguccuaccucagccucacgaguagcugggauuacaggugugugccaccacauccggcuaauuuuugcauuuuuaguagagacgggggcuucaccauccauguuggucagguuggucucaaacuucugaccucaggugaucugcccgccucggccucccaaagugcugggauuuacaggcgugggccaccaugccuggccuguuucuggaaacuuuaaaacgauaaucuaccugggauugauuuguuuguauaugucucuugcuguguaauuggauaaggcuuauuuucauucguggcauauagauaaccaauugaccuagcuucauguauugaaaagaacuuuuuuccuaacuuugucauaaaacaagugucuauauauaaaaguguguguaugucuucgcuauucaugcuuguuuugcauuuccauggaaaguuuauaaucaagcuuguuaccccaaaaaaucaaaaaauccacugggauuguauugacucuuaauuacuuuuucuuucuuucuuuuuuuuuuuuuuuuuuuuugagacaagagcucauucugcugcccaggcuggagugcaaauggugcaaucucagcucacugcaaccuccaccucccaggcucaaguaauccucccaccucagccuuccaaguagcugggacaacaggugugcacaccuggcuaauuuuuuuuuuguauuuuugguagagacaggauuucaccauguuguucaggcuggucuugaacuucugaccucaagcagucgcccagcucagccucccaaagugcugggauuacaggcaagagccacugcgcuugaccuaaauuuugagauuauuggcaucuuuaaugcugucuucaaauauuugaacauggcauaucuuuacacucagcuguuuguuagagaugugacacauccuucauuuucuaaguauuuuuuuaaugguauuuuaaaagauuacugcugauaauauucuugcauuuugaccuuauuuuugggcauuguaauaaacaguaaaacaaaaagaucucuacauaguuuuggauuuucuguauaacaucugauacucaguuuuguguuuuccucucugcuuauacuccuaauauuuuuuucuuuauaccagcuaggaucuccaguaaaaugauuaauggagggauaguggcaucuuccauguuacuauuuaauuguuuuagcuaccauuuaucaaaagaaguuuccaucuuuauaauuuuuuaaauauguagguauuugggguuuuuuuuuguuuuuuguuuuuuguuuugagacgggcucucgcucugucgccaggcuggaguguaguggcgcaaucucagcucauugcaaccuccaccuccuggguucaagugauucuccugccucagccuccugaguagcugggacuacaggugcccgccaccacacccagcuaauuuuuuuuuuuuuuuuuuuuuguauauuuaguagaggccgggguuucaccguguuggccaggauggucuccaucuccugaccucgugauaccccugccucagccucccaaagugcugcgauuacaggauuacaggugugaggcacugugcccggcaguauuugauuuugucagaaauucuuaucuuagauuuuugaaaugaucucaugauuuuuuuuuuuuuuuuugaaacggagucuagcucugucacccaggcuggagugcaguggcgccaucugggcucacugcaagcuccgccuaccggguucucaccauucuccugccucagccuucugaguagcugggacuacaggcaccugccaccacaccuggcuaauuuuuuguauuuuuaguagagacgggguuucacuguguuagccaggauggucucgaucuccugaccucaugauccgcccaccuuggccucccaaaaugcugggauuacaggcgugagccacugcaccuggccccacaguacuucugacaccagaugugugggaauuuuuucccaacugaccaauucucuccacauaccaacuggguggcuugugauuugauucaguucugacacugucuaccugauguuaccaucagaacccacaaguuaaagggcucaguccuacaagacugcccccacuugaagcuagucacaaguccagguuuguacuucugaccaacuggcuauaaagcaaacaagguaugcuuucucugaggucacuaccuucccagcacuucaguguguucuguucaccagcccagaagcucggcucaucacaucucaauguucaagaguuuuguuuuuuaaaaaaaacagccuuacucugucacccaggcuggaguggaguggugccaccauggcucacugcagccucaacccccaggcucagaugauccucccuacacugccuucuguuuucugaguagguggcugggacuacgggcaugcaccaccaugacgggguaauuuuuuuuuuuuuuuaauuuucaguagagacaggguuucacuauguuucccaggcuggucuugaacuccugggcucaagagaucuuccugccucagccucacagacugcugggauuacaggcaugagccaccacacccagccaagacuuuuuauagaguccaaucuccagcuccccccaccacuuuauggaggucagugguuagaacuaaaaguuccaaccgucuaauacuugguuuuccuggugaccaccagcuguauccugaugguaucuaggggcccccacuuuaagucaccuuaguagcauagacucagguaugugcauacagaguucauuaugaauaacaaaagauauuuaugaauuaguguuugcuuaugccagaaauuuucuuuuccuuuuuuuuuuuuuuuuuuuugaaacagagucuucacucugucacccagacuagagugcaguggugugaucuuggcuuacuguauccuccaccucccagguucaagugauucuugugcaucagccuccugaguagcugggauuacaggugugcaccaccacaccccgcuaauuuuuguauuuuuaguaaagaugggguuuggcauguuagccaggcuggucucaaacucuuggccucaggugauccaccugccucugccucccaaagugcuaggauuacaggcaugagccaccgcacccggccuuaugccagaaauuuacugaguucauuaagguaaccuugaauagcccuggggaguuuagacuuugcgaaugaacaaugagaauguuuuuaaccauauguuugaacuucccuuuuuuuuuaaauucucauuuuuauugucauguuagcuuuuuuaaaaaaugcaguuagcauggauuacuuagaagaaagucuguuaaaaauaaguaaaaacagaaggugauuggcauuuaaauguaacaaaaagcuagcugucauuguguggaaugaauuucuguuaaacacguuagaaauuucauugacacuugccuuauuuauuguuguauccucuauugcuccucuucuucccaaauuaaagaugaggcugcucugaagauucaguaauuaggauggacagucagcuacuaauuuucuuagauauucuaucuaggcaaaacagcauuuuaauaaaauaucuuuauuucuuacagauuccugacauucagacaacugacuuguaacugacuuauaacugacuuguaauacacugcuacuauaucaaaccgacaaugaauuggaaugaaaaaccaaagagugcuacauuaccaccacuguauccuaaaagccagccaccuuuuuugcaccagucuuuaauaaaccaaauuaccacaacaucucagaguucuuucagcuauccuggaaguaaccaagaagcaugcauguaucccgguaauucaaauccaauuucacagccacugcugaauauccaaaauuauccucaacaaauuucuguuucugauaugcauaaugggacaguuguggccucacacacuucaguagaaagaauaacauaugcaaauguuaauggacccaaacaacuaacucacaauuugcagaugucuucaggaguuacccaaaacguaugguugaacucaccaaugaggaauccugugcauucucauauaggggcaacuguaucucaucaaacugauuuuggagcuaacguacccaauaugccggcacuacagagucaacugauaacaucagauaccuauucuaugcaaaugcagaugaucccuucuaauucuacacgacuuccuguagcuuaccaaggaaaucagggacuuaaccagucuuuuucagagcaacagguugauuggacacaacaguguauaucuaagggacugacuuacccagauuacagaccaccuccaaagcuauaccguuacucaccacaaagcuuuuuaccagauucuaccauucaaaaacaaaacuuuauaccacauacaucauugcaaguuaaaaauagucagcuucuaaauucuguauuaacuuuaccaucaaggcagaccucagcuguaccaucacagcaguaugccacgcaaacugacaaaagaccuccuccuccuccuuacaacuguagauauggaagccagccuuugcaaaguacucagcauauuacuaaacacuugucuauggaaguuccucagagucgagaaaugcugucaucugaaauaaggaccagcuuucaacagcaguggcaaaacccuaaugaaaaugucagcacaauuggaaauuucacuaacuugaaaguaaauaccaacagcaaacagccuuuuaacagucccauuagaucuucuguggaugguguucagacucuugcucaaacuaaugaagagaaaauaauggauucuugcaauccaacuucaaaucaaguacuggacacaaguguugcaaaagaaaagcuaguaagggauauuaaaacauuaguagagauaaaacagaaguuuucagaacuugcaaggaaaauuaaaaucaauaaagaucuuuugauggcagcagguuguauuaaaaugacuaauacuucuuauagugaaccagcucagaauucuaaauugucucuaaaacaaacugccaaaauccagucuggaccccagauaacuccaguaaugccagagaaugcagagagacaaacaccaacaguaguggaaucugcagaaacaaauaagacucaauguauguugaauucugacauucaggaagucaauugcagaagguuuaaccaaguugauucuguuuuaccaaauccugucuauucugaaaagcggccaaugccagacucaucucaugaugugaaaguucucacuucaaagacaucagcuguugagaugacccaggcaguauugaauacucagcuuucaucagaaaauguuaccaaaguugagcaaaauucaccagcaguuugugaaacaauuucuguucccaaguccauguccacugaggaauauaaaucaaaaauucaaaaugaaaauaugcuacuucucgcuuugcuuucacaggcacguaagacucagaagacaguauuaaaagaugcuaaucaaacuauucaggauucuaaaccagacaguugugaaaugaauccaaauacccaaaugacugguaaccaacugaauuugaagaacauggaaacuccaaguacuucuaauguaaguggcaggguuuuggacaacuccuuuugcaguggacaagaauccucaacaaaaggaaugccugcuaaaagugacaguagcuguuccauggaagugcuagcaaccugucuuucccuguggaaaaagcaaccuucagauacugcaaaagaaaaggagugugauaaacucagaacaaacacaacagcaguuggaauuucaaagccugcuaacauccacguuaagaguccuuguucaguugugggaaauucaaauucucagaauaaaauaaguaaucccucacagcagacagcuuugucgaugguaaugcacaauuaugagucuucagguauaaauauaacaaagggaacagaacuucagauagcuguagugucaccguuaguucugucagaggucaaaacauugucugucaaaggaauaacaccugcaguguuaccugaaacaguguaucccguuauuaaagaaggcaguguuuguaguuuacaaaaucaauuggcagaaaaugcaaaggcaacugcugcuuugaaaguugauguuaguggaccaguagcaaguacagcaacaucaaccaagauuuuuccacuaacucagaaggaaaagcagaaugagucaacuaaugguaauucagaagucacaccuaaugucaaucaaggaaagcauaacaaauuagagucagcuauccauucuccuaugaacgaucagcaaaucucacaggagucaaggaauaguacuguugugaguagugauacauuacagauugacaauauuuguucucugguugaaggugauaccucuuacaauucccaaauagcaaagauauucagcucucuucccuugaaaaugguugagccacagaaaccuucucuacccaaucagcaagggauuggcagcagagaaccagaaaaacaauuagauaauaccacugaaaauaaagacuuugguuuucaaaaagauaaaccuguacagugcacagauguuucacauaaaauaugugaucagucaaagucagagccacccuuagagucaucuuuuaacaaucuugaaacaaacagaguuauucuagagaaaaguaguuuggagcaugccacugaaaaaagcacagcuaacgauacgugcucgucagcugcuauucaggaggauauuuacccucaggaaauagaugcauccagcaacuauacuccccaagauccugcaagaaaugaaauccacagugauaaggcaccugucuuauaccuacaugaccagcugucagaacuucuaaaagaguuuccuuauggcauugaggcugugaauacacgugaagguucugugggccagcaaacuacauaccagaccucagaagaucaaacugcugauaaaaccaguucugacuccaaagacccagcagaucaaauacaaauuacaauauuaagcucagagcaaaugaaagaaauauuuccugaacaggaugaucaacccuauguaguagacaaguuggcagaaccucagaaagaagagcccaucacagaaguaguuagccagugugaccugcaggcaccugcagcuggacaaagucgugauucugugauacuggacucugagaaagaugauauccacugcugugcauugggcuggcucuccaugguuuacgaaggaguaccccagugucaguguaauuccaucaagaacucaucuucagaggaagagaaacaaaaagagcaguguucuccuuuggauaccaacaguuguaaacaaggagagagaacuucugauagagaugucacuguuguucaauuuaagagccuuguaaauaauccaaagacuccuccagaugggaaaagucauuuuccugaacuacaagacgacaguagaaaagauacacccaaaacaaaacauaaaagcuuaccaaggacagaacaagaauuaguugcuggucaguuuucaucuaaaugugauaaacuaaaucccuugcaaaaucacaaaagaaaaaaauugagguuucacgagguaaccuuucacuccaguaauaaaaugacagcaucuuaugaacaagcuucucaggaaacccgacagaagaaacauguaacacagaacucacguccacuaaaaacaaaaacagcuuuuuugccaaauaaagauguguauaagaagcauaguucuuugggacagucauuaucaccagaaaagauaaaauugaaacucaaaucaguuagcuucaaacaaaaacgaaaguuagaccaagggaacguauuagauauggaaguaaagaaaaagaaacaugauaaacaagaacagaaaggaagugugggagcuacauucaaauuaggugacucuuugucaaacccaaacgaaagagccauuguuaaagaaaagaugguaucaaauacuaagucuguagacacgaaagcgaguucaucuaaauuuaguagaauucuaacuccuaaggaguauuuacaaaggcagaagcauaaagaagcucugaguaauaaagcaucgaagaaaaucugugugaaaaacgugccaugugauucugaacauaugagaccaaguaaacuugccgugcagguugaaaguugugggaaaucaaaugagaaacacagcagcggcgugcagaccucuaaagaaucauuaaauggcuugacaagccaugguaaaaaccucaaaauccaccauucucaggagucuaaaacauacaacauucuaaggaauguuaaagaaaaaguuggugggaagcagccugauaaaauauggauugauaagacuaaauuagacaaauuaaccaauauaagcaacgaagcucaauucagccaaaugccuccccaaguaaaggaucaaaagaaauuauaucugaauagaguuggguuuaaaugcacugaacgugaaagcauuucucucaccaaauuagaaaguucacccaggaagcuucauaaagauaagagacaggaaaauaaacauaagaccuuuuuaccggugaaagguaacacagaaaaaucaaacaugcuggaguuuaaauuauguccagauaucuuacuaaagaauacaaacucuguggaagaacggaaggauguaaagccucauccuaggaaggagcaagccccucugcaagguccaguaugauuuucuugguggugucuacaauauuguaaagagucguaggucaauauuugggcuagcaccucucaugcugucuugggcugcugggaaagacuuuaauguguuaugccacuaccuaguauuuguuuugccugguaaaccaauguuucauugggcaauauuuguuuuguguucauugccaccuuauuguaaauuguagaaaauuggucgucaugacgagcuauauguaaaacuugccagauagaaauauuucaguuaguaccaagaaggcuguacugugaaaaacauuccacauuccuugugggaaugucagaaaagugucaaguagcuaguaauguaagagucuugguuuuguuaauucuccuuuggacuuguaauuugaaagcccugugaacuugaaauuuuguucugaauguuagaggauaaguaaugaugaauacugaagucuuuuuguucauauggaaaugggucaacuaauuguccucuuugaaacaguugauggcuguguuaucacuauauuuaaaaugguaacaucuagccuacucauaagauagaagaaccuugaaagcaguauuguccaguguuauaauuuaaaaucuuuaaagccaagcuggcagcuaugaauauuagguagcuuaaugguagacuucucaauguagugcaggaaggaaggagaaaauugauaacuaguuguucaugguacuaagggaacauuuagacauaguggauauuauauguaaagcauugugcugagaaagauuggaaaacuaaaggauuugaauggaaauugaagucuuugcucugcuuuucugacuauauuuguugggguucauaaaacaauagcauaaacaggauauguuuuccuggaaaagaagauagggauauauucauuuuguaaaaaauuggugauuucaauagguucuuucauuuggauccuuggaauuugagguggggauauaaugggaacauuggaagugggugggggcaauguaguuuucuaucucauguguccuuuaauaucuggagauguauuaaccucuucaguucaugugaggggaacauaauuacauaguaaagauaaacucauuuuuuaauugagguaagcauuucaaauagaaaucauuuuuccaguccuuuuuuuagaguuguguuacaugugguuauaucuagggccuuucaaaaucuauuuucagcuuacaugauuuuccuuuguuauaguacuaaaggagaugauuagcaauaucuagaguucugaaaaugaauauuuaaauaguuucaggaauaaaaaguacaaaagaagacugguuaaaauuuguugcuacaaagaaaaggacacagaaagacagccaagagagagguaaagucaucuuuuuaaaucuucauucacuuaucucccuaucugguauauggaaauuggauuaugguuaugauaugauuguaaaguaugauuuuauccauguucuuuuuuuuuuuucagucauucaguguuuguguuugagugguaggaggacauuuuuguguugucgugcuguggaaugaaaggcugagcuuuauuuuauuuuaauaggaaaauaagucuuaucacaaugaguuagcuaagagguuugcauauuuuaccuguauaggaccagacagcaaauacuuuagguuuucugggucauaaggugucuguccugacuacucagcucugacucuguuucagggaaauggcugcagauaauauguagaugaguaucagcuguguucugauuaacuauuuauuuauuuauuuauuuauuuauuuauuuugagacagagucucacucugucacccaggcuggagugcaguggcgucaucuuggcucacugcaaccucugccucccagguucaagcgauuuucucccucagcuucccaaguagcugggacugcaguugcauaccaccacgcccagcuaauuuuuguauuuuuaguagaggcaggguuucaccguguuggccaggccggucccaaacuccugacaucagguaauccaccugccucggccucccaaagugcugggauuacagacaugagacaccgugccuggccucuaauuaaacuuuaucuaccaaaauaggcagcaggcuggacuuaguuugccagacccuggauucaauuauuuacauguuaauuugauuaaucuucaauacaauuuaggcaaggauauuuccauuuuauagaugagagguuacaucauuugacuuaaguuucauugcuagugacugaauagggacuugaaucugguccccucuuuucaaaguccauuaagugugguugagguauagucagcccuccguaucugcguguuccguaucuguggauucaagcaacuguggauccaaaauauuugggaaaaaaauuaauacaaccauaaaaauagaaacuuaaaagacaauauaguauaacaacuguuuacauagcauuuacauuguauuagguauuaaaaguaaucuagaaauuauuuaagguaugugugggggguaugcuuuagguuauauacaauauacuaugccauuuuacauaaggaacuuaagcauccccagauuuugguaucuauuuggguggaugcugcagaaguguccuggaaucagucccucuucaauacccagggaugacuguauuuuaauaaugagaccgguccuagcuguguuauuugcugggaagggauuugggcugaggaccaacuagaaaaaguagagcuuugaguauuugauuuuuuuuuugagacggcaucuugcucugucucccaggcuggaguacaguggcacgaucucggccuugcugcaaccucugcauuccagguucaagcaauucuucugccucagccuccugaguagcugggacuacaagcacacuaccacgccuggcuuauuuuuguauuuuuaguagagacuggauuucucucacuauguuggccaggcuggucucaaacuccugaacucaggugauccaccugccucggccucccaaaaugcugggauuacaagcaugagccaccguguccacccgaauauaugauuuaauuaguggagugaaaguaccuuguuguuaggguuuggcuuugaaaacuaaaagcuagagcucaagaguuuuugucuuaguuuugguucauuaaaugggcaaagagggggcugggcacgguggcucacaccuguaaucucagcacuuugggaggccgaggcaggcggaucaugaggucaggagauugagaccauccuggcuaacacggugaaacccugucucuacugaaaauauaaaaaauaagccgagugugguggcgggcaccuguagucccagcuacucgggaggcugaggcaagagaauggcaugaacccaggaggcggagcuugccaugagccaauaugucgccacugcacuccagccugggugacagagagagagucuugucucaaaaaaaaaaaaaaaaaaauaggcaaagagggguucagagccucaaaaauggagagcagcagaaacucaccaagagaaacaauaagaagcacauuuuauaaaaggaauugacaacgguugugaagagagcuucaaacaaauacuuagaagcaggcguguaaaaauugaguagaggccgggcgagguggcucacgccuguaauaccagcacuuugggaggccgaggcaggcagaucgccugaggucagagguucgagaccagccuggccaacauuaugaaaccccaugccuacuaaaaauauaaaaauuagucagguguaguggcacaugccuguaauaccagcuauucaguaggcugagacgggagaaucacuugaaccugugaggcggagguuccagugagcugagaucggaccacugcacuccagcuugggcgacagagcaaaacucugucucaaaaaaaaagucaguuagcauugaaacaugcauaugggaaaaacuugcaucaaugaagaaauauacucuuaaucagaacaggacaaauaaccuaaagaggagggaaugaagagcagugagaggccugacagugggaaaacaaugccucucggguuggaaggcagaaagccaaaaaugcgaaagauacaaauggguacgaagauuggaguaagaaaaaagcuccuuggaaacaggagagacaugauuaucucaaagagaaagcgagaggcauguuuggaaucugaagcugaaaacacucaaaagacagauacacagauugaccagaggcuucagagauaggcaugaguugaaugacaugugcagacagcacagcaggaugagcacugcacggugaaugugaggcugaaauacucagaaucaugaugaaagaaaaacacaaaccagguacacuaaggcaaagcugggugagacaguccaggagacaagucauacagcuuugucauggcacaacaagacgcaaauaggugagaccuaagggaggagaaaaaaaucucaggugauggcuacaugggcauuuuuauuuacuuauuuuuauuuauuuauuuauuuuauuuuuuagacagucucgcugugucgcccaggcuggagugcaguggugcgaccuaggcucacugcaaccucugguuccuggguucaagcgauucuccugccucggccucagccuccugaguagcgugaaccaccucaccuggcugauuguuguauuuuuagcagagacagaguuucaccauguuguccaggcugaucuugaacuccaaccucagugauccacccaccucagccugccaaagugcugggauuacaggugugagccacugcgcccggccacaugggcauuuuuuaaaugccuauuaggggcgagugaagcugguucuggagaagggaucucugggaaauagugaauuauauaccuuagacaaagaggcuggagaacagugaaccaacuaugaagugagagaaaaaugccaugaacucccaaucugcuauaaagaaacauacaucuggccugguguggggcccaugugugucaucccagcacuugggaggucaaggccggaggauggcuugagcccaggaguuugagaccagcuucggcaacaucaggagaucccaucucuacaaauaacuuuuuaaaaaauuagcugggcauaguggugcgcaccuguggucccagcugcuuggcagacugaggaaggaggaucaccugagcccaggaguugaggcugcaauaagcccugaugcagcacugcacuccagccugggcaacagagccaagacccugucucaaaaaaaaaaaaacccacaggagaaacagaugucuaaauucaguagcaaagguugcagcaaacuugaaguccuaaguuaggguaaagagaugaagaggaaaugacaagaauuucuuggaaagcaacuuagagacccaucuggggcuucaguguuacuaauucugaaagaaagcaaacgaaaaaguggaagacugcagcagaucuaaagaacuaacaggacagaauacuccacccauucagguagaaaaagacaaaacaagaccccauuauucagaagaaaauagcugcagcaggaaugaaauguacagauagucccugacuuggcagugguuugacuuaggauuucuugacugugaugguaugaaagugauacacauucaguagaaaguguauuucgcauacccauacagcaauucuguuuguuuguuuguuuguuuguuuuuugagacagucucgcucugucacccaggcuggagugcagucgugugauaucggcucacugcaaccucugcccagcuaauuuuuguauuuuuagucaaaacaggguuucgccauguuggccaggcuggucuugaacuggcuucaugugaucugcuugccuuggccucccagagugcugggauuacaggcgugaaccaccauacccagccucaacauauuuucaauaggugaugggucauuaugaaaaaaggacacugaagcuaauguaacacugaaauggucucaagaaacaggaaacuauagacauguuuuagaauauccaauacauggcaagaccaaaauaugaaaccuauccuuuucauguauuguuugggacugacucauauuuguacucuuuguauugcuaauuuacauagcuguuuaaaagaucacauucauacuaaugauaugcaaugauacauuuuauugagccaagaguaagguagaacagaacagcccagggcaaugaggauggggcaaggaggcaggaguagaaaacagcccccaaaagaaaggcaagaugucacguguauauaacuuacaauucuauaagugaagagcuaugguucugaaacuuuugcuuaacuccuugccuuaauuuuuuaucccuccaauauauauuuucccucugaauuuugauuauauauugaucacagcuaacauugagaaauaaaguaaguaaaguuuuuauuucccuuagauaauguuaauucaagacucucgaagagaagcuucagugcagauggauuugagaugcuacaaaacccaguaaaagauucaaaagaaauguuucaaaccuacaaacagauguaccuggagaagagaagcagaagccuugguagcaguccuguaaaauaauuacaagaugugguuuuguaauugccacugggaaauuucuuuccuuuucuguucaaaauauuucgcugaaacuaaugagaaaugccaugauaaagauuucucagaguuugguucccacuuucauuguauuucauugaaagugcuuaauuaaaauggcuugagaacuuuggguagccauguguaagaaauggaugguauucaccggggaaacaagguauuugaauuucuacuuuauugaaccagauuuaccauuauuuuaaaaggaaugcuuauacaaaucaauuugaaauucuacccaucuugagggaggaccguuccucaguuaaggacuuguuuauuuaaaugggacuguaaauauguuuugguuucuaagcuauauuagcaaaauuuauuuuucaaaaaugcccacugugaugugaaugucaaaauauauucuuaaguguuuuauaacuaauuguaaacuuuuuuucagaagucuuauuuuauacuugugaaacugaacacaauuuugggacaacguuuaaacauuacuuuucauacuugaaauaaacauuuauuuuuuaaaaaacuaauu

SEQ ID NO: 191711 - RNA, 33691 nt, Homo sapiens
aauuaguuuuuuaaaaaauaaauguuuauuucaaguaugaaaaguaauguuuaaacguugucccaaaauuguguucaguuucacaaguauaaaauaagacuucugaaaaaaaguuuacaauuaguuauaaaacacuuaagaauauauuuugacauucacaucacagugggcauuuuugaaaaauaaauuuugcuaauauagcuuagaaaccaaaacauauuuacagucccauuuaaauaaacaaguccuuaacugaggaacgguccucccucaagauggguagaauuucaaauugauuuguauaagcauuccuuuuaaaauaaugguaaaucugguucaauaaaguagaaauucaaauaccuuguuuccccggugaauaccauccauuucuuacacauggcuacccaaaguucucaagccauuuuaauuaagcacuuucaaugaaauacaaugaaagugggaaccaaacucugagaaaucuuuaucauggcauuucucauuaguuucagcgaaauauuuugaacagaaaaggaaagaaauuucccaguggcaauuacaaaaccacaucuuguaauuauuuuacaggacugcuaccaaggcuucugcuucucuucuccagguacaucuguuuguagguuugaaacauuucuuuugaaucuuuuacuggguuuuguagcaucucaaauccaucugcacugaagcuucucuucgagagucuugaauuaacauuaucuaagggaaauaaaaacuuuacuuacuuuauuucucaauguuagcugugaucaauauauaaucaaaauucagagggaaaauauauauuggagggauaaaaaauuaaggcaaggaguuaagcaaaaguuucagaaccauagcucuucacuuauagaauuguaaguuauauacacgugacaucuugccuuucuuuugggggcuguuuucuacuccugccuccuugccccauccucauugcccugggcuguucuguucuaccuuacucuuggcucaauaaaauguaucauugcauaucauuaguaugaaugugaucuuuuaaacagcuauguaaauuagcaauacaaagaguacaaauaugagucagucccaaacaauacaugaaaaggauagguuucauauuuuggucuugccauguauuggauauucuaaaacaugucuauaguuuccuguuucuugagaccauuucaguguuacauuagcuucaguguccuuuuuucauaaugacccaucaccuauugaaaauauguugaggcuggguauggugguucacgccuguaaucccagcacucugggaggccaaggcaagcagaucacaugaagccaguucaagaccagccuggccaacauggcgaaacccuguuuugacuaaaaauacaaaaauuagcugggcagagguugcagugagccgauaucacacgacugcacuccagccugggugacagagcgagacugucucaaaaaacaaacaaacaaacaaacaaacagaauugcuguauggguaugcgaaauacacuuucuacugaauguguaucacuuucauaccaucacagucaagaaauccuaagucaaaccacugccaagucagggacuaucuguacauuucauuccugcugcagcuauuuucuucugaauaauggggucuuguuuugucuuuuucuaccugaauggguggaguauucuguccuguuaguucuuuagaucugcugcagucuuccacuuuuucguuugcuuucuuucagaauuaguaacacugaagccccagaugggucucuaaguugcuuuccaagaaauucuugucauuuccucuucaucucuuuacccuaacuuaggacuucaaguuugcugcaaccuuugcuacugaauuuagacaucuguuucuccuguggguuuuuuuuuuuuugagacagggucuuggcucuguugcccaggcuggagugcagugcugcaucagggcuuauugcagccucaacuccugggcucaggugauccuccuuccucagucugccaagcagcugggaccacaggugcgcaccacuaugcccagcuaauuuuuuaaaaaguuauuuguagagaugggaucuccugauguugccgaagcuggucucaaacuccugggcucaagccauccuccggccuugaccucccaagugcugggaugacacacaugggccccacaccaggccagauguauguuucuuuauagcagauugggaguucauggcauuuuucucucacuucauaguugguucacuguucuccagccucuuugucuaagguauauaauucacuauuucccagagaucccuucuccagaaccagcuucacucgccccuaauaggcauuuaaaaaaugcccauguggccgggcgcaguggcucacaccuguaaucccagcacuuuggcaggcugagguggguggaucacugagguuggaguucaagaucagccuggacaacauggugaaacucugucucugcuaaaaauacaacaaucagccaggugaggugguucacgcuacucaggaggcugaggccgaggcaggagaaucgcuugaacccaggaaccagagguugcagugagccuaggucgcaccacugcacuccagccugggcgacacagcgagacugucuaaaaaauaaaauaaauaaauaaauaaaaauaaguaaauaaaaaugcccauguagccaucaccugagauuuuuuucuccucccuuaggucucaccuauuugcgucuuguugugccaugacaaagcuguaugacuugucuccuggacugucucacccagcuuugccuuaguguaccugguuuguguuuuucuuucaucaugauucugaguauuucagccucacauucaccgugcagugcucauccugcugugcugucugcacaugucauucaacucaugccuaucucugaagccucuggucaaucuguguaucugucuuuugaguguuuucagcuucagauuccaaacaugccucucgcuuucucuuugagauaaucaugucucuccuguuuccaaggagcuuuuuucuuacuccaaucuucguacccauuuguaucuuucgcauuuuuggcuuucugccuuccaacccgagaggcauuguuuucccacugucaggccucucacugcucuucauucccuccucuuuagguuauuuguccuguucugauuaagaguauauuucuucauugaugcaaguuuuucccauaugcauguuucaaugcuaacugacuuuuuuuuugagacagaguuuugcucugucgcccaagcuggagugcagugguccgaucucagcucacuggaaccuccgccucacagguucaagugauucucccgucucagccuacugaauagcugguauuacaggcaugugccacuacaccugacuaauuuuuauauuuuuaguaggcaugggguuucauaauguuggccaggcuggucucgaaccucugaccucaggcgaucugccugccucggccucccaaagugcugguauuacaggcgugagccaccucgcccggccucuacucaauuuuuacacgccugcuucuaaguauuuguuugaagcucucuucacaaccguugucaauuccuuuuauaaaaugugcuucuuauuguuucucuuggugaguuucugcugcucuccauuuuugaggcucugaaccccucuuugccuauuuuuuuuuuuuuuuuuuugagacaagacucucucucugucacccaggcuggagugcaguggcgacauauuggcucauggcaagcuccgccuccuggguucaugccauucucuugccucagccucccgaguagcugggacuacaggugcccgccaccacacucggcuuauuuuuuauauuuucaguagagacaggguuucaccguguuagccaggauggucucaaucuccugaccucaugauccgccugccucggccucccaaagugcugagauuacaggugugagccaccgugcccagcccccucuuugcccauuuaaugaaccaaaacuaagacaaaaacucuugagcucuagcuuuuaguuuucaaagccaaacccuaacaacaagguacuuucacuccacuaauuaaaucauauauucggguggacacgguggcucaugcuuguaaucccagcauuuugggaggccgaggcagguggaucaccugaguucaggaguuugagaccagccuggccaacauagugagagaaauccagucucuacuaaaaauacaaaaauaagccaggcgugguagugugcuuguagucccagcuacucaggaggcugaggcagaagaauugcuugaaccuggaaugcagagguugcagcaaggccgagaucgugccacuguacuccagccugggagacagagcaagaugccgucucaaaaaaaaaaucaaauacucaaagcucuacuuuuucuaguugguccucagcccaaaucccuucccagcaaauaacacagcuaggaccggucucauuauuaaaauacagucaucccuggguauugaagagggacugauuccaggacacuucugcagcauccacccaaauagauaccaaaaucuggggaugcuuaaguuccuuauguaaaauggcauaguauauuguauauaaccuaaagcauaccccccacacauaccuuaaauaauuucuagauuacuuuuaauaccuaauacaauguaaaugcuauguaaacaguuguuauacuauauugucuuuuaaguuucuauuuuuaugguuguauuaauuuuuuucccaaauauuuuggauccacaguugcuugaauccacagauacggaacacgcagauacggagggcugacuauaccucaaccacacuuaauggacuuugaaaagaggggaccagauucaagucccuauucagucacuagcaaugaaacuuaagucaaaugauguaaccucucaucuauaaaauggaaauauccuugccuaaauuguauugaagauuaaucaaauuaacauguaaauaauugaauccagggucuggcaaacuaaguccagccugcugccuauuuugguagauaaaguuuaauuagaggccaggcacggugucucaugucuguaaucccagcacuuugggaggccgaggcagguggauuaccugaugucaggaguuugggaccggccuggccaacacggugaaacccugccucuacuaaaaauacaaaaauuagcugggcguggugguaugcaacugcagucccagcuacuugggaagcugagggagaaaaucgcuugaaccugggaggcagagguugcagugagccaagaugacgccacugcacuccagccugggugacagagugagacucugucucaaaauaaauaaauaaauaaauaaauaaauaaauaguuaaucagaacacagcugauacucaucuacauauuaucugcagccauuucccugaaacagagucagagcugaguagucaggacagacaccuuaugacccagaaaaccuaaaguauuugcugucugguccuauacagguaaaauaugcaaaccucuuagcuaacucauugugauaagacuuauuuuccuauuaaaauaaaauaaagcucagccuuucauuccacagcacgacaacacaaaaauguccuccuaccacucaaacacaaacacugaaugacugaaaaaaaaaaaagaacauggauaaaaucauacuuuacaaucauaucauaaccauaauccaauuuccauauaccagauagggagauaagugaaugaagauuuaaaaagaugacuuuaccucucucuuggcugucuuucuguguccuuuucuuuguagcaacaaauuuuaaccagucuucuuuuguacuuuuuauuccugaaacuauuuaaauauucauuuucagaacucuagauauugcuaaucaucuccuuuaguacuauaacaaaggaaaaucauguaagcugaaaauagauuuugaaaggcccuagauauaaccacauguaacacaacucuaaaaaaaggacuggaaaaaugauuucuauuugaaaugcuuaccucaauuaaaaaaugaguuuaucuuuacuauguaauuauguuccccucacaugaacugaagagguuaauacaucuccagauauuaaaggacacaugagauagaaaacuacauugcccccacccacuuccaauguucccauuauauccccaccucaaauuccaaggauccaaaugaaagaaccuauugaaaucaccaauuuuuuacaaaaugaauauaucccuaucuucuuuuccaggaaaacauauccuguuuaugcuauuguuuuaugaaccccaacaaauauagucagaaaagcagagcaaagacuucaauuuccauucaaauccuuuaguuuuccaaucuuucucagcacaaugcuuuacauauaauauccacuaugucuaaauguucccuuaguaccaugaacaacuaguuaucaauuuucuccuuccuuccugcacuacauugagaagucuaccauuaagcuaccuaauauucauagcugccagcuuggcuuuaaagauuuuaaauuauaacacuggacaauacugcuuucaagguucuucuaucuuaugaguaggcuagauguuaccauuuuaaauauagugauaacacagccaucaacuguuucaaagaggacaauuaguugacccauuuccauaugaacaaaaagacuucaguauucaucauuacuuauccucuaacauucagaacaaaauuucaaguucacagggcuuucaaauuacaaguccaaaggagaauuaacaaaaccaagacucuuacauuacuagcuacuugacacuuuucugacauucccacaaggaauguggaauguuuuucacaguacagccuucuugguacuaacugaaauauuucuaucuggcaaguuuuacauauagcucgucaugacgaccaauuuucuacaauuuacaauaagguggcaaugaacacaaaacaaauauugcccaaugaaacauugguuuaccaggcaaaacaaauacuagguaguggcauaacacauuaaagucuuucccagcagcccaagacagcaugagaggugcuagcccaaauauugaccuacgacucuuuacaauauuguagacaccaccaagaaaaucauacuggaccuugcagaggggcuugcuccuuccuaggaugaggcuuuacauccuuccguucuuccacagaguuuguauucuuuaguaagauaucuggacauaauuuaaacuccagcauguuugauuuuucuguguuaccuuucaccgguaaaaaggucuuauguuuauuuuccugucucuuaucuuuaugaagcuuccugggugaacuuucuaauuuggugagagaaaugcuuucacguucagugcauuuaaacccaacucuauucagauauaauuucuuuugauccuuuacuuggggaggcauuuggcugaauugagcuucguugcuuauauugguuaauuugucuaauuuagucuuaucaauccauauuuuaucaggcugcuucccaccaacuuuuucuuuaacauuccuuagaauguuguauguuuuagacuccugagaaugguggauuuugagguuuuuaccauggcuugucaagccauuuaaugauucuuuagaggucugcacgccgcugcuguguuucucauuugauuucccacaacuuucaaccugcacggcaaguuuacuuggucucauauguucagaaucacauggcacguuuuucacacagauuuucuucgaugcuuuauuacucagagcuucuuuaugcuucugccuuuguaaauacuccuuaggaguuagaauucuacuaaauuuagaugaacucgcuuucgugucuacagacuuaguauuugauaccaucuuuucuuuaacaauggcucuuucguuuggguuugacaaagagucaccuaauuugaauguagcucccacacuuccuuucuguucuuguuuaucauguuucuuuuucuuuacuuccauaucuaauacguucccuuggucuaacuuucguuuuuguuugaagcuaacugauuugaguuucaauuuuaucuuuucuggugauaaugacugucccaaagaacuaugcuucuuauacacaucuuuauuuggcaaaaaagcuguuuuuguuuuuaguggacgugaguucuguguuacauguuucuucugucggguuuccugagaagcuuguucauaagaugcugucauuuuauuacuggagugaaagguuaccucgugaaaccucaauuuuuuucuuuugugauuuugcaagggauuuaguuuaucacauuuagaugaaaacugaccagcaacuaauucuuguucuguccuugguaagcuuuuauguuuuguuuuggguguaucuuuucuacugucgucuuguaguucaggaaaaugacuuuucccaucuggaggagucuuuggauuauuuacaaggcucuuaaauugaacaacagugacaucucuaucagaaguucucucuccuuguuuacaacuguugguauccaaaggagaacacugcucuuuuuguuucucuuccucugaagaugaguucuugauggaauuacacugacacugggguacuccuucguaaaccauggagagccagcccaaugcacagcaguggauaucaucuuucucagaguccaguaucacagaaucacgacuuuguccagcugcaggugccugcaggucacacuggcuaacuacuucugugaugggcucuucuuucugagguucugccaacuugucuacuacauaggguugaucauccuguucaggaaauauuucuuucauuugcucugagcuuaauauuguaauuuguauuugaucugcugggucuuuggagucagaacugguuuuaucagcaguuugaucuucugaggucugguauguaguuugcuggcccacagaaccuucacguguauucacagccucaaugccauaaggaaacucuuuuagaaguucugacagcuggucauguagguauaagacaggugccuuaucacuguggauuucauuucuugcaggaucuuggggaguauaguugcuggaugcaucuauuuccugaggguaaauauccuccugaauagcagcugacgagcacguaucguuagcugugcuuuuuucaguggcaugcuccaaacuacuuuucucuagaauaacucuguuuguuucaagauuguuaaaagaugacucuaaggguggcucugacuuugacugaucacauauuuuaugugaaacaucugugcacuguacagguuuaucuuuuugaaaaccaaagucuuuauuuucagugguauuaucuaauuguuuuucugguucucugcugccaaucccuugcugauuggguagagaagguuucuguggcucaaccauuuucaagggaagagagcugaauaucuuugcuauuugggaauuguaagagguaucaccuucaaccagagaacaaauauugucaaucuguaauguaucacuacucacaacaguacuauuccuugacuccugugagauuugcugaucguucauaggagaauggauagcugacucuaauuuguuaugcuuuccuugauugacauuaggugugacuucugaauuaccauuaguugacucauucugcuuuuccuucugaguuaguggaaaaaucuugguugauguugcuguacuugcuacugguccacuaacaucaacuuucaaagcagcaguugccuuugcauuuucugccaauugauuuuguaaacuacaaacacugccuucuuuaauaacgggauacacuguuucagguaacacugcagguguuauuccuuugacagacaauguuuugaccucugacagaacuaacggugacacuacagcuaucugaaguucuguucccuuuguuauauuuauaccugaagacucauaauugugcauuaccaucgacaaagcugucugcugugagggauuacuuauuuuauucugagaauuugaauuucccacaacugaacaaggacucuuaacguggauguuagcaggcuuugaaauuccaacugcuguuguguuuguucugaguuuaucacacuccuuuucuuuugcaguaucugaagguugcuuuuuccacagggaaagacagguugcuagcacuuccauggaacagcuacugucacuuuuagcaggcauuccuuuuguugaggauucuuguccacugcaaaaggaguuguccaaaacccugccacuuacauuagaaguacuuggaguuuccauguucuucaaauucaguugguuaccagucauuuggguauuuggauucauuucacaacugucugguuuagaauccugaauaguuugauuagcaucuuuuaauacugucuucugagucuuacgugccugugaaagcaaagcgagaaguagcauauuuucauuuugaauuuuugauuuauauuccucaguggacauggacuugggaacagaaauuguuucacaaacugcuggugaauuuugcucaacuuugguaacauuuucugaugaaagcugaguauucaauacugccugggucaucucaacagcugaugucuuugaagugagaacuuucacaucaugagaugagucuggcauuggccgcuuuucagaauagacaggauuugguaaaacagaaucaacuugguuaaaccuucugcaauugacuuccugaaugucagaauucaacauacauugagucuuauuuguuucugcagauuccacuacuguugguguuugucucucugcauucucuggcauuacuggaguuaucugggguccagacuggauuuuggcaguuuguuuuagagacaauuuagaauucugagcugguucacuauaagaaguauuagucauuuuaauacaaccugcugccaucaaaagaucuuuauugauuuuaauuuuccuugcaaguucugaaaacuucuguuuuaucucuacuaauguuuuaauaucccuuacuagcuuuucuuuugcaacacuuguguccaguacuugauuugaaguuggauugcaagaauccauuauuuucucuucauuaguuugagcaagagucugaacaccauccacagaagaucuaaugggacuguuaaaaggcuguuugcuguugguauuuacuuucaaguuagugaaauuuccaauugugcugacauuuucauuaggguuuugccacugcuguugaaagcugguccuuauuucagaugacagcauuucucgacucugaggaacuuccauagacaaguguuuaguaauaugcugaguacuuugcaaaggcuggcuuccauaucuacaguuguaaggaggaggaggaggucuuuugucaguuugcguggcauacugcugugaugguacagcugaggucugccuugaugguaaaguuaauacagaauuuagaagcugacuauuuuuaacuugcaaugauguaugugguauaaaguuuuguuuuugaaugguagaaucugguaaaaagcuuuguggugaguaacgguauagcuuuggagguggucuguaaucuggguaagucagucccuuagauauacacuguuguguccaaucaaccuguugcucugaaaaagacugguuaagucccugauuuccuugguaagcuacaggaagucguguagaauuagaagggaucaucugcauuugcauagaauagguaucugauguuaucaguugacucuguagugccggcauauuggguacguuagcuccaaaaucaguuugaugagauacaguugccccuauaugagaaugcacaggauuccucauuggugaguucaaccauacguuuuggguaacuccugaagacaucugcaaauugugaguuaguuguuuggguccauuaacauuugcauauguuauucuuucuacugaagugugugaggccacaacugucccauuaugcauaucagaaacagaaauuuguugaggauaauuuuggauauucagcaguggcugugaaauuggauuugaauuaccgggauacaugcaugcuucuugguuacuuccaggauagcugaaagaacucugagauguugugguaauuugguuuauuaaagacuggugcaaaaaagguggcuggcuuuuaggauacaguggugguaauguagcacucuuugguuuuucauuccaauucauugucgguuugauauaguagcaguguauuacaagucaguuauaagucaguuacaagucaguugucugaaugucaggaaucuguaagaaauaaagauauuuuauuaaaaugcuguuuugccuagauagaauaucuaagaaaauuaguagcugacuguccauccuaauuacugaaucuucagagcagccucaucuuuaauuugggaagaagaggagcaauagaggauacaacaauaaauaaggcaagugucaaugaaauuucuaacguguuuaacagaaauucauuccacacaaugacagcuagcuuuuuguuacauuuaaaugccaaucaccuucuguuuuuacuuauuuuuaacagacuuucuucuaaguaauccaugcuaacugcauuuuuuaaaaaagcuaacaugacaauaaaaaugagaauuuaaaaaaaaagggaaguucaaacauaugguuaaaaacauucucauuguucauucgcaaagucuaaacuccccagggcuauucaagguuaccuuaaugaacucaguaaauuucuggcauaaggccgggugcgguggcucaugccuguaauccuagcacuuugggaggcagaggcagguggaucaccugaggccaagaguuugagaccagccuggcuaacaugccaaaccccaucuuuacuaaaaauacaaaaauuagcggggugugguggugcacaccuguaaucccagcuacucaggaggcugaugcacaagaaucacuugaaccugggagguggaggauacaguaagccaagaucacaccacugcacucuagucugggugacagagugaagacucuguuucaaaaaaaaaaaaaaaaaaaaggaaaagaaaauuucuggcauaagcaaacacuaauucauaaauaucuuuuguuauucauaaugaacucuguaugcacauaccugagucuaugcuacuaaggugacuuaaagugggggccccuagauaccaucaggauacagcugguggucaccaggaaaaccaaguauuagacgguuggaacuuuuaguucuaaccacugaccuccauaaagugguggggggagcuggagauuggacucuauaaaaagucuuggcugggugugguggcucaugccuguaaucccagcagucugugaggcugaggcaggaagaucucuugagcccaggaguucaagaccagccugggaaacauagugaaacccugucucuacugaaaauuaaaaaaaaaaaaaaauuaccccgucaugguggugcaugcccguagucccagccaccuacucagaaaacagaaggcaguguagggaggaucaucugagccuggggguugaggcugcagugagccaugguggcaccacuccacuccagccugggugacagaguaaggcuguuuuuuuuaaaaaacaaaacucuugaacauugagaugugaugagccgagcuucugggcuggugaacagaacacacugaagugcugggaagguagugaccucagagaaagcauaccuuguuugcuuuauagccaguuggucagaaguacaaaccuggacuugugacuagcuucaagugggggcagucuuguaggacugagcccuuuaacuuguggguucugaugguaacaucagguagacagugucagaacugaaucaaaucacaagccacccaguugguauguggagagaauuggucaguugggaaaaaauucccacacaucuggugucagaaguacuguggggccaggugcaguggcucacgccuguaaucccagcauuuugggaggccaaggugggcggaucaugaggucaggagaucgagaccauccuggcuaacacagugaaaccccgucucuacuaaaaauacaaaaaauuagccaggugugguggcaggugccuguagucccagcuacucagaaggcugaggcaggagaauggugagaacccgguaggcggagcuugcagugagcccagauggcgccacugcacuccagccugggugacagagcuagacuccguuucaaaaaaaaaaaaaaaaaucaugagaucauuucaaaaaucuaagauaagaauuucugacaaaaucaaauacugccgggcacagugccucacaccuguaauccuguaaucgcagcacuuugggaggcugaggcagggguaucacgaggucaggagauggagaccauccuggccaacacggugaaaccccggccucuacuaaauauacaaaaaaaaaaaaaaaaaaaaauuagcugggugugguggcgggcaccuguagucccagcuacucaggaggcugaggcaggagaaucacuugaacccaggagguggagguugcaaugagcugagauugcgccacuacacuccagccuggcgacagagcgagagcccgucucaaaacaaaaaacaaaaaacaaaaaaaaaccccaaauaccuacauauuuaaaaaauuauaaagauggaaacuucuuuugauaaaugguagcuaaaacaauuaaauaguaacauggaagaugccacuaucccuccauuaaucauuuuacuggagauccuagcugguauaaagaaaaaaauauuaggaguauaagcagagaggaaaacacaaaacugaguaucagauguuauacagaaaauccaaaacuauguagagaucuuuuuguuuuacuguuuauuacaaugcccaaaaauaaggucaaaaugcaagaauauuaucagcaguaaucuuuuaaaauaccauuaaaaaaauacuuagaaaaugaaggaugugucacaucucuaacaaacagcugaguguaaagauaugccauguucaaauauuugaagacagcauuaaagaugccaauaaucucaaaauuuaggucaagcgcaguggcucuugccuguaaucccagcacuuugggaggcugagcugggcgacugcuugaggucagaaguucaagaccagccugaacaacauggugaaauccugucucuaccaaaaauacaaaaaaaaaauuagccaggugugcacaccuguugucccagcuacuuggaaggcugaggugggaggauuacuugagccugggagguggagguugcagugagcugagauugcaccauuugcacuccagccugggcagcagaaugagcucuugucucaaaaaaaaaaaaaaaaaaaaagaaagaaagaaaaaguaauuaagagucaauacaaucccaguggauuuuuugauuuuuugggguaacaagcuugauuauaaacuuuccauggaaaugcaaaacaagcaugaauagcgaagacauacacacacuuuuauauauagacacuuguuuuaugacaaaguuaggaaaaaaguucuuuucaauacaugaagcuaggucaauugguuaucuauaugccacgaaugaaaauaagccuuauccaauuacacagcaagagacauauacaaacaaaucaaucccagguagauuaucguuuuaaaguuuccagaaacaggccaggcaugguggcccacgccuguaaaucccagcacuuugggaggccgaggcgggcagaucaccugaggucagaaguuugagaccaaccugaccaacauggauggugaagcccccgucucuacuaaaaaugcaaaaauuagccggaugugguggcacacaccuguaaucccagcuacucgugaggcugagguaggacaaucccuugaaccagggaggcggagguugcagugagccgaggucgcaccaccgcacucaagccugggcaacaaaagcgaaacuccaucucaaaaaaacaugagaauaucuuuaugcccucgggauaggggaagguuccuauaacagggcacaaugaacaauaagaaaaaagguccauaaaacggacugcaucaaaauuaaucaccacuguuuaucaaaaaacaccauuaaggaagugaaaaaguaaagucacucucuagaagauuauauucgcaauacauagcaaagagaucauauccagccuauauagggaauuacguaaaaagaaaaauguagacaacucaauaaaaaauaagcaugaagcuuaauuaaacacuguaugagacacuacaguugauccuugaacguggcuuugaagugcguggguccacuuauacguggauuuucuuuugucuaugcuacccuggagacagcaagaccaaccccuucucuucccuccuccuccgccuaguuaagauaaaugugaugaggauaaacaccuuuaugaugauccauuuccacuuaaugaauaguaaauauauucucuuaugauuuugguuuuuuuuugagauggagucucgcucugucacccagacuggagugcaguggugcgaucucggcucacugcaaccucugccuccuggguucaagugauucuccugucucagccucccgagcagcagggauuacagggucccaccaccaugccaggcuaauuuuguauuuuuaguagagacaggguuucaccauguuggccaggcuggucucgaacuccugaccuugugauccgccgcacccaaucccuuaugauuuucuuaauaaaauuuccuuuucucaagcuuauucuaagaauacagcauauaauacauguaacauacaaaauauguguuuaucaacuguuuaauguuacuguuaaggcuuccacugaacagcaugcuauuguuaaucaaguuuuggcggagucaaaaguuaaauguggauuuuuuuuacugcacaagagucaguuauccuaauuccuauguuauucaauggucaacuauauuuaaauggcaaaauuuuugguaagugcuaaauccauuaugaauaucagaaauguaaaugaaaaccauaaggugguaauacuauacacaauggcuagaauuuuuucaacucucaauaccacauguuggcaagaaaauggaacaaauggaacucuccuacaauggugauaggaguauaucaugauccuuaaaguaaccaacacuuuggaaagacguauggcaucaucuaccaaggguuaauaaaugcaagcccugagaccuagaaguuucauuccuagguauguaccaaacagaaaugcauaauuauaacacugccagcagcauuaggugcaguaagcaaaaacuggaaacaaacaaaauagaaauguauucauauuaaugaaacacuauaguaacaaaaauaaaaggcuauaugcaacaugaaucuaacaaacacaagacugagugaaaaaggccagagauuaaagaauaauccaugauuccauuuauauaaagauugaaacacagacaaaaccaaccaucuagggacuguagugguacuuuuuacaaagugugauggaauagcaauugguaguuaaguagcaugaagacugcuuuugaccagggugauacuuacacacaaguguguucccuacauaauccacugcauuauacacuuaccauuuguacccuuucuuagguauguuuugauuucauaaaguuauuuuuuaaagcucucuuauaauaguagaugcauacuauuaagcauuuaucaaaacccguaagacccauuggauacagaguaaacucuaauguuagugauggacuuuaauaauaacauaucaguaugacuaauccaaguugcuaauaguggaaccuuagaguuuuggagaugggagguuccuauaaagcucuuauaugggaaugcucuguacuauaagcucaguuuucuuuuucuuuuuuuuucagauggagucucgcucugucgcccaggcuggagugcaguggcacgaucugcaaccuccaccucccggguucaagcaauucuccugccucagccucccgaguagcugggacuacaggcgcgcgccaccaugccugacucauuuuuuauauuuuugcuagagaugggguuucaccauguuggccaagauggucucaaacuccugaccucaugaucugccugccuuggccucccaaagugcugggauuacaggcgugaaccaccaugccugaccucaauuuucuuuaaaccuaaaacucuucuagaaaauaaagucuauccguuaaaaaaaaaaaaaaaaggcagccaccacaugcugacacucauuuuacaacucucaggcguuaggacucuguuccucucacuacuuugacuaguccacaagguuggaagcagaaugggucacaguguucacugacagaagaaaagcagcacuucuaaggagaauuaaugaugcuucauaacugcccgucccccucacuguccccuggcuuuuacgucaacuuggaggagagagucucaugaacugaauuguacccuccccaaaauucauaagugaaagcccugacccucaguguauuuggagauagggccuuuaaggagauaauugguuaagugaggucauuagaguggggcucuaauccgacuaguaucccccauaggaagagggacaccagcgaugucggcccacagaggaaggaccacguuaggacacagcaagaagacagucaccugcaagccacugagagagaagcuucaagagaacagaaaucaaacauauugacccuggacuucuagccgccggaacugggagaaauaaauuucuccacccagucuguggcauuacugucauaguagcccacgauaagaaauacauacuuggucucugcccaugauuccagacacggggcaccuaaaacucuuguagauugggguauacaaucuuuugcacuaauacguggucuuugaacccgguuccugacacagagcuccugagaccuuuguaaucuccugaguaacaggagugucugguaacauagaggugaccguaggguggggcagcaccuggagagggcauggaagcgcucacauaugcauucccccaugcaucucuuccaccuggcucuucaucuaauaggcuuuauaauaaguaaacuauuucccugaguucugugagcucuagcaaauuaaucaaauccacggagggagucuugacaauccccucuuuguaacagguuggucaaaaguacaggucuggcgaagucaggggcagucuugugggacugaguccucaaccugugggaucugaagcuuucuccagguagaugaugccaacauguaauugaauuguaggacacccaguuguugucagcuggaaaacaguuugcggaugggaagaaauccaaauacauucuggugaccagagaugaaguggucaguugugugaagaaguuuugguuuuccuaucucaaacacagcccuagcaauuaauacagagcauauggguaggaagggaaacuaucuuuauguuaauuugguuuuuuuuuuuuccuccaucccucuccuucacuggcauagaagaaaacugaaaacucgaaaagcacuccggaacgaccuaaauugaaguuuuuggaagauugccuacuagcuacacaaauagacugugaaaggaaaauacaaucgacccuugaacaacauagggauuacgacuuaggguggcaguagaguggcagaugcagaagaaacuccaaguguagccagacaagguaguguguggaugcagucccagauacucaggaggcagagaugggaggacuguuugagcccagauguuugaggcuguaaugugcuaugacuguacacugcacuccagccugggcaacagagagugaccucaucucuuaaaaaaaaaaaagucaaauccauguguauguggauccacaugggucaaacucacauuguucaagggucagcugcagucucuaggauggcauaaucuacuuguggauauaauguauucuuagaacuuucaagaauauauucuaacacagauuaccauagacaaguuuccaugguccaucacuaccauuucucugagagaauaaauucucgccccaagaucucugccagccuccaucacugauaguuuaauauaaaaaauacuuuuaaaaagaauuugugcuuccaugaaguuacaaaaaauacagugaaaauaucguuaaagaaauuaaaaacagaaaaaacaaagagaaauuaaaaugcuacauuagaaaauacucauuuaugcaaaauaaaccccacuaaggaauaagaaaggaauaaaaagacgagacauaaaaacaaaaaguaaaacauuagagguaaauguaauuauauaaaaaauaacauuuuuauauaaacaauucugagaauguaggaauaaacuuucucacacuucugacaccagaugugugggugucucaccccacauaacaagcaaucaguucugcaguguacacaccagguggguguccucuaauucauuuuaauuccaagacuaucuauaugaagauagugucagaucucaucaguuuagggcucaguccugcaagacugcccccacuuuuuuuuuuuuuuuuuuuugagacggagucucacucugucacccaggcuggagugcaguggcaccaucuuggcucacugcgagcuccgccucccagguucacgccauucuccugccucagccuccugaguagcuggaacuaccggugcccaccaccacgccuggcuaauuuuuuguauuuuuaguagagacaggguuucaccauguuagccaggauggucucgaucuccugaccucgugauccacccaccucggccucccaaagugcugggauuacaggcgugagccacugcgcccagccgagacugccccccacuucugaugccaacaccaagucccagguuauuuuaccugugcuuccgaccgaccagcuguaaacugggauucccaugucccgcuccuuugguuugucguguuagagcagcucacagaacucagggaaacaccuuaucaguuuauuauaaaguauauuaccaaggauucaguucaagagauguagaaggcaaggucacaugagaaggggcacagcauuuccaugcccucccuggguacgccacccucuaggaaccuccaccugcucagcaaccugaaaagccuucuaaacucuauccuuuccgguuuuauggaggcuucauugcacagaucugauuaauuaaaccauuggcuauuggugaucaacuuaaccucacccccucccucucaaccaggugcaccuucaaagguguaagaaaugaauuccuuuucuucauaaaggccccuguuucaguuauucugcuauaaguaacagaaaauggacuaagauagacaauugguaccaggaauuagggguagggcugaaaagucccaacccuuuaaucgggccuuggucuuucaggugaccagcccuccauucugaaacuaggggaugucagccauaagucaacucauuagcauacaaaaaagacauuuaucacuuuggagacugcucgaauuuuaggaguguaugccugaaaacagggauaaagaccagagauauauuucauaauaucacaauccaaaagacagagaaugucagucuggauuuuaaaaacuauccaacuauauguuauuguuuccaagagauauaccuuagauccaaaaacacagacugaaaguaaaaugaugaaaaaguaucacacaaauagcuacaagaaagcuggaaugcaggccaggcacaguggcucacaccuauaaucccagaacuuugggaggccgagguggguggauuaccugagaucaggaauucaauaccagccugaccaaccuggugaaaccccgucuccaccaaauacaaaaaauuagccagguauagugguacaugccuguaaucccugcuaccugggaggaugaggcaggagaaucacuugaauccgggaggcggaggcugcagugagcugagauugugccacugcacuccagccugggcaacaagagugaaacuccgucucaaaaaaagaaagcaggaaugccuauacuaguaucagacaaaacagacuaagacaaaaaaugcugauaaagagaugcauuuuauaaugauaaaaggaucaacccaucaagguaacaauuacaaacauauaugcacuguugucuaaaacgaagguucuugagguagaaauaaucugauaaagguuuacuggaggccaaaugugaggaucaaucugggaagacauaccaacagaguucaaaguguucuggaguccgcuacaaguuggaaggcuuuuauaugaaauuauaggagaagggagggggacuccuaauacucaaauugucuuuuuucguuggaggauacaauacugagguuauaaucauuggcuacugauugcaacauauaggcuaaaaugucuaagugcaagaaaacuugcaucaauaaaaccugauuuacaaauaaagcagcacccuuuugaguguuagguuaugcauuaaucaguauacccauuugaggaauguguaagauucuuuacucaaggacaggaugucaccaucuuguaucacaauaccuccccaaagcaaguuaaucuggaagcuuguuuacuuaaaacugucaaaugugaucuguagguuauuaauaccuaaaagagcaucaaaauacaagaagcaaaaaccacaauucaccaauaagaguggaagacuucaauucccuacuuucaacaaugaauagaacaaauagguggaaaaucaacaaggaaguagaugucuuaaauucccacccacauucccuuccagugaggugaaagaaaaagguccagaguaccucaacauguaggugggugacuaacuguccauuaguagacuucuagguauaauucugcuucucuucuuuugcagauuacuauggauugaauccaauaguccaaguauucuugaaguugugaauugcaaaaauuaauuugugaaucaggaaauaauuagaaguaaacagcugcaagaaagcauaaagauaauuauggauguggacuuucauauuaaagaucucacuaagauuaacaauaucugugaaauuuaaaaaauauucuauauccacacaaugcaaauaacugaaaaguugucaacccagcagcuuccuuuauuuguaaauugggcuuacuacagaaaauuauaaagcaaaaaauaaucuaaaauuauaccuauaggaaauaaccauauuacuauccauguuaaacacacaugcacaagcacacauacacaugaauagaaagaaguauaagaaaauagaccuaggcugggcacaguggcucacaccuguaaucccagaacuuugggaggccaaggcaggcagaucacuugagcucagaaguucgagacuaaccugggcagcauugugguagcacacaccuguauucucagcuacuuggggggcugaggcauuggaugaacccaggggguugaggcaguggugagcgggaaucaugccacugcacuccagacugugcgacagagcaagacuccgucucaaaaacaaaagaaaaccaaacaaaccagaaaaugaaccuaauauugugaauauggcaugguggccaggucugcuguaggucagauaaaacagcaagaaauagaauauggaaguauaaacugagccacagcaagaauuuugguuuauuuuuuuugagacagggucucacuaugucauccaggcuagaguguaguggcacgaucucagcucacugccaacuccaccuccugggcucaagcaauucucucaccacagcuucccaagcagcugggacuacaggugaaugccaccguguggcuaauuuuuuuaauguuuuguagagaugagguuucuccauguugccuaggcuggucuugaacuccugaggcucaagccaucccagccuaagaauuguuuuauacacagggguuaccacuggccaggugugguggcucacaccuauaaucucagcaugcugagaggcugaggcagaguccagcaguucaaaaccagcaugggcaacacaguaagacccagucucuacaaaaaaauaaaaauaaaaauagaaacacuagcuaggcguggugguacacgccuauauucccagcuacuugggaggcugagauggaaggaucacuugagcaugggaagucgagagugcaguggacuaugguagugccacuguacuccagccuggaugacacagcaagaucugucucaaaaaagggaaagaaaaguggguugacaauuuauuaaagguaaguggaacaucaucagagugaaucaaaguacuauuaacagccaauacgacaggcauaaaagucuuucaggccaacccaaaagacacaugcauguagauaaugucuagcagguuucaguauuugcugaauaaacaaacauuaucugaacaccccauuaaagagaaguccuaggccgggcgcgguggcucacgccuguaaucccagcacuuugggaggcagaggcgggcggaucacgaggucaggagaucgagaccauccuggcuaacacggugaaaccccgucucuacuaaaaauacaaaaaauuagccgggcaugguggugggcgccuguaaucccagcuacucgggaggcugaggcaggagaauggcaugaacccaagaggcggagcuugcagugagccgggauagcgccacugcaguccagcuugggcgaaagagugagacuccgucucaaaaaaaaaaaaaaaagagaaguccuaauguaaacuuauagaugggaaaaaguccugaccacuucuguuuccuuuucuaucuaugccaaccacagacauagcaugauuucaucuguaagcauuucaguaccuaaaagacguaggacuuaagaaauaaauaauauacauuaaaauacuauucuuauaccuaaaauauauaaauucgcucugguauuuuaaauugaaaacuucccuuauggcuuuuuaaguuccacuucuuauguuccacaaaggaaaguuuauuugaagaguauccacugauaugguuaaacugaguaaagucuauuuuucauugaaaaccugacuugcaacauaagcauucgaaaaauuagagauaccuguagaaaguuaacaaaccaccaauacuaacaauucaguguaaaaagccacuuuucaggaauuccaaauguaacacaauuuauucaaccuguacuagcucuggcuuucugucaccuuagucacagaaaaaauuagccuaucaguccuuaaauaggcuuucuagaauccauuuuucuaagcccagaugguccuggaccacaauacaaugguaugacuuaauaauuuugacuuuacaaugaugcaaaagugauacaggcauucagcagaaauuguacuuugaauuuugaucuuuucccgggccugugauaggcaguaugauauucuuccacgcugggugguggcagcaagccauagcacccagucagccacgugaucaugagcauuaacaaucaaugaaaaacacacacacacacaaaaaaaacaaaaauccccccugcggaggcaggcugguguuguggggggugggggugggcgggcgugcagggcugccccucccacggcacauuaaaaaaaacaaaaaaccaaucaaugguguacuguguuagcuaaguuuuuuggauguuguguuuucccaucccaucaugucuauaaaaccccauuuuugacuuacauuuucuacuuaauacagguuaucgaaauguaacuccaucguaagcugagguacaucuguacuacuauaaacaacuaacauuugaaaaucuguauguaaagaacuauguggaaugcuucauauacuuuuaucucauuuaaguaucacaacaaauuaacaaagacucgcaauccucccucuugcagcacagugguuagaaggggcagaacaguucucuaugcuucuguaacugcagucagcaaaaggccaaauggauucauauauuacuaaguccaacagcaaaaucaagaucaguauccccagccccacgggaugacaccaagccagaugagaacaccaaacuguggccauuuuauagccagcaaguauaccccccaaggugguaaaguccuaugcacaauugaaaccaaggaggcagaugagaaacugcuuugugacuguuucucacagggcugcuuuucucucacuuuguucuuggaggaccugcaggguuguccugccagaauaugggucagccugugauuaagccuaagcuuugccuccauggucuaugagaagagcaagucaucagggcaccacggugaagcuguucaccuacaacucugccuucccaucuuucauguauccagcuacaaacucuauucagaaccacaggccauccaaucagauauccuaauccauuguacuuugucuuaggcaacacuggauuaaaaagugccugcaaucgugauucccagcaggaugaucacaccuauuguggaggacauaccaaacguuccccaugcagagccaaguaagcuaaauauaucccaacuaccaagcuucaccagugagagccacagggcuuucucccuaaaaaagggagaaauaaauugcucuacuuuuucugacucguuaacacagguacagcaugaagugcuggcaaucacacaucuugacuggccagcaggaaguucagaccaaugcaacagacuaucaucauucaggcuagaauacugacacuagucuguugugccuucagagcagagaagccagagacaaauuuuagaccauguuuucuauuuguauuauucccuaaaaugggaauuaaagacaacagagaacacaugaagcggaagccaguuacccuacgagaauucugccaaguaauucauuucggagcccucuggauacccaacucaaggaaacaucuacuaaaucaagcuuguccaauccgcggcccaugggcagcaugcagcccaagacggcuuugaaugaggcccaacacuaauucauaagcaugauuaaaacauuaugagauuuuuuuuuugcaauuuuuuuuaaagcucauuagcuauuguuaguguuaguguauuuuauguguggcccaagacaauucuucuuccaaaguggccuagggaagccaaaagauuggacacaccguguacuagaggucuggugaucuuaaauaucugaaaagcgcugacaagcacccccaaguauacaugacacaucaguguguggcaggcggguacaaaccauauuaagacaacacuguguugagguaaaaacuguauucgaaguaucacuucuuuuuuuuuuuuuuuuuugagacgaagucucgcucugucaccaggcuagagugcaguggcgugaucuuggcucacugcaaccuccaccuccugaguuuaagcgauucuccugccucagccuccccagcagcugggauuucaggcacacgccaccacgcccagcuaauuuuuguauuuuuaguagagauggcuuuucaccauguuggccagaaguaucgcuucuucaucgcuccuauuaugagugagucaauuuucugccacuggagauagacaaaaugccuucaguggaacagaagaguuccucuaaaccaugcaguugaggguagcuguccagguucuuggcgucuugaacaaagaacugaacaaaccacacaagcaaggcagccaaagcagagacuuauuuuaaaggacagcacacuccacagggugggagcgggggcagcaguggcucaagacagucaaguuacauaauuuucugcaguuuaaauacucucuagagguuuaccauggauucacguuauguaaaugaaguaguggccagccacuagccugauugguugugggaggggaccaaucagagguacuuucauuuucugacugccacucagcaacuuugacacagaaaaaggagggguugaaaagggaguagccggcagggagcaguggcucacgccuguaauuccagcacuuugggaggcagaggcacgcugaucacuugaggucagaaguucgagaccagccuggccaacauggugaaaccucgccucuaccaaaaauacaaaaauuaccgcggugugguggcaagugucuguaauccuagcuacuuuggaggcugaggcagaagaaucggaagcggagguuacagugagccaagaucacaccaccgcacuccauucugggcaacacagugagauucagucuuaaaaacaaaaaacaaaaaaacaaaacgacaaaacuacaauaaacaagaccauauaguacugacacaggacaggcauugaucaauggaacagaaccuagaacccaggaguaaacccucacauuuauggucccuaguaaggaaggaucagaauccaggauaucuuaaaaacuuacaaccugacaauccaaagacaacacaaauuuaaggccaaaaguuuugaauagauacuucuccaaagaaaucaacaugcacauaaaaagaugcuuaacaugacuaaucaucagguaaaugcaaaucacaaccacaaugagcuaccacuucaggcucacuucuauggcuauaaaaguuaagugucuauggauguagaccaaccaucucucaaacauugcuguauaaaauugugcaugucuauucacaauagcaaagacccagaaucaaccuaaaugcccaucaacgguaaaccgcauaaagaaaacaguacacauacacuagggaauacuaugcagccauaaaaaaagaaugagaucauguccuuugcaggagcuuggagcuagaggacauuauccuuagcaaacuaacacaggaaaccaaauauugcaugcuuucacacauaagugggagcuaaaugaugagaacacauggacauguagaggggcucaacacacuggggccuauaagcaggcaaagcgugggaggagggagaggauuugaaaaaaaaacaacuaauuggguacuaggcuuaauaccugggugauuaaauaauguuccacaaacccccaugacacaacuuuaccuauacacguacccccaaaccuacacacguacccccaaacauaaaacaaaaguuaaauaaaaaauaaagugguaaaucuacuuuggauaauagccuggcaguuccucaaaauguuaaacaguuaucauaaccaaggaauuccacuccuagguauuuacccaaaagaaauaaaaauacacgucuacauaaacacuaugaaugaucauagcugcacuauucacaguagucaaagagugaaaacgugucaaacgucuguuaacugauggaagaauaagcaaaaguggcauauccauacaacggaauaucugguaauaaaaacgaaugaaguaacauacauguguuaacauaaaugagccuugaaaacaugcuggaugaaaaauauuaugacuucaauuauaugaaguguucagaauaugcaaaccuacagaaguagauuaaugguuaccuagggaaaggugcguuggagaaaauggggaguuaccacuauugaguauggagauauuuuggggguaauaaaauauucuuaaauugacguggugaugggugcacaacucugaauauacuaaaaaccacugaaacuguacacuggguguaaaugagugaauaaauggcuuaugaauuuuaucucuaacuauaguuacaaaaggcaugcucugaacaacuugaagcugcuugcaucuggagaugucagggcugcccaguggagggauggucugccugaaaaccaaagcagaggacagcagagcucaaagauacagugucccaaaucuuuaaaacucucuuuuggauuuagauccuggauccaucaaaacccaaagguugugcuccaugaacuuuuuuuuuuuuuuuugagacagucucgcucugucguccaggcuggagugcaguggugugaucucagcucacugcaaccuccccuccuggguucaagcaauucuccuaucucagccuccugaguuagcugggacuacaggcgcaugccaccacaccuggcuaauuuugggguuucaccuguuagccaggguggucucgauuuccugaccucaugauccaccugccuuggccucccaaagugcugggauuacaggcgugagccacugcgaccagcccauggacuuuauuuucuaagacagagucucacucugucacccgagcuaggguacaguggcgcgaucucagcucacugcaaccucugccucccggauagccgggauuucaggcaugugccaccacgccuggcuaauuuuuuguacuuuuaguagagauggagcuucaccauguuggccaggcuggucuccaacuccugaccucaggugaucugcccaccuuggccucccaaagugcugggauuacaggcaugagccaccgcacccgacccugauccaugaacuuuaaaaguaugucaucuaaugaauucuccuuuggggcuugaaaaauaauaaucaccuuaugguuucuguuucuuaaaacuucacuggacaauacaauuucuuuuaauacacuuugucauuuuaaucaccuuauuuacaaaugaaaccuuguaauuugauacaucaagagaaucuuaaguuacugucauuaaaucuuugcgaucaugaaaaccaggagcauaaaauguauaguuccaaucucacuugagauuauuuaccucaacagccuccaacuuugcucuucacuuacaaguacacuuaagguauuaggaauaguguaaguauugcauaguugccacccaacaaagcauuuagaauuccucaagguccaagauucuuucuucacaaucuucuuccaaagugaauguuuaacuugcguaucuauagccaggguuagucaacuguuauccuggacuuaucucaaaaugaauacacucccugucuguuuuacauaauagagugugccucuaaugggggagggagggaggccugauuagauucuugaaauucaccuucacaaaugcuuuuuuuuuuuuuuuuuuaaaaagacagaaucuugcucuguuacccaggcugcaguacgauggggugacuucaggucacugcaaccuccaccuccuggguucagccacuugaguagcuaggauuacaggcaugugccaccacgcccgacuaauuuuuguuauuauuaguaaagaugggguuuugccauguuggccaacuugaggccagggcuggucucgaacuccuggccucaagugaucugccugccccagccucuuaaagugcuggcauuauaggcgugagccaccacaccuggccuacaaauacguuuuaagcaacauuaaaucaauucccuaagcauuugagcuccaauuauauccaagacacugauaaucuaggagggaagagagauuccuguacaaucacagagauaauguagaacaacaaagcuuuggggcaaguuuguccugccuaggaauuuggaggcauuuuuuauuccaaacaagccugcagguaaauccagauguggaccaguagugacagguacuuccuaacaaaacaagaccuacaaaaaagagaaucuaagaggaucuacagugauggguuuaaucaauaaaaagcucauaaauuuagagcuuaaaugaaccagcugaauuucugcuaaggcagcauuacaugucccaggccacaaaaucuauuuccucuaacaugacaauagcuaacauuuauugggcacuugccaugcaucaggagcuguuuaacugugauaugcaugaaacucauguaacucuaccauaacaauccuaugacauuagugcuuguccccauuuuauagaugagagaacaggcagagguuuauuuuccaggguuggcugagugcuacagccaagaucugaaccaaagcagugugguuacagggaccauggucuuaaucauuaggugagacuuccuaacacacuuugugguuacagaugaaagcccuggacaugaucacuuuggcugcacgggaagcauccucccagaguggugcucugcgccacauuccccuaugugccaccaacaguaauaaaauauaauaaaaacaaucaaauaaacacagcacagacagaagcagaccucugcccagguaacuuccaccacaauucccuuaccaaagaccucuuuccuuauuuugcuaagauuaacaacugauuuuucaguacuaugccaacaacauuucuucucaagcuuugcugucaauuccauugugacccacaguuuaauuuaaaaccgauguugauucacugagcuaguaauuuuauucgguaauaggugaauuacuccauaguugagugugaauaaccgccugguuaaaucagggcggguuucuuagaggugauacacuuaccguugagcacaacuuuacucuuuaauuaucguguacauucccauuucccuccaaacacgucagucccucuccacacaguguuuacuucuuugguccuagggacagcaagaaacauuuuauaauaaaagagcacaugcuaauguguuuacuagauaugacacugcugugcaaaacuguuuucuuuuauggcugcacugaaagcaugcuaaguuuacugaauucuuauuaaguguccuaaguaacagaaauagaaacuaggucuggccugaaaauaccauucacuuaaguuagaauuuaugugcgcuccucuagguccgcuauuguaguaucacugcaaaacaauaauacuuuaucucugcacuugucuuuauuggauuaauauuaaacagaaaaaaauccgacugcacaggggaaaaaaccuaaaaccuuaacaugcaugcacauuaacagugacugaaacaugauuaaagcuaacacauuuagcagaaaaaugcaauccccaaacaagcucugcggcccgccuacugaaaugcacccgcccgccacuaaaugaaaaugcgccucaagcucauacacauccuuauguuaagacaguaugcacucgauguacuacaaauaaauuguuuucacggaaaugauuccccgaaaguuugcugcugaacucaggacccuaaggacguuugcuuagggaauccgugucccucgagaacaccuaagauggguaugcguuugugcauuuaaaaaugccucaaggaacuauugcugaggaacagaaaccaucgccggcgcagaagcguucgcggaccacuuggagauagaugccaguacagcaauucuguuccaggaggcuucggcuuaagagggccggggaggaggagaacccucgggaaauagcaaaaaaaaaaaaagauuuuucuuuuucacuccagcgacaggaaagccuuaaaaacauaagcagcucucauacccacccgccucaccagccgcgccucgcaguucgacaaaaugcguccuagccuucgccacucgcgaccucuaccgcgcagagccaggcaaugagggaaaacagccagcgaggcccgcccuccggugcaaggcucggcauccgcggaggcccagggccggccccggugcggcgggcagaagcaagcgcggcggcccggcccagcuccggugggcggacggcgggacgcgcgagccggcggggcccgaggcccggguuccggggccgcccgcgacugcgucuuugccgcagaacaaaagcgcucugcgccgcgcgcaggcccggaccgcgagugccucuggcucccggcucccggcccccgccccgcccggaccccggaaggcggagggaccucggggugcucgucucacacuuaccgacaaagggaagaggaccaccccggcaagcggggagaaaaccggcggccucccgggccccagaguuuaaguc

SEQ ID NO: 191712 - RNA, 270957 nt, Homo sapiens
auuuccuucucccuuuccccgccagcuucgcauccaucucccccaccccguaacccccuccugccuccauccaccggggcuauggccgcagaagagguauugcagacgguggaccauuauaagacugagauagagaggcuaaccaaggagcucacggagaccacccacgagaagauccaggcugccgaguacgggcugguggugcuggaggagaagcugacccucaaacagcaguaugaugaacuggaggcugaguacgacagccucaaacaggagcuggagcagcucaaagaggugaguugccugucaccucucccuuuccuggcccucacuccccccacccgcaaggcccacucaucaugaucaagaagucauaaaggaggugauugaaaggacuguuuuuucuucuagggcccuuuguugguaagagaagauugaaagaguccauuguuuccucccccaagagaaaaauugccuaagaaaugaauauauaagcuggaauuugggaggcaauggcuguuuggccugcgggggagggagauuaguaagagucaucaagucucagcacucuaagacgacauucaaguggguuggaauguauaaaucaaacuucucaaaaccgcuguuaucucaaacccagguuucagcgacaauuucguaguccacaaaagugaugagguuugugccugaggacccacaauuucaggauuuagacuguguggcaccucagcuuuccucuggauguaaccacuccuuggugagagagggaacuccucaccaaucccauuugacaaaggcuaggcaaucuucauucugcuuggcuuuagucauucuugucauugggcugcagaagaaaaacaacuuugcugggugaucccacugccuugauuucaccucggagcgaggcugggccauguccaagucuuaugaggucacccugacuagaaaaaauugaacucaccuacaaauagucugaaagagugguguauaucaaauacguggguaguguugcauuucaaaugaggcucuucugguugaaaugauauauuuauaaaaccagaauaucaaaaaugggugauguauaaugucucuuuaguuuuuugguauuuggccucuuuuaaagccugucggauguaugggagaaaacaaugaacgugcuuugauuuccuaucagucacucuuaagaacauacauauuguuuaaguaacucggucuuuuuuaucugauucuugaggcacuauggguagcaaauaaccacuuacaaauuuaaauguaauauacacuccuuuucugugugucaaguccuuauuuuuaggugcauauugacauuuaaauguuaauuauuguuuggcauauaauaucaaaaaucuauuauuuauuuuaugcuguuacaguuaaaagaugugauuuaugacauacugaaucaacuugccuuccaauuuaguguguaauaugguaagcauuuauacuuuuagauaugucuuauuuuuauuuggaugccugucuaccaaaaaauaaauguacuaccuaugauuaaaaaucccaacuaggaaucuaauuuuugugugucaggcuguaaauuucugguuccuauuuuacuuaccauguaccugucuggucuuaacaacagcuggacuuguuuauauuuuccaacuuagauuaggcugacauguuuaaaugcagugaugcuaaaccuugugaagugaggaagcaggaugaugacugucauucucagagauguuuugauauugucuauaccuaucaacacugcuuugccaagauagggaagugcaaaccagaaagugguaagccaucaccuucuugauaaaggagauggacuuaauuuaaugaaauguaccucuuacugacuuugcugcuugauuuaaacaauccuucuagggauauuucugucauugcacuuaccuugcauagcaaaccuuaaugcaauuguguuuugccuuugcuacaccaugagcuuugcaucccaagucuuuaacacaaaagcuagcacacagugggcaugaaauauuuuaugaaagaaucaguuuguacuagaagaaggcacacuuuuaucaaggguucacuagucaauauugauuaguguuagauaaauacuaagaaaauuaggauguauaggaagugacagauguuaauaaaacuaccuguauuaguuucaccagcaguaaugagaaaaaugugaaaaaaacguuuuguaggaauaauguaacugugguuucuuaauacagaauaaugcaaauaccaacuaaaauuuuuucuauaaauauuuuaauauauauuuuguucuauauagcaggagguuaauaaaaauuuaccagcauuauuuuuacuaaacgauucuuguucauauauuuauuuucaguugcauuuagcauaagugaaauucgagauuccuaaaaaacugguuuauacaguuauauaaaaauguauuuuagguaauaaaauuauuauaguugauuauuugauagugaggccuauuauuuuuauucuuuaaacauagaauauacuuuaguuggaaauauaacuuaaaugaguuaaauugauuucaaguaacauuucuuguaugaaaaguaaauccaaaauaauugugcaaacugagguguuccaacaccucaguuuugaaaaauauuuugugaguguuuugauuuuucaaaagaaaguuuugcucaucagguauguauaguaaaugauguugcauuauaucuauaaagccaagcauaaaauaaaucuuugcuuauuucuaggauuuuugaacaaauaugauuuauuuaaaaauaauugaaccaguuuaugggaaugucaacagaaaacuacuguauuaaguccaaauuggacauuaguaauuugcaguauagcaacauggcucagucuuugcagaucauuuuguuuuccagagucaguacccaccaauguugcuaccuuccuucccaggcuagguacugcugugacaauaaugcaagucggcaguguugccuaaagaugugcaaaaucaagaagaugaaauucauuaaauuuuuuuccuaguuauuucuucccucaacucaauuguuuuuugaccuggccugauguuguuuagugcucugcauggacuacuguaauucagcucacagaagaacacacuugaaagaauaguacuaaggauuugaaaaaaggaugacuucugacaucaucaaaguguucuccuuuucaugauucuuugggcagcuggacagagcaguauguccacuagaauacuugagucugguuuugugauuucacaaguaacacuugcucuucagugaccugagugagggucacccaugcccaguuauguucagggccuggcugauuauauguuugggauguacguaaaucagcacugugcgccugucacccaggccagaauaguguuugaagaagagucauagcuccaaaauaaccugaaaacuaaaaauauacauauauaaaaauaccuuggaucuaaacuuaagaguuuuuuuuacaccgcauguucucacucauagaugggaauugaacaaugagaacacauggacacaggaaggggaacaucacacucuggggacuguugugggguggggggaggggggauggauagcauuaggagauauaccuaaugcuaaaugacgaguuaaugggugcagcacaccagcauggcacauguauacauauguaacuaaucugcacguugugcacauguacccuaaaacuuaaaguauaauaauaaaaaaaaagaguuuuuuuuuaacuuaaaaaugguugaaauuuaaaauguuguaaaguugaaaaagagccccuuagaaaggaaugauucagcauuacugauggcauuuuaaaaaggaaauguaucugugagacagcuuuagaaaaguuuugcagcuuggauaccguaaacuaugcacuaaugagcuucaacccauuuucuugcuuauuuugucaacccugacaccaaggauaguuaccagcugcugaagaagcacuuucuggacauugggcagcuuuuucuuuuggagccaacucuauucuuuuucaggguuauaguuaaaucauucaacacaaaaauauguacuuacacaguuuuagagcuugucacauuggugaccugaugaaugccacuuaaauuaccuagauucaucuuuaagcagaauuguuuucccuucagaugcuuagaaagauuguuaguuucuuuuauaucuuuaaguucuaaaucacaaaaucauauggcaagaaaaaccccagauuucuuuuccaaucuaugaauaaacauaaagagacaguuaauacuuaauugaucuaucugaacuaugauuuuuaacuucucucauuguuuuuauuuuuuuauuuuauuuuauuuuauuuugagauggagucucgcacuuucacccagccuggagugcgguggugugaucucggcucacugcaagcuccaccucccggguucacgccauucuccugccucagccuccggaguagcugagacuacacgcauucaccaccacaccuggcuaauuuuucguauuuuuaguagagaugggcuuucaccuuguuagccaggauggucucgauguuuuuaaagaaaaaauauuuacauuuauuaucaaauuaaucuuaaaaucuaaaauacauuaagauaugcuuuuggaaacuguuuacaaacaaccucaacaaauaaacaucaucgcuuucaaucacauuucuuuuuuucuggacccaguugcucuaacuugcacuaucccuuuuuuuuuuuuuuuuuuuuuugagauggaguuucacucuuguugcccaggcuggagugcaauggugugaucucggcucaccgcaaauucugccucuuggguucaagugauucuucugcuucagccucccgaguagcuaggauuacaggcaugcgccaccacaccuggccaguuuuguauuuuuaguagagauagcguuucuucauguuggugagguuggucuugaacucccgaccucaggugauccgccugccucagccucccaaagugcugggauuacaggcgugagcccccacgcccagccccuucuuuuuauuugaaaucaagauuucgucucuggcgaaguuauuucucagauauaacuuagcaagaauuuaucaucuuuuaucacauuccccauguuuaugugaacauguaugacagcgaugguuugaagguuucuucagaacuuucugcuugcaaauauuuugcccuaucauccccuuaaauauaguuguacucauggauauugcuuuccaaauuugaaaauacgguaauuaauuacuugcauguugaaauauacauaaaggacuugcccacacauaagauuccaccuguaauuauggcuuugaggagaggagggcaugaagggcugcauagucuuaguauuaaauaauucauuacgcuaaaggagaaugcacguaaagucaaguggcaggagaugcaauugugaaagggccauggccacauuuugucuuggggauguggagccauugaaaauaaaugaaacagucacuguguuuaaucucaccagucuucaaaacaauucagagggcuuacugcucauuuuuacugauaagaagauaauaaaaauaauaaagcauugacuuagguacaaggcuccauuuagaacuagguucuuuacaagccucaccucuaauucaugcagcaauccuuacucaagguagguguuucuugcauuauacagaagaggaaacugggucuuagagagguuuaggucucuucccagggccacaaaacuaaacgaugaaacuuggaagaagcccacuuuuuuuucacugcaucauacuaccuugaauaugaaauaucucugccaagucuacaagugcaguauagaagguuauggugauggucauaguggguggauugaggcuguguggugggacagacaguggcaguagggaucgugaggagggggcacgucuaagagcuauuugggagguaggguggaacaggcauuggauguuacuauauguggaaagugaggaagacaguggagcugagaaucuucucaggcuggauaggaggugguucuauuuacaaaggaagguauuauggggcagagcaguuuuagagggugaaauugaugcucaaguuacaugaguuucuguuguuuuugacacaggguuucucucugucacccaggcuggagugcaguggugcuguuacagcucaccgcaaccuuaacuaaccauccuggcucaagugauccucccaucucagccucccaaggagcugggaauacagacccaugccaccaugccuggcuaauuuuuuuuugagacugagucucccucuguuuccccagcuggagugcaguggcaugaucucagcccacugcaaccuuugccuccuggguucaagugauucuccugccucagccucccaaguaacugggacuacaggagcauaccaccaugcuuggguaauuuuuuuuuuuuuuuuugagcuggaaucucacucuaucacccaggcuggagugcaguggucugaucucagcucacugcaaccuccaccucccagguucaagcgauucuccugccucagccuccugaauaggugggacuacaggugccugccaccaugccugaauaauuuuuuuuuuuccaagacagaaucucgcucugucgccuaggcuggagugcaguggcgcaaucucggcuuacugcaaccucugccucccggguucaagugauucuccugcgucagccaccuguagaugggauuauaggcgcgcgccaccacgccuggcuaguuuuuguauuuuuuuuaguagagacaggguuucaccauguuggccagaguggucuugaucuucugaccucgugauccacccaccuuggccuccgaaagugcugggauuauaggcaugagccaccgcgcccagccuaauuuuuguacuuuuaguagagagaagauuucaaacauguugcccaggcuggucugaaauuccugagcucgagcgaucugccugccuugcccucguaaaguguggagauuacaggcaugagccauugugcccagccacauaaguccuuuuaauucauguuuucuuugcuggggaagcguacauugcaugauggauucagauccucaacuuucuuuuuuuucuuuuuuugagauggggucucauuuugucaccuaggcuggaguacaguggugugaucguggcuuacugcagccuugaccuccugggcucaagcaauccucaugccucagcccccaaguagcugggacuacaggugcacaccgccaugccugacuaauuuuuguauuuuuuuuguagacacaggguuuugccauguaagccagguuggucuagaacucuugagcuaaggacaguccgccuguuuuggccucccaaagugcuaggauuacaggcuaacuuucaauuuaauaaaaaaaauuaauuugugcaauugguuguuauuuuauagaagccuaauuucuagaauaugggauauaaacaauuuaauaauguuuucaccaguuaguuugauugcuuucuaaauuaggaaaaaugaaaacaaauaaacgaugggcaaaaaagcugacuggggacaguaaggucuaagaaggcagccuaaguggaaaauuagcccuuacucaccauuuaggguuaugggggcugggagcaacaguccucacugcucacugacuaaucuuuaucaaucuuauuuaaucuuuauugaagaugcauuagcauuuuuaauuuaaguggguuuuuuuccucuuuucuuuugguggggggugugggcggcgggggaguuucaauauguugaccaggcuggucuugaacuccuggccucaagcgauucucccuccucagccucccaaagugcugggauuacaggcaugagccauugcacccagccuuuucuauuuuucauuucaagaguuugcuuuuuaagaauuaaaauuguguaauuaugacaguuuuuauugcaguacuccaagcuagagaaaagcauauauaaauuaauaguuuucccuucuucucccacaguucugucucuguuguuaacacuuugcugaguauucuucuguacuuguuuuaaaugucuuuaaacauauaggcaggguuuuugugugugugguguuuuugguuuuuuuuuuuuugcuguuuuucuuccuuuguuuuuauaaaaacaggaucuugcagccugguguuuuaaauuuaguaguauguccuuucaaaaggcagguauuuacgagacaaagcugcauuuuuaaagcacuggugaagugugaagaaaaugagaccgauuagggaagaaaacccgagaagcucagaguuugggugacccuggggaugugggaagguggugaaaaugguacccugaggguagcauggaugguaagugaaagaggaaaagguguagguuugcauaaaagaaacugauggaauuuggaugcccaauagcagacccaggggaaugauaccaggggaaaagauggacaguuuuguggguaaauuagcagugauuuugauuccuugucuuguuagcugcugauggagauacguguaucagcauaauaccuggcuaguuuccauggccggcaagagccaguccugcagugugaccacauccuguccauucugggucuugguggcaagccaggaugauucaggcaguugggcuuuauuacguuaucccuucuuugcccucugaaagcugaguuuugaaauaguuaggaucuuauacaacaucucagauucagcaugcugugcaggagguggggagaaaaggguacaaaagaggaaaauguucagugaagguguuauuacaauggaggggaauaugaaaguggaaauugauaccuuuuccucuugggauuuaauuaagucuauaaaauuaagguguugcaauacauaaugucuaugauuuuuuuuuaccagcucuaaaucucugagauggcuguguuuuagagcugcauguucugcuuauuuacugccuguccuuuacauuucaaauucauucaauauuuuuccaaaguacagaauaguuuugccuaguugcaguaauuuucaccuagacuucagggaucuuccaucaacucuuuuauguauuuuuucuccuuuguuuuuccacucuggucacucaguucuagccaagauaguccaccuuauuuuagcacuuguacuaugucucugucucugucugucugucugucugucugucucucucucucucucucucucucucucuuucucucucucucucucucuauauauauauauauauauguaauuuugagauggagucucacucugucgcucugacugaaguacaguggugcgauuacagcccacugcagccuugaccucacagguucaaguaauccucccaccucagccuccagaguagcugggaccacaggugcacaccacuaugcuggcuauuuuuuuuuuuuuuaaccugauuuuguuuuuacuggaggcucagguggcccaacuaauuuuuagaaauuauuauuugcagagaugagguuuuguuauguugcucaggcuggucuugaacuucugggcucaagugauucucccaccucagccucccaaaguguugggauuguaggugugaacuacugugccuggccuucuacauuuuuuuuuuaaccauuucauaguucccuuuuucuuugaacacuugguccaaacucacuuuucuucuggauucauauuuucugaucucaccuauuauguuauagaacugauauguuacguuuguuuucauugaugcgucuguacuuggcuucagagagcagaacaaggcccugugagucacugggagccagauuuuggaucaaaauaaaucacuuucugacaaguguaguugucuaguaauggaaugaggcagucuucuuaggaaguaaugaauucccugucaccaaaagggagaagcuagugagccacuugcugagaauacucuauggggaguuguccuuaggaagggguauaucuagaaugaucucuaagguucauucuuauucggauuucuuugauuuuuaucauuccagguguuccaaauaauuugauaaguuuauguuuuuuauacuuuucccaccaccagagcaguguuuccaacaugguuaaauuguucugcuuuaauguuuggcauuucacacuauuugaugacuguaaacauuuggaauguuuucacagugucucaaaacuuuauuuugauuuauguuuugcuuuauuuucagaagaaaacuaauggguaauauaaagcuuuaagaugaguguaucucuaaauuuggagagcuuucagugaaacuguacauuuugaagcuacgugguugcauugagggaggucuacagccuccagaaucuucuuuuucacacacacgggcacaugugcaugugcaugacuuuauauuuugucauuuacgcuuagucauauauauauauauauacacaaauauauauacacacacacacacacacacacacauauauauauauauauauauauauuuuuuuuuaagaccauauuucgcucucguuguccaggcuggagugcaauggcaugaucucagcucaccgcaaccuccaccucccaguuucaagcaauucuccugccucaggcucccgaguagcugggauuacaggcaugcaccaccaugcccagcuaauuuuguauuuuuaguagagacaggguuucuccauguuggucaggcuggucgcgaacuccugaccucaggugaucugcucgccucggccucccaaagugcugggauuacaggcgugagccaucgcaccggcccgcuuaguccaauauuuuauuuuauuuuauuuuauuuuauuuauuuuuuuugagauggagucucacucugucgcccaggcuggagugcaguggcgcgaacucggcucacugcaagcuccgcuucccuggguucaugccauucuccugucucagccucccaaguagcugggacuacaggugcccgccacuacgccuggccaauuuuuguauuuuuaguacagaugggguuucaccguguuagccaggauggucucgaucucuugaccuugugauccgcccgccucggccucccaaagugcugggauuacaggugugagccaccgagccuggccuaguccaauauuuuauaaucugcaucgucaacuagucaggccccagaaucuguggguucagcauccuuggauucugcauccuuggauugaaaauauuuggaaaaaaaauugcaucgguacuaaacguauacaggcuuuuuuuggucauuguucccugaauaauucagcauaacagcuauuuacauagcauuuacaucguauuagguauuauaaguaaucuagagaugauuuaauguauacuggaggauguguguagguuacaugcaaauacuacacuauuuuaucucagagacuugagcaucuguggauuuugguaucugcaggggguccuggaacccccacacccucacccagacugagggaugacuguauuuacguuaucuaccacucugauguuuucuuuuugcuuuagauugcccauuaccucuucaucuguuucauuuauucauucaaaaauuuguauugaguggcuacugugucgggcauggugccacuugcuggagauacagcguugaacaagacagacccaauggggcugccuggguggagcuuauguuucagacugggaagagagucaacgaacauccacacauauuucaguugugagaggugccaugagggaagagacagacuggcuggggaaagcgugaucaggcagucuuccccaggaggugagacuugagcccagaccugaaugaugacaaggagccagucauguggagacuggggaaugugauuuuuaagaagaggacaagugccaagaucugcgaacucuguuguaguuguuaggggaagggauggguuaccaugcucuguaaaaaugaccauucauauuugaaauaugaccauucuguaacacaguguauugccuacuggauuuuucuaaugagguauugggucucaacauuggaaauguuugagcagaccuuggauaucucccugaggucuucucugagaagagguggguaggaacuagugacuuucaauacagacuguauguuagaaucaccugggugauuuauaaaacuacugcugccuggaccccacuccgggagaguuaaaucacucauuggaaguggagccuggcuucagcaugugaaucccacuucccuuagagaugcagccaggguaaagaaccccucuucuauauuuccaacuugaggacuaaaugaccccaugggcguagaaguguuuaguaagaaaaucuaguuccgggugcaguggcucaugccuguaaugccagcacuuagggagaccaaggcagauggaucauaugaggccaggaguuugagaccagccugaccaacguggcgaaaccccaucucuauuaaaaauacagaauuagcugggcaugcuggcaugcgccuguagucccagcuauucgggagacugaggcaugagaauugcuugaacccaggagguggagguugcagugagcugagaucgugacacuucacuccagcuugggcgacagaacaagacucugucucaaaacaaaacaaaacaaaaaacugggaaguuaugagcuaauacauaaaccuucauugcacagucuuuuaaaauuuguuguuucuacuuucugaaaaugaaaauauuaaauccuuccugaaaacagaaaauaucaaaaacuuaacugcauuagacagagauauauguuaacuuugagugcauuuaauuuuguauucuugaguacuguuuaaagugucuuuuaaaaguucucucuuauugugucuauuuauuuuauucuguuugcaguuuuuaugccaacuuuacacauuuguaaauagaauauuuaaaaagaauuuuuuuugagggauugaucucuaacuucuuggugacuuauaguuguucuuuugguuguacaucuuuacuguuuuccaacauuuuaaggagaaaaagcacuacucucaaauguaauauuuaacugcuguguuucuaucuuuaaauauagaauugaaaaugagaaccuguuuauauuuaugggagcaauagcaauauguguacaauaacaguagcaauuuccuuaagaauguucuguugcaguuuggcgugggucugugauagaagguucagaaugaugggucuuuguuuuucucuugcauacugcagaguaauguggaaucaaauaccacuauugaagagcucuuagucaucaauuuuugaaacugaaagagguuuauauuguaagaaggaugggcccuguugauaagccucacugauugcuacuugcuagaugguuuuaggagauaucuugaaguugaccuugugugagguuacuggauggaaacagcaugaguuuaaucuuguacaugacuucuuuuguugagcuggagauacuauugucuugcagauuaucucuuuggcacgcaugaccauuuuuuuuuugucuuuuaaaucacaaacuggcuuucuuucugcuaagguuggugugcuuagauucuuuaagcuccaaaucucaagaaaauauaggaaggaaaaucaaccauuagagagagagagagagagagagagagagaaaaaaaaaaggaaaaaauauaaugugcuccaaacugauuauaaauagcuuuugaauuguuggcuccauagaauuuuuuuuuuuuuuuuuugagacggagucucgcgcuauugcccaggcuggagugcaguggcgugaucucagcucacugcagccaccgccuccuggguucaagugauucuccugccucagccucccgaguagcugggauuacaggcgugugccaccaugccuggcuaaguuuuuguaucuuuaguagagacgggguuucaccauguuggccagccuggucuugaaccucugaccucaugauccaccugucucagagugcugggaguacaggcgugagccacagcaccuggcguccauagauaauuuuaaaaauucauaccagaucuuaauuaauguuggcauuaaaaacuaaugguggcucaugccuguaaucccagaauuuugggaggccaagguggguggaucacuugaggucaggaguucaagaccagccuggccaacauggugaaacccucucucuacuaaaaauauaaaaauuagcuggaugugaucaugcgugucuguaaucccagcuacuugggaggcugaggcaggagaaacucuugaaccugggaggcggagguugcagugagcuaagaucacuccauugcacuccagccugggcgagagucuuguucugucuccaaaaauaaaaauaaaaauaaaaauaaaaauaaaaauaaaagcgcugagguggaaggauggcuugagcccaggaggcagagacugcagacagccaagaucgcaacacugcacuccagccugggcaacagaacaagacucuaucucaaacaaacaaacaaacaaagaaaaccuacgguuaaugauauagugaucugaacaacagaagaucucaguuugucaaauuuuuuuuuuuuuuuuuuugagacagggucucacucucuugcccaggcuggagugcaauggugcaaucucggcucacugcagcuuugacuucccaggcucaagugauccuccugccucagccuccugaguagcugggacuacaggugugagucaccacacccagcuaauuuuuuuguauuuuuuguagagacagugucucacaauguugugcaggcucgucucaaacuguuggacucaagacaucuaccugccucagccuccaaaggugcugggauuacagguguguaccacuguacccagccucaguuuguuaauauuuuacaauaauuuagaaguagaacccuuucuuaaggcugggcgcgcuggcucacaccuguaaucccagcacuuugggaggccgagguggguggaucacgaggucaggaaaucgagaccauccuaacacagaucgagaccauccuaacacagaucgagaccauccugacuaacauggugaaacccccgucucuaugaaaaauacaaaaaauuagccgggcuugguggugggcgccuguagucccagcuacucaggaggcugaggcaggagaauggugugaaccugggaggcggagcuugcagugagcugagaucgcgccacugcaguccagccugggcgacagagcaagacuccguuucaaaaaaaaaaaaaaacaaauaacaaaaaaagaaguagaacccuuucuuaagagcauucucaggucuucuaucuuaauuacuguaguuauuuccagucauguuuuauaaucaggugcuauuuuucauuguggcauaauaaguaauauauuuuuguaaaucauguugaagugcuugagacaauacaagcaauuauuugcuaaaauuuagaccagggucucaaaacaacaauuacauuuuuagauaauggucacaguaagucuuuucagaaaaaagcaacgaagaaagcucuagaccaaugagauuuuagucaucauuaaucaaugccaagcgaaaaaaucuuaagauguauuuaaauuugugaugccagugugauucagaaauuugaaaaauggauuucaaaguaaugcugugagcagauaggucauuguauaaacauaacuaaugguucauucauucauuccuacaauaaugauucagugucagauuuggguguugaaaauacagcagagaacaaacacaacagaagguccauauuugcggagccuacauuuugugggggaagagagaugauaaacaaaaugaaugaguuaaguagauagcacguuagaucauccaaaaugcuauggggggaaaaaacccugggaauagggagauggcaugugaaguggaagaagguuaugauuuucaauagagugaucagagaaagccucauugagaagacacacuaaggaggccauguggcuggaggggacugaguuagggggugaauaguaggugagaccagagggggccacaugauguagcagcuucuagauuaucaggacuuuggcuuuugcucugagugagaugggaaacuuucagagagcuuugagcagaaaagucacaauguucugcacuuuuuccuucauugagauaaccucugcauacauucaagcacgacuaagacccccuucagggaaaagaaguuuucauuaacucaguaucccaugagguauauggcauucucuuccuucccaccauagcagguguuuaauaggugguuaugguauugcacugauuuaggcugggaaaaaauuaaagaugaaguuauuaagacagccaguuguggucgggcacaguggcgcacgccgguaaucccagcaguuugggaggcugaggcgggcggaucaccugaggucaggaguucaagaccagccuggccaacauggugaaaccccaucucuauuaaaaauacaaaaaauaagccaggcgugguggcaggugccuguaaucccagcuacccgggggcugagccaggagaauagcuugaaccugggagauggagguugcagugagccgagauugcgccacugcacuccauccugggcgacagagcaagacuccgucugaaaagaaaaaaaaaaaagacagccaguuauuugaaaagagguuggaguagaccacuuguuuuaaaaauaaccacuuguuugccuagguuaaacccauuuacucaaaagacacugcgcugacuugccugguuccuuguaccugaaucuuuaccuaagugucuugugcucucuguccuuuauucuccauaaugcgagcuauccaguagacccuagccaaaggggacauaaagacagucucaacauuguauuacugguucugugcuacaguugucauucaaguuccugagaaaauggaaugaaugucuguuauucauuuauuuauuaaaucuuuagagagcaucaucuauaugccagguauuaugcaggcuauacaaaaauuaggaagacgugaucuuuauuuuuaaguuacuuauuuguuguuggaggcaacagagauaaaugaauugugauauuuuacuggaaacaauaugaguuuuugaguuaagaacagacuguguuugaaaucccuuuagcagcuaugugaccuuaggccaauauuugaaaugaugugaacguugguuuccuccucaguaaaauggagaaugauaauaacuauaagugguaaggaaaaaugcaugugaaggauuuaauacaguaucugacacaugacaagcacuugauaaaugauggaugugauggugacaauaauaguaauaauaauaaaauaauaauguguuggcugugcucgauaggaguggaggguagcaaacucagcuugaaucagaguaaucuccugaucaggcaacauuugagggggcuuugaagaauaaguagggauuuuccggggagagaagaggggcaaagucauucaggaagaugaaacagccuguagaagagggaaggcuggagagagugcugcuugucagugucuguguuguugcaguagggagguagauggaauggggugagaggggaggugagccuggagagaugguuuggggccagauggggaaagcuguguuauggggcuugucaguuucugccagccaaggcuucagcauagcugacuguaacaaaguugggaaggccuugcuuuugagagccagaccaggaguaccugugacuaacaaggggucugggaggaucugcugcucccaugcccuccuuuguauauuuuaaaucuguuugagccuucugggcuccugugaauuagggagaggcagcuccucagucuaacuccuacugugaccagguugccuaauuggcccuuugguuugggcacccacuguccucugcgugguuggauagaugcugcucccaaugucccugaucucuuacagaccccucugauucuucacucuuggcuuugagagccccugaugcccugcagucuugacugagcuucuaaugguugaucagacccuugaauguugagcucuuuccauacuagacuugaauauucuccugcccauuugauuuguuaauuaggauucauuggcuguuucucugcucuccucuuuucucucuguuccugcugguucaaguuuaaccuccauuuucuuucuccucugggaaguuucccuuaugccucuugaacagggucaagagcacuuaggagcucagauuuacacuguauaucaugagaaaagcauugaaaguuucaaagcaggagagugacauaauuagcuuuauguuuuaaagcggauuuuugacuuuagauucuggcaauacagugguccuguggucuaagacaucugacuaaccuuccugcuagcaacaauuaaaaaugcugagugcaauaaaaaacuagcccuuaaauggaaugaaugagucgacuacuugguaaggaugcucagaggcuaaaacugaaucaaagcaggaacucuuagaaguaagcaguguguuggcuaggcgcaguggcucagccuguaaucccaacacuuugggaagccaaggcagguggaucacuugagcucaggaguuugagaccugccggggcaacauggcaagaccccgucucuaaaaaaaaaaaaaaaugccaaaauuaggcagacaugguggcacacacuuguagucccagcugcucgggagccugaggugggagaaucgcuugagcccaggagguggaguuugcaguuagcugagauugugucacugcacuccagccugggcaacagagcaagacuccaucucaaaaaaaaaaaaaaaaaaaaagcagugcaucaaaucugacuuuugccuugaaugcauuugcugaaucaguauugguucaauacugagcauuaguuuuccggccacuuagaguagaggaaauaggagauaaagccuagaaucuccccagauuugggcuccagaggacccuacaacuauuguggggggaacuggauguggugggaaaaauuguauaccucuucucagacuucauaccccaccaaugggcucucaccacgguuugcagacuguucacaccgaguuuguguagaaaggaugaaaucuuaagauuagaaugagagugaacgcagguuggucaugccugcagcucucuuugaagacacucgcuaucauggugggcuagaaauagucaccauagauaguauucuuaaaaaaaaaaaaguugcuggccggguaugguggcucacaccuguaaucuuagcauuuugggaggccgaggcggguggaucacuugauaccaggaguucgagaucagccuggccaacauagugaaaccuuguuucuacuaaaaauacaaaaauuaguuuggcauggugaugcaagccuguaaucccagcuacuugggaggcugaggcaggagaauugcuugaacccgggaggugaagguugcagugagccgagaucagaucacgccacugcacucuagccugggcgacagagugagacucuguuuaaaaaaaaagaaaaagacccugcagaaauuaaaauuguaaaaauauaaauauacaaggaacaggcaccaggcaccuuuggcuccacauccuugucaucacuucauaccuuguggcucuaguuugcauuuuuguggcugcuuaugaggucgugccucuucaguauuuacaggcauuuaugacuauccugcacugaaaugcauuucaugucuuugcucauuuaccauuggauuguuuacauuuuucuuccugauuuguaagaguauacaccuauacucauauucuguauacuaagccuuuuuaguuauuuagauauguuggaaauaucuuuuccuaguccauggguugucuuuuuacucuuucugugguauccuuugaagaagagaaguuuauaauuuuaauuuaguugauuuaucacucuuuuguguuucuagguuguauuuuucuauucuuaagaaauccuuuccaugaagucauaaaaacaugcaccuauauugucuucugaauaucuuaugguuugacuuuuauauuuaaaucuuuaauucucccuggaauugaguuuuguguuuggugugagguagaaaucuaauuuaaauuuuuucccaugauuccaccccaccccccaauaaaauuagccagugaucucaguaccacagguuacugaacaguugaucuuuccugcacuaauuuccaauguguguuuugugauaaaucaaguuuuuauauaugcaugggucuauuuuuggacuauucuguuacauugguuuguuggucuauucuugugcaaaugccacacugucuuacucuuaccauuuuaauauaaguucuugguagcugauggaauaauucuucuuauuuuguucuuccccaggagucacuggcuuuggacaccuuccuugcugucauaggcucuuugcuuuggaaagcucucaacauuuacaaggaagugacaagugugaacgaaggcagaucacacuguuuauuuccguuuccccaauaagcauuaaggaggaggauauugagggucuaguugugguugucuuagacuuugcacauguuuuuauaagcaaagcagacaagcuccagcaagggaacucaauugucuaauuagauguuaccagaaaucuuauuggggcugugaucuaauucuuuuuuuuuuuuuugagacagacucuugcugugucauccaggcugcagugcaguggcgcgaucucaguucacugcagccucugccuccgaggcuccagugauucuccugccucagccuccuagguagcggggauuacaggugcaugccaccacacccggcuaauuuuuguauuuuuaguagagacaggguuucaccguguuggccaggcuggucucaaacuccugaccucaggugaucugcccgccuccgccucccaaaguguugggaucacaggcgugagccaccgcacccggccugagcuaauucuuaagaagucacuuuggaaaaaaauauuauuuaagggcuuuucauaaaguauucaaaaagguacaaguucuaaucuaacaguucuauuugugauuuuugaggaagcauaugcguauuuccacuuaagcaucugaaauauugccucuagugcugaacaaauucuucccuugguuauuuuccucuuaucucagucccuggaagaauaaaugccuguacuaauucucuauauacauaaauggucucuuuagguauaaauaaccucauaaucacauaaaaguuaaaguuuuaauggaaaaggcugagaugaaauauuaccuaaguaggaauuaauugcuuuuuaucacuuuacauuauuucauuuuuaguauuaugaaaaauauaauuguuccuuuucuuaaaaaaaaaccagcguaauuugugcuuaguuuuaaaccaaaauuuuuccuauauguuuauaguuuauauuuucaagccaaaauacuugaguuuuuuuccugucauaauauaucaauaugagaaauguauuguuacuuuagaaucuuuuaaaacuucuuuuuauuccuuuuuuuguuuuuuaagauaggguauuguuuuguugcgcaggcuagaaugcaagggcacgaucuuggcuuacuguagccucagccucccagguucaagcaacccucccacaucagccauacaaguagccgggacuacaggcaugcaccaccauguccaacuaauuuuuuuuuucuuuuuuuuugagacagaaucucgcucuguugcccaggcuggagugcaguggcacgaucuuggcucacugcaaccucugccucccagauucaagagauucuccugccucagccucccgaguagcugggauuaugcaccauugugccuggcuaauuuuuguauuuuuauagagaugggguuucaccauguuguccaggcuggucucgaacuccugaccucaggugauccgccugccucagcuccccaaagugcugggguuagaggcccaacuaauuuuuuaaaaauuuuuuguaggccgggcaugguggcuuaugccuguaaucccagcacuuugggaguccaggcagacggaucaccugaggucaggaguuggagaccagccuggccaacauagugaaauccugucucuacuaaaaauaaaaaaaauuagccagguaugguggcacaugccuauagucccagcuacuugggaggcugaggcaggacaauugcuugaacccaggagguggagguugcagugagcugagauggcgcaacuauacuccagccugggcgacagagcgagauuccaucucaaaaaaaaaaaaaaaaaaaaaaauucuguaaacacaaggugucacuauguuucccaggcuggucucaaacucugggcucaaccgaucuucccaccucagccucccacaguccugggauuauagacaugagccaccgcaccuggccuaaaacucuuucuucaacauuaagaaauaagacuuuuccagucucuuucuuaacccuguacccuuuucuuucucaucuucuuuuauccccucccuucauuaacuuuacauugcaauaccaaggacuuaaugguuuguuaaaaaaaugaauucuacucaguagaaaauuccugagaauauuuauuaaaugucacugggaggaaauuucccuaagcaagauacaaaacuuagaaucaaaagggaggacugacuuauuugguuuuagaaaugaaaaagaacaguuuggaagaaauagugcgauguggaugacuuacaaacaauuauuauuccuaaaauauagguacaaugaguuuauugaaaacaacauaaugcaauaggaaaaaaggacaaagagcaacuagucagagaggauuugcaaguaaaucaguaaaugggaagagauguucaaucugaguagucagugaauguaaauuaaggaaguuuacuuuuuuucccauuaauuuacaaaaauuuuaaauaugauaauauacagugacaaaauuuuuuuuuuuuuugagauggagucucgcucugucgcccaggcuggagugcacugggcaaucucggcucacugcaagcuccgccucucggguucaugcccuucuccugccucagccucccaaguagcugggacuacaggcgccugccaccgcgcucggcuaacuuuuuguguuuuuaguagagacgggguuucaccguggucucgaucuccugaccucgugaucugccugccucagccucccaaagugcugggauuacaggcgugagccaccacgcccggccccaaaauuuuuaaauaaugauaauauacagugucggaaaguguguagagguagaagugugaauugcugugaacuuugagaacguggauuggcagucuguauuaagaucuaaaaugcauacagugcuugggcccagcagucucacagaagccauaggugauuguaugucaguucccaaauaccacucguuagagagaagcacuguuuaacaucuaguaucucauuuagacccuguuugagcauagaucauauguguguggaacauaaaaguaaucgaaguaugcucauucuuuuuuuaacauaucuuuccaggcuucuauauaguuaaauaaauaaugcuccuugacauuuauguauuuauuuauuuagauggagucuauuucugucgcccagguuggaguucaguggugugaucucagcucacugcaaccucugccuuucggguucaagcaauucuccugccuuagccucucaagcugggacuauaggcaugcaccaccauucccggcuaauuuuuguauuuuuaguagagacgggguuucgucauguuggccaggcuggucucgaacuccugaccucaggugaucugcccgccucagccucccaaagugcugggauuacaggugugagucaccacgccaggcugcuccgugacauuuaaauaaaaucauauuuuaaaguccaguuguaagccuauacaucccccuuaucacuuaucucuaauucacuucuagaccugguuugaacuuuggauuuagugcuuucaaagugugauuuuuuuaaaaaaauuauuuuucuguugccguauauuucagcucuucucggucuugaaaagauuugugagccuuuuugacaaaagguggugcucauuuucuauuucgguggcuccaguaaagggagcugcucucucaucggaugauuauugcccccagaagugguccuaccauagcuuuacuggucaguuagccagaauuuacacauuuacucugaggcuuacaaaaauacuguguucauaaaaagcccuccuucacauuuugugaaacaguugcauggugauuugggauauuuuaaguuuaccaucaccucucuguccucugcaaaaauaaaaauuguggaauguaaaacaacucuguugcacaaaaaggggaacuugguguaggaaaaaauaacuagaaaugauaacuacgagacacugcacucccaaauugaagauuuaaaaaaauuccugaucguaaauaagaaaaauuauggagacauuuauccacugcauaucugaugacuaaacgcuugguauaccccagccauuguuaggugccaggguacaaaguuccugcccucagcggguugacacacuugugggggagaaaggcaacaaaagcuuaagcaaguaaaugcauaauuuuacagggugauaugugcuaaaaacuaaauaaagcaagguggaggaauaacaagacuggcgggggugcuggcugggguggcuauuugagaaaugagggccaggcauggccuuucagaggagaugauguuggagcugaaucccaaguggucagaaggagcaaggugggaaaauauuugagcaagaugggaaaauauuucaguuccugggucaaaaguaacaguaaguguaaagaucuugagaugggggcugggcacuguggcucacaccuguaaucccagcuguuugggaggccaaggugggcagaucaugaggucaggaguucgagaccagcuugaccaauauggugaaaaccugucucuacuaaaaauacaaaaauuagcugggugugguggcaggcgcuuguaaucccagcuacucaggaggcugaggcaggagaauugcuugaacccgggaggcggagguugcagugaaccgagauugugccacugcacugcagccuaggcgacagagcgagacucugucucaaaaaaaaaaaaaaaaagaucuugagaugagaaugaacuggguuuuugugaaaauggcaaauggcauuuuggguacugcaagccuuugcggcucggaacugugcugugcacugugggacuguguggcucaaugcgggacgguuagcaucccuagucacugucauuacaaaaacagucacacauucuagacacccacugcccgccccaacgccaagggggcaguacugccuucaaccaggaccccaaaagacuccaguguggcaguuguuggggagggggaaugugagaggggcaguggagagggagucagcaagcagguucucugagcccuggugagaagucuggauuuuauuuuaagccgccugagugaugugauuucauacauguuuuuaaaagaucacucugguuauuccuugcagacaguggaagagugagccaaguuaggaggcuauugcaguaguucagguaagagaugaugguggcuuagacugagagagaaucuacuugaggguaagaagugaucugauucaggguauauguugaaagauuugcuaauuaauuaaauaugggaggcaaaagaagguggagaaaucaggauggcuccuagguuucuuauaaggagcuaggaagaauguaaagaaaucauaugauaaggagauauaaaaaggaauaaaauaauauuucacacuuaaauuuaggagacgaaauauuugcuuauuugaauuugaaaauucuuguggauaccaauauugauacuuugucugaaaaauaauuuuaagaugagucuccuggccaggcgggguggcucaugccuguaaucccagcacuuugggaggcugagucagguggaucaccugaggucaggaguuugagaccagccugaccaacauggugaaaccccaucucuacuaaaaaugcaaaaauuagccggguaugguggugcacaccuguaauccuagcuacucgggagguugaggcacaagaaucacuugaaccugggagguagagguugcagugagccaagaucgugccacugcaagccagccugggcgacagaacaagacuccaucugggaaaaaaaaaaaagaugagucugccaaaauguuucucauuuggaagggauucaugacuuugccagaaaaacaagcagcauucuauaguuauaaugcucuaugauguaauuuacuggaccuaaguuggcuaccuuucaugaugcauauuaaguguggagccauauuucuuaguuucuguuauaaagcuaaacuguuaagucauuuuuauuccuauaaagucaaacaaacuagccauggauacuuuuuaacauucugugaaaccaacuuuauccaguuucugaaauggaugccaguucuuuuuuuuuuuuuuugagauggagucuugcucugucccccaggcuggagugcagugguacgaucucugaucacugcaaccuccgccucccggguucacgccauucuucugccucagccucuugaguagcugggacuacaggcgccugccaccacgccuggcuaauuuuuuguauuuuuaguagagacgggguuucacuguguuggccaggauggucuugaucuccugaccuggugauccacccaccucggccucccaaagugcugggauuacaggccugagccacugugccuggcuggaugccaguacuuuuuaaaccaaaguuaaaauaauuauuuauaggaagcaguugugcacuguagauuaggaacauggagacuggggcauaaauauauucuugagcuagaauuaaaguaaaacaugugacugauggaaauaacagcucucccugugcccuaccauggaacuugguaagccuuuguuaacucacuggcacugcuagaucaugcuaugguccccgagggccagggaggcaagugugcuaguccaaguaaaaagcugauaugaucuuuguaugaacagaaacacuguuuguaaugugaugauaacguugguuucuugcuccugggauauuguguucuagguaaagugguccagagaccaauggguggcagauacagggauacagaggucaacuuaauauaaaaaaagaccuucucuaaugucuaagagcagagugaaagugagcaggccaucugaggagagagagacuucccuguuggcucaucaugaugcuuaagcagagccaaaaagcuacuugguagggaugucaaggaagugagucagguguuuucagcaccgcgacucugucauugugugccucucuccuuaauaccucagaauuagaauaaagucuugauaacaguaguggcaccaguccugugguuuguuuugcgaugacugugugguuguuaaacuuucuaagugaaacaccauagugucgggagcaaugccgacaagccuggccaccuuuggucuacagcagauauugcaagcugauaucccguggccacagucaggcuuggugauugauaaacauuuugauuuagggagcugcuuuuuucaagaaacagaaucacauaaacaggauuucaggccagucucaaaaaacuggaagauuucacagagccuugggcccacauuucuguguggcaucagagggcuagaggugaaugaguccuccucuccucuccucucccccuccuccccuccauuccccuccccuccccuuccccgcuccccuccuuuauuuuuuuuuuuuaugagacggagucucacugugucacccaggcuggagugcagugguguggucucaguucauugcaaccuccaucucccagguucaagccauucuccugccucagccuccugaguagcugggauuacaggugcaugccaccaugccuggcuaauuuuauauuuuuaguagagaugggcuuucaccauguuggccaggcuggucuugaacuugugaccucaggugauccgccugccucggccucccaaagugccgggauuacaggcaugagccaccaugcguggcuuuuuuuuuuuuuuuuuuuuuuuuuuuuuugagacagggucucuugcgcugucaccuaggcuggagugcagugagacaaacacagcucacugcagccuagaccugcuggguuuaagugauccuuacaucucagccuccugaguaccugggacuacaggugugcaucaccacaccuggcuaauuuuuaaauuuauuguagagacaacacuucacuauauuggcuggccuggucucaaauuccuugccucaagcgaucuucugccuuuacaucccaaagugcuggaauuacaggcaugaaccuucaccuuucuuuuagaaagagcgugaaucucuaauucaccagaguccccaccauuccaucucaucugaguuaucucacuaucucuguucuucccucauuuacaucaucugucacuuaccuguugacaugugaguuuugacuuuugauugagaugcugacacccuccuucccuucuaggaaaggaaaauaaagggggaaggaagguggagagggacaaaggagaggcguguggaggaugauagcgcaggacuugcauucucaguucugccucuuaaaucuuggaaccuauuucuucaucuaacaguauaggacugauguuuauuuuuguauuagaucauauauauaggaguaccuggcauauaacuuuguccaaaguacacauucuuuagcuggugcuccucuguguuccccuguaaagacugaggcaacuauaauguuccacuguucugugauuauugauuuucaggucuguuuccuccaccagauuaugugugucuuacucaacuuuguaucaccaagcaccuacguggcauuuuuucuuuuuugaagguagggaccauggcuuucucuuucuuuacuggacacuguauagaugucaugcaggucugaacgucacacuguuaaauaauuacuuaacaacugaccagaacuaaggcuguggucuagagcuccaaaccagaagcaaaaaggaauggugcugggcuggggcacuuuccucuaacaucacccaaacccagaaaacgaggaucguaagccccuucaugggccaaaugcagggcuggggcccuugggcuaacccuuuagugccucuggcugcaucacugucagaguaagguaaccagcaaggggcugcagggaacaaccagccagguccagacauggacaaacauaauuggaaggaagacaggaaauggacagguccuguccaguguagauaaaaugacagcagcuaaggcagguugaggggcagaggagaggcugggggaucgguauuguagcaaugcaggaguccuguccugaguggcugcucaggguauugacaugccauuuugauaaauacaugaauuaaugagugaguuucgagaguagggggagagagaauaacugggcauccccuucuguagauccucagucuucuagucuuaucucucuagaaggauauucacccauacucaccuuguccacuuugugccagaguugaacauucuuaagaaauuaagaaggugauucuuugccaaccauauuccaguucuuuauuuaggagcuauauuaucagcuuugcuuauggcuccagaaguggccauuaauaccuggagcuaaaacacuguuuugguuuagcaugacucuaguuuucacugaauauuuaguauuuuuaaguuagguuuuuuuguuguuguuguuuuuguuuuuguuuuguuugagacagugucucgcucuguugcccagacuggauugcaguggugugauuucagcucacugcagccuacacugccuggguucaagaaauucuugugccccagccaccugaguagcugggauuacaggcaugcgccaccacaccugguugauuuuuguauuuuuaguagagacaggguuuugccguguuugccaggcuggucuugaacuccuggccucaagugaucagccugccucggccuuucaaagugcugggauuacaggcaugagccaccgcaccuggccuaagguuaauuguuuuuauaagcaaauuauuuugcuuuugugacccaaagcaguacucucagauacuuaguguagcaauuuauuacucagauauauaacuuuuuacaaagagaaucauagcagaaaagaacaagguaacguguuguagggcauauguucugaaggagcacuugaccuuaucuucugacaucauguaaagauuuuggcauuuagugucaucaugugcaaccauuguuacuuuuugcuacuguaucauaauaauacuuagucguaucaguuugauuaaaugccuccuuuguaugguucccagcagcauggcuguagaaaguauucucaaauuuaucaggagacccaaguuuuaauucggauucccuuuguaaaaaggccuccauuacuggaggccaaauauaaaaacuuuuuuuuuuuugagacagagucuccuucugucuccuaggcuggagugcaguggcgcgaucucaguucacugcaaccuccgccucccagguucaagcgauucuccugccucagucucccaaguagcugggauuacaggcacgcaucaccaugccugguuaauuuuugguguuuuuaguagggacaggguuuugcuauguuggccaagcuggucucggacuccugagcuuaggcaauccgccugccuuggccucccaaagugcugagauuacaggcgugagccaccgugccuggccaaauauauaaaguuuaaaaauagcucgcuuguguucauugccuaccacauacuggguauugugcuagauauuuaauaugccagauagcauaugccucauuagccuaugaaguagaggcuuuuauuauuauuuccacuuacauagaugagaaaauugcagcacagauaaauuaauuugucuagcgauggaaccaaaaucucagucaggcagugugacuucaaagcuuguauugauagaaguucuccaagugcuuuaaauauauuaacucauucagacucaccaagcugugcauuuuuaguuuauagaguugauaucaguauuaaauaggaauauguauguguauguauuuauauauguaugcagauggucccugacuuaacgaugguucaucuuaaugauuuuuugacuuuauaauuauuuuuugacuuuauaauuuuuugacuuuauauaaaccauauuuugggugcccacacgucuauucuguuuuucacuuucaguacaccagucaacaaauuacaugagcuauucaacacuuuacuuuaaauaggcuuuguguuaggugauuuuugcccaaauauaggcuaauguaaguguuuugagcauguuuaagguaggugaggcuaaguaagcuguauuugauagguuaggcguauuaaauguauuuuugacuuaugauauuuuucaaacuaugauggguuuacuaggacauaaucucaucaucaguugaggagcaucuguauauguauguguuuagauagauauaauuagauaucuauauauaauagauucuaugcuaugggcauuguaaguucuaaauugcuucaguggcauuauuguacauucuuacauaagauugaagaauuuugugauuuugauuaauuuauauccuucaaagugaccaggaagguagaguuugcaugcagaaaauuugcauguauauuaauuccauaaauaauguuuguaguuaaauuuucauuuuguuuaaacauuuuuuacaagauagaguuuacucagugcuguuauuuagcagcuguguguaugacuucauaauuuagggggcugucuguuuuguguucuaagccacguggcugcuguggugacugcuuuagaaacuuucaguucccuuugcugugaaacagguuucagugcaucgucccuguguauaaggucagguuucuuacauggacucacucuguuucuguaaauuugucugagaauuuucaaggcagugcuuucauggccucuccucuaauuuuguguguguguguuugugugugucugugugugaugaugaaaaagucaaaagcccuaaaauuaaaucagaguuuaauccaugucccuaaacuagauaagcugcuuuagaccuuuuccuuaucccuuacacgucgcucaguaaauacuugcugauugacuuucaaauucagauuacuuuuacgcuagcauacggugggcacaaaggguuuuuuuguuuauuuguuuguuugagacggagucucgcucugucgccaggcuggagcgcaguggugcaaucucggcucacugcaaccuccucuuccuggguucgagcgauuccucgugccuuagccucccaaguagcugggacuacagacaagcgccaccacgcccagcugauuuuuguauuuuuaguaaagacgggguuucaccauguuggccaggaugcucaaaccccugaccucgcgauccgcccgccucggccucccaaagcgcugagauuacaggcgugagccaccgcuccuggccugggcacagaguuaaaaaaaaaauacugguaacagaaaacuuguuggcguguuucaguuuucagagucuucuauaaggucuuauaccagccgagaagcagcagaaccaucuguccguguaccgaggacggaucucagcagcucucuguucaguggcuccugccuuuguaguggauucccuugcugugcuguaauuaagucagccggcaggaguuccuguuuugagggggccucucccggcuggagaaguaccacugccuuuguguuaccugccauguuauuguggaguggauaauuuuuuuuuccugcaugggucuugguuuaacagcaggauccucugggcuucuuccaagaagcaccacauuucccugaaaauaaauggcagaugaauuauuucuugagauuaugaaaaucuguuagaugaaagcuugccuuuuucucauguucaaaacaaugcuaaaugcuuauaauuauacucccaaugaauuacuucuuucacuggcuuccuuugcucuggcaaagguggauuuuuuuuccauggcagagaaauuuuauaaaaaauguaauauuuuagaaaaugccuaaaugucaagaauacaacaucuuguuuguuguuguuguuguuguuuuguuuguuuuuugauacggagucucgcucugucgcccaggcuggagugcaguggcgcaaucucagcucaaugcaaccccgccucccggguucaagcaauucgcugccucagccucccgaguagccuccauugaaggaagugccauagugugggaggaucuuuuuauuuucuacgcgcaccguauuugauucuguguuuacaggaacugugucuguagacaaaaagcaaaauguugggguuuaguuucuucaggugaauaaaauguuacuugcaucuccucauugucacaguguucguauuacauacuucguguguguaguuuuggcauuuaaggaaacagagcuaaaaaaaaaacaaaggacaauaacugcaucaacaacauguuauacaccagaggaaaugcggcgacuuagguucugugaugggaaacccggauuuuuuuguuguacuugaaaucuuccguagaacguacguguuugcaugacccagaaaggaaaacacauuggaggacuuuguacuaguuccauucuaauucuguaaaauucucacaaauucaggcaucuguuaacccuucgagggcauauaaguucagagccauguuuucuguuuugugucuuucccuuuggcggagugguuaccuuuucugagcccuuggcuugcuuucugugaacauaaggcgcuccaucugccgcuuuaaagugaagauuuauaauucaaacaagacagcguuucgauguugcacuccugucuuauuagauaucaacuuaaaguuaagaaaauggaauuauucaaggccuuguuaucuaguuuauagcuuauucagaauuuauauuucugauuuuuuuuuguccugaugacugccugugacuaauuuguguuuuuguuauuaagcuaagauuguaugaaaaauauggcaaaaacaaaauucuauauuucuaaugccccaugagaaaucugauuuagaggcccuuccuuuggacacacuuuuuguuuuguuuuguuuuugagcggagucuugcucugucgcccaggcuggagugcaguggugcaaucucggcucacugcacccuccaccuccuggguucaagcgauucuccugccucagccucccgaguagcucggaguacaggcgcccgccacuacgcccagcuaauuuuucuauuuuuaguagaggugggguuucaccauguuggccaggcuggucucaaaccccuaaccuuaaaugauccauccgccucagccucccaaagugcugggauuacaggcgugagccaccgcgccuggccuggacacccauuuugaauagcacuuaccacagauucccgaagccagugguuuucuagccuuuuuauucgccguucguuguaagcuucuugagucuuggugauucuuguuucauuuguuuuuguuucuccccagagccuagcacauaguaggugacgaacaaauguucaucgaauguaugggcucaaccauagucuauuuuuuucaaaaagguauaaaucuuaucaauguuuuacauuuugcugaacaaaacaggagagagcggauucuuuucaaauaggaaaaauuagggagggaaaagagggauugacugaaacucuauugaaguaugucaacauaaaaguuuauugacagccuggcgugauggcucaggccuguaaucccagcacuuuaggaggccaaggugggcgggucacuagaggucaggaguucgagaccagccuggccaacauggugaaaccccgucucuauuaaaaauacaaaaauuagccaggugugguggcaggcgccuguacucugagcuacuggggaggcugagacaggagaaucgcuugaaccugggaggcagagguugcagugagcugagaucgugucaccacacuuccagccugggcaaaagagugagacucugucuaaaaaaaaaaaaaaaaaaaaaaaaaacaaaaaaccccaccuaucuauccuaucuaucuaucuaucuaucuaucuaucuaucuauuggucuaucuaucuagauaaaaauagcagucaacuaauuuuucaaauuaaaaaugcuuuauuguuauuuauagcaugauuguuuuucuauaaaaaaggcauauuacaacagccuucgcuucacaucugacucuugcagcauucuuauaaagagaucucacaccauauuugagggcuucauuaguuuucuaagccuuaaaaaaauuucaucauuaagauuauucucucaugaagcacccaaaauauagacagcuuuucuuauuuucuuuucuucaauuguugacagucuaaugcugccagaucuuuaucugucagggacuuuugauguuguuggagccaucucuuguggacuuuaugaaaucuugcaugcagcacaauuugaaacuucauugugcauucaauuugcauugccuuugcuguguucacaguggcacuccaugaggcuuaacuauggagauccuggugcuacaagccguuaaauaguucucucuucucaaccuauuccccuauccugcuuuucuuuucuucauagcacuuauuaccuccugauuauauuuuuuguuugccuuuugucuaucaccugucauucuuuuaccagaccaucuagucucauaugucuauauaaccuuucugaaaaacauccugugggaaauauaccauauauacagaaaaagugcacaaacaugaauauacaguuuaacaaauaauauaaaccugcuauucauguagccaccacccagaugaaggaaauagaauaucauaagcaccgcacaaucuccauuugugcccuucuccaucguagcuuucucugucccagacaaccauuguccacaacuuguuguaauaauuuacuuaauuuucuuuuauaguuuuaucacacauaauuuaguuuuugucugcuuuuugaacuuuacaugaauggaauaauauugcauauauuauuuaaugcuuuuucuuucauuuaacauuuuuuuuugugugugugugagauucuccagguuguuguacacagugcuaguuauuucauuuuguuaugguauaguaucccauuguaugauuguaccacaguuuauccauuuuuuaguugauggguuuugacuugcuuucauuguuugggcuauuaugaauagugcugcucugcaccuguuguacauauagccuggugaacauguuugcgaauuucuaugagcgugaucacggugguguagaauugccaaucuucaaccugccuguauuuuccaaagcgaucauaccaauuuauuuaccuuccagcaguguaugagaauucucuauucucaccaucauuggauauugucagauuuuaacauuuggcucaacugauggguguauaaugguauccuaugguacuuauaauuugcauuaucccuaguuacuaauaagcuugagcaauuuuucauauuuuuauuucgauuuccuaauuuaugaaaugccuguuuaagucuucagccauuucaaauguuaccugucuuuucaaaaugaucuauaggaguucuuuguauaauauauauucuggccccuaguccuuuauucuuuguauguguugcaaauaucuucaucucugcaguuuacucuuuuugugguguccuuugauaaaauucucaauuuggugaauguaauugaauuuauuaauuuuucucuuuguuauguauuuuugugucuuuaagaaauuuuucccuauguagggaagaaggacaaaaauugucuuucauaauuaguucuuuaacccuucauaacuuugaguauauaaauuauugugaccaucuuugaaucuacaguaguugaauugcauauauagaggcuugaguucuuaaauuauucuuuccagggugaauauuagcauaucacaauaggacaguagggacaguggcuuuuucgcuaaugaaaucuaagauuuuuccuuuucugcucaugaaaaauguuucugcuuaaauuguaaugaguguacaagaggcauaaauccacaguggguacaaaugucaaagauuaugguuuaaaccagcaaaauaugucuucuuagauauacgaaacauuuugucaaauagccccuggcaucaucugggcuaaaugaagaaucaccaggacaugugauacagugaaacuauuccacuuauaguaacagcacuuaguaauugcuuucauuaauccaggcagguuaauauucuaucuacuugcauaacaaugucaaaaaaucuauuaucuacugaaaccuuuuauauagcaaguuaagcuccuauuucuuucauaaagauugagauucaaauauuaauccaaacuacucagaaucacuuucucuuccucacuuuucugauacccccacuggagagugacugaucagugcauuaucugucaccucagagcucagagugccccucuuuucuauucaaauacaaagccauucauuuacuuugauggacaaauagccguggcauuaguauggguaggggcaagugcuguugucucuuaucuaggaaggaguugguucuuuucugaugguugaauaauauacuuagguauagaaagagaccugagugucuugaaagcaacauucuuucauuuuugucaauguuuuaaucagcaccccugugcauauauuaucuuugcauauuucagcacuuuguauuagacuucuacauguuguggucuuugcuucugauaagggacagaauaaauaggaagaaagaauaaaaaagccauaauguuaaguacauccauuccaugcccauagccauacaucacagaagucacagggaaggcucugugacacgagauaaugauguggaugugacagaacaugguagaggaaaaggccacagacaggugcagaguaggaagaaugaaagaauucauuguggcugucaaaauccuauguuuguguucccaaauccuauuucuuuuuucuuuugacuugugauguauugacugucaauuaguuaucagguacuauguucagcccaguuauugcacaagagauccugaaaaucuuuaaguagcuccuggacuuggaagagggaaggaaggaggagacacuaaaauaauuacaauauguuacuauuauacaugacaauaugcagaaugcauuuggaacauagccaauaacuuuacacagagauagcaguuuuugagcugaauuuuagaggaccaaguugauagaauuugaugaucagaugagggguuagggagaggaagucuuucaguuuauuuuaaggcuggagugaauauuauuuuuguaaaugcaggauuuuaaggaaaaggacaaaaugccagaagacagcagauuucuauuuucuguauauuuguacaucaugacaauacauuuauagauacacuaauucuuguacauaaauaauucauauaauguuugucuuuaucagucugaauugucagcuuuggucauagggaauuggaaccaaguguuuacugagcaucuacuauaugugaggcacuauauuaggugcugggcaugcagugaugagcaaaacagggauggguccagcucuuauagaacuuagaguugagugggaaaaacagaauuaaucaaauuuccauauuuauaauuagaaaugacauauacauaugaacaaaggcucucucagaacccaauuauucuucccuuucacucuucuuccuaaucauacuaccagcguuaaguugacaguuauuuaucaggcauauuuagcagccagccuuacaguuuucucuugcacacuguuaacaauuacugucacauggucacuguuacauguuagccaauagugccucacauucacuguggcuuccaaagcuugggcuuggggaagcagguggauggugauaucaugagcucagauagagaucaugggagaagagauuugagauguuuuaaaaaaguguuuugagcagaugaaguuaaagaguuaaagggaacuauggucaaguggaggugcugguaggcagguggaaauauacuucugaaucucaggaugacuaaugaaaagcaagaaaaugaacaacaagggacuauuaauguguguuaugcugugcuuaugcauuuugucugguuucaaaucauuguauuuaaguaguucuuaaagucacaggagugaaugagauuaaguagaggaagaaggaaaagagguacagauggagaccuagggagugccaggccucagagcagacagaggaagggcacgcagugacagagcccacgaaguguggccagagagcagugaugaggaggauuaccgaguggcucauggaaaccagcguggaagcuuucuuauuucuucuucuccuucugcuucucuuucucccuuccuccuuuccucccucccucccucccucccucccuuccuuccuuccuucuccuccuccuucuccuuccucuucuucuuccuccuccuccucuucuucuucuuucucuucuucuuccuucuuccuccuuccuccuccuucuucuuccuuuuucuuuuuugagacagucuugcucugucacccaggcuggaauguagugguaugaucauagcucacugcagccucgaccuccccaggcuuaggugauccucucaccuuagccucccgaggagcuaagaccauaggugugagccaccaugcccagcuaauguuuuaauuuuuguagacaugggaccucccuauguugcccaggcuaaucuugaacucaagugauccuccugccucagcuucccaaagugcugggauuacauauaugagccacugugcccggcugugggaagcuuucaagaacaagagagaccaauguugccagacaggccaaguaauauuaggacuggaaagcagcuagauugagagacucacaggaacaagaacagagaauucugaauucuaaaauccacaacgcucauuucacugaaaggucguucagguggcggugguggauuuuuuucccuuagccgucauuuuggauauuugauuaauuaucgaccauuauauuuccuucuucuuguuaguuacgauuuacuaagaagaauuuuuaugcuauuuuaaaguuaaaugaucugugauuguaaaaucauucauuauuuaccucaacugcucacuuaauuuuuuaaaaacaucuucaaggcuccuucagaguuuuuauguugauaauuuuaaaaaaucuuuuucaaguuuucuagaaacaugaauaaguacacaauaauuuaguuaaugugggcaguaaauacacaguugugauagugaaaugucuucuaugaacuagaaaauaagaaaauagacacuuaaaguucagaguagagaaggaaacucaaagagacagaaugguuccagggcagccuaacuguacaguacccuuaagaaaaguauucguaucuauaucucuacugcaguaggccaagugcuguggcacacgccuaaaauuguagcacuuugggaggcugaagugggaggacugcuugagccuagguguuugaggccagcccuagcaauauagggagaccccccaucucuacaaaaaauaagaaaaauuagucagaugugguggugcacaccuguggucccagcugcuugggaggcugaggugggaggaucacuugagucugggagguugaggcuacagugagccgugaugacaccaucacacucuagccugggugacagagcgagacuccgucuccaaaaaaaaaagaaucugagaagcagauacuggccauauucacugaggugcuaagcaggggugggcacccugccuggcucuguaguggucauuucugacaggccuguguuguggagacagacacacuagguuuucagagucugaugcaguuacauucgaauuaggcaaaucucauacugauucugauuccauguuccccgcaacaggcacccgguaaacuggcuuucuggagagucugccuuugagcagagaaugugauuuucccacuguccuucucugaccucucggcaguuauacaauucuuauuguaaaauaaagcucuauucugguuuugugcaucagucuccuguggguuuaauucacaugcaagagcguccucgagccugaaugagccuggaauggaauacaguuucccagcccaugaaucaugaccugaaucaugucaaauucaccaaguuaugcucccuuuuaaggucacuuggcagacaggcagguaggaacuuuccuggugaacccucccuguaugaccaugcagcuuuccacugggaacuuuuacagguugcugcuauuuuuauaaaaaugauagacuguaauguugccggggacaguggcucaugccuguaaucccagcaguuuaggaggcugaggugggagaaacacuugaggucaggaguuucagaccagccuaggcaacauggugaaacccugucucuacuaaaaauacaaaaauuagcuggacaugguggugcacaccuguauucccagcuccucaggaggauaaggcacgagaaucacuugaacccgggagguagagguuacagugagccgagaucacgucacuguacuccacccugggugacgaagugaggcucugucuccaaaaaaaaaaaagaguucuguaauuguaaaaaugugacauaggcauucucuaaugugcaaugaauagucauuuuuaagcauuucauacauuguuccuguacugcacugggucuccuugugcugaacugcaugggauaggccauuuccauacaaucucauccucugaauaaggaaccaugaugcuccuaaagacauacuaaauauagaucuuggguaauauuggagucagugcuggucaucaaugauuuucucugugaugauagaggggguccacuaugaaugauagcauuaauuuugcuguauguucuugcaucauugguacauaauaauucauagacuucauaaguuauuaauauacaaguuacagaauuuaauaauguaacccaccuuugauauguuuucauauacauuauggggaaaccauauuuuuuugaagucaagaaauguauauugcuucauguugcaaaauuuguaugcuaugucaaagaagcauugccagaaaaugaucugaaauguagaacaauaaaguuacauuauagaugucuuaggugaaccaagagaaaaauuagugucagaguuaaaaagaugcaagucaggaauuaaggcaaaacauugacccuaucugacuuaggagaauucuggucaugugaucuuaagaagagagaguaacugacaguucuggagacugggaaguccaaaucaaggcaucagcagauucagugucuggugggagcuugcugucugcuucacagauggugccuucuuauggcauccucacauggugaaagggaacaaacagccucccucaagccuuuuuuguaagggcacuaaucccauucaugaaggcagagcaccuacuuguaauacuaucguauucguucguucucaugcugcuaauaaagacauacccacgacuggguaauuuauuuaauggacuugcaguuccagguggcugcggaggccucacagucauggcagaaggugaaggaagaccaaagguacaucuuacauggcagcaggcaagagggugugugcaggagaacuccccuuuauaaaaccaucagaucucaugagacuuacucacuaucaugagaauggcaugggaaagaccuguccccaugauucaauuaccuuccaccgggucccuccuacaacacaugggaauuaugggagcuacaauucaagaugagauuuggguggggacacagccaaacuguaucaacuaucauaccucuuaauacuaucacauuggauuuuagguuccaacauacaaauuuugggaggacaugaacaucuggacaguagcaaugcuaguccauuauucuggucugucugaagguuuuaucuaggcagggaaaagcguauguuuuuuccuugaccuugaaaauuuagcuugggcuuucuuuguacaaacaugaagauccuaggagaagcccaaucaauuuuagagagacaaguggaugaagauagggauuaaaagaauugugcuugacugagcagagagacugaugaucugaaaggacaccagguaaaauguuucuuuuuagcuuuacaaaugcacugcuuguuaacaucuaugaauucauguacuugcuuuuccaugcuauagacggguaacuuccagggcugcuguguggcacaaguuuggggaguagggauggaaaugguacccuuaaaguuaugcagugcagaccugcacaaccugacacaggggccuugggucaguccaugucggugaguguaugauacucugauaucuuaaaaaaaaauaacauaagaaucuguaggcucuuguucaaagauauugcagagacaagaaccccuuccacagguaaagaaggcacgugagacucauggcaaauucauugacucuucuguccgagcauuuucuugucauuuucauuauagcccuuccuuguaaucuuaacaucaaugguacccugcuucuuagcaauuuugauaaaucuuuguauuucagcaaauacuugaaaaaaauguaggauccacuggcuuauaucuucuguguaggcaucaaaacagaugguggugggguuguugggaagaugguagcagacaggguugcuuaaaaauauaagacuuccuugauguccaagaauacugagauuuauaugauuagaaauuucuauacaaagcuggaaacaguggagcauguucccacauagaagcacagguucccagcucccccagaggcccucauacagagcugcagcugccugugauggagccugcacagauucuuccaguagacagucacuuuccuucuuucuuggcagucuugugcccugacagcccuucugauggcucuggagccucuggcugccugccuuccuacucaccaggugcaacuuguuaauuacuugcaugcaauaugaucacuggauuaugguacagcuuuggcuaaaucacuuacauuuuucauucuuauuaauuuggagacaugcacgugccaacccaaguacaauaaauggcacacuguuuauugcaagcacuaaauagauacaucgaagguuauguucucaggcaucccuagcuuauaaguguacauuauguugauuugauauugggugaugaccaaacacaguuggucaaauccucccucugggaguuggagagacauagaaggaaaggaacagaaaugccaguggugauaacagggacagcagaaggaagaggagcagggacugaaagccacugagucagaguacacugaggcauaugagcaauaccugaguggaaucugugguugcagggcaucccuaccucugccugcacaucugcuucuuucuucccuacccccaguuucccuuuuucuccuucccuguggccauaguggaagauggaggcuucacaguuccugagacuagaugucuucaguucaagcagucagcagagacuuguuuuuuuguuguuguuguuuuuuguuuuuguuuuuugagacagagucucgcugugucucccaggcuggaguguaguggcgcguucucagcucacugcaaccucugccucccggguucacgugauucuccugccucagacuccugaguagcugggacuacaggcacacgcuaccaugccuggccaauuuuuguauuuuuaguagagaugggguuucgccauguugcccaggcuggucuugaacuccugaccucaggugauccaccugccuuggccucccaaagugcugggauuacaggcagagacuaguuuuuuuuaacuuuuuuuuuuuuuuaacagucuugcucugucacauaggcuggugugccauggcaugaucauagcucacuuuaaccuugaacuccugggcucaagugauccucccgucuuagccucccaaguaccuagggcuacaggugcaugccaccaugcucagcuaauuuucuugccaugaugcugaggcuagucuugaacuccuggccucaagugauccuccugccucagcuucccaaaguguugggauuacaggcgugagccaaugcaccuggcugaggcugguauuuucaaauuucaauucuagcugucagggagagagaaauugauuggcccaccagggaccagguguuugcuucugguccauucuucuauaaccagggagacauuuauauauauaaacuuggcugcugaggcccaacccucaaaacauagagauuugagcaacauuagaauaaauucuuuuauuuauggaauuauuucuauaggcauaugucauaaccuuuuauuuucuuuuuaagaaaucaagucuacuuaauaugauaauaauauagucaaagaaguacacagccacguauggcuggauuugauuucuuauccaauagcuggaucugagaaaagguuguucaguuacauuccagaagcuucaguagcaaaacugcucuuuuuucccccaacuuuuacuuuauauucagaggguacaugugcagguuuuuuacugagguauaucgugucaugcugagguuuuggguaugaauggucccaucacccagacacugagcauaguauacaguaguuuuucaacccuugcucuccucucucccucucaccucuaggcaucccuagugccuaguauugccaucuuuauguccauaaguaccugauguguagcucucauuuguaagugagaacauacgguauuuguuuuucuuuuccugcauuucuuugcuuagaauaauggccuccagcugcaucuauguugcugcaaaggacaugauuuugauuuuuuauggcugcauagaauuccaugguguuuauauaccacauuuucuuuauccaagccacuguugaugggaaccuaaauugauucugugucuuugcuauugugaauagugcugcgauaaacaugugagugcccuugucuuuuugguauuaauagagugguuuguuuucuuacggauauauaccugaaacuauucuuguuaagugagucaacaaggcccaccuggcagaagaggaaacccaagaacauuaaaucaguuaagauggaggccaaggcggguggaucacuggagcucacgaauucaagaccagcuugggcaacauggcgaaaguucaucucuacaaaaaauacaaaacuagccaggcaugauggcgugcaccuguagucacagcuacucaggaggcugaggugggaggcuggcuugggucugggaggcagagguugcagugagccaagauugugccucugcacuccagccugggugauagagccagacuuuguauauauauguguguguacauauauauauauguguguguguguguguauauauguaauacauauauauuacauaucuaauauauauaauauauauguaauaaacaucauguauauaugauguuuauuagcccuccaaugcuugaaaucagggguuggaaucaaggcuaaccaacucuggucuggucaccaucacugaaugcuugcgguagccaugugaacauuguuuauugucguauacuccugggagagucccagggaugagcuuuuauaaaguugcagacgggaaagggacucucacuuuggagagaauuaagcaugucacccaguugccuaacaaguuauugcugugcaggcaaaaaacagacaaaagacucacccaacucuaagauuuuuuugauggacuucucuaaguucauuaugauaaaguuaauauuaugauuuuuccaguucucaauauuuugggucuaacccuuuuuuuauuacuuuauguauauguucugggcuccguagacucucuggagugacaagaaaaucuugaaaaauaaaaggcgaggucuauuggagagcuguucguggaugauucugauacgugcucuugguuaagaaucacugcucugguuuucuucccagugccucuuacccaccacuguuagaucaguucuuuaaacaccacuuaaacucccacuuuugucagcaaccuccucuugacagucaagcuccuuagucuggcauguagcacucaccauuacuuggugugaguccugaauucugagcagccagugucuccuuaucugucacauucguacucauuuuuaugacuuugcaggucuugcugaaaauucuuccuuaacuugccuugagaaccaccuuuuccaccaagcauucccaaugaauguagcucgugguguucuuuccuuccaaauuccuguucucuuaucucuacugcuuauaacccaauacuugacuauauauugucuuguauaaaugaagucuuuucuaucaaaguagauguucauuuucuuaggaggaggaaugucuuugguauccuguacaaaaucuagcauagccugguacucaaagucaccuuaaucauacacuaaaugguaucuuuauugauggguugucgauaaaccuccugcuuuauccuguauccaauuaaaaugaucccucgucaguuuuuccucugauucaaacauuuuaccccacauuguuucugcaauuagacagaaaaauaagcaucugugaagucaaccuuuuugcuuuuuuuacucugaagugcugcuuuuuuuuuucaguaaguugugguuuuaaaaaaauccaguuauuugaaugacauuuauuauuuuugcaguuaauaaauguauuuuaaguuuuuaaauccacaguguagauaaggcccuagaagcaaguguagacuucguccacagcuguacuccaucggccacugacagucuuauugcauuauuucaacggcacaagcaaucauuuacacuuguuauuacccaggggcauuucaaacuguuacugaaaugcauccaucccuggaguaaccaucugugaaugguaaugccauaagguagagagacuaaaucuaauugauaugcaaaaaggagaauuucagcuguccagcuauggagauucaaauugaaccuuuaauaggcugaggauuucagcuaaauuuuuaaaaucaugauaucuaguucaggcacucaucuuuuagguuucucacagauuaaaguacagccgucuuccuugaaguaagaacaucucaaagucaaaaauacuuguuuauuguaaaacaaaaugcuacagagaaaggaaaguucuuguaaaauacaaagagaucgcuuuuguugcuauauaauagcaaagcagcugcaccuuuccuugguuuuuacacuuguuugugccucaaauugccugaaagaaaaaaagggaaaauaagaaaaugcuuucagauuucaguugcauuaaaacauaaaaaaaauugggagcaacauuuguuaagauauuaagauauagucauuuacauuaagugguuuuauaaaagugauuuauaaucuuuuaaaguuaucucccccuuucuuaugacacguaacccuaaaagagccauuuaaauuagcugucaggcaagauguaccaggccuuuccagugaucccagcccaccuggacauaucuagcaauucugcagaccagcacauacuucuggaaagauguugcauggugauuuauagaucuguguggacacauaacaccuuuacaauggagugaggucuugaaauagcccugcuguugcugcccauugagagauaaguauucuccugagguauuccccaacagcuggaaaugaaguagcagcucuugucagucugugacaggaguggauuaucagacauuuguaaagagacaacagcagaaucaggccuuuuugcaauaaaauugcacacauagauauuauugcuccuccagcguuucauaugcagugucaaggcacgcuacaguucaggcagcaggcaagcagcucuguuugaauggugggacaaacauaccucugugugugaggugccugcacuugcccugcuuugucagggaggacacaaugccacuuucucugcuccucagcauagcucaauuccagcucccgggaugaauuaauaaagagauauagccgagggcagucuuaguuggggcucagguuaccagcugucacauuacugaaaucucaggauaugcuuacaguaauugaaggaaagcacauuaggguuauauugacucagaaugaggcacucucugggagaucaccgugaacagcauuuugggagcaaccuagaucauuuccccuaaaauucugacauuugcuuuuuggucuucugggcuccagguacuuauuacucuuuccugaagagcuguuaacuggcugucaaguuuacauuuugaaauagugccaugauggcaucccuaugcuugguauuauuuaccccacggaggagauguguguauugcagaacacucauguuuagaucagccaagagaacugcuuggaacaauccuagaagcaggcaaagcugcauuuuauguucuucauauauuauuugaaaauuacuaguggucaagaaacauuccaacuguuugaauucuccucuccaaacaggaaaauucuguaaaauuguuuuucauauauauauguauaacacacauacauuuuauaacacauacauacacauauaagcauauacuaaaugaguuaguaaauauacaacacuuugaacuguugccugggauauaauuacuggcauaauuacaugugcucguuauuauuuuucuaaaucaaaggucugguuuucauaggcuuaaaaaauaauaaaauuggauguuaaugguacaaguuuugaaaauauuugauauugauucaggagaugaaacugucuagaaauuacucuugucuauuauaauuaaguccagagucuuauuuucagagauaaguacuugaucccuacuuuugugugucaauuugaauuuaauuuuuuaaugcaugucuuuuaauacuacccuuuauuauagaugcagacguuaaugaagaauccagucccauuuguacaaaugccaaggaguuuacccucuauugaagggaugaaauguugguagagcaaaugcagguguauuauuaugauuacuuuuggauacuuuguauuaacaaauuuucagacacauuccuaaagauucuggggggcuggagcaagcaggcaaacagagguccacauacucuauguguaaauacuaaaagugaucaaucaagggugcucuccacccuuucugcuucuucuggaagcuaccaagauuccugggugcccaaggauaccuguugggugguugcaggggccaccuaaccccaaauuuccuugccaccauucccuucauccucucagcaugacagcugguuuccuacuuuuccucuucuucccccuuuuuucugucuuuggccaaagcuuagugaauuuuaccuuagagauuuuacuuuuaaccuauucccauauuuuaaauguuuccacguauucacugcagugugcugaugguuggaggugguaauacaguuucuugguuaagguguggucuuuggaauuugacugccuguuuagguccuggcuccccacuauuagcugugagacccugggcaaauuacuuaacuuuucuguggcucagguuccagauguaaaaugaaauuuuuaaaaaagcaacaccuuuaaguuuucuuaagaauuaaaugaggcugggcucaguggcucacaccuguaaucccagcacuuugggaggcuuacacaggacgauaauuugagccuagggguuuuuuuuuucuuuuuuuuuuuuuuuugagauggaguuucacucuuguugcccaggcuggagugcaguggugcaaucucagcucgcugcaaccuccgccucccggguucaagcgauucuccugccucagccuccugaguagcugggauuacaggcgcccacccccaugcccggcugauuuuuguacuuuuuaaguagagacaggguuuugccauguuggccaggcuggucuugaacuucugaccuccagugaucugcccaccuuggccucccaaagugcugggauuacaggcgugagccaccgugccuggcccaagcccaggaauugagaucagccugggcgacacggugagacccugccuguauaaaaaagaaaaauuuaaaaauuuaaaauaaaaaaaaauuaagugaguuaauauguggaaagaauaccucugguauauaggaaacacucaacaaauauuagcuauucuuuuucuuggaacucugaagguggcagacuugcucccucuuccuguguggagagaagcccauguacuuuauuuguggacagucaucugugauucucaugaauggcuuugcuuccuucucauguggcuuucacacuuaugcagagcuuuguuagaaccucugcugcauccugcagugugaaauuuacauucccaccucuccaucuccauugguuugugagcccuucaaaggcaaaaauuguguucuuugguuuuguuuuccuagggccuugcacagcacuugccacucuugauuaagcaugcuuaagaaaugcuuguugagugagugcgugaaaggggggccaauaacuuguaugguuauuuguacgccaucaaacuuuuuuuuuugagauggagucucgcucugucgcccaggcuggaaugcaguggcacaaucucagcgcacugcaaccuccgcuucccggguucaggcaauacucuugccucagccucccgaguagcuggaauuacagucgcgcaccaccaugcccagcuaauuuuuguauuuuuaauagagacgggguuucaucacguuggcuaggcuggucucgaacuucugaccucaugugauccacccaccuuggccucccaaagugcugauuuacaggcgugagccaccgcaccuggcucaucaaacguuugauuuaucgguuuccuagcauauaaacuagcugcgaagauguguauuuuuuugagaagccauguggagagaguaggggacacagaaucugcucuucaggcaugcugacagcaaaaagugacuacuaguaggccaugagggauggaagagagaaauacuauaaaaagcauaguugucuggggcuauuuaaggaagacacaauaacacacugcacaucccaggaccccuuucaggcaucacuauaauagcaugguguaagaacuguguccucucaguccuguucagcuucagccacuacuauccuuugucuauuaauacagcaccaaccacuuggucccaaaggaacguucuggcgagaaaugugcagagagaaucaguucgccagcaggugcgauucuggaauuguuuggcugccagagacccgguauuugguguguccgucauuacuggguguuuguguccccaagccagagucaucauguugaccauccuccugaacuggggcucugguuggauucccaccuguuuaccuggugccuuaacguucuucuccacuuaucuugccauacccuuccuggagaggaaagaagacaauuaauuucuaccuguaguuuggguucuccuucaagagaaauuacaaaacugccugccuuggacccagagcuuuccuucuuuaggaugguuugggccugacagccugagguuugaaucuggucuccaccauuuccuaguucauauucacucucagcaaauauuuaacucucuaagccucaaauuucucacccacaaaauagggauaauaauauccuguuguugugcccuuagaugacgcauauggcaucuaacacauacuuagcaugugguuuagucuggcacauacuuaguauucagcaaaugguagcugcuaccccucccacggccaugucccagcuacuggaauagcucacucuggauauuguucacuucuggaaccaagcccaccuuugccaggcagccucggcuaaucccuuagagauguccccacagcaagggaaucucugcuagcaugccuuccauggccuguuuugacaagauguuuauaauucuccagguuguuaagaaaagguuuuaucuuuaaaauguaaagccaucguuagcuaagcuagcuuaaaaauucuauuguauacuuuagaaauauuuccacaaauauggcuaaaauaaauguaaccacucuuggagaggcaauguucauuuaucuugaaauggaagugccucacuuuuuuuuuuuuaauggagccucaauacagucugaaaaccagguggaaaguguuuuucaguaucaagugugguaaauaagagcuaacugauucaaauuacuuuuauuccuuaucaucugauaugaaaaucugaaucaucuugaaauacaguggugccccuuaaaauugcuuuucugucuuauauucauucauucaugcagcaauuuaggguuuauuauauacaagguaguaagguggguagauauuccuguuugugacuguugaaacauuuuuuauuaaguuucagguaucauacacacauacacagauacacacauguguguuuuguuuuuuccccucuuauuaaaacuuaacacaugaagguagauaauauuucaauuguacuuaagcacuaucuaaauuugcuuuaugugcagcaagacuaugauauaaccuuguaaauaucuaacuucauuaaaaacacacauuuauacagaauagguuaacucuguggcucucugagcaauaucuuaaccuuuagucuggaagccuuaaugacacacuaauaucuaauauugccuauaacuucuucagauccggaaagaaaagugauauaaaugucauuaugucuugagacucaccuaaaugcaaucuuuaacaugacuuacugagcccccaacaugguaaaagaucuuagccugaaaacacuccuugucaaaucauugcccaucauagugcugaguaguaaucucuccaggcugaaagauggcaugccguauaacaaaugaaagggagcugacacuagaaagaacauuagugaaaucaauaugauucaaccagagacacagacuccguuaaugguaugucaauaugaccaauuauuuccacagcacugacaucaugauuguauuuuuuucuucaucuuuaggagagaacaguuuuacuuaaccguaauuguugaauuauagccauuggccgagaaagucuuggauguuuuacauuguuaucguuaccaguuucaauuugucuuuauuugauaucuaaacuccugaucauaacuuaccauaguuugaagguuaagaucaauaaaguggaccaaacauucagugaauugugaauucuagaaaugccugaugguauccacugcccagggaauaagauguaauggaagcaggcagaacuugaagagcaaucagagauuguaaauauaaucagaauugaauucauauaguuauuuuguuaauuucugcuuccucaacuagacuguaagcuucuuaagugcagggaaguauauauuuuacuugucauuguauuugucauucuaugccaugucuaucaccuggcauagaaggcacuggaugaauauuuuuugaauaauuuucuaacuuuucaugaauuuuuguucaauuuucucauauugggaagcugccaguuuuagaguuauaccaacacugccauaauaaaaaaaagcugucaagaucaggaaacugcagauacuuucgcagguuccagaaccagcaaaggaaugccccuuaccauacccgucagcacccaugaaguaagggaauggacacugcaacuucugguagcaccaucacagagaagggaagugccuucgugagcaggcuugauggcagcaacagccaucccucggucucacaucccccuuuguaaucccacaggcaugugucugauugguggauucuaaaccacccucagaaauguagcugcaaaggaguaugaaaugugcagguuuuaauauuccagccucugcuggaaagaaggcuuacagaaagaaguuggaauggauguugagugccaaucuacuguaucuauucuacuuccuuaaagcuuacauuccauuaacagucuuuggaagaauguaauauaggcgaagauuuuucagugccaaaaaauaacugacauggauaaaugacaugaggcagugauuaaguaugggcuccagagugaugcugucugaagucaaauccucuuccaccucuaugggaauccauuuccauaucuauaaaauggguaucaucuuucuucaaaauauggcuuugaggaauaaauaagaaaaacaguacgauaugccuagcagagugccuggcuaaugguaauucaucaauagagguuagcuauuauacuuccaauccuuauucuucaaauuuuuguuuuccuggcaggaaacggagauucuuuaauuaaaaauuaaaauuugagguuggguaugguggcucaugccuguaaacccagcauuuuggcagaccgaggcaggaggaucgcuugaauucaggaguuugagaccagccugggcaacauagcaagaccuugcucugcuaaaaacaaacaaaaaaauuagccaggcguagugauaugugccuguggucccagcuacucaggaggcugaggcaggaggauugcuugaguuugggagguggaggcugcagugagcuaugauugugccauugcacuccagacugggagacaaagugagacucugucuuaaaaaaauaaaaaauaaaaaauuugauauuuuauaauuuuaaauuaugguuuuaacauauuuaguugaaaaggacucuuccaaagccucaugaauaucucuuacacauguuaaaugauaacgcaggggucuugaguucugaggauuguuccaguauuucuacuugcuuuuuauuagcuccacaccuaagcaaccccaaauugagaacgauuuucauuauaauagauuuucauauaacauuuuauuauuuaauucuuccugccuucuuuucauuaauuuaugcagcauuugaggguuuauuauguacuaggguacugagguggauagguacuucuguuuuauuugaaugauauaaauucuuauuucuuuaauaauauuuuuauuauaagacuaauacauguuuauuguggagaauuugacaauaaacaaguguauagagaauaacauuaaaucaccuauaaucccacucuacagggcuguugguagcaaagugauauuuuccucuaguguuuuucuugcauauccuuacuuuuuaggaagacauuauguauucaguuugguauccugcuuguucacucaagacuguauuaugagcauguuucugugccauuaaauauucuuggaaaacauuuuaauggcuugauagucuuuuauuauaugaaauauaaaaauauaaaaauugcuguuucccguuuuccaguauuguagucaugucuuuggaacauagauucuggugcucaccaaauauuccauguggcccuuucuauuuccugccuuccuguuuuguugaguuagaaucaugagacugauaugagucaguggcccaugaacagaauccacuaguaccacucacaggccaauggucagaacccaagaccccugcguuaucauuucacauguguaagagauguucaugaagcuuuggacuagucuuuuucaacuaaauaugcuaaagccaaaauuaaaaacuaucaaauuucaaaauuuuuuuuuuauuuucuguuuuuuaagacagagucucacuuugucuuccaggcuggagugcagcagcacaaucauagcucacugcagccuccaucucccguguguuuccuuucuucccuucuucucuuagugaaacgaacuuagaaguggcauauggcgaaugucacagcuauaaguuggaggaggaacuaccagucuacuuucaacuuuaccuagacugauguugagucaaaucauugagacuuacagauuugucuauuauagcagcuuguguuaauuauccugauaauguauagaauguaucuuguuuaccaaugguauugauuuauuguuauauuuuuuaaggaaucuuugcaguuuuaauggccaugcuauuaugccccaauucucauuagcgcacuuaaaaaucaguucuuuccacccuguaaacugaaaauaaaucagaauauaugguucaaaagugaaagacuaaagaaaguuuacuaccacgcaauccuaucuuugucucuuucucuuuuuuauuggcgucaaacuacucaguauuuuagacugcaaaauuuccacugcauggaggaaaguaaauggauugggauuauuuccugcagguaaaugaaacuuuaugguauuuguuauggaggcaaguaggguacuuagagaaagccaaauauaaccugucccucccuaucuuuuccuuaguugugagggucaaaggggcacauuacagucuggauucagaaaccccuuucaacagcacguagauaguuaaagagaaagauuguucuucaagggccucuaaggacaaaagugaauccacuaacacucuaggaagcagugugacuacuggaagaaagacauucaagagguaaaauggauuuuagaaggucacaggagccaauugucaguguuuguacucuucaucaaaauuauuuuuaaugagcucccugacaacugcgcauccugacagcacgggugaaguggcucaucuggggucaugcccgugccugacacugcccuaauuagcugacacugcucugcuuugcugaagcacagggaggucucucgagaaagauccagaagggaccaugauaaaucgggcaaaauauuccuugagagccugagguucacaugagagcucagaggaauuacaauaaagauggauuaggaaaauggaauauuaggaggggaaagacuagaguuacuagaagagauauuugaaaagagauuccaggauuuacuggacagguuuguuuaaaaguauuugaguuggccgggcgcgguggcucaugccuguaaucccagcacuuugggaggccgaggcgggcggaucacgaggucaggagauugagaccauccuggcuaacacggugaaacaccgucucuacugaaaauacaaaaaaauuagacgggcgugguggcgggcgcuuguagucccagcuacucgggauguugaggcaggagaauggcgcgaacccgggaggcggagcuugcagugagccgagaucgagccacugcacuccagccugggcgacagagcgagacuccgucacaaaacaaaacaaaacaaaaauuagcugggcgugguggugcgugccuauagucccagcuacucgggaggcugaggcaagauaauugcuugaaccagggagucggagauugcagugagcugagaugcgccacuguacuacagucuggugacagagccagacucugucucaaaaaaaaaaaaaaaaaaguauuugaguugaugcucugucaaaacucauuuaucaagaggauuugguuuuaggcaacgaaaccuugccucaaacucauuuccaacucagcggguuugaagaugugcaaggauucaucuguucaaaagcaaaacaugauaaaacaaugcagaacaccucaaaaccauagagaaguaccuguggaacuguucaggaguccuaaaggggcucauucuaaguggaaaauuauuguuacucuuucuugaguuguuucugugaauuacgaaaaaggccuaucucagugaacagaccauguugaucauacuaugaagcagagauuguagagauuuuauuaaacugccauacuucucaguucagagcuguuuuacuccuucucccugggacauuuggcaaugucuggagacauuuauuuauuuauuuauuuauuuauuuauuuauuuauuuauuuuuuggagccagcguuucguucugucacccaggcuggagugcaguggcgcaaucucggcucacugcagccucuguuuccuggguucaagcgauucuccugccuuagucucccaaguagcugggauuacaggcgucugccaccaugccuggcuaauuuuuguauuuuuaguaaagacgggguuucaccacguuggucaggcuggucucaaacuccugacuucaggugauccaccugccuccgccacccaaagugcugggauuacaggugugggccaccgcgccaggcuaucuggagacauuuuugauugucacaacuggggggaugcuucuggcaucuaguggguagaagcuagaggugcugcuaaccauccuacacugcacaggacagccaacaggaaagaaucauccagucucaaaugucgguagugcccaggcugagaaagcuugaguuaaaguaaaccugauaaccuguauuuaaaugaauaaaagggauaagacuaggggagaauaaagcuguccacauuuguaagccucuaccaagcacagugccugaugugggauuacagacaggcgccugucucagugagaucauagcaucaguaaucccuguaccguauguagucccagauuggaauccuugaccgaaggcaaguucucaaccucucuaagacucaguuacaaaaaagagggcauaauagugucucuugccuuauagguuuuggugaaaauugaauaagaaaacaucaguaaggauguggcauggugccugacaaucuuuagaugcccaauaagugguagcuaguaucaacauagaaauaaaauugaaaagauacacacacaauguuugcauugguuauccuuggguaauggguuuuaacuuuguuuccuagauuuuaaauuuuuccaccauaacacguauugccuuuauaauaacauaauucacuuguuuuaagucgauucaggaagcuucugauucuauauuauaaauucuaaauguucccuucuauuuuccagagucaaguuuagauuaucuagaucaugaaauaaucagauauuuucagcuauuaccuaacucaugaguguguggaaugcuguggcuuucuguuauuagaaugaaauaaaaaugaaaaauaaauugcuuaucaauauucugagauagcaaagcaaugaugcauuuaugauagacuggaugauaggauuuguuuuugcugaacuuauucauacauauuuguguuuugcuuagacuuuaaaauuguuucuuuuucuaugagcacauagcaauaacugggaaguggcugagaaucauucuuuuuuuuuuaauuuuugagacggagucuugcacugucgcccaggcuggagugcaguggugagaucucagcucacugcaaccucugccuccuggguucaagugauucucuugccucagccucccaaguaguuaggacuacaggcgcaugccaccaugccuggcuaauuuuuguauuuuugguugaaauggggcuucaccauguuggucaggcuggucucaaacuccugaccucaggugaucugcccaccuuggccucccaaagugcugagauuacaggugugaccuaccgcgccuggccuaucauucuuauuugacagggauuucccuauugcugggugcuaagugauugagggaaacccagaaacagcuuuguguugugguuaacagcacagauucuggagccaggcuuccuuguaccaaaucucagcccuaccgcuaacuagcuuuuugacuucagugaaguuucuuaacuuccuugugauuauuuuccucaucuuugaaaaaggaauaauguccucaacagguaacaugaagguuaaaaggagauggcguguguguguguguguguguguguguguguauacuuguguaucucaucccuaaacaaagccuggcucauaguaggcccuauauaagugcuuguuacuaugauugaaaguuggauauauuuuuaaauuucuauuuuucaaucuuuugcaaagaaggaaaacacaacuuugauaaagguaauuuugguagacauucucuaacauguaaacugcuuguguaaacugggaaauaccagauugcucuaaauuaauuaguucuauauuuguucaauuacacuggauuguguucuguguuuuuauuuuguuuuguuucuuguuuucuacucacauggugagacuuggcuugggugagucauuucuuugaagacccucaguucauacuaaggggcaaaagcagaugaggguccagggcaaggcauggaagccaacugcucagugguuucaacccgggcuucaugggaaaaggaugggagggugggguuggguguccuugagauugaggugagaacaguugccugagaacaggaaccagaaaguccuaacagcggucgaucacugauaacauuugugcugaaaacauuucaggcccaaacugucucagccaugcugagcaaggcaggaacuugggaugugaaccacucucuuaaucggguccacuguguauccaaaguugacccuugagggccaggcacgguggcucacuccuguaaucccagcacucugggaggccaaggcagguggaucaucugacgucaggaguuugaguccauccuggccaacauggugaaacccugauaauacaaaaauuagccagguguuuguggcggguaccuguaaucccagcuacucgggaggcugaggcaggagaaucgcuugaacccgggaggcggagguugcauugagccgagaucgcgcgauugcacuccagcuugggcaacaagagcgaaacuucaucucaaacaaacaaacaaacaaacccaaaauugaccauugagaaaaacccuugcuuugugcccaucuguugugaggagaugggacagccuugccccugcauggaaucugcucaggagcuuuaguuucuguaguagaaggugggcucugugauuaacucuguggaguuuaaggaucuggguucagugagcacucaggcucugauggggaauuguaccuggaacgguuaauuaucucguaaaaagaucaauggaaaaauuauuuucaagaaaaauaauagauaaaauuuaccuacucugauacuuagcacaauaaauauuuauugaacuguugaaucuuuucuagguauuugaaguuuuauuuucaggcuaguggcuuuugaauucugccacaggagaauucaguucuccuucugaggccuucugaggaggggagagagugaaaggaagggaagaagcagcuuggccuggacccauuuuuuccauuaauuuuuuuuuucuuaguagagacgagcucucugcuauguugcccaggcuggucucagacuccugggcucaagcgauccucccgccucggccucucaaaguguugggauuacaggcgugagccacugugcccagccuggacccauuuuauauacuagacuuuucuagaagguucucuuugaagaaaaguuuucucugcuaaccacacuuugaaaaauuauuucuguaggaaaaugauauauuauccuuugauaaccuaggucgcuggacagcuuuuguuaaaaaguucuacccauguggcuuuagcuuccaaagauacacuuccuuuuuuugagacagagucucacuguguugcccaggcuggucuugaacuccugggcucaagugauccuccugacuuggccucagccucccaaagugcugggauuacaggcaugagccacugcgccuggcccccaagauacacuuucaccaaacuguguuucaaaguuaugcuuuuaaauuguauuuaaaguucauauaagaacaggcuuagcugugacacuguagaggcgagaauguggaguugacacggguccuuuucacacuuguuccccacacagggcccacaugaaaccugucccugaguuuaauccuaagaaaaaccuuguuucacuagcaaauaauucccuucucugagaaggcaaauuaauuauuuuauuuccaacuuucucuuaggcauccugaaauucugagcucaguuucaugcucugaaaaagaaaaaauaacugcuagagucacagaaaugguauugacuuuuuggauuggaauauuuguuuucucuguuccuuaccuguuucccccuauuuuucuuacuuccuuuccauuuuauuuuguaugccucuuuguaagcugccuuaaaugcuuuuuggaaugaggcaggauauacauucaauaaauaaaauaugucugagccacuuaugaacaaaaccuucuugggccagagccuaaacauuacuuauauaaaaagaccugauuccucaccuucuacaacaauauuauuuagucauuucucugcauuguacucaacucuuuaaagguuauagaauuguaguuagcguauuagaaggcucauggaucuagauucuauguccucagcaggugaagucuuuuuuacacaaugccacuguacggauuguagaguucuugggcuggcauaauuuuaugugaccaaaauuuggcaaagggucuuaucaguuugaggagagauuaguggagcauugaauuucagaguuugaaaugacauuagagauuaucugguccagugauucucaaccagggagacauuugguuauuuccggagauauuuuuggucacaacugaggugggugcuacuggcuucuagggauggaggucaggaaagcugccaagaacccgacaguguacaggacagcccccacaccagcaugucacuacugccgaggacgagaagcccugaucuagccaauccugucauuuuucagacuccagggaguuugugaccugaccuucaaauauaagauuuaauauuuaauugcccaaauucauucuuaaaauauagcaaaaugaugagaaauuucccuucaaaacugagaacaagacaaagaugucuauuaugauagaccguucuuagaaguuuacugcuccuccuggggaugccucucaauagagaaauucuacauucccgccuguugaaagcagacaugguuacuugacuuguuugggccuaugaaaugugaacagaggcgacacacgucacgaucaggugggagacuuaguaacacaugccuggugucccaugcccuuuucccucugccaguguuccagggcguggcaggacugccagccuggucuuggagucacagcugggccccgaaggcgaugcugugggaccuggaaauaaagcuuugcuguuguuuuaaaaauggaaucacauuguaaauuaggauccuggggagcguggcacuagguauucuuaugcagagcuagauggugaugcuuuccuuuccuuaucacuucaagucugcagacacagccuucagggcguucuucuucugugguuccucaguuggggcaccuugucuggaguacacaguaaggcuaugccacaguccugcuaugacugagauggcaauaugagugcuuuucuuuguuggugguuuuuauauuuauguuuaaaaaauuauaaacuaggcuaggcacaguggcucacaccuauaaucucagcacuuugggaggccgaggcggauggaucacucuaggucaggagcuggagaccagucuggccaacauggugaagcccggucucuacuaaaaauguaaaaauuagcugggcaugguggcgugcaccuguagucccagcuacuugggaggcugaggcaggagaauugcuugaacccaggaggcggagguugcccugagcuaagaucaugccacugcacuccagccuggguaacaaagcaagacuuggucucaaaaaauacacacacacacacacacacacacacacacacacacacacacacacacacuaaaacugcugacauugagcauuauacaguaagacagauuuuccuuccuuguuucuuugcaucaauuuucucugccucucccuccguuccuuuucuguuugcuucuacucaggacugggcacgaaugcacacauugcugucuggcuuguaucuaugugguaagucuagaaugaucaguuacugaaagaagagggaaucagugcuagugaaggauauagguugugguuaacuggaguucccaaguagcuggaucuuuugugacagggauuggcuaguuugguuuuauaccagauacuaguuauauagagaugaaaagacaaguuuccuucacucaaaggaaccuuagcuuagagucuugcagggaaauugauuugcaagcaagcugcuuugcucccuuacucuaaacucacacuugaaucucugaucuuaacacuuugauggugaagaaaaagcccuccagagaaaagguaguaagagauccagaaucuagagccuuucccaaggcuucagguagaucugguugaauucaccuuguucucucuugcccccuauucucuuaucagucauucccacagcuuuaaguguuuuaaaggaguggaaagcucccaagacucaggcccuuaugucacuccugacaugcacuuauaggggaguccagaguguuuaguccuccaggguuuuuaugaauggucaguguuacucucagaagaugcugaccuggguaggacagguuguucauccauucauuugugugcuuaccaugugccaggcacaguuccagaacuggggauccacugcuaaauaagacugauaaggucuuugcucuuaaggagauuccaugcuagacauuaauuauauuaaucuugacuccaguuuaugcccuaagccaagcuauccucuauucucuuucggcauuuuucaguuguuaaaccagcaucaccagguugacaacauaacccaacuaauaccaacaacauaaagugccugaguucaccagcccgcucagcucccagcugacugccccggagucccgcccuguucaggcagaggcagaguuuuuuuuuuuguuuuuuuuggagacagcgucucacucugucgccaggcuggagugcaguggcacgaucguggaucacugcaaccuccgccuccaggguucaagcaauucuccugccucagccuccugaguagcugggacuaaggcucaccaccaccccuggcuaauuuuuuuuguuuguuuuuaguagagaugggguuucaccauguugcccaggcuggucucaaacucccgagcucaggcaauccgcccgccucggccucccaaagugccgggauuacaggccugagccaccgugcccggcccaggcagaguuuuaauugaccaccaucccuuguccgacuccuagaaacuuucaccuggauuccuuaaagugaugccuugcugaccugauuggauaacucaguauucauugcugaguagcugagguaagcgugauguucacuuauuucucagcuaucuaugagagcuguagcuuacauugugaucauucugguaaauguucucuaagaaagaaaacgaaaaaauaauggcuagagucauguucaccuaguuuuaacaucuuuagaguuuugcuucuucucaguucaguagcucaaagagagaaaaaacacccaaagacagcaauucuucacucuaaacccaauauucuucaacuuucuagaaauuauuagccacuuaauuuacuuugauuuucaucucugaaaaaguauucagacuuauauauaguugccagauguguucaucaaacacuucucuaagaaauuuguauauuuuuggaauucagucaacauuuuuuggauaaaugaaugugaacacuuuaggaauugcuuauuccacaaaugauuucuuaccaagauuuccagaaacuauuuucauauugaaacaaaaacaaaacaacacaccacucugcuucuucccacagaguucugagacagcuuuuacauaaugaucuugaacauauuguaaucuuguuuaugacagaaaugaaaagcugucaucacauuucuguuuuggagaguucauuguuuucccugugaauucauaggaguucuuugucuauuauaaauauuaucacuuugucuugaaaauagcuuucccuucuguacucuuucucugugggcuuuaugcaucuuuugucuuauaaaauguaugaugucuacagagucagauguaucuguuuuuuccuuuuuagcgucuuuauuuuuuguuuaacacaaaaacaucugccaguugguaaguuauagaaauauucuuaaauuucuucuaaaguuuuaauauuguauuuuucaguuaaaguguaauccacugagccaggcguggugacauacaccuguagucccaaccaccugggaggccgaggugggaggauugcuuaagcccaggaguuugaggcugcaguguacaauguucacacuacugcacuccagccugggccacagagcaagacccugucuccaaaaaaaaaagagaaaaaauuaauccauuggauuacucuuuguuuucuucuaguuaaacauccauugugucagcauaaucaaacuaucuugcccuaugaaaugaguugcuaucucuugucuauauucacaucuuuucccagauuuucuguucuauucccacugauguauuuacaggccaguaucacaaccugugaaagcauugucuucaguggaaauuuuaaaauaguaauuacuccuuucauuauuuuuuucauaauuuucuugguuauuuccagaucuuuacuuuucaaugaacauauuuuuaaaucgcuuaaaucauucagaucugaaaccucauuggcagucuaauuggagugaaucuucugauucacaagcaugaaauguauguauuucuguuuauucaaaccuucuuuuaguauuuuaaauaugcguuuuguugucuuuuucauguaggaucuauaccuuuccuaaauguuuuauaguuucuuguaaauagaauuuuaaaauucccauucuaucugguuauuguaacuauaagacaaagcuauugauuuuuuuccucuuuauuuucuagcauuuauuauuugcaagcauuuauuaguugaccuuuuggggucuguuuucucuuuugaauguguaagcacaagguagaucauguuuaucuuguuuacuaguuuauccccagcauucuggcaggacaaaugaaugaaugcaugaauggauaucugaaaaagcguuugagaggagauucaacaaucuacacuacuuucccuuuucuucuuuuuaccuuguguuucuaacacauacuaagcuuuuuuucuuuuucuucugaaaugggguuuugcucugucacccaggcuggagugcagugucaugaucuaggcucacugcaaccucugccuccuggguucaaacgauuuuccugccucagccucccgaguagcugggauuacaggugcacgccaccaagcccagcuaauuuuuguauuuuuaguagagacgggauuucgccauguuggccaggcugcuguccaacugcugaccucgggugauccacccaccucggccuccccaaagugcugagacgacaggcaugagccaccaaucccagcccauucuaagcuuuuaacauccuuagauuacuguuccaaauacguugggaaggucccccaauuuuuuccuuaacuuuuuaaaagcaacuuuauugaaauauauuuuauauaucauaaaaaucaccuauuucaagaugauuuuaguauucaauaauuuuuaguagcuuuacugagugaugcaacuguaauguaacgauagauguucagguuuagaacguuuucauccuccuaauaggaucucucauguccauuuauaguuaaucccuguucgcaccuuuaccccuauucacaagcaaucguuaauuuacuucuuguuucaguggauuugccuguucuggacauuucauauaaaugagaugguaccauaugugaacuuuugugucugacugcuuucgcuuagcauaauguuuucaagguucaucuauguugucgccugugucaguauucucuuccucuguugcugaauaauauucccuuguaugcauguacuacauuuuguguaucuguucauuaguuuuuggacauguagguuguuucuacuuuuugguuauuaugaguaaugcuccagugaacuucacauguaagucucuguguggacauauguuuucauuucuuuucaguagguaccuaggagcggaauuggugguucauuuuauguuuuuugagaaauugucaaacuauuuuccaaaguggccacaccauuuuauauuucuagcaguaauguaugaggguuccuauuccucuuuucuuaacauuuuucucacaguuuauugauguaugauugagguaucauuuacauugagguauaacuuacauaugauaaaaugcucagaucuuaaguguacaguucaauuauuuuuggacacauguauacaugcauguauacaaccacugcgucaaucaagauacgaaacauuugcaucauucuagaaagucccuuguuccuugcccucagauuuugauuucuaucauucuaucauacuguuuugauuucuaucauuguagauuaguguuuauuccagaauuucauacaaaucaaaucauacaguauguacuccuuuguguugucuucuuucacucaucguaaggguuucgaguuucaucaguguuauuguguuuaucucaguuguuuguuccuuuuuauugcugagagcacuccauuguaugaaugucccacauuuuuguuuauccaguuaccuguugauggacauuugagucauuuuucauuuguaguuauuaggaacaaagguacuauuaaacauuuauauaccagucuuuuuguggacaugauuucauuuuucuugggugaauucccaagaguguaauugcugggucauaggguaguuauauguuacuuacuguuuuuuaucuaguauuaagucacuuuacaaaauucuuuaagaauuacaguuuuuuggccgggcaugguggcucacgccuguaaucccagcacuuugggaggcugaggcgggcgcaugccuugaggccaagaguucaagaccagccuggccaacauggugaaaccccaucucuacuagaaauacaaaaauuagccaggcgugguggugcgcaccuguaauccgagcuacuugggaggcugaggcauaagaaucucuugaacccgggagguggagauugcagugagcugagaucacaccauggcacuccagucugggcaacacagcuagacucagucucaaaaaaaaaaaagaaugacaguuucuaaaauaucgugucuuugauuuucuaaauuauuauacaauuugcugauagguauaauuuugaguuagaucuuuaucuguugaucuggaggaguuucugggacuuuuuuuuuuuuuaaagaagcacacaaguugcccagaaauguauauaguauaauccaaauuuuguaagacaaacaauaacauguauguauauguucgcgauucuauaggcaaaagaaaagaugugaaagauguucacuggcaugcuaaccaugguuucguggcuggaguggcggaggugguuaaggggagguguagaggguugaguuuacaaaaaaaggaaacagggauaaagaaaacacauuauuaaaguuaaaugauuuaguagaguauaaauauauaaauauauuuauauauuuauauaaaauauauauaaauauuuuaauauauauuuaauauauaaauauuuauaaaaauauaaauauuuauauaaaauauaaaauauuuauugcaaaaacuuuuuaaugauaaaaauauuggaaccagcauaaagaugagcuuaccaaaguuauuugcagcuguuaaaaauagugauauacguguguuuagaauguauguuaaauucaaauucagauugcaaagcaguaugcauucuauggcccugacuacuuugugcuaauaugauugugauuaugggcauuuuuguuuacuuuuuaaaaucuuaugggggaaaaaagcaggaguuauuucuagaaguaugaaucacugaaacacaguaauauuccuuaaauuauacuuuucuuaggauagcuguaauuauauaagauuuagucaaaucuuuaauuagaugguaggcugauugaggguagggaucccucaagauucuauuugucaccgucagagcucagaauaauucugacucauucauaacaugaagagaucaccguugaacacaguccauaggaaaguaagaucucagcauuaaagagaugcagguaugaguguuaaagaagagcaggcccuggucagaguauucuccaauugacgucaaucaguucuccacuugauugaccuggagaguacuuugacagggccugcucuucauuuacauaggcucggugccuaccuuuugcagcugaacaggcucggccccaguucuugcuggguucuaagcuacaguuucagggaaaaggcagaaagccaagauagggcaggaaugggaugaaaggggacuggccuguuggcuaggucagcaaauuugucugugauuuacagcacuaagcucaggauuugacuugauuagaauuugauugccuuucauuugauucaaguuggagccacugcuccgggcuguucuaucuaguggauggaccauagaagcagggaucucaugacuuagcaauauuaaaaccucaggcagguggcuuguuggucugagcagccucuaaauuuguacaaaagccugguggcuggcuggguugguaaaaauggcaguuguccugcaugcugacauugggaguuacucugcacugcugcaggcuguccuggcacacugcaggccgggcaucauuucaugguggaggacgucacucaguuuugcaugaggcucuugcaucacauuuguauuuaaggaauucacaccuuauuuuagggaaaacaucuguuccuugguuaaaacagcauugcacuuuuaacagagcggccaccuuuuuccacauacgauaggacagguuuuggauauauggaguauuaacugaaaagagcacuauauauuucauaguucuuuaaagaccauugauauguaaaucaauguguaagaagauaucguuuaagagggguuauggcacaugguggaaggaaugcugcuuugcauuuauccgugugaaguaaucugccugugcaucugaagaaacagcaggccccgccgcaagugaugaagcaguucuguggagaaacccauuuacaccaguuuccagaugcuauuccaccagaaauaauuccaagaauauacuuauauuuuaaauaaaugauaaaaucaauuuccagaugaaguguacauuacaaagagaaacuugguauuauuauguauuaauccauauuaacuaaaguugaaccugacaucaaaauauugaucccuucuuaaaauagacaaaaauacuuugaguuaaauuguuuuucuuccuauuugugcuagccggugcuuaaagucuaaugaugugauaauugaauaguaaaggaaucuaaaucucuacuuucuugauucccagugugcuaacuuuacuaaaauugugggaauaagcaaaauauuuuucauagcaguaauaaggauuuuuaaaaauuaugugacaauuguguauuagacugaaguaauuaauaccuuugucacagggaccgggugcaauggcucaugccuguuaucuuagcacuuugggaggccgagacaggcagaucacuugaggucaggaguuugagaccaaccuggccagcauggugaagccucaucuuacuaaaaguacaaaaauuagcugggcauggugguaggcaccuguaaucccagcuacucaggaggcugaggcaggagaauuucuugaacccaggaggcaaagauugcagugagccgacauugcgcuacugcacuccagccugggcaacaaagcaagacacgcucucaaaaaaaaaaaaaaaaaaauuggcaugagacuaaagaggauuuaagguggaggauuuccucgcaguagguaaagaagcaaagcccuguuuauucagagccugagcucagacuugaauuucuuuuuuagacuuucauuuucucccuuuaugaaguggcaaagucaguuaaguauagauguggccgucuaugucccugagcuucuggguucaauaaucagcucugcgacuccucuuaaagaauccagaggauuuccugccuggaccuugaagucaccuccccgcuacauauuucccagcucugguuuuccaccuccucaggaugaaugucuucuugaauguccucuggaagagugucagcugcacuuaaacuuccaucaaaagggggacucagaggccuuaaaauaggcaucagguacacauucuauuuaugauucugggauuaggccuauuuuuuggcauuuccuguggucaaauuuuuaauuucugaacuuuaucggauuuccaaagauaccgucccuuggcugucuucauugauuucuucaaaggauuuccucggcaaaguuacccuagucuuaacuggaagagcauggcucccuuaaagagucuaaaauaagccuuuuccuuuagugacucccagcucuggucuugucagguugcauuuuucuccuaaccuucuucuuuccuaauccucacucacuaauucaaaaauguuauucugccuuccagaacaucacacuuuguaaacauuuuguuaauaauaaaagcuagcauuccuugaauacugguuuuguaagcuagauuaucucauuuaacccugugaugauguuauucauuaaggagcauuugcuuucuuaggucugcaacaucagucacuccucgcccaucuguaucccagcuuuuaacaguuuguuacugcucuuuccuaucauauucucuugugggcaccaaauuuuuuuuuuuaauuuuauuguaucuuuagaggaguuuuaggggagaguaaaaauaaauauauuuuucaauccaucuuuacccagaaauugaaauauuacuuuuuauaguagaaccagaaauuaacuuaagaauguuuuuggcauuuggagacaugcauacaaauacuaaagaggugcuuauaaaaaaauuacacuuuuggccgggcagaguggcucacaccuguaaccccagcaguuugggaggccgagggggguggaucacuugaggucaggaguucgagaccagccugcccaacguggugaaacccugucucuacuaaaaauacaaaaauuagcugggagugguggcaugcgccuguaauccuagccaccggggaggcugaggcaggagaaucgcuuggaccugggaggcagagguugcggugagcagagaucaccccacggcacuccagccugggcaacagagcgagacucugucucaaaaaaaaaaaaauuuacuuuuuauuauaaauuugucauauuuaaugccauggugcauuauaguucuggcuacaaaaugaaacaauuuauuuuuaaacuugauuuuuuuucucuaacauuugaaaucauuaaaaguuacuaucaggagccucucauuuuaugcauauaaaugcaauaaaacagcugguuaucuuaugcucuauaugaaggguaauauuuuaagugcauuuucaaauucagcuaagcuagugauucuaucagaaaauaucauuuuucacucacuggcuuuugaaacauaauuagauuuucugagcaacuguugcuuauaauuggaauuugcuuauuaucauuuuaacagagaaaaacacugaccuauguaauuuuagugcaauuaaauuuuucuccuuaugccuguguguaccucaucaauucagcaaaagcaaaaccugaucuagaagucccugugcagcagauugcagggaaagaagcagucagcugauuugucugggccauaaaaccguggugucuggcagaauugugauaguaauugcucuaagaugcauucuguuuacaaagacuaacauugcagcugcuuuuaauuagcugcuagaaaugaaaaacugucaggguaugcuuguuagaucuaccugaauuuauuccauugcaaauaaagcagaauuuaaagaauaucaauguaaaacaggaaacuucucauuguaaaccaaguucagaaagguggugguaaauaucugaauguauccuuuugguuuuaugggaagcagaaaaaccugauuuccuaugacacagaccauugcauucuguauuguauuguuuucuuuuuucuuucuuucuuucuuucuuuuuuuuuuuuuuuuuuuuuugagacacagucuugcucuguugcccaggcuggaguacaauggugcaaucucagcucacugcaaccuccaccucccggguccaggcaauucuccugccucagccucccuaguagcugggauuacaggugggcgucaccaugcccagguaauuuuuguauuuuuaguagagaugggcuuucaucauguuggccaggcuggucuugaacuccugaccucaagugaucugcccaccuuggagucccaaaguacuggaaauauaggcaugagccaccaugccccgcuguuuucuacauuucuuuuauauguaaauuucuguccugagcagaugauucacuuccagagaaaaggaucuuugcauucccugcugucuggcauugugcauaauaaauauauacuggcaaauacauaaugguaguauuuuuauuuauaaaaguaugagaaauugcuuugagaaaaucaaaggguuagaaauaaaagaaaauuaaaagcauuguuacaauuuaucaugaaauuuagugaguauuacagagcuuuguacacuggguuagaaaauuuguguuuuuuucuuuuucuuuucuuuucuuucuuucuuuuuuuuuuuuuuuuuuuaaagagauagugucuugcucuguugacaaggcuggaaugcaguggugugaucacagaucacugcagccuugaccuagacucgagcaauccuuccaccucagccuccagacuagcuggaacuacaggugugcaccagugcacucagcucauuguuuuauuuuuuaaauguuuuguagagacggagucuugcuuuguugcccaggcuggucucaaaguccuggccucaagugauccucccuucucggccucccaaauccugggauuacaggggugagccaccacaccuggucuuagguuucuuaauuuuauuucucuguguuucuacaggcuuuuaggccauuuuacuaauaauuacuuuuuuuuuuuuuuuuuuaguuuuuuugagacagagucuugcucugucaccaggcuggagugcaguggugcgaucuuggcucauugcaaccgcugguucaagcgauucuccugccucagccucccuaguagcugagauuacaggcacgcgcgccaucacgcccagcuaauuuuuguauuuuuaguagagacaggguuucaccauguuggccaggcuggucuugaacuccugaccuugugaucugcccaccucggccucccaaagugcuggcauuauaggcgugagccacuguucccagccugcuaauagcuuuuaaaaaggaauauugauuuucauaguuguguggcagacacagcugacaccacuagcuaacuuaagcauacucugagaaugaccuugcauggcagaugcaccugacacaaaauuuaagcauaaccugaggaugacccuguagccuaagaagaauguguauucagaguucccagcuaauaaauccaggaaggccaacugggagagucauuccuuaucugugaguaacaucugaacccucagcccauccuguggaacacaggccauauaggggauugaggcccuuuguuuuggguuagauagagguugcuagggggagggugcuaagcaagaaugcuguauaaacugcaugcuuuuuacaagcaguugccauugucuaguccagcccgucaccacuggaccacccuguauguaaauccucucaguaaaccuugucucauuuacuggcuccaggucucuuugaaagccucucaaacauggcgccaucccuauugcagccauuagaguccggcguggcaguggucaggacuguugaagaaggcugagaauuuagggcacugugaaguguuuaaucauuuaucaagguaucaauuuagugucucucaaggaaaaaacauauuuguugauuugauuucaugccaacacugauguuuuuugcuacucuauggccuugaauagucaggcauugacuguaaccaaaaggauguauggaaaauaauuguuuucuuuuuugagauggaaucuugcucugucgccaggcuggagugcaguggcgcgaucuuggcucacugcaaccuccaccucucggguucaagcgauucuccugccucagccucccgaguagcugggauuacagacgcaugccaccacgcccagcuaauuuuuguaucuuuauuagagauggaguuucaccauguuggccaggcugcucuugaacuccugaccucgugauccacccaccucggccucccaaagugcugggauuacaggugugagccaccgcgcccggccaaaauaauuguuuucuauccuuagugaagagcuaaagagaauuuccuuagaauaacagcaaaggaacuuaaaguguucagaaaaacaaagugaggaugguaggaauccuuucgccugaaacuuuggaaaaagguggaugaauuacaacuaagucaucuuuuagcuuugcuuucuugaucuuccuucaaaguuuaugauaccuaaauucucucuucaacucauaaaauguguuuuaugguuuaauagaaaagcuauaagcacaugacaaaauuaguucuuauuagcuauaugccuacagaaccaauuuugugguuuucaauaugauauguucaauuccagaagguguuuuauaaaucaguugguaggaaccuguuuuauguguaagcuguguccagauggauguuucuuuacccuuuuauguaccuggaccaauaguaccagaaaccaugggagcauaaccaccccacaagaacuccaccccugccacagccuucacuauuuggcaggggaagcagagacucugccaucuucaagccacugguagagccccuuucacaugaccugggagguaauuucacaagcaaagaagucuaaaggaaagguuguaccuaauuuaaauuauugcuuuugucauauucucuaccacucacaggaauguuuuauuauuaaucacaaaucauaagcaauuuauacucuugauuauuucaaaagagccacauccacugcuaugguuuugaaauuauuacauuauacauuauuagucagcuuagacuaaauuaugcugugguaacaaaccccaaaauuucaagggcuuacaacaauaaagguuugucuuucaugcuguacauucauugcagguaacuaagacacuauuccaugucacugucauucugagauaugggcugaaggaacauccucucccugaggcuuugcuaguguuucaguagacagaaaaagaacgcaaugggaacacacacaaugguucuuaaagcuucagcuucaaagcagcacaugucauggcacucacacuuuacaaagcaagucagacggcugcucuggggaccugcagucgugcaggagaggggcucccaaaucagacagccacuccuggcaucaaugacgcagggaucuauaguccuuuuaugcugagggguggugaauccaccacaguuaacaaaaucuugagacuugccauaaacaaauucucaucuguuugugugaugagguccagaugauggcccacuucaguagcaaagacagugcacugugcucaccacgccauuucaucuuuucccuggguugauaggaagauggccuucucaaccccuuugcaucuguguggggccaggagacuaaacaccgccaguugauuaugaggaggaaugacguguggcacuuccagaccuagcucacaaacguggcaaaauccacucucccccaacuccuugagccugucucuccaaauugcugcauagaggcaauguuuccaggagaaccucaccuggccagaaacaucugccuugaacaugguuagaacaaaugaaacuuuuuuguauuaaaacacuugagauucuguggcucuucguuacuguguuacccuauccugaccuugcuuugugguuuauuuaaugaugcacauuuacuagagugguguacauucaauagugagguggccacauacaacauaccccuaaaacauugcugaaaguacacagccauuucuacuauaaaaauauaaguauaugagugaagaacugauuuuugaauuuugcuuuaauuaauuuaaauuuaaguggucacauguggguaguggccaccguauuggaccacagaaccuuaagcaguaggaagcuuuuugcuacgugauguauuauaaaucuuuccacugucucagcaaucuaaacauaaaaccaacaugucuaaauuucacacuuucuagaugaugaagagucauaaaaugaacagaaagucuuuauaugguguuucagggggacaguugugacauuggagugcuggucaaaguucuuuauuauuuuuuauuuguuuccaaauauggagugcagaaaaccaaaugguggaauggacauuuuugccaaaguauaauuguggucuuuaaugauguaaaauaaaauaccauauucauuucugaauuuuuuucaucgugaagugugugagaugugacuugacaacuuugcaaaugucgugccucugcuuaaaucucugcauuauauuuauggaaauguuugagauccuggaaaccauuuagagguguuauaaaauacuuuauuucuugagguccaaaagacuucaaaauaggggcugagugauauaauggaaagaacacuggauuaggagccagaauaucuggguuauguugccugcucucucacuaacuggcucagugaauuugggcagguuauuugaacucucuggaucucgguuucuucuauggugaguuuaugggcuuagauuaaucacccaccucuaaaauuccaggucuuuucuuuuuucugacuuuaggucaggucuuuucuugugaaguauuaaaacugagcccacccaugucaauauaacuuaacucuuuguuccacgaaauucgugcccaggaagauaagacaguaaauuaauaaauaaauucacuguuugcuuuaggaaagucuugcaaaucaauuuaucaggacaaacaguuugcucaucugggcaaacaguugucuuauuaaaacaauauauugcucaccugggcaaacagcuugacaaguuugugaaagaaugucacuaugcauugugguuuugaaaaugaaucuaugggcugggcgcgguggcucacgucuguaaucucagcacuuugggaggccgaggcgggcagaucacaaggucaggaguuggagaccagccugaccaacauggugaaaccccgucuguacuaaaaauacaaaaauuauucgggcgugguggcgcgcuccuauaaucccagcuacucaggaggcugaggcaugaaaaucgcuugaaccugggaggcggagguugcagugagccaagauugugcccccgcacuccagccugggcaacagagcgagacuccauaucaaaaaaaaggaaaaagaaaaaagaaaaugauucuauggaaacagcagacacuggggacuccaaaagaaggacaaagauguaagaacuaccuauuggguacuauguuuauuauuuggguaaggaauucagcaggaacccaaaccucccacaucacacaauauauccaucuaacaaaccugcacauguaccccugaaucuaaauuuuguuguuguuguuguuuuuugagacggagucucgcucugucacgcaggcuggaaucuacuauaaaugcauuuuuuuuuuuuuagacggagucucgcucuguugcccaggcuagagugcaauggcacgaucucggcucacugcaaccuccgccucccggguucaugcaauucucccaccucagccuccugaauagcugggauuacagaaaccugccaucaugccuggcuaauuuuuguauuuuuguagagacgggguuucaccaugugggcugggcuggucuugaacuccugaccucaggugauccacccaccucggccucccaaaguacugggauuacagucaugagccacugcgccuggccaacuauaaaugcaauuuuauuuacuauuuaacugggaguagaauaucuuaguauguaagucuagguauuuuuccaacuagcacaacacuucagauaguuuauauauuggugagauuaauuacaagauuagugagcacaucauagacauugaguuaauuaugacaaggugaaugaacaaaaccaauuuucugugucaaacguaguuuacaacuuuauguaaacauuuaucguauacauuguaagaaauucaguuuucuguaaaaaaauacguagucuuaaguuuacaauucaaaacccauagagguucccugacauuaccugccaacauuuaagagcuacuuauuaguuugaagagagacagaguaugugcacauuuaaacuuaaggcagaaauuugugucuguuggccuaaguguucuuuguucacugggcucugaagaccaucaaauaaaaguaauucuuaacuuaguguuuuuggcacugaaucuugaauuccuuuuuuuuuuuuugagacagagucucacucuauugcccaggauggagugcaguggugcaaucuuggcucacugcaaccuccgccucuggggcucaagugauuuuccugccucagccucccgaguagcugggacuacaggcgcccacuaccaugccuggcuaauuuuuguauguuuuuaguagagacgggguuucaccauguuggccaggcuggugcauccugaauucuuaaauaaccaguaccaaaguuauuuuucuugaaccuucucacuaaguaucuuuaucgcacaugaguucucucuuuaauuuuaacuaaggccuaauuaaaauauuuucaaauuuauaauuuuuauuuucucaugaagccugauaggaaaagcuuugcccuuaggcucauaguuuuaccugaggaaauucaacaauggaucugaaagcagcuuauugaggacaugcaguuagaacuuaagaagaaugugccuuuaaggaggaauaacccugagaaauaguuccaugacauuuaaauucuauugcucugacagagccauucugacagguuuuaaguuucaaaguuaucagacaaugugcagacaaccucaccaucuccugagcuucaccucacuguuaaccagccuaugguaaugucuuucucuuuuucuccuccucuuccuccuacucccuauccuugcccugucaauauuggauauaauggcaggucagaaauggggugaggcaugaggugaaaaccaaagagaacugugcagaagguuaaggguuaaauaacaucaggcaaaccagccaaguauaacuagacauuagaaguucagcucuaguauaaaaguuaaaagacaaaaguauuaaaaaucacuauaccugcauaauuuguugaugaauacacaguauaaaaagguguaaagugugacaucaacaccauagaauggugggugggggauaaguaaaaguguaguaauuuuuuuuuuuuuuuuuugagacagggucuugcucuguugcccaggcuggagugcaguggugcaaucucggcucacugcaaccucugccucccggguucaagagauucuccugccucagccucccgaguagcugggacuacaggcacgcaccaccaugccaggcuaauuuuuguauuuguaguagagaugggguuucaccauguuggccagguuggucuccaacuccugaccucgaguuaucugcucaccuccgccucccaaagugcugggauuacaggcgugagccaccgcaccuggcaaguguagaauuuuuguaugcaauugaaguugaguuguuaccaguuuaaacagaauguuuuguuuuauguaagguccaugguaaccccaaagaaccuaccuuuaguagaaacacagaagauaaagaaaugaaucaaagcauaccacuacaaaaaaaaauuuaaagucacaaagcaagacuguaagagaggaagaaaggaacaaaugaacugcaaaacaaaacaaaauaguuaagcccuuaacucucaauaauuaguuuaaauguaaauggauugaauuccccaaccaaagauaaacaguggccaaauggauuaaaagaaaacccaagaucuaacaauauucguguguacaagaaauucacuuuagacuuaaggacauacauaggcugaaaguaaagggauggaagaaaauauuccacgcaaauaguaaucaaaagagagcaggaguggcuuuauuuauaucagacuaaauagacuuucagucaaaaucugucacagaagacaaagaagaucacuauauaauaauaaagaggucaguucaucaagaggauauaacaauuauaaauauaugugcaccccacauugaagcaucuaaauacauaaagcacauauuaacagagcugaagggaaaaacagacaucaauacaacaauagcaggaugccucaguaccccuuucaacaguggguagauuauccagacagaaaaucaaugaggaaacaguggccugaauaacauuauagaccaaguggaccuaacagacauacacagaccaucucauccaauagcagcagaauacacguuuuucucaaggacgcuuggaacauucacaagggcuagauuauauguugggccacaaaacaagacuuaacaaauuuaagaagauuggaaucaucuccaguaccuuuucugaucauaauaacauuagaaauuaauaacaggaauuaugaaaaauggacauauguagacauuaagcacacacuccugaacaacuacuugguugaagaagaaaucaaaagagagauuaggaaguaucuugaggcaaaugcaaauggauacacaacauaccaaaaguuacaggaugcagcaaaagcaauucuaagagggaaguuuagagggauaaaggccuacauucggaagaaagaucuuaaacaaccuaauuucacaccccaaggaacuagaaaaagaagaacaaacuaagcccaaagucagcagaaggagacaaagauuggagcaaaaagaagcuaaggagacaguagaaaagaucaacaaaacugagauuuguuuuuugaagagaaacaaaauugacaaauccuuuaucuagcuuuaccaagaaaaaaagagagaacucaaauaaaugaaauuauaaaugaaagaagagauacaggcauaccuugguuuauugcacuuuauuguacuuugcagauauugcauuuuuuacaaauugaagguuuguggcaacccugcauggagcaagucuguuggcaacguuuuucccgcaugugcucacucugugucucugugucccauuuugguaauucacacaauauaucaaaguuuuucauuauuguauuauauauauaauauuauguauauauaauauguaauauauauaauacguauauaauauauaauauauguuauauauuauauguuauaugcaauauauguuauauauaauauauauuauauauaauacauauauauuaugauauuauuauaucacaaugcugauugugaucagugaucuuugauguuacaauaguaauugcuuugggguaucacagacuguccccauguaagaaggugaauuuaaucaauagauaucauguggucucugacuacuacagugugggcucugcuacuguucugacuggccuuucccucucauugagccucccuauucccugagacacaacaguauugagauuaaaccaauuaauaacccuauaauggccucuaauuguucaagugaaaggaagaguuacacaucucucacuuuaaaucgaaauguagaaaugauuaagcuuagugaagaaggcauauugaaagcccagauaggccuauugugucaaacagucaaguugugaaggccaagaaacguucuugaaggaaauuaaaagugcuauuccagugaacacacaaaagauaaagcaggccaggugcgguggcucacgccuguaaucccagcacuuugggaggccaaggugggcagaucacaaggucaagagaucgagaccauccuggcuaacauggugaaaccccaucucuacuaaaaauacaaaaaaaaaguagccaggcaugguggcacgugccuguagucccagcuacuugggaggcugaggugggagaauugcuugaacccaggaggcggagguugcagugagcuaagaucgugccauugcacuccagccuggguggcagagcgagacucuguuaaauaaauaaauaaauaaauaaauagauagauagauagauagauagacaaauaaagcaaaaaaaccuauuacugauauacagaaaguuugagucuucuggauagaagaucaaaccaaccacaacauuccguuaagccaaagcuuaauccagagcaaggucuuucuucaguucuaugaagacugagagaggcagugcuauggaaggagaguuugguacuagcagagacugguucaugagauuuaaggaaagaagccauuuccauuacauaaaagugcaaauaagcagcaaaugcugauguaggggccgcagcaagucauccagaagaucuagcuaagauuauuaguaaagguggaugauuuugagggguucaagacuucaguggaggaaggaacugcagaugugguggaaacagcaagagagcuagaauuagaagugaagccugaagaugugacugaauugcugcaaucugaggauaaaaugugaaugaaugaguacuuguuucuuauggaugaacauccuucuuaaagauggaaucuacuccuggugaagaugcuguggauauuguugaagugacaacaaaagauguagaauauuucacaaacuuaguugauaaccaguggcagaauuugagaggauugacuccaauuuugaaaaaaguucuacuguggguaaaaugcugccagacaguauugccuauuacagagaaaucuuucacgaaaggaacaguugaucaaugcauuaaacuugucuuauuuuaagaaauugccacagccaccccaaccuucaacaaccaccaaccugaucagucagcaggccucaguaaugagacaagaccuucuaccagcaaaaaagauugugacucacugaagacuuagaugaucauuaucauuuuuuagcaauaaaguauuuuuaagguauguacauuguuguuuuagacauaaugguauuauugcacauuacuagacuacaguauagugucaacauaacuuucauaugcacugggaaaccaaaaaauggaugugacuuguuuuauugugguauuugcucuguuguggugguuuggaacuggaccugcaauguaucagagguauaccuguauuauagcuaauaccaaauaaauagaaucauaagagacuacugugaauaauuguaugccuacaaauuggauaaccuggaagaaauggaucaauuccuagaaacauacaaccuacaaagauugaaucauaaaaaaacuagaaaauauaaacgaccaaauaaguaaggagauuaaaugagucaucaaaaaccuccagcaaagaaaaaccccaaacuagauggcuucuuuggugaguucuacuaugcguuuaaauaagaauuaacaccaauccuucucaaacucuuccaagaaauucgagaggagggaacacuuccaaauucauuuuaugaggccagcaacacccucauaccaaagccagauaaggacacuacaagaaaauuccagaucaguaucacugaugaacauagaugcaaaaguucucaacaaaauaccagcgaaccuaauucaacagcacacuaaaaacaucauacaccauaaucaaugaaauguaucucugagaugcaaggaugguucaaauauaugcaaauuaguaaaugugauauaccacauuaacaggaugagggauaaaaaucacaugaucaucucaauaguugcagaaaaaguauuugacaauauucaacauccuuucaugauuaaaaacuauuaacaaaucagauacagaaggaauauaccucaacauaauaaaggccauauaugacaagcucacaacuaacauccuacucaauggugaaaagcuaaaagcuuuuccucuaaaaccaagaacaagagaaggaugcccacacucaccacuucuguuauacauaguacuagaaguccuagcuagagcaauuaggcaagaaaaagaaacaaaagacauccaaauuagggaaagcuaaauagucucuguuugcagaugucaugaucuuauauauuaacccuaaagauuccacaguuagaacuaauaaaugaauucaguaaaguugcaggauacaaaauuaacauacaaauauuaguugcauuucuguauacugacaacuaaccagaaauuaagaaaacaauccuauuuacaauagcaucagaaagaauaaaauaggccaggcgugguggcucaugccuguaaucccaacauuuugggaggccgagggggguggaucacaugagguugggauuuugagaccagccugaccaacagggagaaaccccaucucuacuaaaaauacaaaaaauuagccgggcgugguggcgcaugccuguaaucccagcuacucaggaggcugagguaggagaaucgcuugaaccgggagguggacguugcggugagccgagaucaugccauugcacucccgccugggcaacaagagcaaaacuccaucccaaaaaauaaaauaaaacaaaauaaaaugaaauaaaauaaaauaccuaggaauaccaagaaggugaaagaucuguacauugaaaacuguaaaauauuaaugaaagaaauugaaggcuggggcagaaggauugcgugauuccaggaguuugaggcugcaguaagucaugauugugccacugcacugcagccugugugacagagugagaccaaaaaaaaaaaaaaaaaaauugaagacagaaauaaauggaaagguauccucuguucaaagaguggaauaguuaauauuguuaaaauguccauacuacugaaagcaacauacagauucaaugcgaugccuaucaaaauuuuaauggcauuuuucacagauaucagaaaaacaauccuaauauuuguauggaauugcaaaagaccccaaguaaccaaagcaaucuugagaaagaaggacaaagcuggaggaaccacuuccugguuucaaacuacuuccugguuucaaacuacauuacaaagcucuaguaauuaaaacaguauggaacuggccuaaaaacggccacuagggucacugggacagaauagaaagacuagaaauaaacccaaacauauauggucaucuaaucuuugacaagggugccaagaauacacaauggggaaaagaucaucucuucaauaaauaguguuggaaaaacuggauaucuauaugcaaaagauugaaauuggacccuugauuuacaacauauacaacaauucaagugaauugaagacuuaacugaaugugagauuugaaaucguaaaagucuuggaagaaaacaucagcaaaaagcucaaccuuggucuuggcaaugauuuuuuuggaaaugacaacaaaagcacaggcaacaaaugcaaaaauaaugaaaugggacuauguuaaacuaaaaaaacuucugcacaacaaaggaaacaaucaacaaaauuaaaagacagccuaaagaaugggacaaaauauuugcaagccauauguuugauaaggaguuaauauccaaaauauauaaggaauucacauaaaggauuucacauaacucauuagcaagaaaacauaaagcccaauuuaaaaacggacaaaggacuugaauggacauuuuuccaaagaagacauacaaauggcugacagacaugugaaaaguugcccaagauuacuaaucaugagagaaaugcaagucaaaaccaccaugagcuaucaccuugcaccuguuauaaugacuuuaucaaaaugacaagagauaguaaguguuggcgaggauguggagaaaagagaauuuuuguauauuguugguggaaauaucaauuuguacaggaauuaucaaaaaacaguauggacguucuuccaaaauuuaaaaaaagagcuaccauaugauccagccaucccacuucugggaugaaauaaaaucugugucuugaagagacaucugcaccccauguucauagcagcacuauucacaauagccaagauauggaaacaaccuaaguaucugucagccaaugaaugaauaaagaaaaugugguguguauacacaauggaauauuauuuagccaugaagaaggaaauccugccauuugcaaaaacagaaacgaaccuggaggacaugaugguaaguaaaauaagccaaacacagcaagacaaauauuguuuugucuuacuuauauguagaaucuaaaaaguugaacucuuaguaacagaguagaauggugguugccagggucugggggugagggauuaggggagauauuagucagaguguacaaacuuuuaguuuuaagaugaauaaguucaguggaucuaauguucaacauggugaauauaguugacgauacuguguuuacuugaaauuagauaagaagauagauuuuaagugucagcacugcaaccacacacagaugauaacuggguggugauggauauguuaguuaauuugauugugguagucaguacacacuguguauguauaucaaaucaucauguuguacgccuugaauauguacaacuuuucuuuguuaaauaaguacuuuaaaauuuuacaaaagacauuuacaagccacacuuacucaucuugggaaaagcuaucagucauuuaaagcaaagcauccuuuccuuuucaagauuuuacuuuuuuuuuuuuuuugagacagagucucaggcuagagugcaguggcacgaucucagcucacuacaaccucugccucccagguucaagagauucuuaugccucagccuccggaguagcugggauuacaggcauacuucaccaugcccaacugauuuuuguauuuuugguagaggcgggguuucaccauguuggccaggcuggucuugaacuccugaccucaggugaucugcccaccuuggccucccaaagugcugggauuacaggcuuaaaccacugcaccuggccucaagauuuuacuuauauuuuaaaugucuacaucuugaauuucaauucuuauucuaccuagaagcuaaaagcauuggcaggguuaugaguugggguggaaauauuugggccuguggaagauaaauucauauuguuugaagaaaauaaucugcuuauaauuaucaguuuauuauaaucaggcccaaagaaggaaaccaaaagucuuaauauuuucuuagugauaaaguggaggaaguaacugacaaaguaauuuuggcucuuuaccagggaugcuucauauaaaggagggagaacaauuuccuugacaaccaauuaauauguauagcuuaaggcuaugacuguauucugcaagaaauagauuacauuucugaggucugcacaucugaagauauuauaaacuagcuaggagauuuuuaugaugauaugauacagaucagcaauacguaagacagaaaggggguuucacccagcaagaguuaggauuuauagucccaguaugcccgaguuuuacauauugugaacuuugcuaaccuucaccuuuaucaacaagcugugagugacucuccagcacaaagcuuugaguaucaagcaugcauauaguaaaaaaaaaaaaauugccaggcaccguggcucaugccuguaaucccagcauuuugggaggccaaggcggguggaucaccugaaguggggaguucgagaccagccugaccaauauggagaaaccucgucucuacuaaaaaugcaaaauuagccgggcgugguggcucaugccuguaaucccagcuacucggguggcugaggcaagagaaucgcuugaaccugggaggcagagguugcggugagcugagaucgugccauuguacuccagccugggcaucaagagcaaaacuucgucugaaaaaagaaaaaaaaauuauacugaugauuugggggagagcaccaaauacccuuaaaguuuuuacggcacagacuuuuuaguaaaucuuaugaggggaugauuaugggaauaauaugcaucuaucuauauauauauauauauauauauuccaaaaauauuggcaaaaauaaugaagaaccugaaaguccuccauggucagaguuaaggucagggucagggaugaauguugcauuaguuggcaauaaaaagcagccauuguacaguuugacaggccugugugaauauccugcuuuguagcugaguguucuugcuuguuaaucugcuuccccuauccccacucuuuuuuuuuuauuuaaucuggugguugagaggugcuuccaagccuaccuauuuuauuuaccacuuccucguuaguuuuuugggcuucuuaaaaugguccuccacucuuaugacuucuggcuguuuguacacaagaacuguccaccucucuccuccugccgucaaggguguugcuaaaccuaucauccucaaccugaagcuccuuccacauccuucuugccagcucacuaucagucauuuccugagacugacaucacaaaagagucauuagauuuaagcccugguuucagcaauuacuggaccuguugugauucuagacaggguucuuaacuuuuaauuuuccaugacauuuuuucccuugacaucccaguccaagcuguugacuuuugcauuuacugcucauuucuaccuuuaauauuccauuuuccucuguuaauauuauaugcugugaaacccaggagaagucagcauuacuauggucuuggguagaacugagagagauaaagacaugaauuugaggcuguugggggaugaguugcagagaggcauaaauacgaggcagaaaauaaguuaugagugagaauacaacuuauuaauagcuuuuguaaacuucuggcaaaaaaagauauugaagauaauuagaguugaaaaauuauauaagacaucacuuacgauugggauucaaucacauuuuauagaaaauucaaauaagaguugcuuaagcaugaaagaaguucagagguaaguagcucagggcuuguauggcaacuccauggucacagggggcccagguuccuucucacauuguuuucucccauccuuggugcuggcuuacaugccaaaugucuccucaugaccacaagaugcuccugguguucccagaccaaacugaggguugggcugcuauuucucguggcccaauaacgagaagcagaugaacuggggaggaagaguuuuuauuucugcaacugguuauggggggaaggccuggaaauuaucaccagaccaacucaaaauuacaguuuuccagagcuuauauaccuucuaagcuauaugucuacguguaagugugcauucaucuaaagacauaagugauuaacuucuucuaaucuauagcuaaggucugaguccugaagaccuuccucuggagccucaguaaauuuacuuaaucuaaauggguccagcugcuggggugauuacccuuauuaugucuccugcuuaaaucacggagguuuggggaguuccuucagaccuccaauaaacuuguuuguggaggucuggggaguuucuucagacccacaauaaaacucguuuaauccuaaauggguccuguuaagaauuccuuuguuauuuuguuaugcuuuaaggcccaggaaaagccuaggcaaaacucuuggugggcuuucguuacauuccagccuuuguauaagggcacuggcuuuuuuaacuuuuaauauuuaacuuaaccacucagucaguacugaaacaguuguuauggaggccugcguuagugagagcuggccugccacacuggugcuccagcuauuauguccacguuccaagauggaagaaaguauaauggcaaaaguaccuaucucucagcugaaucaguuugcuuuaaagggcuuccuuggcuuccauccacuucugcuuacacuuccuugaacaccuccagaaaccaaggagguugggaaagcuuuaggcugaggacauuaucacuccaaauaacauauuuuuaagucaggaagugggaagaguggauauuguguaggcaacucacagucccuuccaccauagccgaccaggacagagauagcuggaugaugguuugcucuaguugagccuaaacaagcucauggcucccucuccuuaaacuacuuuuauauuuucuuucucuaaguucagagcaaagcuuucauauuauuuuaugaauguuucuuaacaagcucaucguuucugguguuuugcugcaauucugcaguagauaguaugguauauuugguggacagauucagggccaccaggcuuugaauagcaguggugcuacuuagaagcugagagguuaugaaccuuauaugcaaccauagggaauaguguuguuacuauaaauaaugauuguacugaaccuuauaugcaauagugaauaauguuauuauaaauaaugauuguacugaaccuuauaugcaacauagggaauaauguuauuauaaauaaugauuuucagacugaggcaguuuucuaaaaauucaagugaaagaucacauuacuuuacaugaggaccacaaggcacauucaaaagauacgguugauucacuuuguuaaacaauaagaauauaaguguccaaauacagaacaaaggaaauaauauguccaagaaacauuuuucuuugcuuaauacuaaaagccucuugaucuguuuccuauauccuagucacaacugaauuuuaagaaagucgaggucauguugguaacuccaugucaauacugcuuuguguacuaacugcaagaucaggaaucgucccucauuacuuccaucuuggcuuucaaaagagccuacuguaauuuuuucuucugaaauaguaugaaauaacuuuuuuccugaaagaaaaucuccuuucuaugguucuuucuucugaaacaaggcuuuccuucucugagcuuccagcuagaauaauuuccucugacauacucugaucuaggaggauuguaguguggucacaaugccucagcugauuucaguuaauuuucuugagcugaaucaaaugaaugucuuaacaaguuguccuuuaaaaggauagacgugcuuuuauacaaaacuugcauuuaaaugaaaccacuagacuucuucauacaauguaaugaagucuugguauuccagcgauuuggcaccuaaaugcauaggcacucaguaaauauuggagggaaggaggaugguggaaagaaagaaagggggagcagggaaaauuaggggggaaauuauuuuuucuuccuggggauagguuucauuuuuaauugggaaauguaaugugaaauguauuacuuucaaacuugaggacccagaauauaacuuaugaugauuuaaguuuucuuccuuuuauuuacauuuuaaugauaaagacacucauuggccaagacccagaaaaaaaguuuaaauaaaaauuuacauuuuaaugauaaagacacucauuggccaagacccagaaaaaauaguuuaccuauauuuuauacguguuuguuuaaaaaaaaaaaacacaaucuuugaaaaaucuggagaauuuauuucggguuauaauagucagaaaaugugugccuuuaaguuuugcuucugaauagacauauucugcuaagcaagcaaucuccucuuagacugcuugcugagcacauauacuuuccguaugcugauuuuuaaagugucuguauuugguugguggcuuuaguaauaagagacuagcuuuuaacacagccagaagaagcugaugugaaccagcagaaauaacacugaucauauauaauacuuauggaacagugguugcccaccauuuuugaacccaagauuuccugacauuuaucacugugccaacaaaaagaaaaacuaggaaccuggggaggacuuagagagaggaagcauggacagcugccagccugggcagauggcgucuguuugguugagacagauucaccaggaaacaagaucagauccuaguuugagacccaaaaccuggugaguaagaacaaguguucaggacuucaaggggcccaguaggcaauugugggaaaaaaucuggagguccugaacuugcccaaauuacagggguaggugagaaaagguaauccaagggguaauauuuuuuucugcuuuuugguguuaucuauauuuucuuuaacaauuauauauauuacuuaaaggaaaaaacucuaggucuuauauauuccugacuaagcuucaucaauauguauuugcuucuuuuauacaaaguaacauuguuuucauuuacagauugccauuaggauaccuuaguaaugauguccaguuaugaugcagauauuucaaaguuuauuguuuauuuauuuauuauuauuuuggaggcagggucuuacuguguugcccaggcuuggguacaguggugugaucuuggcucacugcagccucgaccuuccaggcucaagcaguccucccaucucagccucccaaguagcuggaacuacaggugugcaccaccaugccugucuaauuuuuauauuuuuuguagagauggggucucgccauguugcccaggcuggucuugaacaccugggcucaagagaucugcccgccucagccuccccaaaugcugggauuauaggcgugagccaccgcaccaggcccaaaguuaaaauaacuuaaugaauaagguuuggaugaugucagguaccccuuuuuucucaggggaacuggcuccuacuuagauaucuuaugaccauuagugggacauuauaggauagccuagaaacagaaacacucacgucagugugauuuauggcuaagcuggcacucgacaucagugggauaggaggggguaauacauuaaauggugcaugggaaauugauuauucguucagaaaauaauugaaauggaucuguacuucauuucauacacaaaaaucaauuucagggagauuaagggacuuaaguuauaaaaggcaaaacuuugaaacuuuuggaaauaguauaggagaauagcuuuaugaccuuggaggagggaaggauuuacaaauaguguuagcuauaaggcaaagguuuggucauugagccaucuuaaaaucaaggaaauuacuucaucaaaagacaucgcuaaaagagugggagagaaaaaccacacacugggagaaaauaugugccauacauauguguggcaggcacaccugacagcaacaaccgaagcauacccugagaaugacccuauggucuaagaagaauguguguuuggaguucucagcugaggaaccugguaguggccaacccggagacugauuccuugucuaugaggaacaucugaacccccggcccauuucggauuaaaggaggguugccaggugaagguugcaggaggggagcuaaguaaaaaugcuauauaaacugcauacuuuuuagaaacgguagugguucguccauccagccugcuaccacuggaccgcugcauauguaaguccccucgagaagcccuauaucucauuugccagcucucggucucuucuuuggccucucuucuuuggccucucgaaccugugcuaucccuauccaacucaauaggggucuggcacaauaacauguaacuaacaauuaggaaacagaaaccugucuuuuagaaugugggacuucucuucaucaaaagcacuguaaaaugaguuaagaaacaacccauaaauacuugaggaagauacuugccauacauguaacugacaaauuaauaaaggaaaaagguacucuggagaaaaaugaacaaaagccuugaauagaaacuacacagaaguggaaaugugagguugggcgugguggcucacaccuguaaucccaacauuuugggaggccuagacagguggauugcuugagcccaggaguuugaggccagccugggcaacauggugaaaccccaucucuacaaaaaaaugcauaaauuaacugggugugguggcagacaucuguggucccagcuacuugggaggcugaggugggaagauugccugagccugggagguggagguugcaaugagcugugaucaugccauugcacucuaaccugggcaacagaggagacccugucaaaaaaaaaaaaaaaugaaaaugugaauggucaauaaaaaugugaaacuacuuaacuucauuaguaaucagggaaaugcaaaugagaagcaccaggugauacuguuucacacucuccggggcggccaaaauuuuuaagucuuaacaaacaacccuaacaauguagagucacaaacaggaauccuuagacacugcugguggcaguugaauuaguacagccacuuuggagaacucugcagccuugucaggaagaguugaagcuguguguaauccacaacacugcccacacuccacagcaaugcuucucaagccuggcauaauauauuagcaucccaaaaugagcauguuggaaauacuuacaccuggcccuuaccccagaccugugauucucaaaugguaugccaagaugcccuggggaaccacagcaaacucacagaagacgaugggauaucuuaaauguucaaggggaaugcagugauacuuggcaucuguugaacgcagugugaauuacuagcucaagacacuucaguucagucucaauguuaccccacgcaucaucccuuucuauuaugcgaagcuggauuuucagugguugcuguaacaaaaagcagauaucaugaaaaucaguauggaagaggaaauaagggugauagaguccaauaugauuccaaaguuuaagaaguuguauagugcccaacgagugcacacauuccauuaauaaguaauugagguuauuuaagaaugaaauaaaacuuuuuucuuugguauuuucauacagauuuuucaaacagcuacugcauuguuaggacaaaaaagacuuguuaacuuuuuuggaccuaacuacuuaaauggaauuguuaggaauuuguucuaggggugccuagaacccugaaaaaauugagccacuuaguagugucccuucaacugagaauauuugggaaucucuuucccaaauuaguuaacucagaauggagauggaaucucuaugucuuuguuuuuaaaaagcuccccaagugauucuaauggguucguaagguugagaaccacugcuugagagacucuugcacaugugacuuaggauaaugcuacucaaauuguaccugggggccagcgcugguuugcaaauuauuuccuacagaucugcagcaaguuuauaugaaucauacuuucagugaauaaugguacaguuuuuguaaucuuuugucuucugauuaaauuuacugaaauauaauuuuaugucaaauuuuauaauggaaaaauugaggcuuguacuuugugcuuuuuucucauauuuuucuaauauuuaugauuuuacagcuuuguugauguauaagugaucaauuugcacucuuuaaauaugugcaauauauuauaugucaauuuugacauauguauauacuugcgaaaucaucaacacaaccaagauaaugaacauauccaugacucucuaaaguauuuucucaucccuguguaaucucucccauuuggcccuccacaucccuucauaauccuccacuccuguccccgccccagugcaaccacucaucugccuguugucacuauagauuaguuugcauucucuagcauuucauguaaauggaauguuacugaauguacucuugcuuuugucuggcuucuuuuacuuagcauaauguuuugcaauucagccauguuguuggauaugucaguaguuuacuccuuuuuauugccgauuaguauuccauuguauggauaugccacaacuugguuuuuuauucaccaauugauggauauuugaaauguuugcauuuuggcugcuaugaacauuuguguguaaaucuuuaugugaucacgugcuuucauuugucuuggauaaauaaauaccuaggaguggaaugguuggauugcaugguaggaauaugcauauaguaauuuauuuuuauugcauuucacaaauaaaaagcauuagcccacaaggauuagaaauaaaacucucccaggccgggagcaggggcucaugccuguaaucccagcacuuugggaggcuaaggugggcugaucaccugaugucaggaguucaaggccagccuggccaacaaggugaaaccucauauccacuaaaaauacaaaaauuagcugggugugguggugcaugccuguaaucccagcuacucaggaggcugagguaggagaaucacuugaaccugggagauggagguugcagugagccgagaucacgccacugcacuccagccugggagacagagcaagacuccuucucaaaaaaaagaaagaaggaaagaaaacucuuccuucagcaaauguauuuugaaaaguacuagccuaaguuaaaugcccaacaguguucacagcuacauuguuuauaauagcaaaagacuggaaacaauccaaucauccauugucaagagaauggauuauuaauaugaaguauauauccaguagacuacuuuauaacaaugaaaacuacauugauguagcugcaguuuaucuacuacauuaauguagcugcagcuacauuaaucagaaugaauaaacggaauuuaaaguugaguuccaaaagcaaauugcaaaagagugcauauggaaggauuucaucauaugaauuuuacaaacaguauuuuacuacaauauuaaauagcauuuuauuuacagaaacauacauauaugguaaacuauaaagaaaauggugauacaaaaugcaggauaguguuuacuuggggaguggccgaagguacaaugagagagauaggaccaaggaggacagacagaggccuuugaggcuagugggucuuggucccguucuuaaacuauaggaauucauuuuaauguuacauuuuguguuuauauuuugucauaaauuuuuugugcauauucaauauguaaccacaaaauacaaaaaaacucucaacaguugacaagggaguuuauuaagcaaauagagguaccaauuacaaaccaucaggguuagaaaaaaaauccaggcuuuaaguaaauauaaaucuaaguaauaggcuauugacuauuaucuuagaaaaacuugggguauuacaccagguuaucacagaauauuuaguugagaaguauggaaaauaugauaugcuauuuauuugaaugauacucgguaggcauguaaugugaugauuaaaucaguuaagaauaugugauagauuuuuuuuaaaaaaacaucucauuuaaaaugcaugucuuuuguuuuuaugauuauugaaaaaugguuuucagaauacaaaaugagaaucaaaaauugguaauuagauauucuguguuucucaaauggacggacuuuauaauuggguggaguuauguuaaaagcuagaaaaacugaagaaguuaagaaagaauugaaaauucccauuaagagaaaaaagaaaaagcugcaaccuuugcuaauauaaaccguaagagccuaugccucuugaaauuucucuguguuugucuuuguacauuuuuaaugacuuaaugagaaaaaagauucaucaggacuccuuuccuagcaggagguuuaguguuucacaaaugaguagggagcugcucucauaaugagguaaacggccaccugauucuuggauaaguccaaggaaaaccuuuacaccagaggaagcaacagcuugccaguguucaaucugagacuuuccaaggucagaagagaggaggauugguauugauauuuaauaagcauuuacuguguccaaggcauuuugguacgaauuuuauaucucuuaucugauauccuugccuuuuaggacuaggcuguuuuuaccuuuaagguagauguuauuauucucauuuuacacaugagguaacugaaacauagaacuuaaaaaccuugccaaacauuucagaggaggcagauuuaaacccagaugcauuugcauuaaaccccaauggauuugauuccaaagcacgucgucuuucugcuaauaauagccaacagucauugaguacuuacuauauuuauaccaaggucuguuccaagugauacauagauuuucucuuuuaagccucguggcaguaugagaaagaagcuauuauuauccccauuuuacagaugaaaaaauggagucacagaauguuauguaauuugcccaaugucacacaguaaguggcagaguugguccaccucaggagcccacacucuuaaccucuuuuggccuuuuaugaguacaucugcccuuucaaggaucaggcuugagucugucagggaggccucaugucuccuauuaacuuuugagccauacgcaucauggaaacugguuucuccuggcuggguacuucugaguugccuggccuccugugagcucuucuuuucuaauugaaucuacucucuaagacucuuugcugcuggaauaugcagcaguaguuugagagacacuucucagucaguucuaacauguuuagcuagguucuuccuauuuuuugugcuucaucagaucauuugggcucaguguuuucuuucuuuuuauuuuuuucuuuuuuuuugagacaguaucucacguuguugcccaggcugcagugcaguggugcaaucucagcucacugcaacccugccuccuggguucaagcgauucuccugcgauucuccugccucagccuucagaguagcugggauuacaagcaccugccaucacagccggcuaauuuuuguauuuuuaauagagaugggguuucacuauguuggucagguggaccuuaggugauccaccugccucagccucccaaacugcugggauuacagacgugagccaccgcgcccagucugggcucaguguuuuucaguggaauaaggaugaaucauuagaagagcuuucauaccucuuaaacucucaaauuccaugccuuaauaaggauuuuuauuaauacuucauuuaaaacaaacaguaauuaagcaucauuuuaaccauuugaugugauuauaacucauaugcuuucuacuccaaaaauauuugaaguagaagaaaccaauacaaugggauaaacacaaaaaaaugcagaacaauguagagaaaacagagauaauuauacaaaaccuuaagguauuuucguuauugcuguugagcauuuaaugcugaauuuccuggcagcugaggcaacagaaagguaauuggucagauaauuuuuguuauauguucaaauaaaguaaacuaguucauuggggaggauaggguaccaugucaggccacuagccaacccuuuucuuccuacaaguuaaauuauaucugaauauccucuggagcacucagaucuuaaaauacuuuagaagagacuguaaagaacugccagugauugucuuuaaagaggcgucauggcagugcuguaauucuugcuuagcaacacuuauaucuaagcuuucuucucugagggaaaggccagguucuaggucacucccucacuuuguuccagucucugcccaaaggucaccucuucccugacugcccuuucuauaugagguucccaccgaacgcaucuggguugcccucuaucccuguccaacauaguagucacuagccauauaugacaauuaaaauuaauuaaaugacaaaauaaaaaauucaguacuuuggucauaccagccacauuucaaaagcucaguagccauguguggcaacugggcauauuggcaacacagauacgucaucgcagaaaguuccacugggcacugcuagccuaugcucuugccuuaacuuuuucaacacuaugccaugccaugcaccuauugauuuguuuauguuccacuagaauacaugcucuggaucacagaguuuuuuuuuuuuguuuucccagaacauagcugaauccucagugccuaaagcagugccugacauaguacagugcuuuguaaauacuugccgagugaaugaacaacaaaugaaugaaugaauuuuaguauuauuuugcaguuucaaaucaaaaguauuuugucuaaugucccugggugaccuaguacacguucugccacaguuuuugagaugaaagaacgaaaauucugugaucaaagagaacauuuuaaagauaaaaugauauuaaauauacuagucaaaauuuuauuucuuuuaucuuuuauauuaugaagaauaauggguacgaaauuucuguuuaucaauuaacguaucauccugaauaugaacacagaaaauaucaauuuucuuugcauuaagaagucauguaaguagaaggagaaaacaaaguacuuauuacauagcuaacuggacuuacagucacaucuaauuuaaagcaaauuugcuccaugcaauggaauauacuaaaaguaauauugugcaauuauagcuacagacaugauaggaaaucauaauacauucuaaaaguauauagaaaaaugucaguuuacuucaacuuauuuuaaacaaaaauuacccaugaaaugauugcaguaccuaaaaagaauuugcaaucugaacaaaauauaacuagaagcacgacuacccuauaucuccuauaaauacagauugaagcuaguuuugugauuucagccaaagaugcagcuucaguaaccuugaaaaacauuguuuccuuucuauugggccuggcuuugucaggagauacucaggaggugauggugaaaggagguaccugguggagccagacgagucggguaaaucagcuuuaacaagcagccagaugauagaugucaguugggugucaugcccaauucuaguugcugacaauuaggaauuagauuaaaauaggaguguuuucuccuucacccucccuuucuuaaaagcagccauuuucugaguaguguuaguucuuaguucucaguggauuugcaaaugcagaucaugaggcaccucuagcuugggcaggauugguguuauuuugcuauuucaaguaaaaaacaugaugguuaguguccuuggauaaccucauauacuuucauuguuuuucaaaucagguccagugaagggccaaguucuucauaaauaucauggcuaauuuuggaaacccauauguucaguuaagguuucugaaacuggaauaaauaugaauggaggauuuaucaacauuuggauauuugcaauuucaauucuugauucuuuuuugaaaaucuauucugggucuacaucugaaauguuuaucuccuuuggugcuagauccagaguacaauuuuugaaaacuuuaaaucaaggguggaacaauaaauucacuugcucuuaagacuuuagggguuguuuuagcugccaagagagcauugccugugugcugcgaaaaauacgagagccacagaauggccaaauuauugcuuuuacucaggcagagugaagaaaauggcccugugacagacauuuccaguuuccuguacauagaaauggggaaacaguugugaaaaaaaaaaaaaagccagcugggguucuugacacacaguucaugcuaauuuuaaauuguacuaauacuugacuauauagugagggauccuuugcaggaugaugaucuguugaagacucagcaggccacuguggggagagggagagaggcugucagaaccuuccccuccagaggccuuuuaauggauacugaauucagaauugaccucacagaaucugaucauuacugaugcaagagcaaagucaacaucaucugcaaagauaauuucucaucuauucaugaguaccugugcuuaucaccacaucuggaaaucugacuacucaaauaagaauuucugucgagagacugaacaagccaggcaccaggaauauuuuacucuguauguacagauggacaucgauacuggaauauuucugucucacugaugcuuagggaccaucuuuugauuuugauccgugucaagauucuaaggcaguuuaacuaagacauggguuuucaguguuuuuuuguuuuuguuuuuguuuuaauuucuguuucugugaguguaauuuagggaggaguaccagcuuguuuuuuauaaguuguuucuuacaaugauuaacacauaaucuuuucugccuuaagguuuauaacaaaugugaaacuaaguuucacagguuaauuccagccuaaucuuuucauagaugauagcguagcccagaagcaauaugcugugacauuuuauuuuauuuuauuuuugagacagagucuugcuuuguugcccaggcuggagugcaguggcaugaucucggcucacugcaaccuccaucucccagauucaagugauucuccugccucagccacccaaguagcugggauuacaggcaugcacaagcacgcccagcuaaucuuuguauuuuaacagagacgggguuuugccacguuggccagacugguuucgaacgccugaccucaagugauccaccaccucagccucccaaagugcugggauuacaggcgugagccaccguguccagccuaccgugacauuuuaaauuucaaaauguaauaaaaucacaaguuaugccagaaagccaccguacuucucauugaauauaguaucuccuugguguucauguccuuauguucuuauauaacucugugugccaguguuucaccaaaucuaucaacucuuuuaaggcagagacuacauuuauuuauuuuuuaacuuuuuguuugaaauaacaaaacuuucugauaacuucagacuuagaaaaaaguugccccaaaauacuacacugauuuucauguacccuugauacagcuuccccagauguuaccaucuuacauaaucauaguacagugaaggaaacagaaauugacguugauacaauagcaucacuaacuaaccuaaauaacuuauuucaguuugccgauuguccuacuaguguccuuuuuaaaguccaggauccaaucuagaaucccauacaacacuuacuugucacgucuuguuagucucaucuaguccggaggagucuuucuauaauuuucacgacuuaauacuuuugaagagucccgaccagugauuuuguacaauguccccaguuuggguuugucugauguuuucuuaggauaagaauuagcuuaugcauuuuugacaacaauaccacugaagugauguugugcccuucccaauguuuuuuguuguuguuguuuuuguuuuuguuuuggagaaggggucuccaucuguugcccugccuggagugcaguggcacaaucucagcucacugcaaccuccgucucucggguucaagugauucuccugccucagccucccguguagcugggaccacaggcacacaccaccacgccuggcuaauuuuuguauuuuuaguacagacaggguuuugccauguuggccaggcuggucuugaacuccugaccucagaugaucugucucccaccucugucucccaaaaagcugggauuacagaugugagccaccgcacccggcccccaguguauuauaugagaggguacaugaugucaguaugucucauugcuguugaucuaaguuuuggucacuuagauaauguggugucuaccagguuucuccacugcaaaguuacuguucuucccauuagaauuaauaaguacuuuguggggagaugcuuuaagacucugcaaacauccuguuucucaucauacuuuugcccauuaauuuuagauacuauugaugauucuuaccuguaacaguuauuaguguuugcuaaaugcugauauauuuuauuuccaucauuccuucuauauuauuguaauucuacuguaaggaagagcuguucuuucuucugcuauuuauugauuuauuauguuaauguggauauauaauuaguuacuauaauuuuuuucucaaaauaucucagauuuggccauuggaagccccuucagacaggcuccugucuccuuuugacauauccucauuaucuuuuaaaugcauguuguaacucuggcaucacaagaugugucuggcuuauuuugcuccagcccuagaaucaguaacuucuccaaagacccuaguucuuuuuacuguagacugguauuuagaaacaaaaucugggugcuggauaugcucauugcuacugguauaucauugcuucuaggcccucucagcuuacagugcuaggaaauaaugugucuguauauccagacacauguuucucucucccucucucuccauaucuauaugccuaugacuaucuaccuauuaaaaacaauaaguuuaucuacuuauuaauacuuccacuuacaauucaauaccacuaguuuccuuuuagauaucucuuuccuuacucguggcuuuuucuccaacaguuagaaaccuggcauucauuaucuacaauauauuuacuuauuugcucaacccuaguauauauguaaagaaguuucagaacugugauuuccauaaucucuaugagaaacaaguuuaccaacaagacuauauagcauccaggugcaguccuuuuugucuuuagucuuaagguauauaauaaaaguacugguuuccaaaauuagguuagauauuuucuuucuuaccucuuucaugguggcuguuguuuuuuacuuguaauacagcuagguucuuuuguuacuguucguguuccauuuuggguucccccaacaccgagagguugguuuuaauuauucuuuauuagggggaugugaaacaugauuauuguucucagagucagaacucugugaaaaggggccggucgugguggcucaugccuguaaucccagcacucugggaggccaaggugguugaaucacuugaggucaggaguuugagaccagccuggccaacaaggugaaaccccuucucuacuaaaaggacaaaaauuagcugggcauggugaugggcgucuguaaucccagcuacaugggaggcugaaguaggagaauugcuugaacccaggaggcagagguugcagugagccgagaucauaccacugcauucuauccuggguggcaagcuagacuccaucucaaaaagaaaaaagaaccaugugaaaaggcauuucagaaaagugucauuccaccucaucccuucugucacguuucagucucccauucuucccaucuaccccguaagugaccaguuuaguuucuacuuuuuucuucuguauuucuuuuugcacaaauaaacaggcacauauauguuuucuuauacagagaugauauucagugucuuuuuuugugugguacugggcaauuuaaaugcuguuugguaauuuuaacucuuaaggauacuguuuauaauugaucuguccuuaaugccaauguauuagaaagcacacuaaaugauuguuuucuuuuuuguaaaauauuugugagauuuuuuaaaaaaugaaggugacaugaauuuugaugggcuuauuaacacugaacuauuucuugauaagaguugucuaaaaaaaugagaacauaugccaggcgcgguggcuuaugccuguaaucccagaacuuugggaggcugagacgggcggaucacaaggucaggggaucgaaaccauccuggcuaacaaggugaaaccccgucucuacuaaaaauacaaaaaaaaaaauuagccgggcguguuggugggcaccuguagucccagcuacucgggaggcugaggcaggagaauggcgugaacccgggaggcggagcuugcagugauccgagauugcaccacugcccuccagccugggcgacagagcgagacuccgucucaaaaaaaaaaaaaaaaaaaaaaggagaacauaaagcaaguaacaauguuuuucaaguuuucuuuaaugcauuacaucuuuuuuucacaagauauuuuaaaauuuuauuuuuccuuauuaagcgaauugaauuauuucaagcaucagugagagcugcuagacuguuauauuucgggggucuugcaggguagcuuuucuuacacauauaagcagaagaaaacauuuucccaagucuuaaaagaggguuaugaugcauuucauuguguacucuuuuucuucccauauacucugcaggcauuugggcaguccuucuccauccaccggaagguugcugaagauggagagacucgggaggaaacgcuucugcaggagucagcaucgaaggaggcuuacuaucuggggaagaucuuggagaugcagaacgagcugaaacagagccgggcuguggucacuaauguacaggcagaaaacgagaggcucaccgcagucgugcaggaucugaaggagguaaauaaacaaauucccuaugagagauuugugagagggagaaauaagaaaguucucuccauagcagagaggaauaacacuuuuguuuuaaucagaggagcuguauuaagcacgaaacuacuaauacugagcuagcaacuuuucuuuuuuagugaaaugauagcuagcuuguucugagaugagcuuuucucucuuuuauuguuucuugaaaauuaaguuuuguauguauugcggacuucggaauuggccuuacuauuucugcaaagguauuuuaaaaauacagugaccuuagcacuuccucccugcauuagcugguuuaauacaauguggagaagaacgguuggcuguaaugcucuguaucugccugauuuccagcugacagugguguuggcucaggacacugcucauagggaaugacagccuaggcgaguguccugagaagucuuugagucuggugaugcagauccccaaaggauuuuucugguuauagagaaggcagcaaauuauggcugguaugaauuaggucagggagucucucuugcucugugaguguugagcauccaccaaacucaguauuccuuguuagcuuuuccaaggcagcaucaccugccauaucauuuucaaacuggcagagucauccuuuaguggaggggugauguuggaaacagagauagccaaaaguagcuucauccaucaaaccccuguaagaacauuuuuggaagcuauauucaaucauucacuccguauuuugauaugaaagcuauagaagagacgcagacguccucuaacuccuacaccaaugcagugaucauugacagguccacaaccaagugggcucacuaguugagcauuuuagugauagaaauauguaggaugaaaauauucuucaauauuguaaaguauaagacaagcaauccacauuugaaauaagugacauauuacaaauagggcuucacuauuauaagauauaaguuguccagaauuuauuggaauuuucuagauaauuuacguuuacacauguccauauuacaaugaacuaaaugaauacugacagcaaggucacuuaugagauaagguuuacuuaucucguuaucuuuggauaugcccaaauauagcaauaugacuugugaagacagagaaaggaucuaaugaaguggaaguuaguguugaguacuaagaagaagaugagacaguuuucaggauaccaggaccuccucauuucccuccaacgugaacaacuguuaaaaacagagcuacucucugguuccuucuuucugagacagggugucacucuauugcccaaucuggagugcaguggcacaauccagcauccauugcagaaguggacagagggucauguggagccaaagcccaccauucuggauuaaggaagucaccaaacauuugcagggagcaaccucagcagccgugagcagcagggucaugugcaaguuggcagagaggauguggcaugggcaacgugaggaccgugugcacacgcaugcaggugguuuauggagaagaaugugaccaaugagucgaguauucuugauggccaguuggauggauccucugaaagcugcaauccccauuguguguagcagcugcagcugagccaagaacagccaagguugaggauggggcagggaauccacagaugcuuuucugugugagucaacguggugaugauuaauggagcauccucacuuacacagccacgcuugaaggcaguuccaaugaguagauuuaugaugcauggcagaaguuaauuaauuaagcaugaaguuacaaguuaggaaugaauggaggcagcaaaagaaaaaaaauuugaggggccuuucauucagaucaguucucaaacuugaaggagcaucugaaucaccuggagaacucaucagaccaugaacacggggcccccucgcagagauucugauucaguagaucgagguaggacccaauaauuugcauuucuaacaaguucccaggugaugugggggcugcugcucuggaaaccacauauuaagaaccacuaauuuagauuuuuuggccugcccaaagcugaggaaggcucacaauugggacauugcuauaagcaccaugaucuccugaauaaaucaauugguugugauucuucaauuuuuaugcauuuuacauaguagauuugcaguaagagaauaacuuguuauauccacauuuagguauuuuugaucuaaaacagcuugaggcacuuuagccuaugaauguguuuauucagauuugucagguaacuaaaagaaaaaaaagaucuuguguuucuuugucuucuaugugugccaauaauguauuuguuaauguucuuucugaugagugagagcuggugauauuacuauaacccugaguuuuuguuuuuguuuuuaauccagcagauacauuuuauuuugcuguaccuaagagaauuauuauuaacauuuagagcuaacauaaaaggagaauaggaauaaauucuauuuuuugguguauugauacacacuuuuaaugguugguauuaaguugaaaucucagauuugauuuccuuuuaggcucaguuuuauuuuuuguacuauaagcauuaacugauguacagugauuggaagagagaucauguaacuuagaacaguuaugacaugauggaccaugagaaauauacaaggauaaccaacccaaaauauaguaaaugaucaguuugacagaugcugugucucuaagaacuuaauuaaugggauaauuuuucuuuacugaaaggacucauuuccuguuuuaguaggauuguugguccuggcaaaggugugugugcgugcauauauguugggugcaucgugaaagauuuacccaugugugugugauuacaaugucaaauucucuuccauaaauaguaguuacaggauaguaugguggaaaauggaaaaauugcugaauuagguauuagaaaaucaauauucuagucagcucugcugaaaguuuuaguauuaaauucaugauauuuguaaaauuuauguuaagauuauauugauauagaguacauacauaaacauaagcaauuaucauuaauaauguucugcauacuccaaaaauaucauugacgauaugacucauuauguagaucuauauucuuaggguaaagaaacaugagauaaauaucucugaauuuaucaccucaaaaauucuuucucuugugauaugaaucaggcaguagaauuacacauuuuuauuucugccuugacuguuaagaagcucugcggcuaugcuuaaguauaaaaaaacuaaccuagauuuuuuucaucuaauucucacuuuuaaacguuuugauuagccuuauuguauauauguuuuuaaugguaaacugcuuuaaauaauuuuauauacuauacuacaaggcuacaguaaccaaaacagcaugguacugguaccaaaacagagauauagaucaauggaacagaacagagcccuuagaaauaaugccacauaucuacaacuaucugaucuuugacaaaccugagaaaaacaagcaauggguaaaggauucccuauuuaauaaauggugcugggaaaacuggcuagccauauguagaaagcugaaacuggaucccuuccuuacaccuuauacaaaaacuaauucaagauggauuaaagacuuaaacguuagaccuaaaaccauaaaaacccuagaagaaaaccuagccauuaccauucaggacauaggcaugggcaaggacuucauguauaaaacaccaaaagcaauggcaacaaaagacaaaauugacaaaugggaucuaauuaaacuaaagagcuucugcacagcaaaagaaacuaccaucagagugaacaggcaaucuacaaaaugggagaaaauuuucgcaaccuacucaucugacaaagggcugauauccagaaucugcaaugaacucaaacaaauuuacaagaaaaaaaccaacaaccccgucaaaaagugggcgaaggacaugaacagacacuucucagaagaagacauuuaugcagccaaaaaacacaugaaaaaaugcucaccaucacuggccaucagagaaaugcaaaucaaaaccacaaugagauaccaucucacaccaauuagaauggcaaucauuaaaaagucaggaaacaacaggugcuggagaggauguggagaaauaggaacacuuuuacacuguuggugggacuguaaacuaguucaacccuuguggaagucaguguggcgauuccucagggaucuagaacuagaaauaccauuugacccagccaucccauuacuggguauauacccaaaggauuauaaaucaugcugcuauaaagacacaugcacacguauguuuauugcggcauuacucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucuccguaaacuauugcaagaacaaaaaaccaaacaccgcauauucucacucauaggugggaauugaacaaugagaacacauggacacaggaaggggaacaucacacucuggggacuguugugggguggggggagggggagggauaucuuuaggagauacaccuaaugcuaaaugacgaguuaaugggugcagcacaccagcauggcacauguauacauauguaacuaaccugcacauugugcacaugugcccuaaaacuuuaaguauaauaauaauaaaauuaaaaauuaaaaaauuuaaaaaaaaauguaaaaugcuuccaacagugccugacauguggcaaaacaaauuaauaaacguuaucuguaucacaaaaaauaaaaaaauaaauaaauaaauaaauaaaaauaaauaaaaauaauuuuauaggccgggcaugguggcucaugccuguaaucccagcccuuugggaggccgaggcggcuggaucacaaggucgugaguucaagaucagccuggccaagauggugaaaucccgucucuacuaaaaauacaaaaaauuuagcugggugugguggugggugccugucccuagaugcuugggaguuugaggcagagaauugcuugaacccgggaggcagagguugcagugagccaagauugcgccacuguacuccagccuggcgacagagcgagacucugucucaaaaaauaauaaugauaauaauaauaauuuuauaaaauacagggaguauaaacaaaaacugaucacccaaauuggagaaccaaauuaauaguuaaucuuaaccuaauuaggaguuaauccuacagggccaauaauaggcagagugaagaaaucucugaguucucuugacccagcauuauuuuugguaagagcauaaagaaagcagauugcuauaggauuuaaauagauauuuaguaaacaaguuugaauuucauuuuuucuaucuucaaccuguagguauaauauacuagaagauagccuaaaauuuggguaauauuuacuuuuauacuuauuuauacuaaacuaaacuaaaauccacauuaaugaaaucauaaaauaggauaaugaaacuuaauacuacuuaauucucccaauuacuagcuaaugucucaaauauaagauauguuagaauuaacugcaauauuuacaaaguauacaaagcaauuaugcagcauuccuaaccagaauugguauauaugggauaaaaagaugucacauaagauaggccccuucagguggaaugcagaagauuggaguuaucaaaugaauuaucgaccuuaguagagauuaagccuauaauuuaaagugaaaauaacaacauuuauugagugccagacacuguucuaaauaccuuacgugccuuaacugcugaaucuuucuaacaacccuacugaggcaguuccuauuauauuauaccccuauuuuacugauggggcacguggaucaaagagaggucagaucauuuguccagagcacauggguaccaagugacaggccaugaucugaacucaggaacacuggcucugaugugccauucuuugccaugucaccguagcugccaagagcauagguuucccucuuccgaacccugccucaagcaaugaaauuucuagaaaaguauaugaaguuuuaauacgauagcugcuauggucugaaugugccccuuuuaaauucaugcacugaaacuuaaucaucaaugugauaauauuaagaagucgggcccuuaggaggugaaugagauuagcgaguuuauaugagggcuggagggagcuagcuaggccuuuuggcccuuuuguccuuuccagcguaugaggacaaggcauucauccucuccggaggacacagcaacaaggugccaucuuggacgcagagagcagcucucaccagacacugaaccugccagcaccuuaaucuuagaucuucagccuccagaacugugaucaauaaauuuguguguuuuuauaaauucuaaugcaagguuucuucuauaagguuauuuugucuauguugaaaaucuauguuuuaguuuaguuuaccuuuaucaaugaucuuagcuagaucugcuggaucacuugcugcauucaguuaaagacaucagcacuugcuacuucaccuugcacuuuauguuauggagauggcuucuuuccuucgaccucauaaacuaaccucugcugguuucaaacuuuucuuuugcagcauucucaccucucucagccuucauagaauugaagagaggcauccgggugugguagcucacgccuguaauuccagcacuuugggaggccaaggcaaguggaccaucugaggucaagaguucgagaccaggcuggccaacauggugaaaccccgucucuacuaaaaauacaaaaauuagcugggcaugguggcgaaugcccguagucccagcuacucgggaggcugaggcggagaaucgcuugaacgugagaggcagguguugcagugagccaagaucgcgccacugcacuggagccugaguaacagaaagagacuuugucucaaaaaaaaaaaaaaaaaaaagaaucaaagagagcccuugcucuggauuaggcuuuggcugguuugaucuucuauccagaccuuucuucaugucagaaaugagacuguuucgcuuucuuaucauucaugugucaauggaguagcacuuuuaauuuucuucaagaacuuuuccuuugcauucacaauuuggcuaacuuagcuaacuuaacuuggcuaauuuggcauaugcuuaaucauuucuuccuuuccuugaaaguacgauucuuucacuuggacacuuugaggccacugugggguuacuaauuggccuaauuucaauauugucuuaugucagggaauaggaaggcccaaggagaaagagauggggaauggcuggucaguggaguagucagaacacacauguuuauggguuaaguuugcugucuuauauggaugugguucaugucaauauaacagauaaaauaauaaugaaaaagcuugaaauauugcaagaauuaccaaaaugugacacagacacacaaagugagcacauuuaauguauccaguaaaaaccaaaguguuucuuacagucucugauguuuccuucugaguaauuggucauugggagcugugguuacacauagcugagugaagcggacacuucugugaaggcauggcuuggcucuugcugggaaguuuucuguuuccuggccuguuccugucucucuucuccucuccauacuuguugggaauggaccucauaccucucuggaaugaugcagugcaccaaacagugaagaacuguuguuguuuuuaacugauuuacauaacugauaauaauaucauagcuaacauuuauugagcucaccauaugccagguaugaagcuuagcacuuuacuacguucauuauugcauuuaauucucucaacaaacuugcagcgcauaugcgauuccacaggagagagcucuauuucuuuugguugaaaaguucuuucuaauacuugcugagcuacaguaaacaaauaugucuauuaaugccauugggaauuuggaagcaaagucuuaacaaaauauagacaauucauuuuugaauaauugugauuugauuaugcuuuuggggaauaucagauuaacaaaguggguuuguuuguaaggauuaguuugcaauucaggcucauagaauuuuuguguguguguauacaguuguaucgauuuuauuuuauugagauggagucuugcucugucacccaggcuggagugcaguguugcaaucucggcucacugcaacauccaccucccagauucaagcgauucuccugccucagccuccugaguagcuaggauuacaggugugcaccacuacacuuggcuaaauuuuguauuuuuaauagagacgggguuucacuauguuggccaggcugaucucgaacuccugaccucaagugauccacucacuaaaguguugggguuacaagugugagucacugcgccuggccaguuccaugaauuuuaacuuguaaauagauucauauagccacagccacuaucaggagguagaccaguuucaccacuucagaaaucucccuuggucagugcuacucuuuguagucagagccacucccaccucagccucugauaaccaaugaucuauucucuauuacuauaguuuuguuuuauuuuuuucuuuucaggaaugucauauaaguggaauaaaacaguauguaaccuuuugagauuggguccuucagcaugaugccuuggagauucauauaaguuguuacaugugucaauaguuuguuccuuuuuauugcugaguauuauuccacuguauagauacauugugguugcauuaaucaguucaccuacugaagaacaugaguuauuuucagauuuuggugauuauaacuagagcuucuauaagcauucauguacacuuacguuuucgugaaguuuucauuuuucuagaguaaauacuuaagagaguggggauacuaggucauaugguaaguguaugguuaaguuuuccagagcagcuguaccauuuugcuuucccacuagcaauguguaaaaguuccuguugccccuauucuuuccagcccuugguauuugacaguucuuuuuuucuguuuuuuuuuuuuuuuuuuuuagacggaguuuugcucuuguccaggcuggaguucaauggcaugaucucagcucacugcaaccuccaccuuccggguucaagugauuuuccugccuuagccucccgaguagcugggauuacaggcaccuacaaccacacccggcuaauuuuuuguauuuuuaguagagacgagguuucgccauguugaccaggcuggucucaaacuccuggccucaggugauccacccaccucggccucccaaaaugcugagauuucaggcgugagccaccacgccuggccuugacaguauuuuuaaaauuuuagcaacucuaauagguguguagugauaucucauuaugguuuuaauuugcauuucacuauugacuaagaauauugaacaucuuuucaugugcuuguuugccuuccauauauucucuuuggcauagugucuuuucaagacuuuugcccauuuuuaauuggguguuucuuuuccuagguaaguuuuuuuguuuuguuuuguuuguuugcuuugagacggagucucgcucugucacccaugcuggaauguaguggcaugaucucggcucacugcagccuccaccuccuggguucaagcgauucuccugccucagccuccugaguagcugggacuacaggcacaugccaccaugccuggcuaauuuuuguauuuuuaguagagacaggguuucaccauguuggucagcuggucucaaacuccugaccucaggugauccaccugucucggccucccaaagugcuuggauuacaggcguuagccaucacaccugaccuauuuuuaaauuuuauauuaauauauuaacuggauuuuugucaaauagagaauuaucuuuaaauaaccaucuccucacuucacacuuagucugggaaaaaaugagagcaaauuucugugcauccagggagcauaucaccaaccaggcaugaagcuuaaagggagagugcaggcugaguggccagcaggccaugggcaucccacagggccaggccaggacccaggcuucagcgacccuucucccagcccaccuaguggcccucaaauccaugaugggacagacaugcauucuccugucccaguugagaagccccuucuagauggaagggagaggagaaaagccauaggaaagaaaucccagaaacacuagcagguaaguacaggggcuuccuccccagcugcggugaccuugcuccugauaacacccaaccccuggagcucuucgccagugugccuggggcuggagccuggcggggaagggaaugugggcucacaguuucuggauguuggccucccacagcuuggcacagaccaggggaaggcaugugaggagggccuggggagguccucggggaagauaacacagcucaggagguugaguguaaaguggcugccagaccaagggagcuggauggacugugaaggaggagguggcuggagagccuccuccauguaaagcuacuagagcaaaaauagaacaaggggggacacccgugccccagaggacagcccuaaagaugguaacggggagcacggcugagcagcgcccuggauucugagcuaguguggaaagcugggggccaggggccucucucuuccuucaucaccaguugcugguaacuuuacagucagauuuggaggaggaacaaggcccuccaucgccuccccuagccucugaugcugccccaaggggagggguaagaaugggcaaagagggugggaaacagggaggugggagggagucuacugggucuucuuauuuucagaggagggggcuguaauaguguaguggcagaggcugguuccuagguauguagguguuguguggguugccuggcacugacaacugcuucuguggcucuggcuuuggcugccagagcagaggggccaauggggccacugaccagagguuccaugagcccagauagggcaguggcagggauugcaggcaucccauagcuccauccaucaugggagguccuggauagaacucagauggggacuguggauugggguagccaggagggcaaagguacauuccauuggcaacuggcagaggaaagacauaggcucuguuggguauguaagaguacccguagccuccauugggggccucgccccuggaggcuugaaaugccaccuggagcauucauuguccaaacugcuguaagguuaacuuguaugaaccccagcccucccagccaucucccgcuucacccuucacuguucuuuugaaguaguuggcagcaaacaggcuaguugaucucacaguccuucaucaggugaaaaggcaucacgaaggcuucauggaguucuucuucuuggacagaaagaugaucgguaagggguaagguagacgaugccuuucuuggucccuuugaaggacucuggcacauucuucuugucauugaauguaaguuccacauggacguaggacauuaggauguucuugguguucuugaucacucugccacccuuugagugauucuuguugagcacgauagucucuuggaaagggguccuaagacucucgaugcagggccuugaguucguuuuugcauaaaggaguugguuuagauugagguuccuuuuuuuggcauauaaauguccaauuguccauuuguugaaaagacuacucuuucuccauugacuugccuuugcacuuuugucaaaauuuauuggccauguuuguguaggucuauuucuggaaucuguauucugcucuauugaucugugugucuauccuuucaccaauacacacugucaugaagucagagagguaacaggaagccagaucauguagggccuuguagaccauugaaaggauuuaggcuuuuaucuugagugaaaugaggagcuacaggaaggugcugggcaaaggaggaaccugacuuuauugaggcaaggauaggaaugugagguuacugcagucauccagauaugcaaaaaugguggauuggaccaggaugauggguagaaguggugaaaaguagucauauucugaauaauuuuugagaguagccccaaugggauuuucuaauggguugaauguagagaaugagagauaggcaugagaaaagaacucuagucugaggguuuagcuugaccaacgugaaaaauggaguuaucaauugagaugggaaaaccuucaaaugaagcacauuuuaggaaggaaggucagaaguucaguuucgaacauguuaaguuuuaaauuucuauuagagguccaccuguggauguugagugaauagugggugauaagggcuaagagcuugggagagaggucugggaauggagguauacauuuuggauccuggcggggcaccugggaucacgccuguaaucccagcacuuugggaggcugaggcgagcggauuacuugaggccaggaguuugagacgagccuggcuaacaugacaaaaccccaucuguacuaaaaauacaaaaaauuagccgggcgugguggugcaugccuauaaucccagccacucaggaggcugaagcaagagaauugcuugaacccgggagguggagguugcagugagccgagauugugccacugcacuccagucuuggcgacagagcaagacucugucucaaaacaaaaacaaaaacaaaaaauuuuuggauccaucaguagauagaugcuauguaaggccauggcauuggugaaaucaccaagggcagauauguagagagaaaagggcaagcacugagcccugggucacugcagcauugagaggugggggacaaaaaaagaaacugguaaaggagacuaaaaaauaguagugagguagaaagaagguagacaaugcuuucugagagccaaauaagaaaaugauauccaggaaguaaaugaucaacagugcggaugcugcuaauaagucaaacaagacgaggacauauauugaccauuggguuuacgaacaaggggucauuggucaccucagugagagaaguuuccauagaguguugggagaaaaaggcugaggauaguaaguuuaagagagaauaaaaggagaggaauugcaggcagagaauagaagcguuuuucauggagucuguuugcaaauaggaccaaagaaaugaggagguagcuaggggacgagaugggcucacgugcaaguuguuggguuuuauuccuuuuuaagauggaagaaauaacauuugugaaugcuaauggccaugaccccauaaagugggaaauuuuaaugauguaagaaggaaagagaagaaagccuagagcaauugauuuccuugaguaaaggagaaaaggauggaaucuaguacaaaaauggagggauugcccuuagaaggagcuagaaaauuuaauauaugguaacacuuggaaaagcagaauauguggauguggaugccagcauauggguagauagaugugagugaagcaaguccucuucagucugcuuccaucuccucacugcgguggaagcaaggucagcagcugagagggaagguaggggaggggcugagauuugaagggacaaaagugggcgauaaucaccugggagagugaaccguaggagucaugggagugagugccugccauaggagagaagaucccucaaaaagaggaauucagggcuggaugcaguggcuccugccuguaauccuagcaccuuaggaggcugagauggaaggauugcuugagcccaggaggucaggacugcagugagccaaggucacaccacugcacuccagucuaggcaacagaaugagacccugucucaaauaaauaaauaaauaaauaaauaaauaaauaaauaaauaaauaagcaagcaaauaaauaaauaggaauucaagaauugagaucaucuguguggguauugagaaugccaggaauuaagaccagaaauucuagagaugauggcaauggcaaugagaaaugaaggggaaugaguugguguuugcuacauaacaguaacagugcuggauagcggaugauagaaucugaugacaugagguuuaaagcacagaauuuuuagagaggagagaaggagaaugcucugaaagcagccacguggagcaaaagcggcgucugucucaccucacuuuccagccauguggagcaaaaggggcaucugucucaggcccaguggcaugggagugaaauagcacuucagagaguugcaggggaaacaguguccccaagggagagucagguuucuguuaaaggaaggugcauuaugcacaucugugaaauuaucaugacugcugucaucccaucugcucauagaaccagugaauauugauuggucauaaaaugcaagcauuauuuuaaggagcauggacauuuaauuucucuuuuaaggacuggaaauaauuuuuuccaugauuuggaaagugauauuauauuugucaaugagaaauaauguaauagcuuuuuaauaguucacaaaaugaugucaguugcucuuuauucaaaaauaucuuuagccuuuuugagguuauuuuggggagaugauaaggacaggcaucuccauaaucccaaauauuugggagaaaacuucaaaaauuaaagcguauuuaggcugagcauggugacucaugccuguaaucccagcacuuugggaggucaaggugaguggaucacuuaaacccaagaguuugagaccauccugggcaacauggcgaaacucugucucuacaaaaaauacaaaaauuagcagggcaugguggcgugugccuguagucccagauacucgggagguugaggcugcagugagcugugaucauaccacugcacuccagccugggugacagaacaagacccugcccccuacccccuccuccaaaaaaagcauauuuaaauauucccagaauccaaauguugaacaucauuuggacacagcuucaaaaugguaccaauucuuuuaauuugugacugcuuuauuuauuuauuuauuuauuuauuuauuuauuuauuuauuauuauacuuuaaguuuuaggguacaugugcacauugugcagauuaguuacauauguauacaugugccaugcuggugcgcugcacccacuaacucaucaucuagcauuagguauaucccccaaugcuauccuuccccccuccccccaccccacaacaguccccagagugggguuccccuuccuguguccaugugaucucauuguucaauucccaccuaugagugagaauaugcaguguuuguuuuuuuguucuugugauaguuuacugagaaugaugguuuccaauuucauccaugucccuacaaaggacaugaacucaucauuuuuuauggcugcauaguauuccaugguguaugugugccacauuuucuuaauccagucuaucauuguuggacauuuggguugguuccaagucuuugcuauugugaauaaugccgcaauaaacauacgugugcaugugucuuuauagcagccugauuuauaguccuuuggguauauacccaguaaugggauggcugggucaaaugguauuucuaguucuagaucccugaggaaucgccacacugacuuccacaaggguugaacuaguuuacagucccaccaacaguguaaaaguguuccuauuucuccacauccucuccagcaccuguuguuuccugacuuuuuaaugauugccauucuaacuggugugagaugguaucucacugugguuuugauuugcauuucucugauggccagugauggugagcauuuuuucauguguuuuuuggcugcauaaaugucuucuucugagaagugucuguucauguccuucaccuacuuuuugaugggguuguuuguuuuuuucuuguaaauuuguuugaguucauugcagauucuggauaucagcccuuugucagaugaguagguugcgaaaauuuucucccauuuuguagguugccuguucacucugaugguaguuucuuuugcugugcagaagcucuuuaguuuaauuagaucccauuugucaauuuugucuuuuguugccauugcuuuugguguuuuauacaugaaguccuugcccaugccuauguccugaaugguaauggcuagguuuucuucuaggguuuuuaugguuuuaggucaaacguuuaagucuuuaauccaucuugaauugauuuuuguauaagguguaaggaagggauccaguuucagcuuucuacauauggcuagccaguuuucccagcaccauuuauuaaauagggaauccuuuccccaugacugcuuuauuucugcauuagacaauaagaaggggccgaaacuucuggccugauaugacagugacaucaaccucuuguguaguagccugucauuaagccagcgccaaauggaaaauuaaauggaaaauggcagagagcauugcccaggacauaauguagaaauggcaacucuggcacugacauagguuuaaaaaaauuauguuuuaaaaguaaucuugcugggaggccaaggcgggcauaucacuugaggucaagaauucgagaccagccuggccaauauggugaaaccccaucgcuacuaaaaauacaaaaguuauguuggcaugguggcgggcacauguaaccccggcuacucuggaggcugagacaagagaaucgcuugaacccaggaggaggagguugcaguaagcugagauugugccauugcacuccagccuggaugacagagcaagagucugucuuuaaaaaaaaaaaaaaaaaaguaggcuuacacauauucccuuuacuguuuuucaaggucauuacauuuuuaucuguuauuguucaccauuuaaaaauaagcaguggaaagcagccuacuuuuuaaaaugcggaacucguaugguguacuuagcauauauauaaggauuucuguccucucucuugccucccucccucccguucuucccccuuccuccuccuuccuuccuuccuucccucccucccuccccuuuccuaucuucugaguagggucaaacaccaguucucuacuucucggaccauaagaauaaagaucugugcacaauccauuuuguacauauugauucuuggacuaaaaauagcucaauuugguuucaaacuuuuucucccacccuaaguucagguuuuguuccuugugcagccugguaggcgggcaaguaaugcauagucagcauuccaucugggaugcuuacuggacaauuuuaaucuuuuuuuuacgucuugaccucuauuuccaaagagcaucccaguuggcaggucuagccugauuaagauucuguucaggcauuuaauucuccuaagggaauuuacagauuaaucuaaaaaucaaggauaccagaaucuacucaggacuuaacuucuugaagguuauaggaaacauauacuugagcaaccuaaugaaugagcuuagugauaucguaaugaauuuuuauauauaccucaaauuacacuuuuuaaugcauauccaacaaaaauauuuuuaaaaacaaauacuguagaccuaacuggauuagcuguauuaguagauccaaauuuaacuuucaauuugaauuaaguuagaacacuauggaucucauaaggcaggcuauauauugauuaccuaguuagccagcuuccauaucaccacuuguucaggaacauuaaaaguacuuuuuuagaaauaguuuucugauauauuuuugguuucacuaagacagcuuuuuaaaaagcaaaauuaggcagggcgugguggcucacgccuguaaucccagcacuuugggaggccgaggcgggcagaucaccggaggucggggguucaagaccagccugaucaacauggagaaaccccaucucuacuaaaaauacaaaauuagccaggugugguggcucaugccuguaaucccagcuacuugggaagcugaggcaggaaaucacuugaaccugggaggcggagguuguggggagccaagaucgcaccacugcgcuuuagccugggcaacaagagcaaaacuccgucucaaaaaaaaaaaaagaaagaaagaaagaaagaaagaaaagcagaauuauaacuaaacaccacuuuuuuuuucuuucuuuuuuuuuuuuuuuuucuggaguuagagucucucacucuguugcccaggcuggagugcaguggcacaauuuuggcuugcugcaaccuccaccuccugaguggagguuacucaggcaauccuccugccucagcuuccugaguagcugggacuacagccaugugccaucacaccugaauaauuuuuauauuuuuuguagagacaggaucaccccauguugcccaggcuggucucaaacucuugggcucaagcagucugccugccucagccucccaaagugcugggauuacaggugugagccacuguugccagccuaaacaucucgucugaggcuaucacaauauauacuauucuccagccuacaguagauuauagacaucuagaauauaaaaauuuguuuccugauaggcuuggcacacaauauuccuacaguccuuugaaaacacacauauuaacagagugacaauauuuacaggcagaauuacucaugugucuuauuguagcuuacaggagagugugucugucuaagaaugggguagagguugguuuguaaaaacaggugucccacaagcuuucuuggauaguuaacucaguaguuagaaugaaggauguaaaauaaccugucaggauaacaccugcucucuugcccucaacaauuaaugauaaugaaacuaggccugaagaggaauaaaaaucuuguaucaucuuugaauuagucuuuuguuggucgugcguuccaaugaaaugauguuucacaaccuuuucuucauuaucaucucugaaaagauccuuuauggcuauuuuuuuuuccuaguugccacaaaauuaaacacaggcauacugugucuuacugugcuuugcuuucuugcucuuggaagauauuguggguuuuuuuuuuuacaaauugaagguuuguggcaccccuacauugagcaagucuacugggaccauuuucuuuucaacagcauaugcuccuuuuaugacugugucacauuuugguaauucuuacaguauuucaaacuuuuucuuuucuuuuuuuuuuuuuuuuuagacagagucucgaucagccacccaggcuggagugcaguggugcgaucuuggcucacugcaaccuccgccucccagguucaagugauucuccugccucagccucccaaguagcugggacuauaggugcaugccaccacacccagcuaauuuuuuuguauuuuuaguagagacaggguuucaccauguuggccagacuggucucgaucucuugaccucgugaucugcccucggccucccaaagugcugggauuacaggcgugagccacugcgccuggcccaaacuuuuucauuauuguuauaucuguuauggugaucugugaucacugucuuugguguuacuauuguaauuguuuggggauggccugaacugcauccauauaacacuuaauugaggccaggugugguaguucacgccuguaaucccagcacuuugggaggcugaggugggcagaucgugaggucaggaauucgagaucagccuggccaacauagugaaaccccaucucuacuaaaaauacaaaaaaauuagcuggguguggugacgcacaccuguagucccagcuacuugggaggcugaggcaggagaaucgcuugaacuggggaggcggagguugcagugagccaagaucaugccacugcacucuagccucagugauagagcaagacuccaucucaaauaauaauaauaauaaagacuuaauugauacuuaauccauaaauguuguauguguucugagugcuccacccaccagcuauuucccaucuuucuccuccuccucagaccucccuauuccaugagacacaacaauauugaaauuaggccaacuaauagcccuacaauggcuucuacauguucaagagaaaggaggaguugcacaucucucacuuuaaaucaaaacauagaaaugauuaugcuuagugaggaaggcauguugaaagccuagauaggucaaaagcuaggccuauugugccaaacagccaaacugugaaugcaaaggaaaaguucuugaaggaaaugaggagugcuauucuguugaacacacaaaugauaagaaagugaaacagccucauugccgauaugcagaaaauuugagugguucuagauagaagaucaaaccagccauaacauuccuuuaagccaaagucuaauucuuuuuuuuuuuuuuuuuuuuuuuucagagucuugcucuguugcccaggcuggagugcauuggcacaaucucggcucacugcaagcucugccuccuggguucacgccauucuccugccucagccucccauguagcugggacuacuggugcccgccaccauacccggcuaauuuuuuuguauuuuuaauagagacaggguuucaccauguuagccaggauggucucgaucugaucuccugaccuugugaucugcccgccucggccucccaaagugcugggauuacaggugugagccacugugcuuggccaccaaacccuaauucagagcaaggcccuaacucccuucaauucacugaaggcugagaaaggugaggaacuugcagaaggaaagcuugaagccaauggguugguucaugagguuuaaggaaagacaccaucuucauaacauaaaagggcaaguaaacagcaagugcugauagagaagcugcaguaaguuauccagaagaucuagcugagaucauugguaaagcuggcuucaccaaauaacaaaucuucaaauguagaugaaacgacuuuguauuggaagaagaugccuucaggcuaggacuuucauagcuggagaggagaagucaaugcuucaaaguuucaagggacaggcuuuugucccuugggcucuuguuaggggcuaauacagcuugugacuuugaguugaaggcaaugcucauugaacauucuaaaaauccuagggcccuuaagaaugauacuaaauguacucuacuuguacucuauuaaugaaacaacaaagucugaaugacagcacgucuguuuauagagugguuuaucaaacguuuaaagccugcuguugagaccuaccacucagaaaaaaagguuccuuucaaaauauuacugcucauugacaguguaccuggucacccaagagcucugaaaguauaaggagaugacuguuguuuucauaccugcuaacacaacauccacugggcagccaauggauccaggagucauuuugacuuucaagucuuauuauauaagaaauacauuuuauaaagauauagcugcuguagauagugauuccucugauggaucugggcaaagucuauugaaaaccuucuggaaaggauucacaauucuagauacuguugggaggaggucaaauuaucaacaugaacaggaguuucgaagaaguugauuccaaaccucauggugacuuugagggcuuuaagacuucaguagagcaggcugggcaugguggccuauaauuccagcccuuuggaaggcugaagcggguggaucacaagcauagaguucaagaccagccugggcaacacagugagacccccaucuccuaaaaaggauuuuuuuuuaagacuucaguagaggaaguacucguaaauaugguggaaauagcaagagaacuagcauuaagaaugaagcuuaaagaugugacugaauugcuguaaucucaugauaaaacuugaauggaugaggaguugcuucuuauggaugagcaaaggaaaugauuucuugggagggaaucuauuccuggagaagacacugugaaaguugucgaaaugacaccauaggauuuagaauaucccauaaacuuagcugauaaagcaggggcaggcuuugagaggaucgacugcaauuuugaaagaaguuguaccaugaguaaaaugcgaucaaacagcauugcaugcuucagagaaaucuuucuucacaaaaggaacaauuggugcagcaaaauuaauuuucuuauuuuaagaaauugucagccgggugugguggcucacgccuguaaucccagcacuuugggaggccaaggugggcagaucaccuaaggucaggaguuuaagaccagccuggcuaacaugcugaaaccccauuucuacuaaaaauacaaaaaauuagccgggcaugguggcacgccuguaaucccagcuacuugggaggcugaggcaggagaaucgauugaacccgggagguggagguugcagugagccgagaucgcgccauugcacuccagcuugggcaacaagagcaaaacucugucucaaaaaaaaaaaaaaaaaaaaggcugggcgcaguggcucacgccuguaaucccagcacuuugggaggccgaggcagguggaucaugaggucaggagaucaagaccgugcuggcuaacauggcgaaaccccgucucuacuaaaaauacaaaaaaauuagcugggcgugguggcaggugccuguagucccagcuacuugggaggcugaggcaggagaauggcgugaaccuggcaggcggagguugcagugagucaagauugcaccacugcacuguagccugggugacagagucagacuccgucucaaaaaaaaaaaaaaaaaaagaaaagaaaggaaauuguuggccgggcgcuguggcuuacgccuguaaucccagcacuuugggaggccgaggcaggcggaucaucugaggucaggaguuugagaccagccugaucaacauggagaaacccugucucuacuaaaaauacaaaaugagccgggcgugguggcgcauguuuguaaucccagcuacucgagaggcugaggcaggagaaucacuugaacccaggaggcagagguugcagugagccgagagcgcaccauugcacuccagugcaguggagugcaguggugcgaucucggcucacgaucguuagcguuuuuuaacacucaaguguuuuugguuuuguuuuuugaguuggaguuuugcucuuguugcccagccuggagugcaacaagagcuggcaugaucucagcucacugcaaccucuaccuccuggguucaagugauucuccugccucagccucccaagcagcugggauuacaggcaugcaccaccacacccggcuaauuuuguauuuuuaguagagaugggguuucaccauguuggucaggcuggucucaaacucccaaccucaagugaucugcccgccucauccucccaaagugcugggauuacaggcaugagccaccaugccuggcccacucaagcauuuuuuaauuaagguauguauuuuuuagauaugguauugaacacuuaagagacuacaguauaguguaaacauaacuuuuguaugcacuagaaaauaaaaauuucaugugacucacuuuuuugagauauuugcuuuauugcaguggucugaaaccaaaccuguaauaucuccaagauaugccuguacugaagaguaagauuuugucaguuagaguuuaaucuuggaaagacuacaaaccacuguaauaaccuaagcauuauuugauuccccaaggaccaauuuucaccccuuugggggccauauuaauuuuuuauggcugcuauaccaaaguacuaugaauuuuauggcugaaaacagcacgaacuuauucccuuguaguucuagaggccggaaaugcaguucacuggggguaaugucaagguguagggccauacccccaggaaggcucuggggaagcguacauuuccucuuccagcuuccaucuuuuucuggcuuccagacuugcauucuguguguucacugacucaugucugcuuccuccaucuuucaaagccagcagccguguagcaucuuguuucaaugucacguugccuuuuucuucugucaagucucccucugccugccucucaugaggacagugugauuacacuuagggucuaccuugcuaauuccggauaaucucugcaucucaaaauccuuaauuuaaucguaucugcaaagcuuguguuaccauauaagguaagagucacagguucccaggauuaggaacuggauaucuuuggggaccaauacucagccacagaggugauaccacuccccaccccuuaaaaaugcauguucuacaccaguaaggaagaaagaaaauaagaaagaagaguaaaagauaauaaauauguaacuuuggcuacaaaugaauucuuuauuauaucucauucuauuuggggcacuugcuauuagaacaaagagagaagauauauuuaaaauuaauaggauucagaagaguagaguugaugauguucaccucauugcgauguacucacccauucauuuauuuugcauuacccuuccugccuggggccagucagcagaggagggcagugagucacuccaaggucagacaguauuauuacccucuuauugugaugggcaaauccaccauuaagcuucagauugagagaaacaccauugaguuggcaaaugcuuucgauguguacgugcagaaagucauauguaucuacaauuuuccagacagcggcaaagagaaauggaaacucugugcuguauuuuaauuggcugcaaaauguuuccuucagaaauuaccauuccauuaagcaccuacucugugcaaacgcuuugcaaacacugcugggaauagcugcauguauaagggcaugccuaccuuuauuagacuguucaggggaauaaaaugaaguuacaauuuauucuaauacuagaaugcaguucucuccccauggacugcaccuuucaggauaguggccugaaucagagcagaaaacaccugcuggauauccuccaaguacacagucugauuagugcccucugggaaacauggaggcagauacuacuuggcucuccagccuaagggaaguauuauuaauuaaaaacuuaaagccagguucuucucuguguaugguuaugcauguccuagauggccuugaaauugaucuguucuccauuagcaaucugugaauuguacuccugucugaaauugaguagaggucagagcuaugaagguugaauucaacaagaauuuuuaugaaguauaacuagaguuagugcucugcucuaacugcuuuuggagacagacuuuccccaguguaucccaucaaaucacagacuaaaaacagucuauuuccccuuauucuuggccagauaggaccuaggcaccugaauuuuuuuuuaaacuagauuuccaggaaauuuuauugaaggcuaacagcauagcauuucauguuggauaaagaagaugcacaagacgggacaugguaagacacaccuguaauccuaccacuuuggaaggaugaggcagguggaucacuugagcucaggaguucaagaccagccugggcaacaugguaagacccugucucuccaaaacaaacaaacaaacaaacaaaaaaacaaaaauuagcugggcaugauggugugcaccuuuagucucagcuacucgggaggcugaagugggaugaucaccugagcccagggaggucaaggcugcaaugagccaugauuccaucacugcgcuccagccuaggauacagagugagacccugucucaaaaaaaaaaaaaaaaaaaaaaaaaaaaggccauaugcaguggcucaugucuguaaucccagcacuuugggaggccaaggcagguggaucgcuugaggucaggaguucgagaccagccuggucaacauugugaaaccagucucuacuaaaauacaaaacaaauuagcugggcaugguggcaggcaccuguagucccagcuacuagggaggccaaggcaggagaauugccugaccccaggaggcggacguugcagugagcugagaucgugccacugcacuuuagccuggccgacagagcgagacucugucuuaaaagaaaaaaaaaaaauucacaaaagaaaaauuguauuaaguacaauuuaauauaauuucuuacaaguuuauuaccuaaaacuuugcaaauaauugaaguuagaagcuuuggauuuuguuuuuagagcuuaauccuuuucuguaaguggaaauccuuuccacugguuuauuuuccuuuugauuuuauuuuacuuugacacccuaaagguuuaguguuccuguuuuuaaaucuacugaucguuucuuaugagauuccuuagagugcccuuuaaguaugcacagauuuugcaaaugcauucauuuucuuauuugccaggguuuaacacuggcuaugcacauguuagcugaauaaccuuaggcaaguaaauuauccucucugggccucgaucuuguuagcuauuaagugggaauaaugacaauuccuaacucaagggucuguugugaggauuaaaugaguccuuacaugugacauacuugaaauaguaccuggugcagaguuagggcugggugaguguuagcuauuguauuauuauuucauugcuguuugcauauauuuuuaaaauguauuuaggauuuucuuuuuuuuuuugagacagggucucacucuuugcccaggccggagugcagugguacgaucuuggcucacugcaaccuccaccucccaggcucaagagauccucccaucucagccucccaaguagcuaggauuacaggcacgccccaccaugccuggcuaauuuuuuuuuuuuuuuuuuuuuguauuuuugguagagacaggguuuugccauguugcccaggcuugucccaaacuccugagcucaagcggucugccugcuuuggccucccaaagugcuaggauuacaggcaugagcaacugcgucuggccaggguuauuucuuagggauagcauuccagaaauauaauuaaaauuuauugauccagaaauauaauuaaaaauaauugaucaaaugguagaagacuuuuuaaauuuauauuucaucaauuuuacacauuuguuagguuuuaauguuucuacuacuugugugugccaaaaaauuauugauuuucuuaaucguuuucuaugaguagaaauccuuuccacugguuuguuauuuuccuuuugauuuuauuuuacuuuugacacccugaagguuuaguguuccuguuuuuaaauguacugauuguuucuuaggagauuccuuagagugcccuuuaagcagagaauaucuuucccucuccuuccucuucccuucacucuucucaaaacuauaaaaauauaauacucauuucuaccuguuuucguggcuuuuauacuuucaauguguucaucuacaugagauuuaguuugauguguggaacagcaagagaguuuaaauuaaaaaucuuccccuaaauggcuaaaugucccagugccauuuacagugugguaccccuccuguaauaagaauauuacauucuuauccguauuaauuauuucuuauucaaacuuaccaguggcauuuaagaaaucauuaguucaguuguuuauagguaagaagacucauucuuuaucugcuauuucaaaauuaaaaucauugucuuucauagauauuuucugaaaugaaauauggaaaacaauuauuuuuacaaugagacuuggaaaaaaaucaauacuaaguuucuuuuguauacaagauagccaauaauaccuaggccuaaaacguuccaaucuaguuuuuugucugcuaauaggugcucaguaugacggagcuuuucuugaggaccauuugacccugugucucucuuugccuuuccccuuaugaaaauaagcugaccccuacauccaaucaaaucaucauagcaagguuuucaucauuuuuuauggaaugucagccuugccaccugcuugccugguacccaauacauauaaucucucuucaggcugcaacacacagcacuugaggcaggcugucauuaauuggaguuaccuccaauugccuacuucuuauucuauuccuaucaaaaacccagcugacagguacacaaggggcauagcccaaauuacauguaauccauaaaucucuccauuuuuucuuaagucuuaguuuucucuugauauaggauuuuuuuuuuuuuuuuuugagauggagucucacucugucgccaggcuggagugcaguggcacgaucucggcucacugcaaccuccaccuccuggguucaagcgauucuccugccucagccuccugaguagcugggacuacaggcacgugccaccaugcccagcuaauuuuuguauuuuuaguagaaaugggguuucaccauguuggccaguaugaucucaauuucuuaaucucgugaucugccugccuuggccucccaaagugcugggauuacaggugugagccaccaugcccggccgacauaggcuauuuuuuaaaaugcaagcucuucugaaccauauaauaugauguuuuaaaauauagacucugaagacaaagaccugggcucagaaucaggccccaccacuuauuuucaauggaaucuugucugaaucuuguaaucuuuccaagccucaguuuuuucaucuguauaauagggauaaaaauaauaguaaacaaauaaauguauuucuuuugaauaucuaguaguauuuuaaaaaucagauaacuagaauuauauaacucuaugugcuuuauuuuuuacuuguuugcugggaaucaaagagcuuaguuuuguuuuuuguuuuuuuuuuuuuugagacggagucucgcucugucccccaggcuggagugcaguggcgcgaucucagcucacugcaagcucccccucccagguucacgccauucucaaagagcuuaguuuaagcucaauucaagugacuauuugaggccuggucaggauaucugcuguuauuuggaacacaagcuguuugcccaggacuaagaucaagugauuuuccuaaagcaaacaguguauugaauguaauccaaaucaucagcaggaacaaaggaggccauauagcuuagcaauuaaggcaugggaucugaagucagagagacuuggauuugaaucauggcccugacaaguuacgugccucucucugccugaguuucuucaucuguuagaugagcauaauauugcaauauaguguuacuuugagaauuaaaugagguaaugcaaagcucuuagaguaguuacuaggauaaguguccaauuaaccauaguuuaagaaaaaggauaagcugggcacgguggcucaugccuguaaucccacacuuugggaggcugaggugggcggauugucugaggucaggaguucgagaccagucuggccaacauagugaaaccccuucucuacuaaaaauacaaaaauuagccaggugugguggcgcacaccuguagucccagcuacuugggaggcugagaugggagaaucgcuugaacccaggaggcagagguugcagugagccgagaucgugucacugcacuacagccugggugauagaaugauacucugucucaaaaaaaaaaaaaaaaaaaaaaaaaggaaaaaggaugaaaucacaacuuggagcaaaaaaacccaaaggcauauuuaaagauuugcguauuggguuaaaacaaguuuuaacaucuggaaagaaaaagcauccaucaacuuuucuuaucaagaaauaugaauuauagccagguccaguggugugugccugaagucccagcugcuugggaggcugaggcgggaggaucacuugugacugggaguuugagaacagccuggggaacauagugagaacccaucaggaaaaaaaaaaaaaaaaagguugauuaaaaaaagaaaaacaaaagaggccaggcacgguggcucacacuuguaaucccagcauuuuggguggccaaggugggaggaucgcuugaggccagugauuaaagaccagccuggacaacauaguaggacuccaucucuauaaaaauuuuaaaaauuagccagacauggugccgugugccuauagucucaacuacuuuggaggcuaaggcaggaggaaugcuugagccugggggguugaggcugcagugagcugugauggugucaaugaacucuauccugcaguacagagugagaccuugucucaaaaaaaaucaucuuuacaguuauuugauuauuugcagauuuucaguguuuauuguuuuuacuuuccuugccccacuauucugcauucaucaaauauucauugaacacugucuuuuugccagagacugcuguaggcacaagagauacagcaaaaaacaagacaaaacccuugcucucaugaaacuuacagucaagugugugagauggacauaaacauaguacugugcugucauguuguaaaaugggaccucucauugagaagcuggguugguuuggggguggggaguaugacaucaagaguucuguuuugaucauguuuaguucaagaugccuguuauggucaggcaccguggcucacaccuguaaucuagaacuuugggagacugagguggguggaucccuugaguucaggaguuugagaccagccugggcaacacagcaaaaccuuguuucuacaaaaaauacaaaaauuagcccgguaugguggugugugccuguagucccagcuacuagggaggcugaggugggaggaucacuugagucaugguaacagacucgcucuggguuucgcucuggaugacagagcgagacccuguaucaaaaaaaaaaaaaaaaugccuauuagaccuucaaguggugaagacaaguagguaauuggauacacaagucugggcucaggguagaggcugggcuagagaaagaaauuugggagucaucagugaauagaugacauuuuaagccaugggcuuggaggagauaaccuaaggaaugacgagaauacaucugaagauccagccucagacacucugguguacagaagcagguagagaaaaggagaaaccauuaaagaccucuguugggccgggcaugguggcucacaccuguaaucccagcacuuugggaggccgaggugggcagaucacucgaggucaggaguucaagaccagccuggacaauauggagaaacccugucucugcuaaaaauacaaaaauuagcugggugugguggugcacacucacuucacucuagccaguagucccagcuacucaggaggcugaggcaggaaaauugguugaacugugaggcagagguugcagugagccgagauugcaccacugcacaccagccugggcaacagagcaagacugucucaaaaaaaaagaagacugagugugauggcucacgccuguaaucccagcacuuugggaggccaaggcaggcggaucaccugaggucaggaguucaagaccagccugaccaacauagugaaaccccgucucuacuaaaaauacaaaaauuagccacgugguggugcgcaccuguaaucccaacuauucgggaggcugaggcaggagaauugcuugaaccugggagguggagguugcagugagccgagaucgcaccacugcacuccagccugagugacagagcgagacuccaucaaacaaacaaacaaacaaaaaaaacaaaaacccaagaagaccucugucuccuagagcagucaccuagaauccuagagaaaaaugucuuuccaaaaggaagaaaugcagaacugugugaguaaaaugaagcuaagaauuaauuacuggauuuggcaagauggagguugcugaugacuuggcaggagaguuucccugaggugauaggaaccaaggucugaugagaguaggcugaagagcaaauguggagaaacagagauggcaagaaucaacaguucauaucaggauuuugcugugaaaggcagcagagggaugggguaccauuauuuucauuuuguuuuguuguugguuucugcugcagugguaguuuauguugagauguauauuuuaaacugaugauccuuaaagaaggagaaauugaugaaggagagaggugggagggauaauugcaaaaaugaaguccuugagcagugagaucugcuuccuuauuaugcauauagaugaaacauuaaaauguaaaacagacucuugugcugauuuuaagaacucuaaguuagaagaggguggggagaacugggaagcuggggagcccaagaugcaggauuuuggcucuuuagcucagcuagguucagguucuugucucacaaccaggaggaauuaggcacguggacaccagagggugaguagaguagaauuuauuaagcaaaaggaaagcucucagcaaagaggggggucuggaaaagcagguuguuggcugcccccuucacaguugaauacugugcuuaaggcacaaauuccuggcggcuccaccccauccuuccagugcgcaugugggcccuuagggugagccacuccauauugauuuacuucccuuacugcacauguguuaaggaauggaauuuuccacugcgggcauguuuaggcaagcccccugugcaaguucccacaucugcacaaaauaucugguguaagcauuuguggggcggguuggagguucuccagggacccuucccuuacugucugccuaaagcaagcuggcuaacuucuuacaccuguguauuauacagcaccagucuuuagggaaaggaacuucagguggguaggguagaguauagcaauagcuggcaagaaaaaaaagauuugaagaaacaaacucuguggugcccuagggagcagaugugggauggaaaagugaggcugggccuuaaaucacaagaagcccaagguguacagggaucucuuuacaacagaacguguucuuauauaugaguuauuugaaauagcuuaauuauaccacuauacugucauuaauaauggauaaauguacuucaaaguaauuuauuaguuugucugugaauaugucuuuccuugucucuuuucccccuuaccuagaauguaaacaagagagaagagaacuccagaucugauuuucauggaggaaggugauacagaucauuauggcuguaaggggaggauucuuguguuucccagguguccugaaaccauucacauggagccuaaguuaaaaugcucuggguucgggagugucuuccuggagaucacuaagggcuucaggacuccuugagauggaguuuucuuuucucucucucucuuuuuuuuuuuuaguauuuuaaaauguauuucguuaauuagcagcaguaugccaaaguuguuccauuauuauauuuuguucauucuuuuguacaagugucuuccaaugugauuugauaaugccaacaauuugcaagugauuuuauugcagcaugacuuugguucccaggaaugcugaagcacagguccuagaacagaggcuugaaaaggaaauaaaagggauuugaucauaaaugcuucugggguuggcauaccagaucauuuugagcucaaauaggagacaaaagaaaggauguugggaaagcuguaugguggagaggcugaacuguuggaaugaaaagacaagaagcauauuauuauguuaauuccagcacccuagaucugcaaugcugaaaggacugccaaaacuaaagcuuguccuacaccacguucaucacaaagaaauucuguuuagacguugaguuaaacuuucucaacuguauucaguacaggauuaagugguugagaugggccauucugcaguuacacuguuuccguuccagucugggucuccucauguauuagcuguguggaccuugggcagguaacuccuuugugccucaaagaaauggagaugacgauaauaccuaccucagugggguuauugugaggauaaaaugcgauuaauagaaaauaauuagaauggugccugggauacauacugcucauuaaacauuguauauuuuuauuauuagugcacugugcuauaauaggauggcuaucuagaaaacaucaugcaauuuguaaugcacauuuaucauccaguuaauugaaagagguagugaugggacagugguggcagacauugaaugcucagggaugaaaaaugagacagguuuuaucuuguuuuguuuuauuuuugccucucauuagguauccaccuacuuuucaaaauuguguuauuuuaaucuuuauugcauacagacauauucucaguaaauugaggccaccauauggaaguguaaggaugaagccaggcgcaguggcucaugccuguaauccuagcacuuugggaggcugaggugggcggaucauuugagccuacgaguucaagaccagccuagacaacauggauaaauccugucucuacaaaaaaaauacaaaaauuagccagaugugguggcaugugccuauagucccagcuacuugggaggcuaaggugggaggauugccugagcccaaggaggucgaggcugcggugagcugugaucauaccacucacuucacucuagccagggugacacagugagacccuguaucaaaaaaaagaagaaguauaaggaugaaaucauaagcuuagguccuaguucuuuugagugaguuagaaccuauauaaaauuuucuccuuuuggaauuuuauuuuucuaauguuuaccucauuauuuucugacuauaauagaaaauuauccuuaaaguuugccauuacaaagggaauuguacuucuuuaaaaugccaauuaaaaauaucuucuuguuguucuuauauauauuuuuaaguuauauaugcauauguuaaaauauuuaagugaaauaggaaugacauaaaaauaaaaucuuccuccucacuaccucaaccuccagucccaugcuauagaaguaaauacuuaaauuaguuugcuguaacaaauuaccacaaacuuuguggcuuaaagcaacacgaauccaucucauaguuguguagcucagcauucugaaaugcgucucacugggugaaaaauuaaggcaucagcaggacugguuucuuccuggaggcucuagggaagaaucuuuuccuugcccuucucacguucuagaccccacuauuaacacucauauauuguuucagaaauguuuaaugcuccuugauuuuuaucaccuaauuguauauuuucuagaacucuccauucuuuuauauacagcuacauacuguucuacuauauggaugcaccagauguuauguguccagcucccuguguuaauggagucuugguuuauuuucaaguuuuuauuuucauaaauugcaucauaaauaauaucuuuauacuuucauauuuaugcauuuugacaaacagauccaugggauaaguuguucuugguguaguuuccagguaaagcaggauguacauuuacacuuuugauacuucuuuuuaaauugccuucucaaaagacaucuauuaucuuucccuccagugaugaguaagaguucauauuuccacacgguuuuggggcgcucgggaguuuguuuuuuuuacaaaacuuuuaaaacuuuaccacuauauauauaauauauuuauaauauauauuuauaauaaauaucauauauuuauaauauauauuuauaauaaauauuauauauuauauauuuauaauauauauuuauaaauauauauuuauaauaaauauuauauauuauauauuuauaauaaauauuauauauuauauauuacauauuauauauuuauaauaaauauuauauaauauauacuauauauuuuauauauauuauauaucuuguauauauuauauauauaacuucucuuuuuacuucguuucacuugaguuauaaauuugccauguuuggagguuuucgaugguccuagcaaaccaguuucccuagaagcaacuucccuucaguccgauucacaucaaagaugugacuucaauaccaucugauguucaagcuauuuauuuuagcaguggucuuacaagucggauagugggagcagguggguggcaugggccagauucaaucagaggucagaugacugccuguccaggagggucuccaucuggagacuauucucagaguuugggagauucuucccauuucuucuaccugcauuuaguucagucaauuaucaggcguuucuuucauaagaggagguuaagcuagucuuauaaggguaagcuuuguuaaagguuuacgagauuugcauccgugaugagguggccuuauguccuggaaaucccugggccagcuuggaaauccccaggccagguggccucacgcugcuaaguggcacauagugucaguccugugagagcuuguuaaugccuuauagcuaucauuaaucuuguagucaugauaugucuccuauaggaugcuacacaguugguuuuagcauuuuacuaucguuuuguuguugauuacuuuuguuuucuuucguuuuuuguuucuguuuuugagacagggucuuacucugucaucccggcuggagugcaguggcaugaucauggcucauugcaaccucugccucccggguucauauggaaggcagaggauucucccaccucagccuccugaguagcugggacuacaggugcacaccaccgcacccagguaauuuuugcauuuuuuguagagacuggguuuugccauguugcccaggcuggucuugaacuccugggcucaagcagucggcccgccuuggccucccaaaguguugggauuacaggugugagucaucgugcccagccagcaucuuacuauguuuauuagccauuuggauuccuuuuucuuugaauugcugcuuguuaauauauuggcccuuuuuucuguuacauuauuaauaaugccaggaauuaugcuaguugcuaugcaagaugcagacuugaggaaaaccuggucccagcuuucaaaaugcuuacuuuccaaaucugacucaucguuugacuuuaaugccccacuggacuucucuaacagcauuuuccauuuucccuuucaaaaggacucaaaauauacaaauuuaauuugaugauaagagcucaagaaaggccguggauucuuuuuuuuuuuauuuuuauaguaaaagugaucagacuguuuccucuuuuaagaagaaaaagaaagcagaggucaauauuaagcuuccaauuaaugcuuauucaucacaaauaguaaguaaauaaugacagaaauaauuccuuagucacucucuagcacacuucuuuuuuauuuuuaacauuuuucacuaugugagauuuccuagauuuguuuuauuuucuguuucccucuaacugcaauacaagcucuuguggacuggaaccacaccugucauauucaugcuguaucucaccugucauauucacugccaaaucccaccugccauaaucacugccguaucccaccugucauaaucacugccguaucccaccugccauaaucacugccguaucccaccugucauaaucacugccauaucccaccugccauaaucacugcuguaucccaccugucauauuuacugcuguaucccaccugucauaaucacugccguaucccaccugccacauucauugcgguaucccaccugccauaaucacugcccauaucccaccugccguauucacugccgaaucccaccugccauaaucacugccauauuccacgucauauucacugccauaucccaccugccauauucacugccguaucccaccugccauaaucacugcccauaucccaccugccguauucacugccgaaucccaccugccauaaucacugccauauuccacaugucauauucacugccauaucccacuugccauauucacugccguaucccaccugccauaaucacugcccauauucccaccugccauauucacuggcagaucccaccugccauaaucacugccguaucccaccugucauauucacugccauaccccaccuaccauauucacugcuguaucccaagcuuccagaguaggcucuagcauuuguaggugcucagugaauauuugcugaauuagcaaaauagaaaauuuaaaucucuuaacagguaccacguuuugacauaaucacuuguaacaucuauuuagaaauccauaggcagcacaagcacauaaauaaaaaccugaccuuccccaagaucuuuccuccucuguucagcaugcugugucaagagcagcacauuguguggucacugucucauucaauugggacagucgcaucaucugccccuugcugaaucgagccuuugaauuagaugaaggaaauuugggccaagucuucuggaauuuagugacuacuauuaucuaguuucccucuggugcaauuagaaaugagcaaugaaccaauauauaaccuugcuuaaaaagcaauuuccuuuacuauucuccuuguuuaauuagucuguuuuguucucccugagcucgagaggcauuuuuucucccaaagcagaagcauuaaguaagaugcauucaguguuuucaugagauucauucauucuucuuggacaagaucuuggccacuguauuagucugcuugggcugccauaacaaaauaucacagaccagguggcccaaacaacagaaauugauuucucacaguucuggagucugagaggucuaagaucgaggugucugcugauuugguuccugcugagggcccucuuccugcuugugacagccaccuucuugcugcauccucacgugacuuuuccucugugcuugcauggagagaaagagacaacaagacagauucgcugaugucucuucauauaaaggcacugauuccaucaggccacugaucccaucaucccccagccucauagccucauccaaucccauuuaauucccaaaggcccuaucuccaauuaccaucacauugggaacuggggcuucaacauaggaguuugggggaacucaaacauucaguucauaacagccaccaugugccagucaucuggacagagguugaaaaagcccuauccaugccaaaaucuuaccucuuaagguaguagaggcauacugcuaaugugaaccuuuaaaaaugcucauuuauucuacagauauuccuuguuuaugccauauuacucacuggcuuaaaaaucuucuaaugaugaggcauggaacuuggagaaaccacccaaaguuucuaccauguucugcaaggcugugaucaggcaccugcuuaccucucacacugcuccagccacacuggccugcgugcugcugcuuucucccuuagggccuuugcucuggcuguucauucuccuuguggugcuuugccccagauagcuggcucauucucaucauucaggucucacuuaagugucaucuuucauaggacaucccugauacccaaucagaauuacucccuuggccagcuggccugugccagaugcuuugcuggauaugaagacacaaagaucaguagugcggccaggcguauuaaaauauuacccuuaaucaauguugacucgacauuaauaauagagcauauuaaugauaauauuauuaauuaauuauuauuaauuuaucaauagagcagauauugaacacuuacuauuugcaaggcauuaugcuaagucuuugccauuauuauaauuauuguuauuuuauuuuuuauucuuuuagagguagggucucacucuguggcccaggcuggagugcagugguacaaucauagcucacugcaaccuugacccccugggcucaagcaauccuccugucucagccuccugaguaggcaggacuacagccaugcacuaccaugcccagcuaauuuuuuaauuuuuugagacggguuuuugcuauguugcccaggcugaucucgaacuucuggcuucaagcaguccuccugcuuugaccuucaaaaaugcugggauuacaggugugagccacuacgcccugcccuuugccauuauuuaucuaauuuaacccucacagccauccucugauauacauaugauuaucauccccacuuugggucagaucauaaaaccgaaccuuaaggaggucaacucaccugccaaaggccacacacaggaaagugauagagcugagauuuacccaguuuuguugagcuucagguuuuaaagccagaaagauuucucuuuuagaaaaugauaaagaaaaguuuuuuuauuuugaaaaauugaacaaauaauagauaagaaggaaaauuguaaaaagagacagugaugacuaaugaagauaaaguuguuuuguaaucagacagacccugguuuguauucugacccagccaccaauuggcugugucacuguggauucaacacuucucuuaucuuuguuuuuuaucuguaaaaaggaaguuaugagcauuacacgaaauaaacacugacaugaacagauucucauucaauguuaguuugauuuuauugaauaauauuaacaaauuacaguaucuaauuaugcaguucaucaucagacacaaauaagcacuuaauuucuuuuuaaugauauaaaaucuuuucuggcuggguguaguggcucacgccuguaauaccagcacuuugagaggccaaggcgggcggaucacaaguucaagagaucaagaccauccuggcuaacauggugaaaccccgucucugcuaaaaauacaaaaauuagcugggcaugguggcaggugccuguagucccaguuacuugggaggcugaggcagaagaauugccugaaccggggaggcggagguugcagugagcagagauggcaccacugcacuccagccuggugacagagggagacucugucucaaaaaaaaaaaaaaaaaaaaaaaaucuuuuuaaagcaucacuaggaucagaaaugcaaauuuuucagaaauuucaaaaauguggagaaaagguuggacauuuuguuagggaaguaaaagcauauacauauaaaauuauauuuguucuggaauauaaaauauguuauuuguauugcucacuauagaucuagugauuguaagaacuuauguagcauuuuaucaagccuccauaucucuuuggagacuucaaagacuuuagaaagguauagauaauaucaaauguuggucaagaugguagucaacaggaacucucaaacauugagaguaggcauguaauuugguacaaccaucuugaaaaacuguuuggccuuaucuaguaaagcuaaagauguauagauccuaagaucuagcaauuccaguuggagguaugaacccuagaaaggcuugcacuuuugagucagaagauguagacaacaaaacucacagcagcacuguuuguaacagagaaaacuaaaaacaacggaaauuacuauccacaguaaauagaaugaauuacaguaaauaugguuauacaauggaaccuuauguuugugcaguuuauucaagugguugcauguggccacaguucauuuuguucucaauauauauaauauauagaugauacauguauguguguauacauauauuucauugugugacuauacuacauuuaauuuuuccauucuguugucauuugacguuucaguuucagauaguuagcuauuaugaaagagcuacuaugaacauccuuguucauguauuuuggagcauguauaugagcauuucuguuuauuauacgccuagagguagaauugcagcagaguaugcuuguucagcuuuaguagagacugccaaacaauuuuccauagugguuguaccaguagacaggcccaauaugugaggguuugcuuacuccacagcuucaccaacauuugguauuuuuucauuucaauacuuacuuucauuuucauuuuauauuucauuucaaaacuuucauuucaguauuuuaguucauuuugaugcauuuucauuguagucacucuagugaguguauagugauauuguacuaugguuucaacuuguauuuuccuuaugacuaaugaaaucgaagaccuuuuaauauguguguuggucauuugauaugcuauuauuuuaaaguaauaaauauaggguccagaccuauggggcuuagcggguguucucuccguguguggaaacgagagaucuaagaaauaaagacacaagacaaagagauaaagagaagacagcugggcccgggggaccacuaccaccaagacgcagagaccaguaauggccccgaaugguugggcgugcugauauuuaucguauacaagacaacggggcaggguaaggagggugagucauccaagugauugauaaggucaagcaagucacgugaucauaggacagggggcccuucccuuauagguagcugaagcagagagggaagacagcauacaucagcauuuucuucuaugcacuuaucagaaagaucaaagacuuuaagacuuucacuauuucuucuaccacuaucuucuaacaacuucaaagaggaaccaggaguacgggaggaacaugaaaguggacaaggagcgugaccacugaagcacagcaccacagggagggguuuaagccuccggaugacugcgggcaggaauggauaauauccaaccucccacaagaagcugguggagcagaguguucccugaguccuccaaggaaaggaagacucccuuucacagucugcuaaguaacaggugcuuucccaggcacuggcauuaccgcuugaccagggagcccucaaguggcccuuaugugggcguaagagagggcucaccucuugccuucuuggucacuucucacaaugucccuucagcaccugacccuauacccgccguuauuccuugguuauauuaguaacacaacaaagaguaauauuaaaaguuaaugauuaauaauguccacgaucaucucuauaucuaauuuguauuauaacuauucuaacuguuuucuuuauuacacugaaacaguuugugccuucaguuucuugccuuggcaccuggguaauccuccacccacaaauaaauaaaggauuauuggaaaaauuacuuaauaagauugauuacgaucuauguaaagcaauguaucaguggacugaggcuugguuauccuaacagugacacaugacuugagaaucucaguagcuuaaggcaagguuuaacucuuguucuugcugcaugucuauuuccaacagucagugggucugcuccacaucagcaucauucuggcagcuucugugaagggacagccucaauauggggcauugcuggucuccaggcagagagaaaggagagauggcaacacaaugggccacacacaaguucuuagaacuuuggcucagaaguggcacacacuucacuuacacucacauuucauuggccaaaggagaucagauguccaagacugauguuagugaguggauuauauaaucuaaaggcaagggcuuguaggaagaggcagucaauauuugugaacaagagaaugaucaguaacaucuuucugcagaguaggcuuauaagaguauuacuguaggauagagaaaacaagcugugugucugugggcuguugucaacacauauauauacacuacacacuuuuuuuuuuuuuuuuugagauggaguuuugcucuuauugcccaggcuggaaugcaguggcuugaucuuggcucaccacaaccucugccucccggguucaagugauucuccugccucagccucccaaguagcugggauuacaggcaugcaccaccacgcccagcuaauuuuuguauuuuuaguagagacaggauuucuucauguugaucaggcuggucucgaacuccccaccucagaugauccacccgccuccgccucccaaaguguugggauugcaggcaugagccaccacgcccagccucacuuuuuuucuuuuguuuuguugaacugguugccaacguuuaaaaauuaugacauuuaacaaagaugcagauuucuggcuucuuuuggaaauccuaagcuauagcaagaaucauuuggaacugaguuguagcugcccuucuggugggaugugcacucucugguuuuccaugacuguaucugccugucuucucugcagcagugccuuucaaacauuuuuuacguagcucacaauaaacaauacauuuuacauugcuaccaaggacucgcaugcaugugugugugucugcauucauauauagguauagauaugcauauacauauacauuccaaaguaaaauacaucaaggaaacagugcuuaccauuacucauugaaauugucuguucuauucuauccuauuguauucuaguacuuuuuuuuuuuuuuuaaugcuggaaucaacucccuaaauugauuucacaaaccacuucugggucauagcccauagguugaaaacaugguugucuaucauguuacuugucuguuucuccucuaaaugcuauugguuaguuuucuagccuggauuccugucuaagcccuuuaggguuucaggacaauucacugugugggugagcagcaucugcuucccuucacuuaaaccugggcaauuacugguuuugcccaagggucuuaaaacuuaaacugcuugaauaucuggcaguuuccccgcugacuuuucccuugucugauuuccuauuucaauaaaaauagccuuguaggcgaauaugccacugauucggagaaucucaguuuccugacugggcuaggcaaucaagggcaaaugaaagugaguccuguuguacaggaaggagaguucucagaugaugaggauggucauggggacuuuguuaccgaaggaggcccaagcucaugauuucacaggauugauuccuccaucucacugaucauuuaacaaauacuuauggaugacccaugugccagacccugugcuagggaacucauccaaaacuuacaaaaauuucuccuagaugcacagacgaugaauaguaauuaccucuuccuguguuuuacccuuccuauuucuucuuuucuucccuugacccagaaauucaucaauugcccuagggcuguuccggcuuagugcuuguuggucaguuggaugugcccuucugcucaggucuuugugggcucucacugguguucguaugcauauagaauggaugucugcaucacauuguagggacaguguauggggaugugaagacaauaagugaaagucugccgcccacuaagacacaagcagcauugcuauaaacuccaguggaaaaaggugauauuauagggaaggaaaaccguauugucauauuuucauggaauucagugaauugcauuuugaggaccagugccauuuugaugcuggaggauuccaccaccuuugugguguuguuuccuggaagagauucuacuacugaagugguguuggcagcagguguacccagcaaaaucagguagcaaggccugguggaacuuggcagaaaggagcucacuggggccaucagagacaguagugaggcccccuugugccaguuagggggcagcagagacccaaaaguggauuuuaccagaaaggguugaagcaggagaggaaggaaauggcgaaugccuugacaggccauguuugugaguccaggaagacaacucaugggagcucucagaaauaauuguggggugaggugagugcauacuuggauagagauguuacaguaccugacaggggcaagacccaguaauauauggguuguuacuauuaaacgugaccccauuuuaagucguggguuuauauaacaagguuauuuaugcuuguuauaugcuuuaugugcauuaccuauaaauguccuuaaacuuuuaucacagugcaaaugcagcucauuaccagaauccgugagcacugucuucaaacccuccccauugccuugacauuggcuuuuucuuaauucugucucuuuuuuuggccacucugcucuugaucuugugucuacaucugagccugaaauuggagaguccuuggcuacucuauaaucugagucuucuacuuccugcuuucccuauucagucucccauuuccuucuccagccccaucccugguacuagcaagucccucccugaugucuucaccauccguuccuuucagacaccugccacccuucacauuagcaaaaugacaaaaaauaagaauaaauaaggugaguauaguagauugcauaguggcccccaaaagauacaccacagagcuccacacauacuaacccuuggucccucagaaugugacuuauuuggaauaagggucuuugccaauguaauuaagauaaggaucuagagaugaguccaucuccuggguuacagugagccuuaaagccaaugacaaguauccuuauaagagacagcaaaggagaagguggccaugugaagacagagacagagauuggaauucugcugccauaagacaaggaaugccaggggcaccagaagcaggagcuuucugaaggugcauggccccugccagcaccuuaauuucaagugucuggccuccagaacugugagagaacaaacucugcuguuuaaaccaccaaauuuaggcugugagugguggcucacgccuguaaucccagcacuuugaaaggccaaggugggcggaucgcuugagcucaggaguuugagaccagccuggccaacauggugaaaucucgucucuauugaaaaaaaaaaaauuagccaggugugguggugcacgccuguagucccagcuacuucggagagaggaucaccugagcccgggcagccaaggcuguagugagcuaugaucuggccacugcacuccagccugggcaacagagugagagccggucucaaaaucaaacaaaaaagccacuaaguuugugguaauuuauaacagcagcccuaggaaacugagacaaugggugaccauacagcaccaaaggacuucuauuucaugauuggugaacauuuuaaaauaagaaaaggccaggcaugguggcucacgccuauaaucccagcacuuugggaggccgaggcggguggaucacgaggucaggaguucaagaccacucucgccaagauggugaaacccugccuguacuaaaaauacaaaaauuggccaggugugguggugggcaccuguaaucccagcuacucgggaggcugaggcagagaacugguugagcccgggaggcagagguugcagugagccaagaucacgccacugcacuccagccugggugacagugagacuccaucccaaaaagaaaaaaaaaaaaaaaguauuacagaaaagaaugugagaacauguuucaaguauuaacaaauaaaagaaugcaugcuaaauaauuauuugcaacacaucauagagccaguucucaccuggcaauaagguacuccaaaaguucauucauaaguaaauugagacucagaaugcauauuuuuccugcaggagucaugugauauauuauggauguuuucaaauauuaauccauaauaaucauuuuaaguuaaucauaugcggacuauaguuuucuugaagcgagggauuguucuacacguauuuaagucuugcugucuagcagagugcuuugcauggguagggccuccaauaaaugcuugaugaguaguaguucauuaaaaaauucuuuaaaauuuuuuuuaccacaaaacaucugcaaguagaguaguucauuuuuuaaagcaccauacacuaauauuuaauagcagcuguuuuagagucagauugcaaggcuucagauccuggcucugccacuuacagaaugcaaaucauuaagcaaauuuacauaaucucugugugcuucaauuuauuugucuauaaaauugugauauuaauaccuaucucacaaugcuguugugaggaguaaaugaauuauuauguacuaaauacuuagaacauuacuugcauguacggauucaauaaaucuuaaauauuguuauuagcucuuaaguauaucuccucaacuaaauuauaaacucugaggaagaggcaagauccuauccuuuuuaaaaucccggcaucuacacaauuucuugcauauugugugcacucagugaguauuuguugaacuacuaaaaggaaugaaugauuggcuauauguuuacaauaccuucuccauaaaaaauacauauagaauugauaacauucuaacauuuguuacaguaaaaaauguuuuuagaaauuaaauagaauuuuuuuuuuaagacagugucuugcugugucgcccaggcuggagugcaguggcaugaugucagcucacugcaaccucugccuccuggguccaagcaauucuccugccucagccucccaaguagcugggacuacaggcacgugccaccacacccuccuaauuuuuguauuuuuaguagagaugggguuucaccauuguuggccaggcuggucucaaacuccuaaccucaagugauccaccuaccuuggccucccaaaaugcugggauuacaggugugagccaccaugcccagccuaaauagaauuuuuaagaugucagagcaaaaaggaaauuauuaccagugugaaauucuucacuauauuuuagccccuaagaggcagagaccuuguccuguuucuuuguaacugcugcauuuugcgugauguuuugcagaauaggcaugugcgaccuuguacacagaaagggcuuaagcaaauccuuaugcagauuccuggaguuauuuuucugugcuggucgcuccuuuccagaauucuacucugcaacuuccagcugccuuagccuucugaacucagagcccccucuccuuaccuccacgaggccucuggggucucuggguuuccccuucuugcacuugcaguuuauacauugccuccaagcagaaggcccagguguuucucaugcucaucccaucuguuuccccucuaacagagauuagucuuacaaggccucguguucagucugaaaacagcugcuuccuguacuucguucaguucucuaauugcucacaauaaaaagcuaaguccuuucuuacuucaucauggcuagaagcaguucccaugcgaaugucuugguuaaaggagaaaaauguauaagguaacuauaaacuaagacuuucacaucaauucaguugguucuuuuguuaagaauuacaggguugggcacgauggcucacaccuguaaucccagaacuuugggaggcugaggcgggaggaucccuugaggccaagauuuuaagaucagccugggaaacauagugagaccccguuucuacagaaaaaaaaaaaaaaaaaguaaaaauuaggcacagugucgcaugccucuagucucagcuacuugggaagcugaggcaggaugaucaaucccuugagcccaagaguucgcgguuacagugagcuauaauugugccacugcauucagccuaggugacacagcgagauccuauuuaaaaaaaaaaaaaaagacaaaaagaaaagaaaauuacaguauaauuuuucuguguugaagagcuucugcuggacaaauuuucagucuuggucggcaguuuaacucaagaacagacucuucuaucuucacuuccagcuuacauaaauuagaauggagaagagaauucuaaaguauaaagaauguacacuguucucugccccaauuacacaucugucucacggcuuguuaggcagcaugaugaauaagcgugucaucucucuccauuuauuugugcauccauuuuuauauccauagucuauagagacuuucauugcuucucacaaauuuguuuaaacuuuuaauagugauauauacagacuuccucaucuaagcacagacacgauuucuauuuaggucauuucugugcagucacuuccucuuccuaggucauagcccuguaguucuaucauacauagacugucuauuuuaauagaaaccugcagcaaugguggaaggaggggaacgggagucauuucaucagaaagaugcauuguaucuacuggagaauuuucuugucuuagaaacacuagaaauuauauuuucuggaaauuucaaauuuuacuaaaauguggucauugucaauuauguaacaggggcuuuccuuuucaauauagcgacuaucaguaauagugcuggaaauaugauaacaggccacauucuaaaaauucauuuccucuuuaauuaggaccuaacucuuggaaacuccuucaugugagcugccacaacaucaucuaaaagcaaacugccaaaaaaucaucuuaaaccgcaucaucuaaaaguuauuuuggcaaaaugcauggucucaaauggaagauaaugacagcuaagauagaauuuagaaugagccccagcacuuugggaggccaaggcggguggaucacuugaggucaggaguucgagaccagccuggccaacauggugaaacccugucucuaccaaaaauauaaaaaaauagccaggcgugguggugcaugccuauaaucccagcuacucgggaggcugaggcagaagaaucacuugaacccaggagauggagguugcagugagccaagaucacgucaccgcacucuagccugggcaauagaaugagacucugucucaaaaaaaaaaaaaaaauuuagaaugagcacgaaguuaaugaauaauaccucagucacauucuaguaagaaaccauuccuccuugugggaauuagagcccugcccccagaacccuggcucugagguuugacuucuguuauguacugacaguccccauuacgcucaugguuccauggugccagcacaggaguggcugaugacagaggcugacaugucaugcacaucauucugucuaucucauuguuuagugucucuuccuugguaaaugcucucugauagguguuaccaugcaaucgaaagaucacacaccugauacuacuaugugucuauccauuugccucuuuccuagacaucuuaucccuagccuuucaaacuuucuccuucuggaucccugcauauguacacaguguauacaaugaacuguaauuaaauaaacuacauaauuuacuuauugauuaggucucuuuuaaacuauuucuugugaguucaagaaagcagagaucuuuguaguuuuuuuguuuuguauuuuaauuacuacuguaucccuagcacuuauaauaguguguggcagagaacaaguacucaguaaauaguugcugggugaauccauacuaaauauaaaucuuugucaauuaguauaugugugagaaauaucuauuccuaguuagaggcuggucuuuucauuuacuuuauuguaaaugauguuugaaugaacagaaguauggaauuuuaauguaguuaaauuuaucaauccuuauuaagcuauuuuuuuguuucuuauuuaagaaauucucugcugcaaagugauaaauauguucugguauauuuucuucuaacccaucuuucccccacugaucugcaaugacauuuuuguuguuaauuaacuuuuauuaccagugaaucuguuucuaggcucucuauuuuguuucauugucugacuauccuuuuuaaaauaaguuuuuuuagagacagggucuaacucuguugcccaggcuggagugcaguggcacaaucauggcucacuacacccucuaacuccugggcucaagugauccgccgcagccuccugagucacugggacuacaggcaugggccaucacuucuggcuaauuuaaaaaguguuuuuuuugaagaaauggugucuuacuguguagcccagacuggccucaaacuccuggccuuccucccaccucagugucccaaagcacugggauuacaggugugagccacugcacccagccuauccuauuuauuuuuauuuaccauuauuuauuuuuaauugcuggacaguuugacaaguccaguuugagcuaguuauguaucacaucccauuugcaaggguuguuugucuuguucaaaggacaaugaguacaaccaaugucaacagaaguuguuuuucuuccuucgaagagaagggaugcgccaggauggagagugccugcauuccugcccaucaggguacuauggacacugagccccagauaugaacagaugugcaacuucucucggagaaaacaaaauaaaaaauacgucauugguccauguucaacugcccaucguaaaaaagaaauacaucauuggauaagcaacuucauucaaaagucagugccacagcaagcaagaaauuagaagcuuguaaaaauaagauggaauuuugagcugggcacggucgcucaugccuguaaucuuagcgcuuugggaggccaaggcagguggaucacuugaggucaggaauucaagaccagcuuagccaacauggcgaaaccccgucucuacuaaaaauacaaaaauuagccaggugagguggugagugccuguaaucccagcuacuugggaggcugaggcagaagaaucacuugaacccaggaggcggagguugcagugagccaagaucgcgccacugcacuccagccugggugacaauaaaaauaaauaaaugaaaugaaaauaaaauaagguggaauuuucacccauugacaaaaaguuaauaauuauuauuguaucuaauuucuggacauugaauagcucauaagccaaccuacuuaugagcaucuguuuucuggaugagcuucaaccguugcaaguggauuuuucuucuuuggacuacuugucaaacuguagugugaaucagaggaguuuaauacagauugcugaaguuuuugauuuguaggucugggaugggacuugagaauuugcuuuuuuccaaguucccaugugauguugauacugcugguucugggaccacauuuugagaaacuuuguugucaauaaugugcccacagcugcauuauuuuuuuuuuauuuucccaagaauuaaugucaucagauuuaaauaguaguauauauuaauacugaaugacaaguuagaaagauagauuuguuuaaaagauaauauuggaaauaggcacaugaauauuuugaacuuaaaauaaauguuucagugauuuuuauuaaaguaauaugaauauuguccuccaaaacuuugaugauagaguuuuguuucuuuaaugugaauuacuuucuuacauugugaaaacuuagagcauauucuuccucaggccuaaguacuguauaggaacuauuaagugagaacuuuaacaguaauucuccauaugcaaaaaagcauuuuuacuagucuguacuuaacaacuugcaaauuugcuuuuauccaaaaggaagagaauuagagaaaugauuuuaguaagaaaugcuaaaaucaaaaagauagguaaauauuuaaggaaucauuguaguauucccaacaguuuuauagaugaaauuuuaaguucucuggguuauaacuugcuuucugaugccauuauaaaccugauggcugagacacuggucgaucacccauuaggaauauaugcuaaaauuguugcuuucaguuuuuaaaauauggcuuaauuuuauguuugcuuaaaauugguuuguuuuggccugguaauaucucgggucccacacauaugaucauucacaauuaucauaucgggcugagcaggguggcucacgcuuguaaucccagcacuuuggaaggccgagguagacagaucacaugaguuugggcccagccuggccaacguagcaaaaccccaucucuacuaacaauaaaaaaauuagccaggcgugguggcacguaccuauagucccagcuacucgggaggccgaggcaggagaauugcugaacccaggaggcggauguugcagugagccaagauggcaccacugcucuccagccugagcgacaaagccagacucccucuaaaaaaaaaaaaaaaaauuauuauuauuuaguuuuaucuucucuaucuguuaaugagagagacuaaaauaaugaugaagaaaacauuuuaauaugguauaugaauaguaauaaaauaauauaauaagauguaucuccaaaaucugaaucuaaugguacuauauucguauuauagcugauucuuuacaaaaagcagucuuggcuuacuggaaaauucacauuuuaaaagucgaucaguuucauuuuuucuggagaauguuagcuuuacugaaaguauaaaaguuucguuguuguagacaccagguccuaauaaaaacaaguaaaagaagaaaaaguuuguuauggguggaacugauuaagugagguaccacugaagaauuaaagauaucucacacauacuuugauuaauuaaauggugaauaagaacuuguuuuaaucucauuauucaagucacuaaaauguuaaacagguaagacaaaaaggcaauuauuacaaguuuuuacguaaaacuaugauaagauuuuuuaaaaagugaaacaccacccauacacacugaauucauuuggcugguauugauucugaauauguauuuuauaauauuucauuggccuugacccacaaacuaaacacagacauuuucucaauuagucauuuucagguuuauugccuaagaugcuaauugaaauucagggcaggcaaaaauacaucauuggccuuuguauaucuuugaaaggccuucugaugggaccuugcuccguauaaaggcuucucuucucugcaaacugaaagggacccugugugugaaguguguucaguggggucuucaaggaacaacauagagagcagccgcuggccagccggaagccaccaugcgcuguccucaacagagcagcuccaggcuguaugacccccaggcaauuaggcaccaaaagaagaugcucacacuuuccaaaauucuuucccagggcugggggaagggagccagacuuggagccccuauguggaacuuagucuccaaggaaagaaagcauguucucauccuacaaacacuccauuuucucccugaauuaguguccuuucuuugaaccagaugagacuucgcucagagcuggaggcuauggccccuuaguucuguuuccacagugcuuccagcccucuccccaguuuggaggcccccaaaaugaggcgcuuaucucuuugauuuugugaaagaaaaugcacaguucgucuauuuggggcuucugaaagauguuaggcccugaagaagguugacugggagacugaguggggagugacagaccaugaccuuaauuacugaccuuuuguuauagauuaacuuccuuccuauuuuauuguuccuggcccagaccagauagcacuugagauaaaagaucccuugauuauuacauccuuaauguggaauguuaaauacucccuucccccaaggaaucacugccuaaaaccagucagauugcugcgacugugcacuaaccuuguguggaaaaugcugucauccuguuaagcuuccccauaccgugccuguauaaacaauccucaaaccucgcugcuucagagcacuaaccccaucuuuuuggaguccuccugggugacccuccucaaacuuugugcucaguauuuuaauccuauugccuggaucucgauuuaaaguugauaauuuucagagaauucuucauuuucucuuugcauauuuuauuguuuccuuuccaucuguuuuucuuuuacuuacugccugaagccaagagacaaugucaaggugucuuagugaaaggagcucauacuuaaggguuccugggucaaaaccuacaucucucauuucuuagcucuaugaucuaccuguuuccuuaaucucucugggccucaguuuacccauuauuguaguaaaacauguacuacaaguuacuuuuuauuuaacuacuuaugccauauuuaauucccaaccacuaauauuacauauuaguuauauauuguuaaaucauaauguucuuucacuauuucuuuuaugacugagaaauuucuuuucaauguauaaaucauauacauguugcuccuggacaaaacugagggucaggcugcuacuucuccuggcccaauaaugagaugcagacaaacuggggaagagagguuuuauuuuugcauuugguuacagggagaaggccuagaaauugucaccacaccaacucaaaauuacaaaguuuuccagagcuuauaaaccuuccaagcuguaugucuacauauaagugugcauucaucuaaagacauaagugauuaacuucuuuuaaucuauaacuaagaucugaguccugaagaccuuucucuggagccucaguaaauuuacuuaaucuaaauggguccaggugcuagggugauuacccuuaucuugucuccugcuaaaucacagagguuuggggaguuccuucagaccuccaauaaacuuguguguggaggccuggggaauuucuucagacugacaauaaaacuuguuuauuccagucuggccaacauggugaaacccugucucuacuaaaaauaccaaaaaguuagcugggcguggugacgugcaccuguaaucucagcuacuagugagaccuggccugccacaaugugguuaaggaaacauauuaaaacauuuuuaaaaaucaagauuuuccauuucaauggccuuguaauugauugaaaaguuuauuuugagucacaugguguucuagacucuuguggaggguuuagauuggaaaauaaguaaugacagugaagcaguuguuauguucguauaaaagaaagaaaagaaaaacccacaggacuuuauuugguuuuaaaagucuaucugcaaagauauaguuuauaggaaaauucaauuccaaauguuucucauugcucuggagugugugaagaagaggccuaagaauauucuuaggaaggcaaaaacuuucagaugcaguucauaugcuugacaccucuguuucacuuuuggcugacuuguguagucugauuuuuggucacugacaggcucagcaucaugagugugcaagacguaagggaggcaggaccuugucuuuucaauggugucuuccuggguggcugccagaauucaucauuauugcacucuacucucauagccucgauuucuguuuuuguuugcuuuuacugaaauuggaguagugacacagagucagaucauugaaaagacucacaagauuccaaaggguauacugguagaguauaaacuggaggauaagguacagcgggagaaagcaaguaccagcagacacagagggggcugagacuccugcaagcagcgccuuuccucaggcucacuggaugugcucuguguuugggugugaaccaccaagaugcaugcaugauaucuguuuucagggaagccaagauacaaguguacagaaaagccauuauacccccgucacauugcugaaacuggaugauuaaaccacguaccaagcggugucuaaauuucaguaauaaugaucagcuaguagagggugccucaaggcaguuucagacuuuaaauaacauaguagaaaucacuagcuaguccauuucauccuuaucauuguugcagaacuuucuccuuaguucagcuaaaaccggguucuugucacacaaccggaaaagauuaggcucagggacacauagaagggugaggggcagaauuuauugggugaaaaggaaaaaggaaaaagaacucucagcaaagcgagagggagucuugccaacaggcccuccaccucacagacugaacaccaggccaccacacaggaacugaagaggccaggcuccuccccgcugaacaagcguaaacuucucuuggcuccacccucuucccccagugugcaggugggcauuauucagagagaaucagcugagaaagggcaggcuuuauccgggaccagcaguccaguucuucagccuucaggcucuuuuaggcuugaaggcaggguuucgugggggaccuugguaagaagaguucuuuucgacacuuuaauguagauuguaagagguagaaaaaaauugaucacauuuaacauauaguuacuuaaaaacacaucuuugaguuuucuagacuucuaauaugauuguagaaaaucagcguggcagccaacuuaagacagaucaauaccucgaagucuguaacuuuaauaagaacaucagaacugaaauucuauauuaguuacccuauuguacucacagucauggaauacagaacaggaaagauucuggaaacacauuuugauagucagggucacagauauugcucuguuucaguaaccagguuuucuacuuaugaaaguuauuuaaaaggcaaugaauauucaaaaugugagcagcuauugcuaccauuagcuccagaaucaguucugaagaauuuguaggaagucaucuugaaaauaauaaagcaauauauuuuucagaaauaguauccacuaaaucauaaucugaggccacuuuacugaggcguuuauauuuauauuuauauuaauuuguuauuuuacacagaaagggaaacuaugaccuaaagacagagauaacaauaaucugauuagcauuagccaccccauuccaacaacaaaucacguuaauaaggcauuuuuagaaguagcaaagcauagugguuaagaacauauguucuagaacuagacagucugaguuugacuccugauaccacuuauuuuauucuaaaacuuuuggcaaauuauuacauaaccucccuugccucaguuggccaagcuguaaaaugggacuaauaaugguguccaacucacaggauugcuauguaggcuaaaagguuaaaagaguuuuauauuucuaaaacaaugugcuuguaauagucuuggcacauuguaaacauuguguaagugcuuauuaaaaauaaauucaugcuuguaauugaagaucgccauaugagauacacauucuagugaucuauauguuuaucauuagauauaugauauauacacacacucauauuucaguccccugagggauuaacuuuuaaucccuugauuugcaaaucaaguuguaaauuacacguauaaauaaaauaccuuuguagugauucguucauuauaaaauuaugcuaacuauguugguuuucauguaggcauaagcuggcucuauaaauaaaguuugaaaauaaguaagguauaaaggaacccuggcgggauagauaagauacuaggaacagugguuugggagugaggaugggaaguagacugauguggaacaagaugggagugagacuuuuuuuagucaccgucuauauuuuuauaauuucugggucuggaaucaguaucuccucauccuaacuuguucauaugaugaguuagagucauaucugccugcuguuaguuuuuucaaagaaucuucaaauggggcaacccccuuuggguccccucccuuuguaugggagcucuguuuucacucuauuaaaucuugcuacugcacucuucugguccauguuuguuacggcuggagcugagcuuucgcuugccguccaccacugcuguuugccacugucgcagacccgccgcugauucccaucgccgcugacucccaucccuccagauccggcaggguguccgcugugcuccugauccagcgagacucccauugccacucccgauugugcuaaaagcuugccauuguuccugcacggcuaagugccuggguucguccuaaucgagcugaacacuagucacuggguuccacgguucucuuccaugacccacagcuucuaauagcucaucgcauggcccaagauuccauuccuuggaauccgugaggccaagaaccccaggucagagaacacgaggcuugccaccaucuuggaagccgcccaccaccaucuuggaagcggcuugccaccauuuugggagcucugugagcaaggauccccgguaacauuuuggcgaccaugaagggaccuccgaagcguuugucucuuccagaauugaaacuguaaaacuacaaaugguucuucaaauggagccccagaugcaguccaugacuaagauccaccgcagaccccuggaccggccugcuagcccaugcuccaauguuaaugacauggaaggcacccuuccggaggaaaucucaacuacacaacaccuacuaugccccaauucagcaggaagcuguuagagcagucauuggccaaccuccccaacagcacuuggguuuuccuguugagagaggggacugagagacaggacuagcuggauuuccuaggccgacuaagaaucccuaagccuagcugggaaggugaccgcauccaccuuuaaacacggggcuugcaacuuagcucacacccaaccagagaguucacuaaaaugcuaauuaggcaaaaauaggagguacagaaauagccaaucaucuauugccugagagcacagcgggagggacaaggaucaggauauaaacccaggcauucgagcuggcaacggcaacccccuuuggguccccucccuuuguaugggagcucuguuuucacuguuucacucuauuaaaucuugcaacugcaaaaaagaaaaaaaaaagaaucuucaaauggcuauugaugcuaaagaaaguucugaaggagcauucuccaaugcaguuauuuccuacagaagauuuuaagugauuuuuuaaaaaacugccucuuuucuaaaaauauuucagcuuuuauuuuagauauggggguacauauguaggauuguuacauggguauauuggauccagguagugagcauaguaagcaauagguaaaaaaaugaccucuuauucaagaggguaccucauuacuauuuacaaagugcuuucaaacauucuuucucauuuuuucugacaacucuggacgucccccccuacuuuuagaagaaaacuaacagucccaaaaauguuuugguguaagucaauauaugaacccagguccauguccagaacuguuuaccacucaccucuuuauaaaacgguaacuguggccaggcacgguggcucacuccuguaaucccagcacuuugggaggccgagggagguggaucacuugaggccaggaguucaagaccagccuggccaaucuguugaaaccccaugucuacuaaaaauagaaaaauuaguugggcaugguggcacgcaccuguaaucccagcuacucgggaggcugagacaggaaaauugcuugaaccggggagguggggguugcagugagcugagaucaugccacugcacuccagccugggcaacagagcaagacucugucuuaaaaaacaaaaacaaacaguaacaguuacuucucugaagcuauuauuuuuuauccuguuacauauaucaaagacuucauuuggguaacuauauucacgauuauuuuaagcuuucuuuuucauuaccaauaguugggcuaaccuuuauuuucuggaugguaaagguguuuuauagcaacaaaaacaaacagcuaagucaauccguccagguacccuguuaaagcuucaaagacucuggaucagaaugaucucugcuauacacacauacccaaagaauaaacaaaaaugcuauugcuaauaucucucagucccuugagggauuaacuuuuagucccuugauuugcaaaucaagcuguaaacuauauuaauuccccccuuucuguaccuuuccuuucggaugaugcucaucuagcauuuugcugucuugaauaccuucuccuuucucaucccuauauauuuucauucuuuauuugaguauaauuccacuuuaacacauuaccuuaaugcaaaccauuaucuccauuuuugcucacuucuuucccuuucacagcaccucuucucaauaaaagucuauauguaguguguucccauggugaugggaacuaaaauuacuuauaaucaaugguuuuuauauugucgcugcugcuuaucucuuggguuaggccucucuuugcagccaggucacagguaagucuaugaaggugagaugaaacaauauuuaccagagauugaacuacuucuggaauauuugugaauccagccuucaccauuauugcaccaucuagauuucacaucuguuuaguguauuaccaauauuuccuuuuuccauauaaugaauucuuuuauuguaguaauugugguaucagggcaccauggauauucauaguuauaagaagauauuaucauagaagaaaauugucaugccaucauucauuaugguguuuugcaucuuugaauuuuaaacagagaaagagaaagaacagucaagcuaguaagcaagagauaaccaaucuacuuugggaaaugaccaaugguucuugauuucaggguagauuauagaaaagagaaaagauuauaguauuuuauaucugcaaaacuuauuccaaaacaaaucaguaaauccagguuaaaauacccaggucagacagucacauuuuuacuaauaaaaauuaacuagcagcccgggcgagguggcucaugccuguaaucccagcacuuucggaggccgcggccggcggaucacgaggucaggagaucgagaccauccuggcuaacacagugaaacccugucucuacuaaaaauacaaaaaaaaauuagccgggcguguuggcgggcgccuguagucccagcuacucaggaggcugaggcaggagaauggcaugaacccggagggcggagcuugcagugagccgagauugcgccacugcacgccagccugggcgacagagcgagacccugucucaaagaaauaaaauaaauaaauaaauaaauaaauaaauaaauugcagcccauugagugaacuuuaaaugaucaugcuacuuugugaaauagaauaucacauuacuagaucuguugugugcuggacaaaugccagcacaaugcaguacuuugcugauauaguguggaauagauuuugugcugcagcaaagcugucuauagacuucaaaaaacaaagguuauaugagcauuaaccaaacuguuuaaaaucuuacaguuucaaaggaccacauauucuaugauuccauuuauaugaaauguccaaaauaggcaaaucuauaaagauagaaaauagauuagugguuaccugggacuugcggggauagaagcauuacagggucagggcagugaccuucccuaaaagauacagaauuuauuuucuaggugauagaaauguucuaaauugauugcggugguggucacaacuaugugacaauauuaaaaaucauucaauuguauacuuuaaaugagagaauuguaaauauaugaguuauagcucgauaaagugauaccaaaagaaagaucuuccccaaaaagcuuucccguaaaaauacauguuccacccaauuaaaaugcaaugucaauacguauucguuuauuuuauugcuuaaaauaauguguucuuuugcacaaagaagaaaaaauagaaaucagaauguaagaagacaagucauuuaugauuuauuuugcaccauuuauuucaacuguuuaaaauaaaagggccgauuuuaugcugcugucaagguuuugcuuaugauaaauguuugaagugacacugaaaugugaacugguugugagacaggcucuccuuggcuucuaauggaggcagguaucccaugggacagaugcuuguauugcuucaaauucauuguaggagaauuaacccuucguggugccacuuucuucauaugaauuaaagugaaaauugccagggucaguggcuuacgccuguaaucccagcacuuugggaggcugaggcggguggaucaccggggucgggaguucgagaccagccugacuaacauggugaaaccccaacucuacuaaaaauacaaaauuagccaggcaugguggcacaugccuguaaucccagcuacuugggaggcugaagcaggagaaucacuugaaccugggaggcggagguugcagugagccaagaucaugccauugcacgccagccugggcaacaagagugaaacugcaucucuaaauaaauaaauaaauaaaaauaaagugaaaauuaugcaguauggguuucacuguaguuuuacuacucuuguauagaggaggaaaaauuucuccucuaccuucuuacaaucucuggcuaggccuaagaauuaaacuuauauaauacagauuaauagaagagaagcauacaaauuuuauuauaauuuuacuugcacaugaaaguccucacaagacaaugaagacccaaagaagugaccagaaguaguaaacuuauauaucuuuuagaugaagaaaugauaaauuugugaagaagugauaagacaaagcaguuuggauuauaggcaguaaauugugaggaagucacuaaaaauauagagggggaaacuaauggaagauaagggauauuuuaguaaguuuguacagaucuauuucagagucaauuccaagucucaggugauaaagauguucuuuucuuccugguacagggagggcaccuuucuccuggaaauuuuaaugguguguuuuuaaguagaaagggggaggucaaaaggcuuuccugcaucugcuauuucuccauugcuuucagcucuaaauaaucaguaugccaaaguggcauauuuugggguggcacguccugaaguccuucacuuguuuacucacucguugcuaaucaggacuugaucaucuuugucucaccccuuuuuacagccguccagcccuaugcuuuuuauuuuaugccauuauuuaaaucugauguuccauucaguucucuacaguuggaagggucuagcuugggcuaccuuuguauuguucaaaaugcuuuuuuaaaaggacaaaggucuuguggucaaaucaguuuagcgaauggugcauaccauaucuugcucuuacagagucucagugcacacuaacauauuaaagguucugagaaauccagaagaaaaaacaaguauguaacuuuauuuaaccuaauauuucccaaacuuuuuuuuagugacucacagaaacacuccguagaacuagccucugcagaacacccuaugggaaaugguguucuggagucauaauuaucucccccuuuauuaccuuauuacucuuucccagcuaugacagaucuuuuuauauuucuuuuuuucuucccgaacauguuuguuuuaagccacaauucaaacuugcuacauuuacuuuuuccugguuauugcccaguuguuaagucuggauugcccugggaagaugcugauuacauggugcucugaauaccuugcguucuuugccaguagcucuccuaaagauuugugaugcauacauuacugcccaacagagaauugggcuugccucauugcaauuucagaagacaauccuccugcguccaucagcuuguuauuggcuggcaccacagagauguguuucucuggcccucauuaauuguaaccaacccuaagagaguuaaguuguaucaggcauguguauaccuuacaguggauaaguuugucagauacuuuccuuagugcauauuuuuuaaagagauagaauaaaguauaaauacacauggaauggaugucaccaauaaggguuuuuaaacacuggagaauuuuauaugggccugcuuuguagauauccuuuuuuuuuucaaucuaugaacucaaauauaugaaauaugucuguacccuccuucuuuuggcugcccagcuaagcucaucccaacaacgcuucccagcuuucuucaggucaccaccaauccaauccaggcuggaagugaugagacugagcuguggaauacaaggagcgugcauggggugcucuucuggauccuggggauauagugguuaaaccguuacugacaacaugcucucauggcucuuagaucuagugggggaaagauagccaauaaacacacaaagaaaucaaaucuugauaaacacuuuucagaucacuaaaaucagauuaugugagugugaccaaguggcugcuguagaaggaauggucuuagaaagcugcuuuuggagaugacaguuagguugaggauccuagugaaaagagugugaacaaggagaaagaaauccaggcagaggagacagcugcugcaaaaacucuaaagcaagacccagcuucaggucuucuucuuuuuuuuuuuuuuuuuuuuuuuuuuuuuuuuuuuugacacagggucucacucuguugcccaggcuggagugcagugacauggucucggcccacuauagccuccaccuccuggacucaagugauccucccacuucagccucccgaguagcuggaacuauaggcacaugccaccacacccagcuaauuuuuguauuuuuuguagagucaggguuuugccacguugcccaggcugcaccuugaagucuuucaagaaccaacagaaggccagggaggggagcaaaguggaugagugggagaaggauacuuccugagcucuuucaaggaggucagggcaagucgcauaggguuuuguuaacccugacguggauuugagaaucaucagcacgcaaggagguaucuaaagcuggaggccuggaugagguugccuuugggaagugaggaaacagcaaaaggaggggcuugguacagaccuggauggcucaaccuuuagagguugagcagagacgaggggacugcaaagaagcagccaggcagguaagaguucagaugucugggaagccacacgagaaaguguuuccaaaagcaacacaugcuguugaagaagcccagaaagaggaagauacagagguggccaccgauccaaugacaacgugcaaguuguugaugacuuugacgagaccagguucaguguucuuugggaggauugaggaggaaugugauuuaagaauagauguucaugaccguagaaguggaaauaugaauauaaagguuaagguuuguuuguuuuaagaugggacuuacugucuuuaaacugucugcaguagaauggaagcaacuaaugaaaaugaagguggggauagaagccauaucuccuugggguuuuuuucccccuuaaggaaauaugaggcaagguuuucagggagggaagauggacugacuguaggaagaggaagagagagaaguaaauaacuugcuauacugugaacauguaguaugaccacuggacaguauuuacagccuauuagaauuugagagauucaggacuauuuguuuuuuuuaaguccaucacucuuaucagugauuuugaccaaauuuaguuaauaccgaagucaggaucugaacccggggacgucuugcucagagucugggcauuugaccacuccacuccacuccacuccacuccacuccacugccucuccacgaguuacagcugaaacuaguccccagucagcacagaucugucauuucuccaguucuccucagcuaugagcaugcauagagaaggcagagaguuagguuuuaugaccaaaagagagagaugagacagaauuaaauguguuugcaagucaguaaguaugcgaugauggugaaaucaaagaagugaagaaccaccguuguagauaaugagcaaauuggggaucaaaggauaggaaacguugaugagguggaagagcgagugguuugauuggaagaagugcagagccugauuuggaagaaucagaggugcaguuauuggugauaacaugacaaaugauaugggugugaguggcucauguggguacaggagcagaucaccuguguugagaagguugaggauugagaagucugggccugucccauggaucugacauccaggggucccagccuucuuguuuucuacaaaagagaaacucagagccugugccccuggaauuuucaaauaaagcaugugcuugucccaagguauggagaauagcggccgugcagccaauaaugucacugggcucacuugggcuaaagugggucuccccuuuccuucccugcccucccucuaccccgaaacuuuccuuaacuacugaagaucaggccuucuuggccccaacacagaaaucccugugggguggggggcaaggagaacuguuguccacuccugucugcaacaaaagaagaguucauuuuuggccaaaugaaugacaaugaauauuagggucuuggacugccagaacucccugccaguggcacucccugggagagaaggccuguucccacaccccucucuccagcuuucuccaccuggaccagaucaguuguucucccuuacuccccucuaggauccagaauuccugguuugacuaucaaaaguaacacuacuuauaaguauuuauaggauacaucauugacucucacauucacuuuauuauaaaauuucuuuuucucuaacaacucuagguacuuuuauuguuauuaggccauuguuccuuacucuuuguuuucuuguauuaucacaucagucagcgaccaaauccuguucauucuaacugagauguuccccgaucuguccccuccguauucuucaugucuucucucauguugggcauuggagcagcugcuuaauuuguucucuuugaccuuucuugcuaaaguccacccucgcaacucucaacagagucacuuggcaaaacguaggucugaucguguggcuguuuugcuuaaaagucuuugaugguuccccagauugcuuuguuaaacaaaggaauuucuacuuuaaaaguagaauuuccugcggaaucuuucucaaguuacuuugcuccaaccacacuaaaccgcaccguucccuaaaccacagccuaguuaagaacuuuaaagauuccaagcacugacuauauuuugguuccucccacuacuucagagguucgcgacacuagacuaauuuaacauuuuauucuacaaaauagcaccgaacuuaggcauauguggaaaauaacuagcuguuuuccagauuuuucuguuucugucuucucuuuucuuuugaucacugcuccaggcuugcuggggcuguaaggaaaugcucagucuaacuggagaauuuuagcauugccuucaacacaaauauaaggcuacuucuguuugaagguuuaucucuggcuggaaaaucugcccuccucuaucuccauuuaguuaaccuuuacuuuuccuucaagguucuacccaaugauaacuuccuuuauaaaguguucccuggcucacccagggguaaucaauugcuuaggcuuuugcgugugaacuucugcucguguuaccauaaauuaucuguaugucuagcauccuugcucauuuuaccauguuauaucauuaaauccucauaauuaucauguaaucuuaaguauuaggauuccuguuuugcagauaguaaacagggguuuguuacccaccuaaccaagcuauuauuaauaucuaaugugacaauggguauaauuaauuuauaaaagacuaagagcauuaaaacuggaaggcaguauuauuuuuaauauauugacucuguguggugacaagcguucaucuguauuuuuucuucuugccaauagugaagggaauuuaugauuccuacauaaagaaaucuuuuuaauguuaauuaaacuaaacuguaagaaugcugcuaugcucaggugcaaugcaaauaaugaggugacucuaucccugccaucucaggcuaauccccucuccccugaggagcugagacucagcucccuggaggugaaaagcuaaagcauuccccuguugugccauuuucuucccuuucucucaugcauuauuuuucuuacucugguuauucuugaugggaauuuuuagcagagcucagcgccaucuuaucccaggaagaaaaaaaaauuguaggagauaaauguaugaugaauggugcaaaacacaacaguugcaaucuuuuaaauuuauugugaaauuaaagaacaugccccuagaauauaaucgcuggcaauucaaaaagcaaggauuuuuagcaaaauaaauaagaccaguuuucuuccucugggccuugugucuguucaucucagugagucuuucagcuuaaccaguguugcagcccaagcucuuccuuguccuuaauuagcaucaggaguuuucauuaguuauuuuacgaguuguuagugauccucauuagcuuugcuguggucuuaaauuuucuugacauuuacuguuucacugcauaagauuuuaugguuaauucccagaguauauaagccagauuauuagccguuauauuuuuuacaauguauauauucccauuucagaaucucuuguaucuuaacauuuuucuuuacaauuuuauauaaaugacugucauccaguucguugggcuuccugauaucuuuuuuauacauauuaaauaaggaaaaauaaguaaauauauauaucauucacucaguugauagauuuuucaagaaagaaaaaaauuaagauaauauguuucuacaaaaaaagaauguaaugaaauacuguaauuugacuuuauagccaaauuaggggaacacuacuauuuuucauucuacaauuauuccacacuaugcugcaaguauugcccaaggaacagaaggcagaaaccaaguaacuugacaauauauuagagaagaauaacaagucaaguuauuuugaagauuuagguguauuuuauuucaaagugcauuguucucccuuugugccuccuucucaaauaacacaacacaggaagcugucauccauguaauauauauuuuuugggggauuaaucacuuguauaccuguuuuauuauucauuccauggucauuagggccuaaaauguaccagguauuagggacacaggauaacaaggcagcaaaggaucauuauauucagaugcaaaaggaaauguaauaaauauaaaauguauaaaaaguaaguagccaguuucaaauaauaaucagugucauucugucaacacuuauuuucuaaguauguacuccaugcuaaauacuaaucuauaaaguaacucugaugggugaguggagggcgaggggagcuauuuuauauuaguugcucagggaagguuucccugaggagaugacaucugaaaugagacuuaaauaacaaguaaacacagaagaguuuuucagcugaguuucugggagucuguggauagauuucaggaggucuauagacuuggaucagaaaaauaauuacaucuguauuuucacucaacucagacugaaauuuagcauuuucuucuauuugaauguagacaacaaaucucaguaguacuaguagcacuuguuacuuuguuaccaguagaaaguauaguuuuuuuaaauuauaucucaguuuucacaggugucuugaaauguuaucauugcuuugaaauuaugagauuucuuggaugugauacuagaucugauucuaauuguguuaauaaagaagcacauguauuacuguauugauuauguauuacuggguaaugaaugacccacaauuugggagcuuuaaacaauaacccaugauucuguuggucagcaauuugggcugugcucagcugggugguguuuuuuuuuuuguuuuuuuuuuugagauggagucugucucugucgcccaggcuggagugcaguggcacgaucuuggcucacugcaagcucugccuccuggguucacgccauucuccugccucagccucccaaguagcugggacuacaggugcccgccaccacaccugguuacuuuuuuauauuuuuuaguagaaacgagguuucaccguguuagccaggaugaucucgaucucuugaccuugugauccgcccgccucggccucccaaagugcugggauugcaggcaugagccacugugcccggccucggcugggugguucuuaaggacuugccaggauugcucaugugguugcagucaucugacagccccacugggccaaauaguccaagauggccuuccucccaugcccagcagcuggugcugacugcaggcugggccacauggcuccaacaggcuacccuggggcucuucacauagucacaguguuacaagacagcaagagcaugagccacaaagccccgugaggcucaggcucagaacuccccagcacuuccacugucuucugugggucauaacaaauccaaaggccagcucagucaguuugagagggaauuccauggguugugacuucagggaagugugauuaauugggggccauuaauauacuuaccugucaccuaccaaguccuaauuuuuuuuuuuuuuuuuuuuuuuucugagacagggucucacucuguagcccaggcuggaguguaguggcaugaucauggcucacugcaggcuugaccuuuggggcucaagcaauccucccacuucagcccccugacuagcugggacuaaaagugugcaccaccauaccuggcuaauuuuggcauguucuuuuuuuguacaaaauaaucuucuggauggggcucaccauguugcccaggcuggucucaaacuccuggacucaagugauccucccaucucagccucccaaggugugggguuuacaggcaugaaccacugugcccagccuaugucauaauuuuaaaaauuauuauaauaaguuggccgggcuuggugacucacacuuguaaucccagcacuuugggaggccaacgcagguggaucacuugaggucagaaguucaagaccagccuggccaacacaacgaaauccugucucuaguaaaaauacaaaaauuagccaggugugguagcaggcaccuguaaucccagcuacuugggagacugaggcacaagaaucacuugaaccugggaggcggagguugcagugagccaagaucaugccacuguacuccagccugggugacagagcaagacucuuucaaaaaaaaaaaaaauuauaguaauuuuaacauguucgguguuuucuguaauuuugucuuuuacacuuuuuaaaauauuauucugagaagagguacauaggcuucagcacauugucaaagagggucaagcacauuaugagauuaggagcccuugaucuaaaggcagggaguucuggaaagaggaguauagaagccucaaggcagaagcaagcuggcauguccaaugggauagaggagcagaaggaaagcuccugcggccagagccaaagauugaggggcagagugguuggagacagagguagggccagaucaugugacuucuuugaaagcuucugaaacuugcaaagggaccuccacuuccccacugcaccauacccacagagugugaaaguagguauuguauguaaauuguauuuuaugauuuuuuggggucauugcuaacuuuuuucaguuaucuuggcagaaauaagaaaauucuuuuuugcuauuccauauaucuauugugauaucagagucuguuguuuguuuguguguuuguuuguuuaagacagucuugcucuguugccaggcugaagugcaguggugcgaucucagcucacugcaacuucugcuucccagguucaagugauucuccugcuucagccucccaaguagcuaggacuacaggcgcgugccaccacacccagcuaauuuuuguauucuuaguagagacaggguuucaccauguuggccaggaugguuugaucucucgaacuugugauccgcccaccuuggccucccaaagugcugggauuacaggcguaagccaccgcacccagccccagagucuguuguuuauagaggaugauugggcguagcuuucuagagcugggaaaaccaccuuuaaacaguauuauauaccaauauuuacuauuucauaaauucaggcauauuugcuuaaaauaaucuccuguagagaggcaagaaacagaagcccauuuuuuuguuuuuaggaaauucauagaagccuuugguaagguucuuuuaaguuggcaaacucuauuuucagaagacuucuauguugacacuugugaccuacagaauugcuuuaagaggucagcacugauaaaaacagagggaagcuguaaagggaggauuaggcuaaagucaacugguggaguaggcauaggugaauuacuaaaguguugaugaaaugacucuguuggaguuaccaguuuauuauaaugagagcuaaagugaaaaacgccagacagccuagaagcauucugaauaacaaggagcuccaaccccuuauauauaaaugagguuacauauaguagguugaaagcagguuuccaaaacaaccaauuaguuuguauagcuucagcuucaggauugaugauuacauuccauaggauauuacauuaaauugaugaaaucugcacgucucuggggaacuccuuacaagcuagccagugagcuuuuaugaugauaagauacagaauggauaaaaaucuucugaugccaaaaaagcuuuggcccugcccaaguuaggaucuauauucauauuaucaccagguaaagugucuugcaaacuuucuuagcuuucauuccuaucagacugcaguucaugacugugaggugucaaagacucucuccuuaaccaagcuucagucaugcucugcuaaugucucuuuuggaccaggcuucaagcuugcuccacccccagcuuuggcuugcccagcccagccuuagcaaggaauucugcuaagucaucucccaacccuagauaucuaauuacccuugauaucugaucaaguucuucauccuccaccuuuuugaugucuaaguccuuggacugccuuuagcaagaguccuguuaggccagcuuagcaagaauuccccugcccuugauguguucuuuuagcaauuucccauccuuugacauccucaugcuguucuuggcuauaaaucuucacuugcucuugcuguuucagaguugagccccuucuuuuccccccuccaauugcaaugguuuugaaugaagucuuccuuaccauuuuaacaagugucagaauaauuuuuuuaacaucugucuuuacaccacagucaacaaccccuuauccuccccaaaacucugagcuaacgccacuacuuagagauuacagugucugccuauuuuauuagcuggaacugcaucagugauuuuggaguugaauuuuucauuuuuuacaugaaagauuauguguuuauaauuuguuguuuucacauaugcauaaacagaacuaggaagagcuguacucaggagucaagucagaagaaaaaacaucaccauguucaaauagacaacugaacaugccucugaaaaccagagacaaagggaguuauuuacaguuaacaucuauagaauaugggccggguguaguggcucacgcuuauaaucccagcacuuugggaggccaaagcaggaggauugcuugagcccaggcauucgagaccagcuuaggcaacauggcgagaccccaccucuauaaaaaauuuaaaaauuagcugggcgugauggugugcaucuguaggcccagcuacucaggaggcugaggugggaggaucacuuaagccugggaggucaaggcuacaauaagcugugauuaaggcaccugggcaacagagcaagacccugcuucuaccaaaaaaaaaaauauauauuaaauuuguagaagucugggcacaguggcucacaccuguaaucccagcacuuugggggcugaggcagaaggauugccuucacgaguuugagaccagccugggcaacauagugaaauaccaucucuacaaaaaauacaaaaaugagccaguugugcugguguacaccuguagucccagcuacuuaggaggcugaggugggagaaucacuugagccugggaggucaagacugcaguaagccgugaucaugccacugcacuguagcaugggugacagagugagaacaugucuuuaaaaaaaaaaaaucuguggacuaugaagcaagaugagagacauuugaaagcauaugucggaaagucagguauacuucuagagcuggcucucuguuaggauagagaccuuuaaaauguuucuagugcuugcagaugucacccuacccuccugcaaagauaacagugcauuuacuucugucacuguagauuaguuuugcccagguauucuuuucuuagggcugccguaacaaagucuggguggcuuuaaaacaacagaaauuuaucgucucacaguucuggaggccaaaagucagaaaucauggugucggcagggccaugcucccucuggcagcucuagggaaaggccuuuccuugccccuuccuggcuucugguguuugcuggcaauccuugauguuccuuggcguguagaugggucacuucggucuuugccuccauggucacguggccaucuuuucccuguguuucuucacauagucuucccaucccacaugcagaaguaugugucaguuucuguguggcugaauuuccccuuuuuauaaagacagcagcccuaucggauugggccuccucuaaugaucucauuuuaauuuuugccuuuguaaagacccugggaguuaggacuucaacaugucuuuuuugggagacaauugaaccuacauagcauguuuuugaacuuuacaugcagaaucauauuguauguagucuuuugcaucuggcuuauuucagucaauauauuagugagauucaucuguguugcaauagcaguuucuauucauugucaguccuaccuaccacuauaucaaggcucugcaaauuauggugugaaggccaaaugcaucaugacuuauuuuuuucgcauauggauaucuagguauuacauaagaaaaugugguuuuugguuucuaugauacuucuucccauauuucucuuuguuugaauaggaaacaaaucuaauuaauccuuaauuaaaagaaaacuuuuauaucccaucuuuccaugacuaugaauauguuacauguauaaauguuuauaucuguuauguggucauuauacauuuugaacuaaaacauagcuuauacuugccauauaaguuuauggaaaaaguuaaauauuuuacuuaauugauugauuuauauccuguaacuuuacacauaaguccugguaauacaagcuuguuguuaaaaaaaaaauugaaaugauccagaaggacauaaaaucaaacgaauaggcuccucuccuuaucccuguggcuugcccagucuaauucuuuauaagucaccgcuauugacaguuuucuggauauucuuacaaauauuuuuucugacauggaagugugcauguaucuguguauguguguguucccuguauuucuaacauaccugggauccuaauaugcauacuaaucuaugacuugcuuuucacauuuaauaauauauugugacuacauuuccauuuuaguacaauaaaguuucuccucauucuuuuuuucuguuuuugagauagagucuugcucuguugcccaggcuggagugaaguggccugaucucggcucacugcaaccuccgcaucccagguucaagugacucuccugccucagccucccaaguagcuaggauuacaggcgcccaccaccacgccuggcuaauuuuuuuuuuuuuuuugguauuuuuaguagagacgggguuucaccauguuggccagguuggucucaaacuccugaccucaggugauccaccuaccuugaccucccaaagugcugggauuacaggugugagccacagcgcccggccuuucucguuucuuaaaauaauuuuauaauguuccguucaauggaugcaugauaauguguuccccaaauagcaaacguuuagacuguuuccaauuuuuuguguaaguauacauggauuuguuucuguuucuauuuacuucuaugaaaacauacuuaagaaugauuuuuagauguugaauugcuggguaauauauaugugcuuuuaaguuuuugacagauaccacuaaauugccauucgaaaaaaugcaguaacaauuuacaccccaugagguguuuuuauuauuauuuuuaacuaccaggacuuuacaccuuguaaaaucuacaauaagagaguuauauauugacuguuuacucuguuguuucagaacaaugagaugguggagcuacagagaauacggaugaaggaugaaauccgagaauauaaguuccgggaggcacggcuccuucaggacuauacugaauuggaagaagaaaauaucacauugcagaaacuaguguccacguugaagcagaaccagguaagguuuaagaaauuuuuuguuauacugaagauggaucuacaucuucugaccacuaggguuaaaucuccaaacuugucagaauuuauuguuacucuuuuaucuucucucuauaacauuuauguacugcaaugucccaacccuccuauuucagcuaaaauauagaaggaaaaaauacaccuguaaguaguauaguguacacuaaaguuuuauugaauaagaaaaagaauuuuaguuuuuauuuuagcucuguguucauuuauuucauaagucaaauguaucguaacaaauuuaaccugacaacuucucauuaaaagccugagucuuagccgggcauggugguguguuccuguaaucccagcuacuugggaggcugaggcaggagaaucacuugaacccaagacgucaagguagcagugagcccagauugugccacugcacuccagccuuggugacagagugagacuccgucuuaaaaaaaaaaaaaaaaaaaaaaaaagccugggucuguaagcuugucuaugagcuuagggucucccuacaaucacuggucucucacucccuuaaaauuuuuucuguaaauugcuuucaaaucguagaggggaauggauuaugaaguauaaaucaagaagagcaaaauuauaagaaaaagaggccgggcguggugguucaugcccguaaucccagcacuuugggaggccgaggcggguggaucaccugaggucaggaguuugagaccagucuggccaacaugaugaaaccccgucucuacuaaaaauacaaaaauuagccaggcauguugguggguaccuguaaucucagcuacucaggaggcuaaggcaggagaauugcuugaacccaggaugcggagguugcagugagccgagauuacaccacugcacuccagccugggugacagagugagauuccgucucgaaaaaaaaaaaaaaaaagaaaaagaaaaugccuguuuucuuuuucagcuguaaccugacuacaaagauuacauucguacauuuaaaugauuuuuuugcuguaauggggguuugauagcuuaauuuuccugauugguuugcauuguggauuuucagaacuauuaauaauuauugaaucuguaauuuuagaagaauuuauuuaugaauacaguugaaucgaguaguuaauuaagcaaaggugaauuggauguucgaguucuuuucaaggugcuuccucagcgacaccucuauucuggucuaaacgcuguugccaccucucaguucagaucaacagccuaugugccaggugcugugcuagguuggacagacacaagaauccauagggcaugauucuuguccucuguaaacuuagaagccagcccagauguaugcuuuuaccucacucccuuccugaguugguaucuacaugauacacugauugauugauugauugauagauauaaggguuaagagggaaaagaaaaaaaauccagaagagaaaaauccauguaguggcacaauuaaaauuugauuucuuuuuuuuuuuuuuugcgacagagucuugcuguguugcccaggcuggagugcaguggcaugaucucagcucacugcaaccuccaccuccugguucaagcaauucuccugccucagccucccgaguagcugggauuacaggcaugagccaccacacccagcuaauuuuuguauuuucaguaaagacaggguuguaccauguuggccaagcuggucuugaacuccugagcucaagugauccguccaccucagccucccaaagugcugggauuacaagcacgagccacagcgucuggccaaaauuugauuucugaucauugccacuucccccagauuuggagugcuggggggaaggcauguaaggggacaguuucaguccaucaaaaaagggcuacuggaguauccccauguguuucugccucauuccuuccguaagcacugaauccccauaugugugcugagggcuggccauuccagaggcuccccaggucuugauuuggcugggauaagugagcucacaguggagaaauguagacuuagaaaaauacauuuguaaagaugcuucucgaauacuuuuuaaaauaagaagggguuuuuuuuuguuuuuuuuuuuuuuuuuugagagacggagucucgcuccgucaccaggcuggagugcaguggcgcgaucuuggcucacugcaaccucugccuccuggguucaagcgauucuccugccucagccucccgaguagcugggacuacaugcauguaucaccacgccuggcuaauuuuuuauauuuuuaguagagaugggguuucaacguguuagccaggauggucucgaucuccugaccucaugaucugcccgccucagccucccaaagugcugagauuauaggugugagccaccacgccugaccuaagaaggguauuuucuugugguccuuuuuuugguuauugaugaaacacauagaggauuugaaacaaauuuacuugaagugcaacuauuuaaaguggcccuuccuucccgauuccuacacuccucacugcucucuagagcauggugagagcacgaucagcagccucccuggagagccuucccugaccgcauguggagacugauggacucaggagguuaaugaaggccaguauuagauauucuugaaagacugccaagguaucccuugaguauucauuaacccagaugccgguucugggagaauuuguacugucauuccuguugugaguuuccccaugcccuucucccaguaauugaaacauggaauccaaugguuaacucagaaguuuuuuaaaaaggaggggggacuuacacauuuuuuauuuccaacaugccauaugcuaauuuucccaauuaaguaucuaauuaauucauucaaaaucauuuucugcacagagcaccauucugguuuauucccugaaauugggggaacugaaaugccacaagucucucccagcuaagaaaaugcuguguuuguuuccaguaguaacugaucuuucuuuauagaugcuagcaucuaucauaaacucucucuaaucaauaaaguuuuuugguuuuuugggguuuucuugagacagggucuugcucugucacccaggcuggaaugcaguggcuuaaucucggcucacugcaaccuccgccuccuggucuugugacucggccuccugaguagcugggauuacaggcgugugccaccauguccagcuaauuuuuguauuuuuaguugagacaggguuuugccauguugcccucccuauguugcccaggcuggacucaagugaucgcccaccucugccucccaaagugcugggauuacaggcaugagccaccaugcccggcccuaauuaaugaaguguuaaguacaauauuguauguacaaaugccacagaguuuuuuaaagagaugacaaugaguagcauucggucacaaaauuggacuguguuacuuuguacugaaguucccaauacguuguauaguccuucagccugguuugauguuucucuaaacagcaaagcuacuaccauuuuaaaaugcuuaguucaaagaauuuucccuucugaaguauuauuuuucuuuuaguuauuuauuauuuucuaaguacaguguaauuauuguuuaaaaaacaccucuuacuuucuauaaagagucuauuuacauuccauuuccuuccauuaacauauagcaccuacgauagagccugauccacaguagauauuaaauaaauacuuguugaaagaauaagaaaacuggccaggcacgguggcucaugccuguaaucucagcacuuugggaggcugaggaggaucacuugaguccaaaaguuugagaccagccugggcaacauagggagaccucaucucuaccaacaacaaaaaaaauuaaccaagugugaugaugcacaccugugguuccagcuacuugggaggcugagauggaaggauuacuugagccugggaggcugaggcugcagugagcugugaucacaccucuguacuccagccugagcgauagagugagacccugucucaaaaaaaaaaaaugggaaaaaaaaaagcaacaauucagucacacuucuaauaugaaacauuuccuccaaugucagguaauaauauauaagaauaucacccugggugcaauggcugaugccuggaaucccagcacuuugggaggccgaggugggcggaucgcgaggucaggaguucgagaucagucuggccaacauagugaaacccugucucuacuaaaaauauaaaaaagaaauuagccgggcguggugacaggugccuguaguccuagcuacucaggaggcugaggcaggagaaucgcuugaacccaggaggcggagguugcagugagccgagaucacgccacugcacugcagccugggugacacagugagacuccgauccaccucaaaaaaaaaaaaaaaaagaggcugggcaugguggcucaugccuguaaucccagcacuuggggaggccgaggcgggcagaucaccugaggucuggaguucgagaccagccugaccaacauagagaaaccccgucucuacuaaaaauacaaaauuagccgggcgugguggcacaugccuguaaucccagcuacuagggaggcugaggcaggagaaucgcuugaaccugggaggcagagauugcagugagccgagaucaugccauugcacuccagccugggcaacaagagugaaacuccaucucaaaaaaaaaaaaaaaaaaagaauaucauaagguaauaucauaaaagaccuaggaaauguauucaguuguuuuauuucauuuaaccgguauuucagggguaucucucuaugagaucauguacuuuuuagagacaaaagauacagucacuggcucaaagagcuuguagucccaauagggacuccuagcaauuuguguaaaugaauauuaaagccacauguuagguuuggcaacacagggauagauuaagaucuuuagaguuccuaagcucugaaaggauuaugauaucuaaccuugaccgucauguaguuaaaaauaaaguuauuaaacuaugaaguugccauaaggaauccuaauaaagcacuuauuuuuccuauggugacugcuuugauguugucuuuaaaauaucaaacaccaguuuuuaagcaccuucuuguuccguuucuugcuuccucugcuuugcuggggcucuaaucacauggugcagccuuacaacaacggcacagaaaggagugaugaguuugccucagugggcaccaaagacuucaguuaggaugagauucuuaacuuagguguuaaaagaggaauaagaguuuuccagaugacagccuuuucccaggcggagaaacaugaaacagcugggugaauaguaggagcuuguaccacauuugagugaguggugugagugaagcugcccagacagaaagagaucagggccaggcacgguggcucacaccuguaaucccaacacuuuaggaggccaagucacgaggaucacuugaguuugaaaccagcuugggcaacauagugagaccucgucucuacaaaaaaacaauuuaaaaaaugaggcgagaggaugacuugaguccaggagguugaggcuccaaugagccaugauugugccacuggacuccugccugggugacauagcaagagaucgggucuuacaggaagucuaggccaucaauugaauaaauacuacugaauuuuaaacucugcagugcaaacuaaauuaaugucuucaagucaagaccagaguuagcaaacuuuuucugugaagggccagauaguaaguaucuuagguuucauaggucacaugaucucucuugcgacuacccagcucugcucugguagaagcagccauagacaacauguaaacaaauacaugggaguguguuccaauagaacugucuacacgaaaauagguggugggcuggauuugcuccggaggacauacuauuuuuuuuuuuuugagacagaggcucgcucugucgcccaggcuggagugcaauggugcgaucucagcucacugcaagcucugccucccggguucacgccauucuccugccucagccucccaaguagcugggacuacaggcacccgccaccaugccuggcuaauuuucuuguauuuuuuaguagagacgguguuucaccguguuagucaggaugaucucgaucuccugaccucaugauccuccugccucggccucccaaagugcugggauuacaggcaugagccaccgugcccagccaggacauacuauuauuggacaaccucuggucuaggccaucaguuuaacaaagauugcagcaaaacaggucuacaaugcaaacuaaaguaaugucugcaaauauaagcuuaucacauaaucuggggcagucagaggguugguugaaauacuaggaaagguuggcaagagguguccuauguuguccagggaaagaaaaggaaaggguugagaggaagaugacuuuacaguauuuuuuuuuuuuuuuuuuuuuuuuuuuuuggagacagaguccagcucuuuugcccaggcuggagugcaguggaagcaauccuggcucacugcaagcucugccucccggguucacgccauucuccugccucagccuccugaguagcugggacuacaggcacccaccaccaugcccagcuaaauuuuuuuuuuuuguauuuuuaguagagacaggguuucacuguguuagccaguauggucuugaucuccugaccucaugauccacccaccccagccucccaaagugcugggauuacaggcgcgagucacugcgcccggcccaacuuuacaguauuuaagcaggccugaaagaaaccaugacacaaggaaacacacugcugucugaagcaauuuccaaguugccuuucuuauaaccacacugagggcaauccuugcuucuccuuucauaaggagguaaaggcccuucugauuuccauacuccuucaucccaagucaccugcaaagcaguaaaucauguugagcaugcguuucuggauuccucucuuccuccacacuucauccucaguuucccccugcuuccuggcuaacaaauugagauuccuauaaucagagaaugaaccuuucauuucacuaccagagauaaaguaaaaaaugcauguuuuugcuugaaguaacaaccuaguugaaaugcagucagucagcaaguauaaaggaaaggugacuggaugcuuuagugugggaaagguuguuugcucgguggaaaagguuggagagagucagucacagggcaggagcagugaacucaaaugaccacaagcagcuuauaaauagcauuaaguacaagauguaaacaaaaaguagaggccgagugcaguggcucacgccuguaaucccagcacuucgggaggcugagguggaaggauugcuucgguccaggaguuugagaccagccugggcaacaugguacaaaaccuugucucuacaaaaagaaaaaaaaagccaagcauggagguaugcgccugcaaucccagcuacccaggaggcugaggugggaggauugauugagacugggagaucaaggcuguagugagcugugaucaagccacuguacucuagccugggcaacagagcaagacccugucacaaacaaacaaacaaaagaaaaaguagauggaaaaggaacagccagugcucacuuacaggugauuuuugugcucugugaaggugggcccaguguugccugaauuauuuauuuauuuuuauuuacuuauuuuuagacggagucuugcucugucgcccaggcuggagugcaguggcgcgaucucggcucacugcaaccucugcuuccuggguucacgccauucuccugccucagccuucugaguagcugggacuacaugcaccugccaccacgccccacuaauuuuuuguauuuuuaguagagacgggguuucacuguguuagcuaggauggucuugaucuccugaccucgugauccgcccgccucagccucccaaagugcugggauuacaggcgugagccacugagcccagcccgaacuuuugauuuuuuuaaaaaagaaaucagaaguuuucaaauguuugugaaaucaucaguuuucuaaauauuggcaaucaauuccaaaaguuuuauaacguguuacaagccaaauaaagcacaucuauaggcucgauggucuaugggcaccccuugugaucucugcuuuaaaucauuugaugucugaauugguggaagggacacgggagcacacaccagccuggggagcccacuagaguacagaaugcaaacuacagggacacaugccuuugagcagguaguagauagccagggccugucaaguuauuaggugucccaggccagguaauaacuccuuggaguugugaaaaguauauuucauuuccaugccaucauguuuguaacaugcuauuuauagugcccaguuaucauuuuucccaaagugcaauuuuucucccaugaaguacucauaaucuuaaguaauguaguugauauguaacccagaaacuccuacuugauuagaagacaguuauugguaguaugccauugauagauuuguuaauuuuuuguuauauuuauucaaaugcauauucaugguagaacaauuagcacuuucuaguuuucauucuaaauaauggauauuauaaauaauggucuccaauauugacucuuuugaguaauucuaucagggacauguugaaauuccaaugaccauuuuuuuuuuuuuuuuugccuuagaggcaucuuuuguacauaauguauuucuuuuuuuuuuuuuuucccucaagacagggccucacucugccacccagauuggagugcagugacaccaucagggcucacugcagccuugaccucccugggcccgagugauccucccaccucauccucccgaauagcugggacuauaggugcacgccaccacaccuggcuaauuuucuuauuuuuuguagagagaggguuucauuauguugcccaggcuggucucaaacuccugugcucaagcaauucaccgagauuacaggccugagauuacaggugcugagauuacaggccugagccaccgugcccaguccucauaaugcauuucacacaccauaguguggugagcacauucuuucacugaaauaacacuauccauauucacauauacaacuggcauuguuagaaacaucugcuauacauaugucuuuaugaguugcauccuauuagagcaccacaguguuucggugaccagugagugcugguuuaccaucagcuuucauuguucccuucugacgguguauuucucaguuuuuuccugggcccagugcugcccagaguaaaggcuacauucuucacuccuccucgcagccaaauggcauaagacuaguaccagccaaugauauauaacaagugauguggguaacuuuuaauguccuuaaagggagacagugugcuccuuauuuugugccaccgcuuagaacaugaucaaauggcaagccaccugagauaguauggucuagacuagaaggcuguacaacaacagaggaagagccuggcuccuggaugaccucauggagcagagauuccaugaggaaucuccuccugucuaccuccauacuguuacauaagagaaaaaccucuggcugggcgugguggcucacgccuguaaucccagcacuuugggaggcugagguggguggaucacaaggucaggagauugaaaucauccuagcuaacauggugaaacccugucucuacuaaaaauacaaaaaaauuagccaggcguggugacgggcacuuguagucccagcuacucaggaggcugaggcaggagaauggcgucaaccaggagguagagcuugcagugagccgagaucacgccacugcacuccagccugggcgacagagcgagacuccgucucaaaaaaaaaaaaauagaaaaaguuccaucuugacuaagucacucuugcuuaggugucuguuacaucagccaggcuacaucccaacuaaaucucuacccuaaccuuugcgagacaaaccauugcauugagauuauauaaagggaaguugggggagaaagagaaauauaugaugaugauacuggucaauguucccuauucuucaguuuuuaaaauauuuuuuaaaauucaaguucaaacuaauauauaugcuaaaauaaauaugaaacuaagcacauaguuuguauuagcaucuaauaucaugaugacuuuauuuuacuuuuucuacuuuauuuuuucauucuccauaguucuuuauucagcaaaugcacauugaacagcagaauucuguuuuaaacaccaugaaggaacacugaagcacuaugaggagcaaugagguggauaaaaaaguacuuacuuucucuaaggagauuacaguguacuuguggagauaaaauguuucuuaaaagguggcaugugauaagugccauggaaaggaucccaaggaggcaugucggcucagaggagacaucccugucacccgugggccuucaugaccaagagauuguuugaggagguuuauuuuuauugcauuucaaaagaauauuaccucaauaacaacauauggccaggugcaguggcucacacauauaauccuagcacuuugggaggccaaggccagaggauugcuugagcccaggaguucaagagcagccugggcaauacagugagaccgucucuacaagaaauaaaaauaaaaaauaaaaaaaauagccagguaugguggcacaugccugugauacuugaggagcugaaaugggaagaucacuugagcccgggagguugaggcugcagugagccaugaucauaccauugcaccccagucugggcaacagagcgagacccucucucaaaacaaaccaaccaacaaacaaacaaacaaaagcaauguagguauuuuuuguuacuggauaguuuauguaacuguucuuucagauucugucuauccuuuaagcacauaacaaugaucuuugcauuuucaucuuacucucaaacauuuuacugagauuauguuauuauaaucguuaacaaauuuaucucuggguauaaaaauuuccucauuauuaauaaggaaauaaaacaaaguaauggugaugauacaaucuuuucuuagauugcaaauauucucauaaguuauuacaaaaaauauucccuauuuauugggcaaacagugcccccuuuugaccacuggauccuaugaaagaaauccuaagacaauagacucuucaucucugcuaaaaauugaauuauauagagaguuauauagauguauauuauuagaucuaauuauauauaacauuuauguuauaucacuauaauaccuaauuauauauuuuauauaugguauauaauuucuaaagaaacuauccuauauaacuuuaaggauauauugugugcuuuuuauuauuuauuuuuuagacucauguuguauuuuguuaagugauuagguccacuagaguguuuaauggcaguuuuguaagauccacauuuuaguuuuaugaaucuucuuuauccugucugauucagguugaauacgaaggcuuaaagcaugagauuaagcgauuugaggaggagacgguacugcugaacagccagcuggaagaugccauccgauugaaagagauugcugagcaccaacuggaagaagcccucgagacuuuaaaaaaugaaagagagcaaaagaacaaccugcggaaggagcucucccaguauaucagccucaaugauaaccauaucagcaucucaguagauggacucaaauuugccgaggaugggagugaaccaaacaaugaugacaaaaugaacggucauauccaugggccucuugugaaacugaauggagacuaucggacucccaccuuaaggaaaggagagucucugaacccugucucugacuuauucagugagcugaacauuucagaaauacagaaguugaagcagcagcuuaugcagguaagaacuuuguuuagggccgcuagagugaauuucuuguagauugcagguagcauguugugggacuucugauucucgcauuucacuucuagauuucuuuucuuuuuucuuuucuucucuuuucuuuucuguucuuuucgagacagagucuugcuccaucgcccaggcuggaguacaguggugcaauuucggcucacugcaaccuccgccucccagguucaagugauucuccugccucagccucccgaguagcugggacuacaggugcccgccaccaugcccggcuaauuuuuuuguauuuuuaguagagacgggguuucaccguauuagccaggauggucucgaucuccugacuucgugauccgcccgccuuggccuccaaagugcugggauuacaggcgugagccaccgcgcccagccccagcuuucuuuucuaaauauugcuucuucagcuagaaacuucgaaagugcaguauuuuagaaagacaugacagaaggagcguuaaagagaaaugcagucucucauuugcaucacuucaagaaaugaacuucugagagccacaaauugagcuccaaugaagucugagaaaagacagaaaaaaguuccuugggccgggcgcgguggcuuacaccuguaaucccagcacuuugagaggcugaagcgggcggaucaccugaagucaggaguucaagaccaaccuggccaacaugguaaaaccccaucgcuacuaaaaauacaaaaaauuagcuggacgugguggugggugccuguaaucccaccuaacucaggaggcugagucaggagaaucacuugaacccgggagguggagauugcagugagccgagaucgccauugcacuccagccugggcaacaagagugaaacgucaucucaaaaaaaaaagaaaaagaaaaaagaaaagacagagccuuaaugcauuucugauuaacaaaagaauucaaaagcuuuauauacaaguaaaaugauggaaaccaugcaguuuuucaucacaagcaacuguguuuauagcuuccagauuuaugguuacauuucacaggaauacuugaagccuuaaaagacguaaaggacuuccuauguacaaauuauccaggauaccguaugauuaaaaauacagaacagguauaaucuaagaccaaaggauucuuauugcaacaugaguuaaaccuuaaauuuuuagcgucuucaaaacaaaugucuugugaagaucccagccuugaaaaaaucgcuuucuaguuuagagucuugccuuccugccacauguaauggaaauguuguuuaagaaacagcagcauuaccaucaccugggggcuuauuuauacaaauuguggagcuccguguagaucuacugaacuagaaacugaacuagaaaucugguauaacaagcuuguuaagugauuaaauuugaggcuuaaucuucaaucucaaucuuaucucuccaagguucuucauguauagcugauaauuagaggcuguuaagccucuggcagucaucugccuccacggaaaugaugacuggaaaagugaaauuagcagaaauaaguaagagaacagagagccaaugauguugauuuguuaacagguuuauuuucuaugucuuuuugcucaguuuacacuaauaugacuagauugauugaaacagaaaacauauuuccuugugaaaaaguuuuacaugacagauguauucauaagaauuugugccccccagauugaauaccauuaaauagaaguuuuaugaguuuuguuuaacucucauauugguggcuuugagauaaaaaguuaguggguucaggcuuuuuguuuauuccuuuuguuuugguggcagugcagaagauaauaggaaaagaggcuucuaugcaugaaacagcacaacaauuuucaagcaggucaucuauuggcugaaagcucagagcugugcucagauuuaauucuaaaugugaucugaauuggguaauacaaaagucuaaaaaagaugaaaaguucaauuaaaagaaugguggaaaacaaguaaguacucagcuggagacuggcucuccugaguucucaauagacugucguuuucguuugguuuaggcgguuccucauugccagagaauguuuucuuccuugagaagguuuagcgucucugaucccaacucaugagaugcugguuacauuuccucaguugaagugaugaccagaaacuccccauguauuucaaaugcucugagagucagccacuaguugacagucauucuuagaggacagcacuuuacuuucccauggaaugggauacauaauaccuuccucguuagagugucaugaagguuuaugaguuauaugcagagugcugagaacagggacuagugcacaguaaaugcucauuaauuaugaacuguuaucauuauuucaacuccauugguccuuuaauuuauuaggcacucacuuuauaauaauuuagauaauuauuauuaacuauuauuuuugggcuauuagcucaaggccaaucaccccaaaagggacugauguggauacugguaggaauauagaaaaauaacaguuaagucucauggugcaagaaggucugaaaaaggauauucauuuagcaaaauguuagggugagaaaaacuuugcuggauaaacccuccaucagucuauugagaaagcugugucccuucaaaucuuucuucaacccuuaacugauguugacaguuugcaaagauguagaggggcgcagguagguccuuauaucccaaaguuugcuccagauuuaguugugaaaaccagguucaacacaggaagggcuuugcagcuuccaaucucauacuaacaacacuaacuguaaauuuuuuuuuagguagaauauccauuuaucuucuuguaaucagcguuuuuaaaaagcaugucagcuuuuccuaagaauauauuuuauucaaacaaguauauucaugagaaguauaccuucucaugaacuauuuuuuugcaauacaguuuuuuccuuagccacacaucuuuuuggguuaaauuuauguaaauaaacacauuacaaaaacauuacaggauacauugccuagaauuuauuguaauuggcuuugauguuaauaaggauuaaaaauaauauggcaagucugaucaaugagaguacugugcaccugaagcauauaugugucaguaccauuguucuggaaauuaugaagaggaaccaaucaaauguacuuuaaguauagcuaucuggaaugcuugggaccagguguguuuuaaaaauucagguuucagauuguagaaagguaauaugcagcauauaccacauagauugugauaucuccacugggaucagaugcagcauccggugaucaaauaauauuaacauuucugcagugaaacaugaguauucacacuaagaauaagaugaggaccauuaaaggccuuacaccagucaggugcaguuuggcugcccugggaguuuaggacugucugaauacugccaagugaguuuuaucauaaucaagugaauuaugauaaaacuugauuucgagcuuuuuggauuuugcaguugcaggcguuguaggaauagcacuguccuguugggcggcugucaguuuugcgcaccucagcuuacagugucaacauacuuggaacgugacaguuuguauuuucauuuuuuuuuauuauuauuauacuuuaaguucuaggguacaugugcacaaugugcagguuuguuacauauguauacaugugccauguuggugugcugcacccauuaacucguuauuuacauuagguauaucuccuaaugcuaucccugacaguuuguauuuucauaguuccuuuaucucuuaggauuucuccuggccuggauccaaaacacugcaugggagaggccgccuugugccucuaauccaacagcugugcuuagcuaacagcucaugacaguguagaggggcacaggcaaggcuguaacucccugaaccaggugauaugcagcaguucagguuuucuuccuucugaucaaguaccccuuugauggaguaaguucaagagaucuauaguacaacacagugacuguaguuaauaacaauguauuguauugaaaauaaaagaguagauuuuaaguguucucaguguuguagaaccccuaaauguagguccacguguuggaugggcaguaagccaaauacugacacaucagugcuuagcagcagagaaagguguauucauuuuuccaaaaaugacauugugggagaggcaaucggucaaauccuaccugccuuugaacguaacuggggguuuuugugaguaaggcagcugugcaggagaaugaaaucccccaaugaucaaaguuguuugugucccgcagcucaaucagacuucuggaugccaucaaggaggucugcaugaccuaaggaucauuguucuuugaaaggaaaacaaguucauuaaucuuacuggcugccaggguuaggaugcaaaguuaaucaauuauuagugacuaccgucuaccgaaugacuacgugcaagcagucaugcauggaggaagaaaaggacaaagagaaaggaaaauaaguaaaaaacaaacguuuaaugauuuugauaauauaggcucaguuacaucaccacaaacaugauaaguaugucaggucaugcaugucauaauuagcucaauuuccacuuugccuacauauuucaaaacaucauguuguacaugauaaauauguacaauuuuugucaguuaaaauaaauacauuaauuuguuuuuaaagaacuccuuugaaaacaguauaccuaguccauauacccuuucggccuuuucuucuccuacaaggcucaauguaugcccaugauuuauguuuucccauccauagguauuuauuuaaccugguuccaggaaaaaaaaaugccucugucgacgaagcaagucaaacucuguaaaauauuuuaagagauuuauucugagccaaguaugagugaccauggccugugacauagcccucaggagguccugagaacauaugcccaagguggucgggguacagcuugguuuuauauauuuuagggaggcaugagacaucaauuaaauacauuuaagaaauacauugggccgggugcgguggcucacgccuguaaucccaacacuuugggaggccaagguggguggaucaugaagucaagagauugagaccauccuggccaacauggugaaaccccaucucuacuaaaaaaaauacaaaaauuagcugggcauggugaugcaugccuguagucccagcuacuugggaggcugaggcaggagaaucacuugaacccaggaggcggagguugcagugagccgagaucgcgccacugcacuccagccugcgacagaucaagacucugucucaaaaaaaagaaaaaagaaagaaauacauugguuugguucagaaaggugggacagcucacagcgggggcuuccaggcuauagguaaauuuaaacauuuucugguugacaauugguugaguuugucugaaggcgugggaucaauggaaagaaaauguucagguuaagauaaaggauuguggagaccaaguuuuauugugcagaggaagcucucagauagcugacuucagagagagcagguuguaaaauguuucuuauugcacuuagaagggugccuggcucuuagcugauuaucuccuggaucuggaaaggaaggaaggaaaacaaagcggggaaaggggauucucuacagaauguggauuuuucccacaagagacuuugcagggcaauuucaagguauggcaaggaaauauauuuugguuuucuuucuuugccaguaucagauuggaaaguaacucuugauauacaggguuaaauaaaacgcauccgaugagaauuuaugguuuguagggcaugaacuccccagaccccuuagauaggaauuugggcaagauaaaaaaaaaucagaucuuaguccucaccucugccuuaauuaucaggaauguugagugaauuguuuugcuucucugaggcucauucaaaaggggaagguaauaaauuagccccaccauuugucucugccaugccuuuguuggaacuauggaaaaaacaaaacaaaacaaaaaucaggucuccuucuugaagccaucauacugccaucugcugggaaaugguaauaacaaguauaaacauuuauagcuacuacaauuuaaauagcaccuccuggaguuguuugcauacaaccugcagacuucugcauugaagcccuggugauaaugccaugccuccucuguagaauugugaggaccaaaugggaugguaaauaugaaacuguguauaagucauaacauuuuauaaauuauuauuguccuggaaacugccaucagguuucgagaugccaagaagguccccacuaucccuguguauaaacggucaauacauaaauuauaaaaaguaugggaaaggcaaguggugguaagccuguaucuaaauuagggagagcuuuuucucagaauaaauuagagugaauauuuuacugaauuguaugccuuccuagguuauggaauaaaauacaggaauauuuuaaacuuagcuaaucaugcuaaguuucacauaauacagaaacauauacacaaaaaauacaguaagaaaacauuuugauucaccucagucucuauaaacuugacaauaguccuugauagugaauaguucaaugagugucauccuuuauucaugagagaaguuuuucagaguauuaucggauaaauuauuuugguuuuuuggugcccucaagaccucauuauuucaaauagguuguaauugacauuuuccaguggcagucaaauaccuuaauuaguuuuauuagaaugaaaauaaguagauucugucuggaaauacuaacuaaauuacuuaaucaauuuaaagguguccuguaugcuugugcugaaauuucugucuuugauaaauagccucuaacuuuacaucugcauagagucaaacuaagcaggggaaaacucuuuggauuuuuuuuuucaguauuaugcuggguauauaauuucacauguaguaugagaaaacaguaauguuucuguaaaacuaaaauuaauauauucuguugcauccucauggauguggaagaaauauauucauauuauguuuugauccacucuauuaaaggcaauuuuaguuuuuucuauaaugauugauguuaaguggugaugguaauuugcuauaugucccauaagaguucaaagcaauuuuuauauauuugcuuaauugguugcugcuuauaacaacuguaugggguagagaguauuauuaucuucauauuauagauagggaaacugaggcaugacuguguuaugucauuaguucaaggucaaaaaucuaguaaguggaguugcuacacagagacagucgaacaagugaaauauuaucucugcuuaaacacucacagaauauuuauaggaugacauuaaugaaaacaagauugguuaguucuuggguucugaaacuuaaagugacaaguauaauuauuuccuaguacaaagcugacaaauggcuaaacuauuacagauuuuauaguuagagauuacaaacuagcugggcgcaguggcucauaccuguaaucccagcacuucggaaggcugaggcaggaggauagcuugaggccagggguuugagaccagccugggccacauggcaaaaccccaucucuaccaaaaauacccagaaaaaauuagcugggcacgguggugcgugccuauagucccagcuacuagggucgcugaggugggaggauugcuugagucugggaggaggucaaggcugcagugagccaugaccaugccacugcacuccagccuaggugaaagagcgugacccuaucaauaaauaaauaaaauaaaaauaaauggaaucauacaauguguggucuuuugugacuggcuucuuucacuuagcauaacauuuuaaagguucguccaugcuguaauauaucagcacuucauuuucauuucuuucuguugucaaauaauacuccaugguaugcagauaccacauuucauguaaccauucaucaguugauggacacuuuaguuguuuguuuuuuuagcuauuaucaauaaagcugcuaugaacauuuguguacaaguuuucgugugcacguauguuuuaauucccgggggaguuaauacuagagguggaaaugcugggucauaugguaauucuauguuuuaccuucugaggaacugcuaguuuugaaaacaaaucgaguguaccauuuuuuuauccccaccagcaguguaugaguguuccgauuucuccacauucucacuaacacuuguuauuaugugccuuuucaaucauagccauccugguggaugugaagugguauuucauuaucaucuugacuuguauuuccuugauggcuaugauguugagcaucuuuucaugugcuuaucugcucuuuuauaucuucuguggaaaaauguguauucagauuauuuuuugacuggguugucuuuuuauuucugaguugaaaguguucuuuacugauuuggauacaaaucccucaucauaaaagugauuuaugauuugcaaauauuuucucccauucuguggguugucuuuucacuuucuugaugguguccuuugauguacaaaggaguuuuuuuuuuuuuaaaagagaugggucucacuauguugcccaggcuggagugcaguggcuauucauaggcacaaucauagcacacugcagccucaaaccccuggacucuccuggccucaagcaauccucccaccuuagccuucugaguagcugggacuacaggcgcaugccacuaugcccagcuaaaaaaacuuuuuaaucuugaugugucuaguguauuuuuuucuuuuguuguuugugcuuuuggugucauacaaaacuguugucuaaucuaaggucaugaacauucauggcuagguuuuccucuaagaguuuuauaguuuaucucuuacauuuaggucuuugauccauuuugacuuaauuuuugaauaugauaugaggaagagaucaacauuacuauuuuacacgugggcauccaguugucccagcaccauuuguugaaaagacuauucuauucuuucuuuccccuauugaauuaucuuuguacccuuguccaaaaucaacuggucauagauguauauaugggcuuauuucuagacuuucaauucuauuccauuaauuuauaugucuguuuuuaugccaauacuauaguaucuugauuauaguuuuuuuguagcaauuuuugaaauaggaaaguuugcuaguucuuuuucaagaaguuucuucaggacuguuuuggcuauucuagguccuuugccuuuccauauaaauuuuaugaccaucuugucaauuucugcaaagaauccagcugaaauucuguuggaguuugcauugaauauguaaauaaauuuggguaguauugccaucuuaacauucaguuuuuugacccagaaacaggggcuguuuaucccuuuauuuaggucuucuuucauuucuuucaacaaugcuuuauaauuuucagaguacagaugguccuugacuugugaauguucgucuagacuuuuuuauuuaacaaugguguuaaagcaauaccauuuaguggaaaccauacuuugaguaccuauacaacuguucuguuuuucauuuucaguacaguagucaauaaauuacaugagauaguaaacauuuuauuauaaaauaggcuuugaguggggcugggcgugguggcucaugcuuguaauccuagcacuuugggaggcugagaugcguggaucaucugaggucgggaguucgagaccagccugaccaacaaggugaaaccccgucucuacuaaaaauacaaaaauuagccgagugugguggugugcgccuguaaucccagcuacuugggaggcugaggcaggagaauugcuugaacccaggagccagagguugcagugaucugagauugugccacugcacuccagccugggcaacagagugagacccugucucaaaaaaaaaaaaaaaaaaggcuuugaguuagaugauuuuugcccaacuguaggcuaacguaaguguucuggacacuuuuaagguaggcuagacuaagcuagaauguuugguagguuauguguauuaaaugcauuuuggacaugauauuuucuuuuuuuuuuucuuuuuuguuugagauggagucucacucuguugcucaggcuggaguacaguggcaugaucuuggcucccugcaaccuccaccuccuggguucaagcgauucuugugccucagccuccugaguagcugggaauacaggcacgugccaccacgcccagcuaauuuuuuuuuauuuuuuauuuuuuaguagagacggaguuucaccaugucggccuggcuggucucaaacuccugaccucaggcaauccacccgccucagccucccaaagugcuggaauuacaggcaugagccaaugcgccuggccauacuuaggauauuuucaauuuacaaugguuuuauugagauguaaccccaucacaaguugaggagcaucuguauacauuuugcacuucuuuuuuuuuucuuuuuuuaaaauuuuauuauuauacuuuaaguuuuaggguacauaugcacaacgugcagguuuguuacauauguauacaugugccauguuggugugcugcacccauuaacuugucauuuagcauuagguauaucuccuaaugcuaucccuccccacucuccccaccccacaacaguccccggugugugauguuccccuuccuguguccauguguucucauuguucaauucccaccuaugagugagaacaugcuguguuugguuuuuuuguccuugcgguaguuugcugagaaugaugguuuccaguuucauccauguuccuacaaaggacaugaacucaucauuuuuuauggcugcauaguauuccaugguguauaugugccacauuuucuuaauccagucuaucauuguuggacauuuggguugguuccaagucuuugcuguugugaauagugccacaauaaacauacgugugcaugugucuuuauagcagcaugauuuauaauccuuuggguauauacccaguaaugggauggcugggucaaaugguauuucuaguucuagaucccugaggaaucgucacacugacuuccacaauggucgaacuaguuuacaguccuaccaacaguguaaaaguguuccuauuucuccacauccucuccagcaccuguuguuuccugacuuuuuaaugaucgccauucuaacuggugugagaugguaucucauugcgguuuugauuugcauuucucugacggccagugaugaugagcauuuuuucauguguuuuuuggcugcauaaaugucuucuuuugagaagugucuguucauauccugcacccacuuuuugaugggguuguuuguuuuuuucuuguaaauuuguaugaguucauuguagauccuggauauuagauccagauuugucagaugaguagguugcaaaaauuuucucucauucuguagguugccuguucacucugauaguaguuucuuuugcugugcagaagcgcuuuaguuuaauuagaucccauuugucaauuuuggcuuuuguugccauugcuuuugguguuuuagacaugaaguccuugcccgugccuauguccugaaugguauugccuagguuuucuucuaggguuuuuaugguuuuaggucuaacauuuaagucuuuaauccaucuugaauuaauuuuuguauaagguguaaggaagggauccaguuucagcuuucuacuuauggcuagccaguuuucccagcaccauuuauuaaauagggaauccuuuccccauugcuuguuuuucucagguuugucaaagaucagauaguuguagauaugcagcauuauuucugagggcucuguucuguuccauuggucuauaucucuguuuugguaccaguaccaugcuguuuugguuacuguagccuuguaguauaguuugaagucagguagccugaugccuccagcuuuguucuuuuggcuuaggauugacuuggcgaugcaggcucuuuuuugguuccauaugaacuuuaaaguaguuuuuuccaauucugugaagaaagucauugguagcuugauggggauggcauugaaucuauaaauuaccuugggcaguauggccauuuuaacgauauugauucuuccuacccaugagcauggaauguucuuccauuuguuuguauccucuuuuauuucauugagcagugguuuguaguucuccuugaagagguccuucacaucccuuguaaguuggauuccuagguauuuuauucucuuugaagcaauugugaaugggaguucacucaugcuuuggcucucuguuugucuguuauugguguauaagaaugguugcauuuugcacuucuuuuguuaaauuuauuccugccgggugcgguggcucacaccuguaaucccagcacuuugggaggccuaggcagguggaucaccugaggucgggaguuugagaccagccugaccaacauggagaaaccccaucucugcuaaaaauacaaaauuaaccaggcguaguggcgcaugccuguaaucccagcuacuugggaggcuaaggcaggagaaucgcuugauccugggaggcggagguugcagugagcugagaucgugccaucgcacuccagccugggcaacaagagugaaacuccaucugaaaaaaaaauuuuauucugaaguauauuauuuuuugauagugcuauaaaagcaauuguuuuauuaauuuuauuuuucauuuuucacugcuaguauauagaaauacaacugauguucguauauugauuuuguauccugccaccuugcuauacuugcuuauuaguccuaauaguuguuucuuagugaauuccuuaagaauuucuauuaauauuuacaagagcacgucaucugcaaauaaagaucauuuuacuuuuuucuuuccaaucucaauaccuuuuauuugauuuucucaccuaaguucccuggcuagaacucuaguacaaugaugaauaaaaauggcaagagcagccauccuuguuuugcucuggguguuucauagaugcccuuuauccgggugagggaguuuucuucuaugacuagauuguugacuuuuuuuuauuaucacaaauggauauuaaauuuugucaaaugcuuuuucuucauauauugagaugaucaugugguuuuugucauguauucuauuaguaugguauauuauauuuauugacucuugaauguuaaaucaacauuguguuucuaugauugcauuugguuauguugcuggauucaguuugcuaguauuuuguugaggauuuugugucuauauucauaagaggucuuggucuuuaguuuucuuuucuuauaauauguuucucugggagggagaggucguuuguuuuuuaguuucguuuuuuuuucuuuuuugaaacagucuuggucuguugcccaggcuggagugcagugacgugaucuuggaucgcugcaaccucugcuucccagguucaagcaauucuccugccucagccuuccaaguagcuaggauuacaggugcccacuaccacaucaggcuaauuuuuguauuuuuaguagagaugggguuucaccauguucaggcuggucucaaacuccugaccucaagugauccucccgccuuggucucccaaagugcuguuucucuaguuuugguaucagaguaauacuggucucauaagaguugggaagggccccucucccuccaucuuuuuuagucuucguccaguugacugacuuuuguguguuagugugcaugaauuuucuuuucaccacacacucuaaaguagacacuuuuaacaacugaugaauucccucauauagaguuucuuuguucuaucuugaucuuuuuucauagaauuaucuuuuguuggggcacagauaugcauuaucagaguuguuucucuucaagcagagaagaacaaauuauuuaggaguuccguuugugcauaucgaugcuauguauacuguuagaagaaucacaugaucauuuaagugucaaacugagagucaaaagacuuggcugggcaggguggcucucaccuguaaucccagcacuugggaaagccaaguuggcaggauugcaugaggccaggaacucaagaucagucugggcugcauagagagaccccaucucuauuuauaaaaagguuuugaggcugggcacgguggcucacaccuguaaucccaacacuuugggaggccgaggcgggcagaucacaugaggucaggaguucaagaccagccuggccaacauggugaaaccccaucucuacuaaaaauacaaaaauuagccagguguguuggcacgugccuguaaucccagcuacucgggaggcugaggcaggagaauugcuugaacugggaggcagagguugcagugauccaagaucacgccacugcacuccagucugggcgacagagugagacuccgucucaaaauaaguaaauaaauaaaaaauaaaagguaaacacucagugaaauaaaaaaaaauucuaugggauauaggaacaacaaugacaauaguaaacauauguuguauacuuacacuagacuaaacaguucacaaauacugaagucagguuuucuggcaaaacaaccagcucugcugugaaaaaauaaaaucuccaguuccagacagaaacugaagauuguaggaagagaaauaagacaacuauucucagucacuacagaagaucauaauaaacuccucaacucucuguuggauaaauucuuuacaaauggaaauuaaaauaguaacacuuaaaauguauaguaauuuuaagcuuuaaagugcuuugcauguuauucauucagagcacuaaaucuaaaacaauuuaggccagguacaguggcucacgccuguaaucccagcacuuugggaggccaaggugggcagaucaccugaggucagggguuugagaugagccuggucaacauggugaaaccccgucucugugaaaaauacaaaaauuagccgggcgugguggcacgucccuguaagcccaacuacucgggaggcugaggcaggagaaucgcuugaaccccggaggcagagguugcagugauccaagaucacaccacugcacuccagccugggcgacagagugagacucugucucaaaauaaauaaaaaauaaaagguaaacacucagugaaguaaaaaauaauuucuaugggauauaggaacaacaauaaucauaguaaacauauguuguauacuuacacuaaacaguuuacaaauacugaagucagguuuucuggcagaacaaccagcucuucugugaaaaaauaaaaucuccaguuccagacagaaaaugaagauuguaggaagagaaauaagacaacuauucucagucacuacagaagauuauaauaaaccccucaacucucucuuggauaaauucuuuacaaauggaaauuaaaauaguaacacuucaaauguauaguaauuuuaagcuuuaaagugcuuugcauuuuauucauucagagcacuaaaucuaaaacaauuuaggccaggcccgguggcucacgccuguaaucccagcacuuuuggaggccaaggcggguggaucaccugaggucaagaguucgagaccagccugaccaacauggugaaacucugucucugcuaaaaauacaaaaauuagccaggcgcaguggcagacgccuguaaucccagcuacuugggagacugaggcaggagaaucacuugaaccuagaaggcggagguugcagugagccgagaucacaccauugcacuccagccugggcgacagagugagacuccgucucaaaaaaauaaaauaaauaaauaaauaaauaaaacaguuuaagcaucugcucuuugaaauccaaauaccauuuaagguacucuaagccuuaauagcugagugaaaauacaguguuggaguuuuacaaaauuaccuguauuuuaguaauuuuuuugucaggccaaacuuaauuaucugggagaaauauauauagauagauagauaugauauauuuauauguguauaauauauauuuacauauguguguaauauauauguaauuuggauacaauuuccuauucaauugauuucagcagaaacguauuaaauauagaaaguaguacuguauagcagcaguccccaacuuuuuuuggaccagugaucuguuucauggaagacaauuuuuccacagauagggugcggguggucuggggccauuagaucucauaaggagcuugcaaccuagaucccucgcaugcgcaguucacaauaggguucgcacuccuauggcaaucugaugcugccacucaucugacaggaggcagagcucaggcgguaauguuugcucgccugccacucaccuccugcuguguggccugguuccuaauaggccacaaacugguacuggucagaggccugggaguuggggacuccuguuguguagggaggaaacacacaugcaagagacaguguucuauuugauguuuucuggagaugcuaucgugaagacacuguagacuuaccuuuuuaggcuuagaaaauguuuauauuaaaucucaacugucagaguccagauugaaggcuguucuaaaggcaugaccuuauucaucauaacacuuuugcugcuaaaacaagcuucagacacauucaguacauuuuguuuugauccaauauuuauuugauccagaggccuuuccuuuugaagggcguuuuggaaacagccuuaucuguaaucauguguacuaauugaauaacguuuacacuuuccagugcaaauuugcuuaauuuucaaaggaaaaaaggaaaacaaaaacacuucugacauaaucaguuuucacugagauuguauagaauagagauuuuccaucuccuuuaugaaaaauucaaaugacauggcuauucaugaaauaccauauuacauaauuaccagguuuuucacugaaaacuauugcccaaauagucuggguaagcaaauucaucaucaccucuggagauacagucuguuauaacuaaugaaauccagcuaagauuuguauucaaauauuuccugacucuaaaaugaaagaguugcuuuuauaaaauuuucaaaauugugagaacagauguguuugccauguaaaaacauuuugguugugggagguggaccacagcuaaccaauuguucacaauagcuaacauuguagaaccuucaguauuaaauucacuaacucacuucaucaucaaaauucccuaugaggcguuacugugcuccuugcauagguuaccaaacugaagcuuucucagagucacauagcuaaguaaauguuggucccgagauuugacuccaguguucucugaugccacaggcccaguucuuuaccugcaguacuaucauuugggaauaauuugguuucugcagccauaauauauaauuuguggguugcuuuccuuucauagguauggacaaacacuaugucauaaaaucagagcuacaacuuaaaagccucuaaauaacaccuugagauaacaaaacuguaucuuagguucuaauauaugugaucauacuauacaggcaguccuugguuugcauaguagucugggacaguaaaaaauggucaugcaaacugaaaccaugcaaaacaaacuuaauaauuaauggggaaauuuacaauuguuuugugaucuuuaaauauuuuugugaaacauuaaaaagucucuuacuguugguuauaaauauauauagaaaugaaaauauaguaaaacuacuuaguacuucauaauuuaaaacauuaggaauauugagaguuaaccuuuuauuucuuuguaaacagcuuaucaagaguauuuugaucuugccuucccauaaagcuuagggccgggcgcgguggcucacgccuguaaucccagcacuuugggaggccgaggugggcagaucacgaggucaggaguucgagaccagccgccaggcugaaaccccauuucuacuaaaaaccccauggugaaaccccauuucuacuaaaaauacaaaaauuagccaggugugguggcgugugccuguagucccagcugcuuaggaggcugaggcagaagaaucgcuugaacccgggaggcggagguugcagugagcguaaaucacaccacugcacuucagccuggugacagagcuagacuccaucucaaaaaaaaaacaaaaaaaaaaacuuaggacacugagcaagaaucuuuucuaugcuuuggcaaauugucauccucauuucuaaguuuggaucaccuuccaacauuuuauccucugcacuuuaaacaucuggaaauaucuuugugaguaccuuuaaugugccagcaucacuuccucuucgacauuuucauccuuuuugcaacuacuguacuguacuuuucuuuuucuuuuucuuuugagaugaagauggagucucacucugucgcccaggcuggagugcaguggcacaaucucggcucguugcaaccuccaucccccggguucaggcaauucuccugccucagccuccccaguagcugggauuacaggugcgugccaccuugcccggcuaauuuuuuaaaauauuuuuaguagagacgggguuucaccaucuuggccaggcuggucuugaacuccugaccucgugauccacccaccucggccucccaaagugcugggauuacaggcaugagccaccacacccggccauacuguacuuuuucauuuaauagauugaaaaauuugccuccacuaaauuucuuugggugaacaucuaaagucccucaaacagcauuagugucaacauuuccauauucaguuauuucuucuauaacuccauuuagguaguuuuggggauuuuuuuagaggcaggguuucacuauguugccucagcuccugggcccaagcaaugcuucugccucagccccuggaguagcuaggacuacaggcacaccccacugcaccuggcuccauuuauguuuuuuuuuuuucagauuucauuuccaacauugucacucuuuguugcuguccuuucuuucuuguaauucauuuuuguaaaacaucacauggauuuaucacuaggagacaagacaaggcaacuacauccuuagcugucuaugagugaacugaauaacagauacguaguaaccaaucacuggccgacuuugaaugaaguggugucauuggccguuggucaugauguuauguagugauuuuauagacugaagugcuggcagcaaagauugugcguuaugcauugcucacaaucaauauauuuggucauugaaauuuggaccaugguuugaggaguagcugguguuuuaacuaaagcauaguaacugaaacuuacccauaucagaaccucgccaagagaggacuaccaugaaaguuaaaugaggggcauuagguuccauaaaggaucauaaaaauacuacucuacucuauuauacauuuacauauacacauguguauccuaaaguaauaagcuaguuuuaaaauauuaaccauacuuaaugauuaauauuuauuauaucuaauuauaauaauuuuacuugccaccuagggauuuagaagaguucagagggauuuaauguaugauccaggaaguuugaaaguuugaauugggccaggcgcgguggcucacgccuauaaucuuugggaguguaaucuuugggaggccgaggugggcggaucacgaggucaggagaucgagacuauccuggcuaacacggugaaaccccagcucuacuaaaaauacaaaaaaauuagcugggcguggucgugggcgccuguagucccagcuacuggggaggcugaggugggagaauggcgugaaccugggaggcagagcuugcagugagccgagaucgcgccacugcacuccagccugggagagagugagacuccaucucaaaaaaaaaaaaaaaaaaaaagaaaguuugaauagauacuuuccuuuagauaugaagacauucagcaucaauucauugcucuuaaagcagaucucaugaugguuuauuuuuuaaaaagaagaagaaagaaaagaaaacacaagugcagaaggauaugaacaccaugauacuucuuauagaacaauaauguaaacaauauuauuugguuauugagaaacauuuacauuauaaauguaaaaacucauaauucauaauauucacccauauggaaggagagaaaaugguuuaaaauuuuuccacauugcaauuucuuauauaccuauguuuaaugagacaguauuuuauauggacaccugaguguuuuucaucacacgguaauacuuacauaucacauuauucaaauuaauuacuaauauuuaaaauuccuauuuuggacugaaggaauugaauugacuuauaaguuguucuuuuagcccuaaaauucuguauguauucuuugacuuuuauauuagaaaccaucaaagcugggcgugguggcuccugccuauaauccuaguacuuugggaggcagaggcagggggcugacaugcgccuaggcauucaacaccagccuggacaacauagcaagacucugucucuacacacacacaaaauuagccaggugugguggugcauaccuguagucccagcuacucaggacacugagguggaaggaucacuugagccugagaggcagagccugcaguaagcccugauugugccacugcacuccagugugggugacagagcgagacccugucuuaaaaaaagauaaaaacuaucaaauguagugcguguuuauuuuggggacuaaaugcuuauuuuuaaggggaugguuaaaguacucagcauuauuuagggaguuaaagccuuagguuuuaaaccugauuugggguugagcucugggaaggaaaagaugauugauucauaggcacccugauacagucacuuaugaucugaaaagcagauguacucuaaggcacucaaaauaaaaauaacaccaguccuaugcuuaucucuuaaagucauguuguuuucugcaagguguuaaaaaucaaaauaagauuguucuaauaacauugaaguuucgucaguauauguguaugauacaagcgaaauugauggguaacuacuugcaguauaauucuuuuagaauuauguacuuuuagauugacuuaccagaacugcugaaauaaaaaacacuccaauuuaauuugaaauagugggaacauuggcucugcugcagugauuuuaaguguauacaugcccgacugugaauggauuaaguucaucauuggugcugccuugaggugauucagaaacuuucuuuugccauugcagguagagcgggaaaaggccauucuuuuggccaaccuacaggagucacagacacagcuggaacacaccaagggggcacugacggagcagcaugagcgggugcaccggcucacagagcacgucaaugccaugaggggccugcaaagcagcaaggagcucaaggcugagcuggacggggagaagggccgggacucaggggaggaggcccaugacuaugagguggacaucaaugguuuagagauccuugaaugcaaauacaggguggcaguaacugaggugauugaucugaaagcugaaauuaaggccuuaaaggagaaauauaauaaaucuguagaaaacuacacugaugagaaggccaaguaugagaguaaaauccagauguaugaugagcaggugacaagccuugagaagaccaccaaggagaguggugagaagauggcccacauggagaaggaguugcaaaagaugaccagcauagccaacgaaaaucacaguacccuuaauacggcccaggaugaguuagugacauucagugaggaguuagcucagcuuuaccaccaugugugucuauguaauaaugaaacucccaacagggucaugcuggauuacuauaggcagagcagagucacccgcaguggcagccugaaagggcccgaugaucccagaggacuuuuguccccacgauuagccaggcggggugugucauccccgguagaaacaaggaccucaucugaaccaguugcaaaagaaagcacagaggccagcaaagaaccaaguccaacuaagacccccacaaucucuccuguuauuacugccccaccgucaucuccaguauuggauacaagugacauccgcaaagagccaaugaauaucuacaaccuuaaugccauaauccgggaccaaaucaagcaucugcagaaagcuguggaccgguccuugcaacugucucgucaaagagcagcggcucgggagcuagcccccaugauugauaaagacaaggaagccuuaauggaagagauccucaagcuaaagucccugcugagcaccaaacgggagcagaucgccacauugagggcgguguugaaagccaacaagcagguaaucucauucuacuggugaaagcaugccagucaaagcuuucuuaacuaauuuauucccuaauuuuauugaguaucgaguaucgucaagaugagaguucagauucuugguaaguggauaaauaaaacugucccagugccagaucagaaugucauaauaauuauuguuuuuaaaugaugaaauaccugugcccaguuagguggaggcagaggugaggaacuuaaagcaggaacacaggagaagaucuagaugccuuucugcagauguagaaaggcagcucaggcggugcugggcugaagccuggcagugaguggcuguggaaacaggagauggaggguggcagaauaggcuggcaaggcagguuacaccaaccagggcgauacagcaagaaagacaaacacccagcaggcagcuagagcaaacagagggaaaucuggguacauauggugaagaaggucugauggccaauaacuggaccccagcuuuggagcuggagguucagauucaagacucaauuucuaggaguauagcaaaauuauuauuauuauuauuuuuuauuuuuguuuugagacagagucucgcucuguuguccaggcuggagugcacuggcgccaucucugcucacugcaaccuccgccuccuggguucaagcgauucucaugccucagccuccgaagcagcugagauuacaggcaugugccaccaugccuggcuaacuuuuuguggagacagaauuucaccauauugucuaggcuggucucgaacuccugaccucaagugauccgcccaccucggccucccaaagugcugggauuacaggcaugaaccaccgcgcccagccaaguauagcaagauuaaaaggaguguuuuguccuucaucccaaacuuagagaaacaagagcgcuaaauaaaugaauaagucagggaugaaaggcaagacaacugugaggaccugagugaguaacagaaacaaagccagacagauuguuaccaacaaauuaaauaguuuggggccacuuuagcaaggaaauaauagagagugugugugagagaguauaagaaugagcucuaccugugcuacugaccacguaucugaaauuuagguucauuugggauguuaacccaccugggucagagguuaaguaauagggagcuuuuccuagcuauugaucuuguccuucuggacaaguaguaauguuacaacaugaaccugucuaauucccagcccuccuuaaugacugaaauuguuuucacccugaguuuuaccuuggugggagugcugcgaaauauaggcaggaaaauuauuuucaccuuuauuuaguuuaucugaaaagauauucuugaaagacacauauuugagaaaggugcugaauaaauguugguguugauaaagagaagcaacaaagcaccaaauacccuccugcaaacgcaagcagugccagugaauaguaggucaagggagcucuuggucuuuggagaaugaggauuaauuucagauucagagugucuucuccauuugccaucaucuggggaaaaccacgcccuuauuaucucaucuacagugcagcuuucaaguccucaucucuaguucccauaaaucuauuuauauaauugacaucuauaccauaagccauaauauuguuugcacuauuaacauguuuuauauaaaccuaagggcaaaauaugacuuuauuuuauguugucacuuuagagaaauagaaaagauuagagugaaugaaaccaucauucucagcaaacuaucgcaaggacaaaaaaccgaacaccacaaguucucgcucauaggugggaaucgaacaaugagaacacauggacacaggaaggggaacaucacacaccggggccuguugugggguggggggaggggagagggauagcauuaggagauuuaccuaauguaaaugacgaguuaaugggugcagcacaccaacauggcacauguauacauauguaacaaaccuguacguugugcacauguacccuagaacuuaaaguaaauuaaaauauauauauauaaaauaaauaaaauaaaaaaagaaaagauuagagugaaugaagaauuugugagagaucugacucuaauuuuaggucggaauaaaggaauuuauuauuguaacucugcuauaauuuaaagacccaaugauucagaguggucauaaauaaccaauaccauauuagauaaggcuuacacaaggacaugcuauccuggggcauucuugaucaagccauccagauaacuucucugacuucuuccuaaagguugaauauuaacaauuuaggucugggcgcaauggcucacgccuguaaugccagcacuuugggaggccaaggccaguggaucacuugaggucaggaguuugagaccagccugaccaacauggagaaacaccgucccuacuaaaaauacaaaauuaaccaggcgugguggcgggugccuguaaucccagcuacucgggaggcugaggcaggagaaucacuugaaccccggggggcggagguugcggugagccuagauugcaugauugcacuccagccugggcaacaagagcgaaaaucugucuuaaaaaaaaaaaaaucaagaugcuuaacugaaacagagguauagauaaggacacuuggccaaccaacagagacuaauuugugaacaagcauucauugauuacauauuuucugggaggcaguaaguagggaugcaaaaauaaaugacauaaucuaguaggaauuccgcaauugccuguagcuguuuacaagacaggacuuaucaagcacuuuagagugauguaaacaguaccacaggaaaucagaacagaacaaagcauuccuagcugaaguuuuauuuucacugugcuuugugguacagguugaguaucccuuuuccgaaauguuuugggggacaagaaauguuucagauuuuggauuuuggacauuugcauauauacauaaugaguuaucuuggggaugggauccagguccaaacaugaaauuuacuuauguuucauguauuccuauauacauagccugaagguaauuuuauacaauuuuuuuaaugauuccguggcugaaacaaaguuuugacugccacucaugacaugaggucagguguagaauuuuguggcucaugucagcacucaaaagguuucagauuuugaagcauuuuggauuuuggauuaaggaugcucaaccuguaccauuugcauuacauuagaguuacagucuauaugggcucaguaaauuaaaugaaaacacauuucuagcaaugcauuuggucugcacguucaugauguuggggcuguugcugugaugcuuauugccguaaauagcuucaaguauuaacagaugacauucacuauauuuauuuagacauugugaaauguuuguuuuuaagguuaaggugagaauucugggguacaggggaaaaaaggaaaucucccuguuuuaaaauaggcauucuacuauacagccauaagaaagaaaagaaugagaucaugucauuuacagggacaugguuggagcuggagaccauuauccuuagcaaacuaacacaggaacagaaaaccagauaccgcauguucucacuuauaagugggagcuaaaugaugagagcaaauagacacauagaggggaacaacacacacugguuccuguuggaggcugaaggaugagaggaaggagaugaucaggaaaaauaacaaauggauacuaggcuuacauaccuggugaagaaauaauugguacaacaaacccccaugacacacauuuaccuauguaacaaaccugcacauccugcagcuguaccccugaacuuaaaaguuaaaaauaaauaaauaggcauucuguagucucuaugaaucuucucauuuacuuaaggauuuuuucauaggcacagugccuucugaugaagucaguaaaugcuuaugaagcaccguccaucuagcacugugcuagaugcugaagauucaaagaagacuaacacauggucccugccuuccagaagacucagccuccuggggaugucaggauagaaacacaauuacaguucaacguuacacaugcuguaauccaaguuaugagaacaaugcagaggaagcaacuaagguuuccuagaggagcggaaaagacuucacagaagcaauuauaccuuaguuuguuauuaaaggauaagaaguuguuuuccagaggaggaggaaguaauuccagacagaacaguagguagagaggcuuuggagugacaaaauagaauaauauauucagggaaugcucacaaaggccuauguggcuggaaauaagacuuuuuuuauuuagaaagucaacuuuggaauguguggagaaaguggugaaagcagaaaucagcaaauccagugaguuauggauacuuaaaauuacuuaauucuggaaaaacuuugcacagucaauggacaaacaaaucuacaaacaaaacugaggcuuugggguauuugucacaaacaauaaaugauuuuguauuucuguuucagaucuagcucuucuguuaucccccauuuuauuccccuuagauacugaccaugggauucuaugugcuuacaaauuuguuacaucuacauuucacaacuuaaacauacuuuucuguuuuaaaugaauaugugucuaagcuuuuuaaacacuaaacaacugccguuuuuccccaggucaauuucugccuuguggauaauuuucugaaucuguaauauuucugaagauuccuccaaguauuuacagaacauacagaaguauuuuaugaguaaagucucauuuuaaucugaauuuaaauccaaucaaaacucacaagaaacuacuucggaaucaaaacaguaacaaaguacccuaucccaacauugauuuaauuaagaaagaauuuauuucuauagauguuggcacuuugcauaugaagguuugaagcugcccauuucaagcaacaaaaagaaauguuaaaaaccaagguagucuuccugggaaaucccguuaguaauggauuucucugcuaguaaugggguuguucauuaguaugggguauuuguauacacuuugaaaaguuauaguuuccaguuuguaaaaaucauguguucccaguuuggcuucaacaugcaaacugugugcuaugcaucaaacaggcaaucccuaaguauacacugauuuuaugcauugauucagucaguguguuuuuuuacuugugugugugccaggguagcucuugauuugaaacacuauuaauuccaagaacuucggacaugcccaaaucccagauucaaacaaauguuuuaacucauucaacauuuuauaaccccuacuuuuauggagauuuugaaggaauuauauuucacuauauuucauuguuuggacaaauuguaugcaaauuagaaaguaauuaguucuuuaucacuucuuuuccuuaaauguaugauaacauggauuuauaguuuaucauauacucauauuauaaauuacaaugguguaugucuuuuauucuauguuuugggcccacagagcacaggugacaaaauuugaguucuaacauauuccaauuugauuauuccuauugaagcugugcuucuuuacuaaauaauugguaaaaaaauuuuuuuuguauaaaguuucauuuuggcucccuccuuguccuaaaaucgcauacuuucagcaaucugcauuaaauauuuauuaaacuacugucauucucuuagcuccugauacugacucuggcucgcagcgggcuucuagggcaauuuaaccacauuaugaauucacaacacauuuugacauuaaagaaaaacuucccuguguccaaagcgcauaccuauguuuauauaaaauguaaccaaaucaauuucacuuuccuuuuauaaaagaacauaauaggcacagcaugaagcaaucuguaugauggauuuuccugauaugaaaauuguaagcagugugauuuucugcuuuagacagcugagguggcgcuagcuaaucucaagaacaaauaugaaaaugaaaaagcaauggugacugaaaccaugacgaagcuuagaaaugaacugaaggcuuugaaagaagaugcugcaaccuucucaucccugagagcaauguuugcaacaagguaacaguauuuucuuccuaugacugggugugguaggugggguaaaggcuuuaaaauucacagcccugccuuugugcauguugaguguauucggugaguagucuaggauggcuaagugugaagaaaaucuguggaaguccacucugacguaucuaaaagcaagccuucugugcuguuuuccagagcccccuacugaacacucuggauccagaaauucuauuacauaaaaauauuuuuuaaguaagcuaauauuaauagguuguuucuagaauuuaugcaccccaaagagagucucccuccaaauaaaaagcuuucaauaaggaaaaaaaccccacuuccuagaauagcuaaauauuaucaccucugaaauagaguucugugaaggaaguacaugaaaguauauaaaagugccuuaccuuuaguacugugcgagaagauacugucauaaugaagauuaauaaucaucacaucagcuaauuacuuauaauuuuuuuuuuuuuugagacggagucuuacucuguugcccaggcuagagggcaguggugcgaucucagcucacugcaaccuccgccucccggguucuagcgauucuccugccucacccucccgaguagcugggaauacaggcaccugccaccacgcccggcuaauuuuuuguacuuuuagcagagacgggguuucacccuguuagccaggauggucucgauuuccugaccucaugaucugcccgccucggccucccaaagugcugggauuacaggcgugagccaccgcgcccggcuguauuuuguguuuaaacaugaagugauuguuaagaauguauuugauuugaaguuuucagaaucuugagauuuucaauauacuguugaaauacauuuuuugcugucacaaugcagugucaaaaaagaccuacuuuuuuuuuuuuuuuuuugagauagggucucacucugucacccaggcugaagugcaguggcgcuaucucgguucacugcagccuggacauccuggacucaagcaauccucccacgucaccucagccucccgaguaccuaggacugcaggcuugcacuaccacacccgcuaauuuuugugguuuuuguggaggcagggucucgccauguugcccaggcuggucucaaacuccugggcucaagagauccgcccaccucggccuccaaaaguccugagauacggguaugagccaccaugcccgaccaaauccuaccaauuguguaucuuguaugaugcaaacuuggugcaaaauucacgaauaauuacuauggcuuuacuugcagauuuaguaaauaauuuacauuuggcugauacauguaaaaguguuaaaaacaaacaaaaaaagaucucuugagcuuuauaggagucccccagaaacugagaucacaccacuguacuccagccugggugacagagcgagacuccgucucaaaaauaauaauaauuuuuuauaaaaaggaauuguuauccccaaauugucuauuuucacagacuuuuuuuuggcaugaacaguauuuguuauucauauuuuagcggguaaauaaacucagaaaaaaaacaaaacaaaauucagaaugagcuuuuucuccacgccaccucuaccuuccaaauguauaugugccagguuuugccuuugguaaggaaaaaagaucacuaagcuuaucuuucuucuucggcacaaguaugaaaccugaauaaagauguuucggacagccugcuguaucuguaugaaaccuugugaaaucuugguuuuugcaggguuuucuguuuuuuguuuuuugacaacucauugcucugucaucugguugagaaaucauugaaaauacucaguuuucuaauucaggcaaaucagucaaauugacaagaccaacagcugcaaucuauacuaaacuaaaacguauaaauauagauaaggaaauguuuucuuuauaaacauuauuauuuuggauacuauaggcauagccuauaauaaacuuguuacauuccuccaaagaauacaaugucauacaguaaaaagagcuacuguaagacacuucagguauaguggacauugugugagacuugacuguuauucgucuguuacacagcagccccacgauaacucugucccugggguuuaagacauugccuauuaagacugucuccauaugggcugggugcaguggcugauaccuguaaucgcagcacuuugggagacugaggcaagaagaucacuugaggccaggaguucgagaccagucugggcaacacagugagacccugucucuuuaaaaaauaauaaugacugggcgugguggcucaugccaguaaucccagcacuuugagaggccaaggugggaggaucacuugaggucuggaguucaagaccagccuggccaacauggugaaaccccgucucuacuaaaaaaaauacaaaaauuagcuuggcaugguggcacacuccuguaauuccagcaacucggcaggcugaggcaugagaaucgcuugaaccugggaggcagagguuacagugagccaagaucacgccacugcacuccagccugggcgauacagcgagacucagucucaaaaaacaaauaaacaaaacaacaacaacaaaauaauaauaaauuuuuuaaaaaugucccauauaucucauuguauggaugaacauauauuccaguuuucugcuauuguggguuaucuacauucuauugcuagaccuuuaaaccagucuucuaaauuucuaaauuucggucaaauuuauuacuuuucagcuuaacucccaaauucaguuucaccaagauuuuccucugaccacuucucuguuuugguuccagaugugaugaauaugucacccaguuggaugagaugcagagacaguuagcagcugcagaggaugagaagaagacucugaacacuuuguuacgaauggcuauccagcaaaaacucgcccugacccagaggcuggaggacuuagaguuugaccaugagcagucccgacgcagcaaaggcaaacuuggaaagagcaagaucggcagcccuaaaguaaguggggaggcaucagucaccgugcccaccauagacacuuaccuccugcauagucagggcccacagacacccaacauucgggucagcaguggcacucagaggaaaagguaugcaugcagcgaucuucauaguacggugcaguggccagauuuuaguuaacugcaaaaauaaaugugcucuuguuguggaggauggaggaggggaagcaaaagaaaaaaugggagcuggcauauaaauggucuugcuaaugugggucuuuccagaucaaaaccuuuuugauaauuguguuuauguaguccuuucuaacccccugcccaaucccuccucuugauuaaucguaauauaauuuucaagugucuguuaauauuuuugcuacucuuuguauguguaaauaugccucucccuuaccuccaaccugagaauugguagauaaagguggauauuaagaaugaagcuguguucuaccuggguuauaauuuuaaaagucauuguaccuuuggaaauggugcuguuuaucagcuucucuuuaacggggcaaggauaugaauauguucucuuagggaaacuuuuguccauaugaccaaaacugaugacagacugaaaggggaugucuauaucuagauaaaaugggauggaauacgcacaguccuuuucuugaaagcagguuuuugugcuuuuucauuuggcaugggaauauugcccagagaaaccacuuguaagguuuuuaggggcuugauuuugugaguccuggcuguugaguuacuuacccuguauuuucgguuaaugguaacauuuuuauuuuaggagcuuucauuaaagacucaaauaauauauuuucuauuugcgguucaagcugacuaacuguaauaaaucuuuuuuccaguauccagaacaguuuccaaauaggguuguauccugauguggaaacuaaaaaaaaaaaaagcaaaaagauugauuuacauauuuaaaaaauuaaaugccaguauaaauaauguugucacuggugaggcguuaaaagguaauuaaaguaaaacuuuuuuguuuccuauauguauuuuucuuggaucuccugcaagacaauuuucaccuucccuuugugaucagagccgucccaggacuucaggggcuuccuaccuacagaauuuauuaagaguucccccugaucccaccuccacagaaucauuucuucugaagggccccccuuccaugagugaauucauccaagggcaccggcucagcaaggaaaaaagguuaaccguggcuccaccagguaaacauuuuuuccuugggugcaugugaugcaaaugauuaguugaauagacucuccccuuccuuccggucacucaggcucacccagcugcagaguauaccuuugaugauguguaaauuccuauaagucaaguaaaaacuuccuuacacuuagcuucccauuuccuccuucacucauauuccuuagaaugacagacuuccauuuaacagccaaagauggcaaaugagaguuggaaggaaugggauagguaaagggaaauuagcaacaagcacaacgcacacacacuuggauccuauuugcaguuugguagcucauggcgauuccaucuuggucagauuuggccaguucucucuuaucguuuuuaauguaauuuccguaaagggagagccauauguauaacaaggcuuuugggcugauuuccuuuuguggugacucagaacgucuccucaaucauuauauugagaauaaaaguaaaaccuucuaagauuuugcuccucaagaacauuuaggucuuaguauaauguucuuguagauugcaggccccccacugguuaaugcuuaccaacauguucacacuuagcuucacuauuuugcauuuuucuuucuuccuuccuuccuuucauucuuuuuacuuguucuaugaagaggccuaacuugaaaaugugacauauggcaaauagagaaaauuauucuugcaaauaaaaaucauccuuuuaaggaaucccugcaugugaguauagggcagaaguggcaaacaaggagcccauaaaccaaaguaagcuuaaaggcagcuguuauuugacuauugccagaaaauaaaaaauaaaacuauuuaaguuaguuauugacaguuaaaaauucaagagauuuuauaugaacaucaguauuucuggccucuuuuggaagauucugaauaucuggcagcccuaggucugcguucacgcaugucaacaccuguuggagcucuguaguggcugcugcuguuagggcaagcuucgcacuuugccacagucaccacuccuccuuauuacuuauacccagccugcuauccucauuucuauucucuccuggccccuccuguagucuuugaguuugccaccguugaaauagaauuuuuuuuuucauuuuaccuuaauuccuuuuugcaaaccucagccuuuggaucucuaauacuuuccuuaucugauucaugaagucagccuacugauugggauuaaaagaugugguguagaaacugauagugcauuucacguucuaaagguguuugaggaaauugguagugauaaugaguuggaaugguguaauagccaaaauauacaccuaagaagaaaaaaaguaaaaacugcuugguguuuuuaauuucauaacugauuuccuauuguuuuagaccuccuuggaagguaccuugaaguauucugugaaucaccaaagugguaaugauuuaucaggauaccuaacucggauaaaacccacaagucuucuuuuuaguguuccaaauggauuuaguagcacuaucuacuggaacuuagaaaagaaauugguaugauuaauaaauaacuccuauugcuguuuaauuaaaaagauaacaucucaauaagguuaaaaauuaauaaucaauguuaacaacaauaacuguuuucauuuuuguaugacugguuuuuguuuacaugaauauauacuuuauauuguuaucauuacauuguuuaagccaugaacauuauaucacaagcuuuuccauguugcuaucuagucuuguuuuuauuuguuaaaguuauuguaucauagauuuuguuucagaugcuguuaucacauuaaucacuacuucucuucuuguccacugagguaguuuuucauuauuuguuauauuauagagcacugcugggaauacccucaugcauucagcuucucaucuauuacauuuuucucaagagugagaucacucaguuaaaaguugaacauccuuauguuuuuugcuccauucugauguugcugucaagaaggguauaucaauguacuaaaagcccauaaaacacuuucccuuuuucccacauugggaaucuuucugcuacuuuauccacacugugcacaucuuacaacucuaaagucaguuagcauacaugaaugagaguaccauauauugucuuaaacucuuuaguuuugaauaaccagaaaauaccauugaccuuagaaaugauuacuauuuaugagauucgaggccggcugcagugguucacaccuguaaucccagcacuuugggaggccaaggcaggugaaucacuugggcucaggaguuuuagaccagccuuggcaacauggugaaaacccgucucuacaaaaauuagccaggugugguagugggcaccuguagucccagcuacucaggaggcuaaagugggaucccuugagacagggaggcggaaguuucagcgaaccgagaucgcaccacuacacuccagccugggugacagagugagacacugucucaaaaaaaaaaaaaaaauuagagauauaaggaauguggaauucagaauaaucaccagaccagaaggucaugcuaaugacagcuuaacauauugauaaccuuuauaauucucaccauuuauguaaaguuaaaauaauaaaagaggaaaggaaguaaagcuguuauuauagccuuaggaauuuuuaauuauguaucguggaaucaaccagauuaacgcuuaguaaauuauuaucaaaucaaucuuagcaacauuuucuaaaagguccuaguuaaaugaauuacuacagaaagugacggaccauccacaccaaauaaauuguagcuucuacaaauaucugcauuauuaccaauauauguuauuuucccucagcugaacuauauaggguaagacauaucaaacauuuuuuaugaugcuuuuacuauauaaaaucuuuucaauaagccaagaaagagaaaauaugacauauaauaccagucuuauguucuauauaagaaauaucauaagcccaugggaaauaguagauuuuaugaguauuuuuaaauucaggaguuuaaccauuauaaaauuugcuagcuaguaacaauaucuauuaaucauuuuaaaaggaaaauucucuauuaauguaucagaauguuuuugauaagcauuguuuuacauauauauguauauauauauguguguauauauauguguguauauauauguauauauauauguguguauauauauauguguguguguguauauauauauauauauauauauauauauguauaguuuuggggguuuguuuuuuuuucuuuuuuuuuugagacggaguuuuccucugucacccaggcuggaguggagcggcgcaaccuuggcucacugcaagcucugccucccagguucaugucauucuccugccucagccucccgaguagcugggacuacaggcgcccgucaccacaccuggcuaauuuuuuguauuuuuaguagagaugggguuucacaguauuagccaggauggucucaaucuccugaucaugauccgccaucucggccucccaaagugcugggauuacaggcgugagccacugugcccagccuaaaauauauuuuuaguacaucuuuuuagaugauuuuuaauuauucuaauaagcagauaugggcuuuauuuuucuauugaggaccauugaaacaauuaccucaacuaaaaaugaaaucaguuuaauuuguuuuuaauccuucaguugaagaauugagagagguaugugucguuuaaaaauuuaagacacagaacauaaaauguuauuuauucuguacaagaguuacuuucaaauagauuuuauuucuaugagaugguaaacagaaagccucaucuccuuaaaugcacaauuucuccauucuggagaaucaacuauagggugaggcacugauuuucaacauuaguagaauauuguauaguaauugauuaaugcauuauacugaucgguuugcugcauuaguacaaccuuuuaagggaaaauucuggcguuucccucuggcuggcucagcuucugcaaccucagcccuuacaauugcagugcuucuggccauggcuugcuuguuaacuuucuuguucuugacuuuauccuuauccuggcacacaaauuccaguguccuuccacaugcucaucuuaguuuucacaguuucaguuaccagcugaucugagaagugccuaucagccuugaugaccuugacucaaaagggacccuguugucaucaaggaguuuguaauuggacagcagauuguaugucuucacaaaauuguugccuauuuuuuagccagcauuuuaucuugacuccuuaacuaccuaggccuauauccuucuccuccuccuccguccccucuuccucuuccuccuccguccccucuuccuccuccuccucaucaucuuaccauuuaaucaauaauugcaaucagccugucagaauacguaaagggaauccauguaauucacaggcgggaguuguuauuucuguaguaaagaccugacugcagcauuuacacaugauaaauaggaaauggcaaaccuggggaagcaaguuugaacucaaucuggaaguaauagccuaagcagcuugcucuucacacuguguuucccaugucacccuuuuccucuuagguaucuugcuucucccucucauuucaaucuccuccuuccuucuguuccuccauccuuccaucccucccuccugucuuucucugacacaaugacucagcuaguuuaagagaaugguauuauuuugaagucugaaaauguuucugugauauuuugcuuuuuacugaucuuuaaagcaacucacagaaguguauuagccuuagauacguaaucaccccuugagauauauagucaacaguacacacugacauguucauaguaaaaacugccuuuauguuucacugcauucaagcaaguagauauuuguuuguuucacguauugcaaagccuauguucuuaagcauguaccaaaaucacauuuauuucauuaauccauuuacucauucaccagaauguaacaaaauuuagugaauaucugcuaugugucaggcacuuuucuuggcucuugauauacaaugauauucaaauaaaacucauagucugguaggggagguaggagacaaauauguacugauguuaauagauauuccugaaauaaauaaaggaauuaggaugguuaggaacguccuuccagaagaaaugcaaggcuggccaugaaaggugacuauaucguaauaggcagaagguggcagcgcagguaugggucguaagaagaaccuuauaggaaaggaggucaacuugccccagugccaugagcucagcacuacaaccuggugcaggacuucgaaguaauagaaagcgaggcugcaaagguggacagggaccugaagacagagggccagguuagugagagcagacuuaccacgggcauagcuuagcaguuuuaagaauaggaucagauuuucauuugauaaaaucacccugaugacaagguggagaguggauuagauguggguaacaucgaagauaaagaagcagguacagagacucauaaaauaugcagaugagagguaguggagaccagaaucaaaacugugaggaauaggaauguuuaaauaugucccaaguuacaauucaguuacauauuucaucagccagcauguccugugcacacacgaccugcucuuacugcuuuccauguucuguauguggaaggagaucagucaaucuugaacucauggccucaguauuuuguacuuuauaauuuauauuuuuuccuauagaggcuuuucuauuuauguguauuccacuuccccauaucacuaaacugucuuuuuccacaggauucaauucuugaacuaguaggagugaagggcagucuguugaaaccuguaaucucuuaggcuuguauuuucuuugaacauaguuuccacagaauucuucccuguaggggaaggccugggcacuucuugaugucagaacauguugucuuuaguuuggaaucugccaaaacaaaaguuaaaucaaaaauguuaauuccugucaccccagcacuucgggaggccaaagcaggaggauugcuugagcccaggaguccgagacuggccuggguaacauagcgagaccucgucucuacauuaaaauuuaaaaauuagcuggaugugcuggcaugcacucauagucccagcugcucaggaggcuaaggcgggaggauugcuugagucugggaggucgaggcugcagugagccacugcacuccagcgagugauggagugagacccugucucagaaaaaaaaaaaaaaagaagaaaaaauauauuaauucacaaaauugucaaccacauguugagaaauacauuuuuauacuugcuguauauuuuucaauagguaaugguucaaaaauuuuaaaguacaaaggguauacaguagaugguagauuucugccacaacugugcccacccaaccuuuuguauuuuuccagaaacauucuauacauauauaaggaaaugcauauaaauauauacauauauaaaaacauaugcauuuuacauauguguuaauaccauuggcacaaccacagacauuaugcaugccgguuuuuuucacuugauguaucuggguucuucuuuccuauacauuuaucuuuuuguuucuuuugagucagaagaaguuaugaaggggaaggaagacaugcuugagcucuuuaagaaagcuuggaauguuucuaugugugcaauagaaauauuucuugccaaaugauaaaaugacagcuacaagaauguuucuauucagaacuauucaauagaaauaugauauaaaccauauauguaaauuuaaauucucuaguagucuaguagucauguuagaaaaaguaaaaagaagucaggcaccauggcucacgccuauaaucccagcacuuugggaggccaaaaugaaggaucacuugagcccaggaguucaagaccagccugggcaacauggcgaaaccaugucucuacaaaaaauaaaaagauuauucgggcauaguggcaugcgccuguacucucagcuacucaggaggcugagaugggaggauugcuugagcccaggagauugaggcugcagugagccaugaucgugcaacugcacuccaggcugggugacagagcaagacccuguuucaaaaaauaaauaaaaagaaacaagugaacuuaauuuuaguaguagauuuuaauugacacacuauauccauaaugugaucauuucaacauggaauucauagguggcuaacaccuauaauuccacuuugggaggccgagguggguggaucccuugaggccaagaguucgagaccagccugggcaucauggugaaacccugucucuacaaaaacuacaaaaauuagccaggcaugguggugcaugccuguaguuccaccuacucaggaggccaagguguggggaucgcuugagcccaggaagcagagguugcagugagccaggauugugcuaguucuuuccagccugggugacagagugagacccugucaaaaaaaauauauauauacguguauauauauauauauauauauauauauauauauauauauauauauacguguauauauauauauauauauauauauacguguauauauauauauauauacguguauauauauauauauauauacacacacacacgcacacacacacauacacauacauacacauucuguuuuucuuauucagucuuugaaauucaguauuaugcacuuacagcauaucuugauuugaacuagccacauuucaaaugcucaacagccuaauuucgcuaagggcuacuguguuggacggugcaguucuagaacuucuuaguuuuaacuagauagaauuuccacacagaaaucuaaauuugaauaacuaaugacugauuuuaaaauaaaauuuaagauggcauguauuucgguuuuauuucuuuucuuuucuuuuuuuuuuuuuuuaagacagaaucuugcucuuguugcccaggcuggagugcaauggcacaauauugccucaccgcaaccuccgccucccagguucaagcgauucuccugccucagccucccaacuagcuaggauuacagguaugugccaccaugccuggcuaauuuuguauuuuuaguagagacaggguuucuccauguuggucaggcuggucuugaauuccugaccucaguugauccuccugccucagccuuccaaagugcugggauuacaggcaugagccacugcgcccugcccucauuuuucuuuuaaacugacauagaccaaagugcuauuuugcugauucugcuuugucucugauugguggcagugcuuuuuaaaauagauacauauuaaauguuugagccaggcgugguggcucaugccuguaaucccagcacuuugggaggcugaggcgggcagaucacaaggucaagagaucgagaccauccuggccaacauggugaaaccccgucucuacuaaaaauacaaaaauuagcugggcaugguggugcgugccuguaaucccagcuacuugggaggcugaggcaggagaaucgcuugaacccaggagguggagguugcagugagcugagaucacgccauugcacuccagccugggcaacaagaacgaaacgccaucucaauuaaaaaaaaagaaaaaguuuguaccuauauacccuuuucauacaucucuuauuuguuacuagaucuccuugucaauauaaaaacuuaauuacuuagguauauccuaacaaaacauauuccuuaaacauucuuaaaacaguauaaugacuuaguuuuuuaauuaccguaaugaaguuguaaaagcccauguuucuuauuuuaagcagagagugccuuaaaaagguuuaaaaugcauccugccaguuuuaaauagcagaauuuauugauaccauauauauagacugaaaacacaucaaagucuuucaagguugauuauuucuugugccuuccuucuucccacaguaagagagaagauaaagauaauacugaguaaaccauuccaugcuacaaauuggacccauucgacaaaaaugcaauacuuaguagaacaucugaugaccaugguccuauucguguuuuuauuuuguuuuauuuuuguuuuuguuuacuguucucuccucuguccaguauuccuguccagaaauuacauuuccuuaaaagauuucauauucaaaaccugagcauuguaugcaaaauaagcuaugaugaaaggaugaaacuuuuuaauuacugaagagaucaacaugaaaaacucuguagcaagaauguguauuuuauauuagaucauacuuuucaauccauauugacuauuuuaguaccauuauguaauuuuaaagucuuuuagauuuuguuaaaauuuuauuaaauccauggaaauugaaaguuccuuauuuuaauccuuaggagaaaaacuauaauuuuucucuaauauauccauaaagugaaagaagaaguacuuauuugauauucuuaauuguuacauauuuaagagcaagaguaauuaguucauacuuauguucaccuaaguccacccauacauugcugaggauagcggccuucagaagguggcuguuuccggaggaguaacagggaggaacaggugggcugagauauacaugaggcccaggacauuccaggcaauaacugucugccucuccugacucugcccaaacccgaaaugaugcuuucuagcucacacaaaaauauauauauauauauauauauauauauauauauauauauauauauauauauauaucagcaggcagauacucaagcugaaagagacauuacugggguucguuucuagaucacagauccugccucaggcucacugaagugaccagccuccacccaguaacaacaaacuagucuaaauccagaauaaaacaauuauacauuuuaaucuuaccaccuucuaccugugugugcuguccacccucaagacagagaauagcccguauuccaccaaccagcaaucacuagccuacaacaccaaauccacaguuucuuugguauccuuugugccagggaguugggugcugaacaaucuaccuguaacauucccuugccuucauaucccaaagcucugcaagcaaagaagaguucuggugggcagcuagggccauuuguuguaguccagaggaagagagccauccguaucuucugugcuguacucauaccuauuuaauccaaucugcuggcaccagucuauuauauucaacuguuugcccccacuguaacuacauaacaaccaccucuauuacaacagugauuauaaggcauuaucugagaggguauauccaaacuguaccuugcaaagggacuucuaucugcaaagaauacuaagaaaacauauuaugagaaagucacaauagguacccagagaagccaaucucuagguuaaccaacuacuucccuguccauuucuccuuauaaaugugaaaggagagccuacaaugaagaaauccuggaagggcaucucccagcucugagacucucugaugcuaugaauucaaguuauucuguccaugacugggucuggaggucacuguguaaaaucuacgcuucuaaauaaauguuaugauaucucagcauacuauaccauacuuauaacauguaugcuuauaacagcauacuauaccauauaguauaguucccaagaaaagggaauguuucuuccccccuaaaaaaaggaaaauucccauuaucuaauauauaaaacaaacuuuuuugaugauuuaaagugacuguguguugugaacugaguagacaaggcaggaaggaguagugauguuccugaguucuugcugaauucugacaacgugccaacacuuugauuucucugucaaaaugggugggauuugauaucuaaaaaaguauaccauuacauaucuaaaaguauauuguuacauggaauauggaagccacugauuuaauucuggaauguccgucaacaugacagccaccuaaacuccucugaggcauuguaaacgguuaggaaaauugaccuuucuacacacuaaaucuggcuucaguggcucuccugagcucuaagggaguugggcaggggcagccugagcuccggcugugagcauagcucaacugauguguaguuagaauguucauggaaggcccaggcuugcuacuucccauuccuuuauuuuaaaugauguagugagccaggcgugguggcucaugccuguaauccccgcacuuugggaggccgagguggguggaucacuugagcccaggaguucaagaccagccugggcaacauggugaaacccugucucuacaaaaaaaacaaaaauuagccaggcaugauggugugugccuguaguuucaggggaggcugaggugggagaauugcuugagcccaggaggugggggcugcagugagcugugauugcaccacugcacucuagccugggugacagugccuacauaaauaaauaaaaagaaagaaagaaaugauguagugaaaauauaguuacauagcacuuauaccuagacuacuuaaagugaccuaguaauuaaacuuauauagcucaucaaccagcaaagauuccuagugcaccacacucguuauagagcagggaagcaucgcugccacccucagggauuccucuugcauaucucuguguucuguccuccacacacccaucucuuuagucaucuauugauuuuauucaauuuuccuggcaguuuccccaguguauuuuaccugaaagguaugagaggaaaaaggaaaagcacaacucaaaaugguugacuauuccauucuuuguuuucuucaaaaaguguaaagucauaaagaugccauagaaccacuaaauucauuguccuuugucaccucucagccaauaauagucauugauauacucuccauaccacaaauuuaaaguuuuuugugaacuguacaugcaauagccaaguuuauuuuaacuuuagucauuacuggaucccagagauuuucuuucucuuuuuuggcauauagauuauuuaugucacuucaguaugcccaguccacagaugagaucuucugagggacugcuucuggagccggcccucuugugugauugaauuagucagugaugguucucaggacuagauuagauuguuacucuuaaaauaauuacuuaaaaaaaaaaaaaaaacuuccauaacuugaaaauuuuguggccaggugugguggcucacgccuguaaucccagcacuuugggaagccgaggugggcggaucgcuugaggucaggaguucaagagcagccuggccaacauggugaaacccugucucuacuaaaaauacaaaaauuagccgggcaugguggcgcacgccuguaauuucagcuacucaggaggcugaggcaggagaauucgcuugaaccugggagguggaggcugcagugagccaagaugguacccacugcacuucagccugggcaacagagcaagacucugucucaaaaaaaaaaaaaaaaaaaaaaaagaaaggagaaaaagaaaagaaaaauuugcauuuaagacuuauaugaaaauacauaauuuauuuugcagaaugaucuagagcaggacugucauuuuaacuaaaguuauuuuuggccaggugugguggcuuaugucuguaaucccagcacuuugggaggccgaggcagguggaucacgaggucaggaguucaagaccagccuggucaauaugguaaaaccccaucucuacuaaaaauacaaaaauuagcugggcaugguggugcauuccuguaaucccagcuacucaggaggcugaggcaggauaauugcuugaaccaggacgcgggaggcagagguugcagugagccaagauggcgccacugcacuccagccuggacuacagagcgagacucugucucgaaaaaaaaaaaaguuggccaggcacaguggcucacaccuguaaucccagcacuuugggaggccaaggcggguggaucacaaggucaggaguuugagaccagccuggccaagauggugaaaccccaucucuacuaaaaauacaaaaauuagcugggcacaguggcgggcgccuguaaucccagcuacucaggaggcugaggcaggacaaucacuugaaccugggagguggagguugcagugagccgagaucgugccucugcacucuagccugggugacagagcaagacucugucucaaaaaaaaaaaaguuauucuuaguggauauaaaaauugguguuuuuggccgggcgugguggcucaugucuguaaucccagcacuuugggaggccgaggcggguggaucacgaggucaagagauggagaccauucuggccaacauggugacacgcaccuguaaucccagguacucgggaggcugaggcaggagaaucacuugaaucuaggaagcggaggcugcagugagaugagauugcgccacugcacucuggccuggcgacagaguaagaugccgucucaaaaaaaaaaaaaaauugguguuuucuugguuuguuuuguguuuuaguuuaaggagacacauuuccucaucuuaaggacuuuuuugcugcucugaugcuggucaucuaguccauucuuuugcucuaaacugagccuugccucccaguucuucauugcacuucagauugugucuuacuacaaagagaaaauuagucugugaucaguuuggaucagaagaacugaaaauguacauuuagaauagaagccagggaugugaugcacacccgugaucccagcuacucaggaggcugagaugggaggaucacuugagccugggaguuagaggcugcagugagccgagaucgugccacugcauuccggccugggugacagaacaagacccugucucuaaaaaauaaaaagaagaaaagaaagaaauuuaaaguaggaagggcuaccguuugcuucuggccaagcuucaccucuaaccauaggaucuuuuaaaagacuaguucugagguccuuuacucugaguagguauuuauggaauaagccauuauguauugacauuagaaucaguuaaacauaaauuuuuuucucuuuuuaugcacuacuugacaucaaaagcaaaaagagguaaguuggcuauaaaccuguaggugaaccuaauuuuucuuaguagauuuguuccugaguagcuuugcuucaauuaaauuucugugaaucaaauacuuuuacauuaggaagauugucauuggaaauucuuauucuuuucuuugaaaaugaauaagcaucuucuguaaacuuagauuuucaagauaucuaguauuuaaacauuuugcuuuuccuuuaaucaaguuauacuuacgguuuaauuugcuugugaagacaaggcauuuucaaacacuugguuuaguuuugagauaacugaauuguuucucccaccagaaauguggauuacauguuauaagucuuuccuauuuucuuaaaaaugaaaaaaaaagccaagaaacaacugacauuggugaaagucuguaauuuucagauccauugauuuacagaagaagaugcccugaaccucucagaauauuuucuagugugauuuuuuuuaaugauuaaaaaaaaugaagaaaauauuaaacaagaagaucaaacacauuucauugaguggugucucauauguuuuucuuguuugggaucuauuuuuauaauugaucuuuuuaguggauucuugauuguaguuuaacuuauuucucuuuuguuucuuuuugaugaugcaucaauucugacauuucaaagguacagcuggucuucauuagauaugugcuguuauugacuuugcuuaacaagaacagaccaucaucguaccaccuugaguuaacucugugccagcuggccuugcucuugagaaggucauuucuaaacagaagguuauuuuuugaaagauuuuuaacugguguaagaaucuggcagcagaauguacuuuuaccucuuggugccacuguauuuaauuacccucuccccauuuauccuccaugucuuuccuaccauaagcuauugauaacacacaugcucaugguuuaauuguaaguuguucagaaauagaaagcugacuguacugcagggcguuuuuauauuucucuuuugcaagauuugaaauaaaaauagauuuuugcaugaauauuacuuuguuuuaucagcuagucaucugauauucaucaggacagcaaaugggaagaugggugaaagguuuugucaaaucuauaaccacugaaaaaucuaaaaaugcucccucucuacuuagcaaggcaugcucucauucuacaucgcugaagacgacuuucaugcuugucacugaagugugaugaacuauaugcaguugucauuuaugugaaggaggaaccagaugcuuuuuaagauuugucaccaggucuuauuuuugcauugucuauauugaaauuuuuugauguguuucaacaauuccuucuuuuuguucucuggaaauuuuuaacgaagaaugauuguuucuaucaagaguauacgcuauaauggacuuugcuguguuaaagacugauguaaauaugucugaaguguuuggugauauaaauuagcagauuucacccgauaagucagaaauuacacuaucaucuguggguacuuuuagaauaacugauguuuuaacaggggauguaauacguuuggugaaaagggaugagauagccaacucuauguguuugauuauaaaaugcugacagugcuucacagcucuccauuuuuauucauaucaguguaccauuaaauucaucauuagauuuuugaaaauaguuauuuuccuagcuacuguuaauauuuauguaaauguuucuaucucaugcucuucuuuuauauauaauauuucuuucucaguuuuuccuuauuauuucuaaauucucuacucuauauguguguuuuucaguuuauuuguuuaggaauucauaggacuguuuaaauguucaaguuguuacuacaaggagaauguauuuugaugcuucuuuccauuaaccuuucuguuaauucacuaacauuauuaaucauuuuguagauuuagugaggaauaauuuacugguuauguuauuuggcacaucuuaaaugauggcaauuuaaaaauuauuuucaagacuuauauauuaaaguccuacaguuaccaaagaagaauaauugaucaucugauaacacuaaauuaaccuuaaaaucuuuaucagauaauauuuauccauucuuauuccuuuuguuagaaagauguuguuacaaugacagggaugucuaaauuguaaacucuccuuucaagugaauuaauuaaacagugacauugaugauacuaauaaauaaauccaaggauuuuuuuuaagggaggugguuugcaccacauaaauucccuagcaaaguguuguggggaauugaagaauuauaaggcaggguccugccugcucucaaggagcugcauaguguggcuagagagaauagauauacugcaagggaagcaggggucuagaauucuguaagaaaugccaaaggaagcugggcgcaguggcucacaccuguaaucucagcacuuugggaggcugaggcaggcggauugcuugaggucaggaguaugagacuagccugggcaacacggugaaacucugucucuacuaaaaauacaaaaauuagcugggcgugguagcaugcacguguaaucccagcuacucgggaggcugaggcauaagaaucacuugaaccugggaggugaagauugcagugagccgagauggagaucacgccacugcacuccagccugggugacggagcaagacucugucucaaaaaaaaaaaagaaaugccgaaggagaugagagaagugcuaaaggaguuugcaggaagcagacaccuccuuuugggauggccagaaauaaugacugaaauuugacuuugcauagucugauagacaagagcauuuccgaugaauauaaugauagcuuguugaaaugaauuucuccuaugauccauuuugaccuuucuuauuuccuuguuguuaauagcauuuacuuuguuucucgaagcugaaaaccuuaagggccuucgacuccucccuuuccuuuguccaucaugucuaauugauggacucagagcugcaugcuuucacaaacauucucucaccugaucuucacgugaacccugcaagauugguauuuaauguucucacuuaaacggauagaaaaacugaggcuaagaacaguuaagucacuucuucagugucccuagcuacugguuguuggaacugguaucuaaaagagagacagagaucuuucugauggacucuaaauuucaugcugaaauggagaagagcugaagagcacagaggagagagaauagagaauaaagagggccaggcgcgguggcucaugccuguaaucccagcgcuuugggaggcugaggcgagcggaucguuugagugcaggaguucaagagcagccuuggcaacauggcaaaacccugucucuacaaaaguuuuaaaaaauuagcugggcguaguggcacuggggaggcugaggugggaggaucgccugaacccgggaagcagagguugcaaugagccgagagcacacuacugcacuccagccugggugacagagugagacuccaucucaaaaaaaaaagaaagaagaaagcugagaugccauaggaaauggcugcagaagcaucauuggcaaaugcaaggaaauuauugugauguacccucacuuaagacuccagugcaucuaaguguguuaguaacugauuauggagagcaccuuugugcuauuaucagaauuccugggugugggaaacuucuauaacugugcaacuuuucuaucuccacgucagugcacaguauauggacauuuauauuuucuacuaacacaacugacauuccacucccgucaguuuaguuucccccaguaccacuguuuugaccacuuucacacuucugucuauagugcuuuugcuaagaaggaaucugcuaaauucgaaugcagauucuccugcuuuuuuuuuuuuuuuuuugauggaguuucgcucuuguugcccaagcuggagugugauggcgcgaucucggcucauugcaaccuccaccccccggguucaagcaauucuucugccucagccuccugaguagcugggauuacaggcgcacgccaccacgcccggauaauuuuuuguauuuuuaguagaaaugggguuucaccauguuggccaggcuggucucgaacuccugaccucaggugguccacccaccuuggccuccuaaagugcugggauuacaggcaugagcaaccacacccagccccagauuauccuucuuaauuugugcuucuugccuuucguauauaucuuuuucauuuugaguuuccuugaauuaaaacuuuuuaauucaacucuuggauugcuuaauuuugaauaauuugagagaauuugggcuguucuugguuuauuuagacugaagaaguacucucggcagaguaagaaggagcacuaacugcuucuacuuuggagcaaguaucaaaggcuguguuagucugcuggggcuuccaucaugaaugaccacagacuggaugccuuaaacaacagaaguuaauuuucucacaguucuggaggcccgaaguucaaaaucaagguguccgcaggucuguuuucuccugaggucuccguccuuggauugcagaaggccaccuucucacuguccucgcaucucugugcacugcaucccuggugucucucugcauguauuaauccucucuucuuuacaaggacaccaaucagauuggauuagggccaacucuaacagugucacuuuaauuuagucaccucuuguaaagguccugucuucaaauacaguugcauucuaagguucugagaguuagggcuucaauauaugaauuuaggggaacacaauucagucuauaacaucaugggccauuccacugaaagggcguggguggacagucagaaaccugggcacaaguucucacucugccacucucuccaugggcccuaagaaaaucacuuaacccuucugauccucaguguucuaaucuguaaaaugggcauuaugacuaccaaucucaguugaguuugguuuguuuguuuguuuuugagacagagucucgcucuguugcucaggcuggagugcaguggugugaucucagcucacugcaaccuccaccucccggguucaagaguucucauggcucagcuucccaaguagcugggacuacaggcacgcccuaccaugcccagcuaauuuuuguuauuuuaguagagaugaguuuucaccauguuggccaggcuggucuugaacuccugaacugaagcuaucugccagccucaguuucccaaagugcugggauuacaggcaugagccacugcgccuggacucacuugaguuuucuaggcacuaaaaagcuuuuguucauuauaaaagccauacagaggccaggcacaguggcucacgccuguaaucccagcacuuugggaggcugaggcaggcggaucacgaggucaagagauggagaccauccuggccaacauggcgaaaccccgucucuacuaaaaauacaaaaguuaacugggcgugguggugcaugccuguagucccagcuacuuaggaggcugaggcaggagaaucacuugaacccgggaggcggagguugcagugagccgagauugcaccacugcacuccagccuggcgacagagugagacuccaccucagaaaaaaaaguaauacagaaagugaccuugcauaaacuuaguuucucauuucuaaacaaaaauaaaauguaucucauagaguuuuuacaaggauucaagagcuuuugcaugcaaauugucugcaaauauauauauauagcacuuuuuauaagcauuacauauuaccauuauuucucauccuucuuucuucuacauuucuucugcccgcucuuccuuuucugucauugccuaaaaucccuauuaaugaauaguuugaaagaacauggccagguuugcagaaagaagaaagagagauauccuuuucccucccauaaggacuaaaagaggaugucucugugcuuugaucauuaaccauggcguguugauuuuaggacaaucuauaacucucugucaauuuccuacuuaacagcuuucaaaauuaaauguucuugcuuuucuacuaacuguuaaucaucuguucuuauugaaaggucuuuaaugaauauugacuguuuacuccaaguuuauaagauuuuuggucuaaagugguugucuuaguccauuuucuguuccuuauaacagaauacuugaaacugggugauuuauaaagaaaaggaauuugucauuugcaguuauggaggcugagaaguccaaggucacggugagagccuucuugcugguggggacucugcagagucccaaaguggugcagggcaucacauggcaagggggcuguacaugcuaagucaggucugucuuccucuuauagagccaccaauuucacucccaucauaacccaugaauccauuaacccaugaauccauuaauccaugaauggauuuauccauucaugagagcagaccuuuaugauccaaucaccucuuaaaaaguuccaccuuucaauacugccacauuggagauuaaguaucaacaugaauuuuggaggggauauucaaaccauagcagugguaucuauuuaaaucuauuuacuuucaaauagauaauagcagcauguucuaugauagcaauuguucaaagaaauuuauuaaaccuuuuuuauagacagucuugggaagaauacagcaaguuagcaaagauaauaacuaagagucucaucaagaggcguguguguuccuuauaucaucaacuuccauuucuccugccuauuuuuaaggauaugaguaugugggcugggcgcaauggcucacaccuguaaucccagcacuuugggaggccgaggcaggcagaucacgaggucaggggaucgagaccauccuggcuaacacggugaaaccccgucucuacuaaaaauacaaaaaauuagccaggcgugguggugggugccuguagucccagcuacucgggaggcugaggcaggagaauggugugaacccaggagggggagcuugccgagaucacaccacugcacuccagccugugcgacagagugagacuccaucucaaaaaaaaaaaagaauauaugaguugcccauuuucaaaacaggaaaggaaaagaagaaagcacacgucccuuuuuuucucacuuguugaaggaaagagacugaaaaaucaugaacuuaugaaagauagaggaagaggugccuaaggagaaagagaauauuuaaguaagaggauuaauaccuauauaugucagaagaagaaauguagaaauauaguuuuuacacgguggaaaagaaaaguuucucuaaacuguagaccaacaaacuuugccucauccucggcaaauuucuggaaauggaugaauuacaaaugcucucuauagaauggggauuguuaaaagccagugugaguucaucaagaaugacuugaacuggacuacccacauucucuaucucauaagaccagggaaaugguaaaauaaugugucugaacuugggcaagcaauuaaccaggcauuuuuuuuuaauauucuugagacaaauagagaaaucaauucuagaggauaauauaauuguguagacucauaacuaauugaaugauaugugcaaaggguccaaauucauugacuuauauuuaugaaauauggucuucacuuagccugaccuuauuauuaauugcuaaucuuacauaaagcuaucgaggucaugauucucauauuuucugauuuaagagagaaauaaaugcuaaaugacggaauaggauccaaaauauucaucagauaggaagaggcgaaauauuucacauguauuuuaaacauaaaguuuaaauggauaugaaauauugugcuggaauuccaagcacuguaagauggaggaaaaaugacuuuauagcacuaccuguaaacaaagcucaauggaaauagcagugugauguggcugcccaaaaaugccaugagguuucugcuguuuuaauaggacugggaugucucagauaagacaagacagugccacuguacucuucacugggcauaucuuaccacacaugauuuccuuucuuaucaccucauuuuuagaaggaugugcacaaaccggaacaaggucagagagcaaggagacgagugagggaaauugacaucacgucuuaaaaggaagaaaugggguugggccugauggcucacaccuauaauuccagcacuuucagaggccggggcggguagaucauuugaggccaggaguucgagaccagccuggccauggugaaaccccaucuccaccaaacauacaaaaauuagccaggcauggcagcacaugccuguaaucccagcuacucuggaggcuguaacacaagagucacuuaaaccugggaaguggaguuugcaaugagccaagaucacgucacuucacuccagccugggcaacagagcgagacuccaucucaaaaaaaaaaaaaaaagaaagaaagauaagaaaaaaaggaagaacuuggauacuuggccugaggagaacucagaggacagagauaguuuucaugggaacacguggagcauccggagguuguuuauggucaugagggaaagagaugugguguggaaaauacgaucuugugaaaaaguagggaugcauuaguucucaagucaggaaaaugaggagguggagucaagcgaugcuacaggagacuguuugccacaaagaguugcugcugugccugccccagagcacuugggcccaaagaagccaccucugcagccucacuacucaucguggcuggguuuggucuccacagaugggcuuucacucacauggugcucaccagugcccacugcugccaucugggccagguguggagccaaaacauagaaguguuccuugucuccuacaugagcuguuccuucccaucccaaacagccaccagugggcuccuggacucccuaaggcauugacuuuuagaaaauuggguaguuuggcugggcgcaguggcucacgccuauaaucccagcacuuugggaggccgaggcaggcagaucaccugaggucaggaguuugagaccagccuggccaacauggcgauaccccaucucuacuaaaauuauaaaaauuggccgggcaugguggugcaugccuguaaucccagcuacuugggaggcugaggcaggagaauugcuugaacccgcgaggcggagguugcagugagcugagaucaugccauugcacuccagccugggcaacaagagcgaaacucugucucaaagaaaaaaaaagaaaauugguuaguuuucuaaauugcauugaaaauuuuauaaauaauagaagcccgagagaaagccacacagcaaaacuuucucucucugccaaugaaauguauuauuuucagccaccucuuuuuaaaaacaauauuaucuucauuccuguacccuucauuuugcuuuguauuuuugagagcgcugguugccuuaaaaucaguaucucaaaucucuggcaaaguuccuucuguuucuuugacucuaugacccugauauuuucuagagguagcuggugucaauuugagaagcauccagaggagugaauagaaaagaggccuuagcauuaaaaagacuaaauuuaaauccuuguuccgccacuuccuaacugugugaccuugggcaaguuaauacacaugcugagcuuggauuaaucaguggaggcuuguaggacaccuacugugauggcaaauucuguguuuguuucuagcaggagagauuuuaaaaagaaguuaaagaaaaaaauaugugagacuaugauauucucccauauuaucaaaaacacuuauuuuccucaauguaggaauagugcaagccugucgacccagcuauuuuagaggcugaagugggagcaucacaugagcccaggaguucaagaccaggcuuuaagagacccugucucuuaaaacagauaacaaauguaaaguuuauaggaaagauuacaucauguugauucagcaaauauuuuccucucuuauuucucccuuucuuuucuaucuucccuucuacgugaggcccuuguuuauggaggaaugucauacaaggguacucuucuugugcauaucgagacagaccuauagaugcuuugagcuauaauauuccauauucaucccugcccuggaggcauuaguaaucucuugagccaggcacaguguacacacuuguagucccaucuacucaggagauugaggcaggaggauuacuugaacucacugcauuacagccugagcgacauagcaagaccuggccucuaaaaaaaauacauaaauaaucucuugaguaugcuaugacauuucccaagccuguggccuuaucauauaaacguacagcauuuucuaauuccauucugaucauuucaaauaaacacuuuaauuuuaugauaaaaugucuuauuacuguuacuaaagaccauaaaaaguuuguaguuacaaagaaguuauuugacuaacucauuauguuagaugucagccuagauaucacaaccuccaggaagcacucccuaaccacuuagauuuaguuguguuugguuaguuagauuuaguuauguuugauuaguuagauucagucuaauuuaauuuaauuaacuuccgcugugagguccuguaacacccuacacuuucccuaucauaggaggcaauacagugauacuucugcaaguucagcucagcccuuggaccauacaauccuggauucaaauugcaccucuaccuccuaguggaguuugucaaguuacuuaaccuaaguuccccuuuccuuauagaugaagugagauuaauaaaacaggguuauagaagagcauguauauuaagugccuauacagugccugagacaucguaaacaauaaauaaguacuagaugcugucaucaucaccaucaccaucaccaucaccaccaucaucaccaucaccaucacacuucaauguaguugcuuauuaaauaugcuuaucuuccuugauaaaacagagaccacauuuucucuguucaccuuuuucccccugcugccuaacacaguuucugacacaaaauaggaguuuaguaacuugacuguugaaugguuuagacaaacccugguggccaaacaacagcaauggcuuuguggguucuacaaugccugcuccuucaugcacauaguugucaucuuuuauuccccccaaagcaacgagauguggucuaguuccuucaagggugagccuagcagaauagauccuagacggagcaggggagaucacucagagccugcagcaucucagagcuacaagggacuuccucagccucccaaccuaccuccuucauuuuacaaaguacauccuaagacacauccguggcucagccaggcuacaauugacacaacuggagggcuguagacccgagaagagggauuuagaagacaacugagucagagcaauguagcuacauuuuaguuuaauuuuuuaaguccaucaccauuuuaucuaugaaauuuguuuuuuauucuuuaaggauaacacguagcuaagugcuuauaaauaauaaaugaaaaauaaucaucauuagcuuggcuaggagcaguggcucacaccuacaauccccacaucuugggaggccgaggcaggaagacugcuugaggcccggaguucaagaccagccuaggcaaaauagcuagaaccugucucuacaaaaauuuaaaaaauuagcagggugugguggugugugccuguggucccagcuacucaagaggcugaggcaggaggaucacuugagcccaggcguuggaugcugaagugagcuaugauagccaccuaggcaacagcaugacauccugucucaaaaacuaaauaaauaggccgagugcaguggcucacaccuguaaucccagcacucugagaggccaagguggguggaucacccgaagucaggaguuagagaccagccugguuaacacggugaaaccccgucucuacuaaaaauacaaacaauuagcugggcgugguggcgcacgcuuguaaucccaacuacucgggaggcugaggcaggagaauugcaugaacccaggaggcggagauugcagugagccgagauugugccauugcacuccagccugggcaacaagagcaaaacucuugucucaaaaauaaaauaaaauaaaaaauaaauauuagccagagaugauguuacuucuaaugaaggaaaaagugauauucacuacaaauaagaagaaugucuaccaccucucuagcauuucauuaagggaguacacugugguucugaucaccugcugucugaauuuuaccauaaauuauauuuugaaugaauaauaaucugugacuguauuggcaaaacaaagucaaauauaugagauauuuuuaaaagauguaagccauuuuaauacucuaguuacucuaauucuaaggaucgcuauuccacagaggccacuacucugcuuuagaagaguuucauuauaccucccuggcaauguaagacauaaggaauccagagugguuuuuacauccauugcauuuacccaaauacaccaucggagggcagcacacaccugguugacuuaacugccugucugguggccuuaucaaaauaguugucaaauuagucuaagacauuccuaaauuaccacucagauaggcaggaaagcuguuggagaagacaaaaggagcaaagauuuuuaaaagacaaaagaaugcauuccuuaagacucugaguuucuacaaaagggaaucuggagcuaaucaaugcugcaaaaugggaaaacggaguuaaaaaaggaauuuccucaaucugagaaaacagauuuguuauauuugaaagauuuuuacugaguaugaucauccgaacaccagcuacuaaacaaaaaucagaucuccuuguuccuauuaagaugcgcuaauuaauaagauggcaacaaagaccaccauauaaaaggguuccuucaguaauguuuucuugagugaacaaaaaucaagccugccuuauauuguauucuacuuugcaucacaaacaguuuuaguguauuucuggaaaagcaucagcaguuuuuucgaauuuuaaauucuggaguuauguaacuauauaggcaggcuuuuuuauaacagaauauaacagugauacuuaaauagaagacuucaaauguaaauaucaguagagccucguuaaggcuauaaauccagacuuugugauaauguggauuaaauauuauuuacauaacauauaaggaggccgggugcaguggcucacgccuguaaucccagcacuuugggaggccgaggcagguggaucaccugaggucaggaguucaagaccagccugaccaauauggugaaacccugucucuacuaaaaauacaaaauuagccgggugugguggcacaugccuguaaucccugcuccuugggaggcugaggcaggagaaucaccucgggaggcugaggcaggagaaucgccugaacccaggaggcggagguugcagugagcugagauugcaccauugcacuccagccugggcaacaagagcaaaacucugucucaaauaaacaaacaaacaaacacauauaaggaaagggauuugcuaagcaaauacagucuaagcaguuggcaagaggaaaugcuucaauuauuuaagaauaauuuuuaaguuuaauuccaauuuuaacuuguuugcaaaaaucuuuuuggagaaauaugacguauaugcauuucuaaccagcuucuugcaugauucuaauauagucaccuaguaccaguaaacagacugcucuuugauuuuuuuuuagaacaccaggcacuacuuucuuggaguagaugauuaacccagcuaaagcuugauuuuuacuagcuagcacuuuauuaaccuaguguguuauauugugacuuuaaaaugguaaaaacaauuacaaaguggaguucucauucagguuagcuuucuaguccaagucacuaacaauuuacuauguaauagacauucuaagauuucugccaacaauucuauugucaauauauaaaaucaauuuucagaaaacuguaaagauuauuuccuuguuuaauuaagauucuacuaaucauagaaaagauuauauugcacacuuuucucaaguuaccuaugggacugacaauauguccauguguccugauaguaaagucaguuaucugaaugcguuccauuuuggaauaagagaucuaagugcuaagcaaguaaccaccaccacauucagguuuagaauuggaagaucuuucauuauauuaauagacccuuuauuuuuagauauaacaaaauaccaaagacaaauggccacauauauccuaauguacuugagaaaucucgcuacuaaugcugugucacuaauuuuuuaauacuguauuuaagaaaaaaaaaaaagccugucuuuucuauuggcaucauucaagaagaaaaaaaaaaagcugaaucaggauauuucugugugaaugcacauuccucacuaaaucucucaggcagcugcuuuagucacuguuacuaacaccuugcucugucaucucuuuguacacaugucuaauuuaucaguuucuuguagauugucagcagccugcugccuccguaccgccacagugcucacaacuagccgggaggcaagacugcccaacugucagguaaauucagauguccuuucccuuccacccagcugcaugucagauccauagaccccagcuccccuuuccgacaccugaacugccuacgcaucauuguauuuugcuguauuuuauuucaagugugggcuacauagacacacauuggacaccugcagucccugcguucccaguaggaauacaagagagcugggguuuauuuugcuggcugccagcugguagacucuacaggcugccuucagccccuuugucuguguaaauacuuggauuaguccacuguuucauuccuuuccaaaaaauaaaagcuggaauuguuaugauguuuguccuacuuuuuauuuucuuuugucuuuaaaauauauuuauuuuccuggggaaucugagggauaccaauauacuaauugaccugauuugauuccuguacuuuauauguauuaaaacaucacuauauacuccaugaauauguacaauuauuauuugucaauuuaaaaaaauaaaauccccgcuacucaggaggcugagguaggaggaucaaucgcuugagccugggaguucaaggcugcagcgagcuaugauaccacugcacaccugccuggugaguaagaaccuguugcuaaaaaacaaaacaaaacaaaaaacacaguaaaauaaaacuuaaaguguuuaaauaggccaggcaugauggcucacacccguaaucccagcacuguggaaggccgaggcagagggauuaccugaggucaggaguuugagaccagccugggcaacauggugaaaccccgucucuacuaaaaauacaaaaauuagcugggugugguggcacaugccucuaaucccaccuacucaggaggcugaggcaggagaaucacuugaacccaggagguggagguugcagugagcugagcuggugccacugcacuccagccuaggugacagagagagauuccaucuaaaaaaaaauaaaaaauuaaaaaauauauaucucaggccaacaaacaggaagaauauaaagaauuagauauaaaggcugggugcaguggcucaugcugguaaucucagcacuuugggaggcugaggcaggaggauugcuugaguccaugaauuugugguuacagugaguaaaaucacaucacugcacuccagccuggguaacagagcaagacccugucucuagauaaauagauagauagacagacagauagaacagcuguauaaaaguguuucuguguuucuguucucuguccacucaguagccuugguaaaacugaauuugaaagguggagaaaaacauuguaguuagcauucaaaagauaauauuugcugugacagugaccuuuaugugagauuacuugaaaaauuguuaaaacagguuugcacaguccugaacacugaacuggagaguuugcugacaauuccgauuccaaaggaaagcuuuccaaaucagucaugaauugcccuccauccuggugaaccuccacacagcgucucagcguuccaucaggaccucaccuccauccuggaaugcuucaucuccagccaccuggccucugauggugccagaccucaguaguccgguugugguuuucaucaucugcucaguguucucuccuuaucacagcuguugcccuucuaccaggggaaggcuucuuuugagcaggggcaggcccaaacacuuuccaugugugucugaggaguagaugucaguagcaagcuacauguggucaggggucagagccaggggaccuggggugccacaaguguggaaacacaguggcagcugaagcccaagugucacauggucucagaggcgguugugcagccagcuguaucaguggaacauugaguuagcacagaaagguacauuauuggccaggugugguggcuuacgccuguaaucccagcaguuugggaggcugaggcgggaggauggcuugaacccagaacuucaagaccagccuggggaacacagggagaccuccacccccgaccucuaccaaauuuuuuuuuuuuuaaauuagccagguauaauggcacauggcuguagucccagcuauuugggaagcugagguuggagggucacuugagcucgggaggucaagacugcagcaagcugugauugcaucacugcacuccagccuggguaacagagugagacccugucucaaaaaacaaauaaauaaauaaaaagaaaaauacauuauaaaauagguugcuagccagcaguuuccaauugguguguguuaguugauuguucccaccaccuucagcaacagggcuuuaagaaagguuuuucgcuaaugccauuuuacaacagcacuaauuucgguuagaaauaauaaugauaggucaggcgugguggcgcaggccuguaaucccagcacuuugggaggccaaggccgguggaucacaaggucaagagaucgagaccaccuuggccaacauggugaaaccccgucucuacuaaaaauacaaaaauuagcugggcauggugaugugcgccuguaaucucagguucucgggaggcugaggcaggagaaucacuugaaccugggaggcggagguugcagugagcugagaucacgccacugcauuacagccuggcgacagagcaaaaaagaaaaaaaaaaaagaaauaauguaauuauagauuuaucucaauuauauaaguaacaauauaaauauucaaacucgucucagugggauucugaauuuguagcgguuaagaacagggcucuucaccuacaguccauucuccaccaagcacccccagcccuuaccccaaggccugggucagugcugggcacaugacagcugugcacuaaauauugauuauaccugagagagugaaugagcucuggaaucagauugcuuggguugaauucccacuucuaauacccacugguuguuuaacuuuggaaaauuucuuuugcuggcuaagauuccauuucuucacuuguaaaguucagaugacaauagauacugagggaauucagcgaggcacgcuccuggcuuggagugucugcucaguaucuguuaucaauacuuuuuuaguaucuuaccauuccucaagacaaagaucugcaaucucuuaaccucucuaauuugcugaagaaagcguggagcgggcugcuguuuuguuugcuucagagauugggucuggcuauguugcccaaacuggacuugaacccugggcucgagcaaccuuccugccucagaagacuacugcuugaaguguuuccauuaaguaggaaauggaaaggcuggcaggagauuuuuuuaacuuuuuuuuuuccaccuugcuuguuuuuugagaaccaguuugacuaaacaauuauguagucuaguuccaucuguucugagauuaauaaauuuagguugcuuacuacuaccacagggaugauuuacuuuaaagaaaagcaauuuaaugaauuacaaacauuuccagcuucucaaauguuuccaguuucuacccacaugaauacagccuggucuagagcccaauucuacuacuguuccccaucguggucuacguaaagaaaugauuaaaugcauauagaucugaaaagacucuuuuccaaaauugcugggaugaugacugacucuuuucccacccauacacacugccaaaugggucaauguuaauaccuucauugcccuuuuuacuccuucuuggcagaaaaguuaacacauagccaacauucgaauucuuaguauaaaccagacaaggguucauuucuuuacacauauuaaacauuacagccuuccauaagggauaagcacaguuauuacacccauuuuuguuguuguuuuuguuuguuugguuuaguuuuuuggcguuuuuuuguuuguuuuuguuuuuguuugagacagagucucccucuguugcccaggcuggagugcaguggcgugaucuuggcucacuggcaccuccaccuccuggguucaagcaauucuucugccucagccacccgaguagcugggauuacaggugugugccaccacacccagcuaauuuuuguauuuuuaguagagacaggguuucaccauguuggccaggcugcccuugaacuccugaccuccagugaucugccugccucagccuccuaaaguacugggguuacaagcaugagccaccacaccuggucuuacacccauuuuuaugugacgaaauugagguuugggaagguaaaaugacuuguucaaggucacauauccugaacacaacugagccuagugacuccuaccuaccaccacagguggcugcacugcagaggagaaaucuauuucaguuacacugugaggagcaaagucagaguauguaaaucacccaccaugauuccuuuucccucaaacugaagaggaauguuuguuuaaugagaaacagaagaugugcuaagaauguugaguuauuucacaucagguguucuguuucucauuuugaaaaaugauuuugagugcugggcccaguggcucaugccuguaaucccagcacuuugggaggccaaggugggcagaucaccugaggucaggaguucgagaccagccuggccaauauggugaaacggcaucucuacuaaaaauacagaaauuagccaggcaugguggcaggcaccuguaaucccagcuccucaggaggcugaggcaggagaaucacuuggaacagggaggcggagguugcagugaaccaagaucacgcuuggacaacuccagcuugggcaacagagugagacuccaucuuaaaaaaaaaauuauuuuguacuucccucgguuuauacauauauucaaacagcuuuuaaggugaaugauuuuuuaauaaaagagcauuuucucaccuuuaacaauguagaacuuuucagccggacauggugacucaccucuguagucccagcacuuuggaaggcugaggugggaagauugcuugagcccaggauuucuagaucagccuaggcaacuuggugaaacccuguccuuuaaaacaaaauacaagaauuaggcaugguggccugcaucuguagucccagcuacucaggaggcugcggugggaggaucguuucagccuaggaguucaaggcagcagugagccgagauugugccacugcgcuccggccuggguggcagaagaggacccugucuccaaaaacagaaaaaaaguagaacuuuuccauguauacuuuuuacaggcuaauuccauuguagagcuaaauuaucaaaauuguuuauagauaauagguauuauaauaugaaaggaaugcccaagguauauagccuuggauauaauauugaaauauauagaguuguuugguauuuagcacuucccuucuaucaaguaguuuucuacuugggaaaaaaaaagaaacuuccugaagauguauccaauuuuauaucuuaguaacagcuuccuaaacuugccauuuacaacaugaucuaccuauguaaaguaaaaucaaugguaaauguugaauaacaaguggacucuugaaaauauuuagcaaucacaacugaaacugaauucauucuaugccuuaaaugauuauaauuuaucaaauauuuauauccaagaaauaguaucuuaaccuguaagccaagaaugugugucuuacagguuaauuuacacauaauauacaccaugugauugcagcauuuuaugcaaauuaaaaauauuaauacuauagauaauaacuuuauguaagaaaucuaucuaaaggaaugaaaaaaauuuaaaucaucacgaaugauguaaugucaagguguuaggcaaagugaguuguaacccauauuuaagcuauagcuacacacuucagcuggucaggaagaaauauuugucuuccuuuaucaaaaagaguauuggggccaggugcagcggcucacgccuguaaucccaacacuuugggaggcugaggcggguggaucacaaggucaggaguucgagacugucauggcuaacacagugaaaccccgucucuacuaaaaaaaaaaaaauacaaaaaauuagccagguguuguggcaugugccuguagucccagcuacucgggaggcugagacaggagaaucacuugaacccggaagguggagguggcagugagccaagaucgcgccagugcacuccaggcugggcgacaguuugagacugucucaaaaaaaaaaaaaaguauuggauuacacaaggucuucaaaaacauaucuuucuuggguggacacaguggcucaugccuguaauccuugcgcuuugggaagcagaggcaggcugaucacuugaggucaggaguucgagaccagccugggcaacauggugaaacucugucucuacuaaaaauacaaaaauuagccaggugugguggcgcaggccuguaaucccagcuacucaggaggcugaggcacuagaauugcuugaaccugggaggcagagguugcagugagcugggaucgugccacugcacuccagccugggcgacaaagugagauucugcucaaaaaaaaaaagaaaagaaaagaaaagaaaaaaaagccauaucuuucuuguguaaugugacgauucugcauuacuugccauaaaucacauugcauaauauguuuaguucccuaaaaagaaauuaguucuggugcugacuuccacagcacguauaguaaaauuggaguuuuuuuuacuauaugugcuguggaagucagcagucuaagucaugcauauuugcagaaaaacuguuaggucgaugggaaagucuggccuauaaccugcuguuuaccaggccgucaaacucuguuuggagggucaagugugaaucuugccauacauuauuuucuguuuuaaauauuuucuuuucuuucuucuuuuuuuuuuuuuuuugagacggaguuuugcucuuguuacccaggcuggagugcaauggcgugaucucagcucaccgcaacgucugccucccggguucaagcgauucuccugccucagccuccugaguagcugggauuacaggcaugugccaccacgcccggcuaauuuuuuuuuuuuuuuuuuuuuuuuguauuuuuaguagagacaggguuucuccauguuggucaggauggucuugaacucccaaccacaggugauccgccugccucggccucccaaagugcugggauugcaggcgugagccacuaugcuuggccuaagauuuucuucauuuauuuuccuuuuuuuuuuuuuuuuuuuuuuuuuugagacggagucucgcucugucguccaggcuggagugcaauggcgcgaucucggcucacugcaagcuccgccucccggguucacgccauucuccuaccucagccuccggaguagcugggacuacaggcgcccgccaccacgcccagcuaauuuuuuuuuuuaauuauuuuuaguagagacgggguuucaccauguuggccaggauggucucuaucuccugagcucaugauccgcccgccuuggccuccugaagugcugggauuacaggcgugcgccaccgcgcccaggcuuauuuuccaauuuauaaaugaggccgggcacgguggcucguguguguaaucucagcacuuugagaggccgaggugggcagaucacuugaagucaggaguucgagaccagccuggccaaaauggugaaaguccgucucuacuaaaaauacaaaaaauuagccggacgcgguggugggcccuuguaaucccagcuacucgggaggcugaagcaggagaauugcuugaacccaggaggcagagguugcagugagccgagaucgugccacugcacuccugccugggcgacagugagauuccauaucaaaaaaauuuacaaaugaaacuaugcgcuauuuucuuaggcuuuuuguugaagguccaguucucccauguuuacauaccacauuuuaaaaauagguaggaaaaacaauuuuuaucacugcuugucuuaaccaguacagaacagcaaagcuucuuuuaaacuauauuuacagcacuucaaagaguuugggaagaaagaauaaccucaagccagucagauauuuuccauaauuaugauuuuguauuaaaaugcaagagauauagguagaggauaauuucaguaccaaagauaaaaauuauuuaauacuaauuuuaaugacuccauuacauuuuaaacuccauuaaauuuaaagcuaauuuuaauuagcuuuaaaaagcuaugcuuaaauuaauaguaauaaugagccuugaauuguucucucaaacaucacuucugguagaaaugaauuauauaguacugacuuucauaguuuaagggaauauaacagaguuuuagaaaaauacucuuuucuaauuaaaaaaacaaaucuccauguugugauucccccauugcuagucacauuuuuuuuuuuuuuuugagacggagucucgcccuguugccaaacuggaguacaguggcgccaucuuggcucgcugcaaccucugccucccauguucaagugauucuccugccucagccucccgaauagcugggacuacaggcacacgccaccauacccagcuaauuuuuuuuuuguauuuuuaguagagacaggguuucaccauguuggccaggauggucucaaucucuugaccucauaauccuccugccuuggccucccaaagugcugggauuacaggugugagccaccgcgcccggccgcuagucaaauuuuaaaaggcccaaacccaaauguguuuugucauuuuacccuaggaaacucaaugauuuugcuucuuuauucuucaagauuauucauccagacccugauaggccugagcacagguucauuuaaacuagaggcuaucacaggcgucguuuggaaaguuacauuauacacuuaacaaaugggaaauguuaggcugggcucgguggcucacgccuguaaucccaacacuuggggaggccgaggcagguggaucaccagaggucaggaguucgagaccagccuggccaacauagcaaaaccccaucacuacugaaaauacaaaaauuggcagggcaugguagugcaugcauguaaucccagcugcucgggaggcugaggcaggagaaucgcuugaacucgggaggcggaggcugcagugagcugagauggagccacugcacaccagccugggcaaaacaacgagacuccaucuaaaaaaaaaaggggggggggggugaaauauaaaacucuuccuuauaccuccaagcccaagcagguagggggaauucuuagagcaaauuagacuuccacaggcaaauucuuuauccuagugaaucuggaucuaccagauaacuauagaauccucuaaacuccaaagccuuggucaaccugucaguaccaucagcaucacugggagcucauuaaaaauguagaaucucagaucucaccccacaccuaaugaauccgaaucugcccuuuauacugagcuccccagguaauuugcaugcauauuaaaguuugaaaagaacugaucucaugaaaucuuacagcuaacacagagaccuaggagaacaagaccgugcaaaaauugagaagaacuucuguaaaaugcugggggcaagaaaauagggaaaacaagaaaagagaagagugacuuugagggaagagugcauauaucauuuccuuaauacauuucauuuuucuuuuuuaugccuuguuuugaaaagcuaccauuaucuuggcaugcuuuagauggaaaccauuuacugugcagauuucuguucuuguucucaaaaucuaugcaaaaauaucucgucuaaccccuaccauugugccuggcccuuugaaauguguuucuugcugacgugcuuguuucuccuuuccaguccugacacagcucucccugaggagcagccacauuccagcucccagugcgccccucuccacugucucuccaagccuccucaccccuagucuucaucuccuguggacgaacaucugggguggaaguuuuguagccacacacaggauacugcccaagauccagcggguguuuucuucucgguuguuagauguacaauuggauuaauguccaucguuuuggaagacgagagaaaguugagaagaacacgaagcacagacccugaugugauaaaacauuuugugguuucucugagucacagauaaacuucugccaucaaauggcuacaguucauuuaaauuuaaaaaaaagaaaaaagaaacagaaaacgugucucagauggcuggcuuuaccucgauagcauaagagagaccuaagacauguaaaauacguauauugcaguaucaucuuuccucacacuccaaauucagcuagggaaguugauuccaauauguuugucauugauauuuauuuuguacuuuauuugcuacaugauuuaugucuauacaaauaauuucucugaggugaauuuaauucauuuauuuucaaauaagcauaauuugcucaauuaaguaugaguuugaauuuaguuugaaaucuggaauuggccagacuguggucauuuuucuugca

SEQ ID NO: 191713 - RNA, 8213 nt, Homo sapiens
ccgcccccacacuccgcccagaggggccucagcuuuuccaccacugcuuucuaguccuuuaacuccuagaggcaaacuuuugggggauaagaaagccugggaggggccugugccaaaacccucucugccuggggacugggcggugauuccgcuucugccugggcuccugccauggcccccgagaggggcugacacuuuagcucccggugcagguaaaggggccuuaugccagggcuugccagggguggggccuggacuccugggucugagggaggaggggcugggggucuggacuccugggucugagggaggaggggcugggggucuggacucaugagucugagggaggaggggcuggggggucuugacuccugggucugagggaggaggggcuggggggucuugacuccugggucugagggaggaggggcuggggggucuugacuccugggucugaggaagaaggggcugggggucuggaccccugagucugagggaggaggggcugggggucuggacuccugggucugagggaggaggggauggggccuggauuccugggucugagggaggaggggcugggggccuggacuccugggucugagggaggaggggaugggggccuggacuccugggucugagggaggaggggcugggggucuggacuccugggucugagggaggaggggcugggggccuggacuccugggucugagggaggaggggcugggggggucuugacuccugggucugagggaggaggaagggcuggaggucuggacuccugggucugagggaggaggggcuggggggucuugacuccugggucugagggaggaggggauggggccuggauuccugggucugagggaggaggggcugggggucuggacuccugggucugagggaggaggggcugggggucuggacucaugagucugagggaggaggggcuggggggucuggacuccugggucugagggaggaggggcugggggccuggacuccugggucugagggaggaggggcugggggucuggacuccugggucugagggaggaggggcugggggucuggacucaugagucugagggaggagggccugggggccuggacuccugggucugagggaggaggggcugggggccuggacuccugggucugagggaggaggggcuggggucuggacuccugggucugagggaggagggccugggggccuggacuccugggucugagggaggaggggcugggggccuggacuccugggucugagggaggaggggcugggggucuggacuccugggucugagggaggaggggcuggggggucuugacuccugggucugaggaagaaggggcugggggccccugacuuucgggucuggggugggauuaagaaagcgaagaucuaggacgccuaggaccugagggcgaaggaggagguggcucuacggacccggaugccuggcuccugaaucucccuccggguuccacaugacacuuuccuuaccaggugagaacccgcccggaggaagaaggaaggcgcgggccggggauuaggagacggaggcggacucggagccagggaaccagggguccgggcuagagcuggagucgugagcgcgcgcccgccccgcucugggaggaccgcgagguaaggcgcgguggggacagggguccugggucccggucgggagggaaaagggccgcugaauucccggccgcagccacguggcugcaggaagcgcgcagugaagcccucgccgggccgggggucuccccaucuggggucccccgacccggcugcaccgcaguucccacgggucugagaaccaguugggccggaucuagaguggguuguuauuuccguccuggcggggccgggacugagagaggacagaggugaaccagcugugcccgccacccugcagcuggagccguggcccugccccagcaggaaagagaggggugggcggaggcggggggagaacgcgcggcccgggccuccccgggcuccacggucgcgccccgcuuucugccuguuccacguuggucacaaacaacagccccucugucccgagcccuggcagcgugagggacuuuuuccgagcaugaccucauugcuuuaaacacaauucaaccagagggaggucagaggcuucuauuuaagaggacacgcaggcuggcagaagugaagcgacuuacccagggucucagagcuagggcgcagagguggcauucgaaaacgacuuccaacucguuguucuggucuggacuggagaggaaaaaagacaaucaagggugucagaggaaaucucucgccuucauaucaaaucagaacauuauuauuuuuuuucucaugggguggcaugcccguagucuccuauggggagcuaagaguucgucuggauuccagaucuggagcgcagcauuugcuacugugugacccagggcaagugacuuaacuucucugugucucagccaucgcgcaucuguaaaauggaguuguccugaagauuaaauaaauuaguucauucauggggaggcacucaggcuggugccuggcccaggauaagcacuuggaaaauaaaauuucggcacccucaguguagucuuucuuucuucccuuucuuucuuuccuucuuuuuuucuuucuuuuuccuuccuuccuuccuucuuuccuuucuuucuuucuccuuccuuuccuuucuuuuucuuucucuuucuuucucuuuccuuccuuccuuccuuuuuucccucccucuccucccuccuuuccuucucucucuuuuucucucucucucuccuuuucuuuucuuuucuucuugagacagggucucuuucuguugcccaggcugaagugcggugggacgaucauaccucacugcagccucaaacuccugggcucaagggaucuucccuuuucagccucccagguagcuggaacugcaggugcaugacacagcaccuggcuaauuuuuuauuuuuauuuuuguagagagaucaucucacuuuguugcgcauucuggucucaaacuccugggcucaagugauccugcugucucagccucccaaagagcuggcauuguaggugugagccacggcgcccagccacaaacaagaguuccaaccccuguuuuuugaggaguaaacugagcuuuaggcugaggaagccaguuugggaucgcacaagaaggaaauggcaaaauuugagcccagaugugugugaugucagaaaccaagacuuuauguguguugccaggugcugaaaagugguggcaacggauagggcaauggaagggggaugcgaggugcaugcugggagcugggucugaccagaggcaggggcugagagcuguccacgagucaagaggcagcagagaguggaggcagccagcucuagacacuggaguucccuagagcuggcuuugugaucuuggucagucacguccugucucggaucacccauuuccuucucuggaacacugggagaaugauccgaggugugacuccauugagcauauguuaauugaacauucccugugcgcugggcacugugccaagacuugcagggacauaucccuccaccaauucuugcaaaaggacugggaaguauuagauuaauaucaugccauuuucaagauaaggaaaugaggucagaaaggucaaguaaguugcucaaagccacagagcgaucagcacagccagauucaaaccugugcaauggacuuucugaauuccacuuuuucaccucugacccacagcagagcaagugcugagaucauaggcucuguuagcagcuagagaggauuuuuuuuuuuaaacuguggauccagaagauacauuaaugagcugagcucaacauuuaaaaauaaaauagauuacaauagaaaauaucagaguaggggccgggugugguggcucaugccuguaaucccagcacuuugggaggccgaggugggcagaucacgagaucaggaguucgagaccagccuggccaacauggugaaaccccaucucuacuauaaaauacaaaaauuagccaagcaugguggugugcaccuauaaucccagcuacucgggaggcugaggcaggagaaucacuugaaccugggaggcggagguugcagugagccgagaucgcgccauugcacucuugccugggugacagagcaagacuccaucaaaaaagaaaagaaagaaagaaggaaggaaggagaaagaaagaaaagaaaggaaggaaggaaggagggagggagggaagaaaagaaagaaagaaagaaagaaagaaagaaggaaggaaggaaggaaggaaggaaggaaggaaggaaggaaggaaggaaucagaguaucuaccacguuguaagacaaguaaguauuggccgggcuuacuggcacacaccuguaaucucagcacuuugggaggccaaggcgggcagauugcuugagcucaggaguuugagaccagccugggcaacauggugaaaccccaucucuacaaaaaaaaaaaaaauacaaaaauaacacuacaugguagcaugagccuguagucccagcuacucaggagucugaggugggaggaucgcuugaguccgggaggcggagguugcagugagccaagaucucaccaccgcacuccagcugggugacagagugagacccugucucaaaacaagacaaaucuuguuucuuaaaauuuuuguuuccauuauggggaaggagagaguggagauugugugcuagguaacgauaaaaauauauuuauucaucuagguugaggucagagaaauuugauaaaugcugcagagguaguaaaucaaaacugguuuccccauggaaaucaauguaaagaguguguguguguguguguguguguguguguaggccagucuucagaaucuagccaucuacaauuauuuuaaaucccuuuggcuuucauuuuccuccauauuaucaccaauacuucccagggugccuguuacggugaaaacaaugucagcggcuuugucuuucucauaguguucuauccaaccuaauuuuuguuccacaauuauuguuagggaaauauuuuccccccaacgcuagcauuacccauugguuagcacuauuacaaguauaguuuucuuugaucagacuuuucuauguauccugaaaggaagguaguguuauuuuauuuaucuuacagauagaaaaguaaacagggaaauaaaguaauuuauugcaguucauacagcuggcaaaggguagggcuucaacugaaauagguuuuuauuauugcgauaacagugacuguuaaaacaaaaguacaaggucaucaaagucccucccagaaguuccacacaaaacaugcaaugaccaggauaugggcagacucuguggcugcguuucuauuucauauugaauuuaggccgggcgugguggcucaugccuguauucccaacacuuugggaggccaaggcaggcggaucaccugaagucaugaguuugaguccagccuggccaacauagugaaaccucaucucuacuaaaaauacaaaaauuugcagggcauggcagcgcacaccuguaauuccagccacucaggaggcugaggcaggagaaucgcuugaaccccagccugggcaacagaacaagacuccgucucaaaaaaaaaaaaaaaaagaauuuggugcagcuaugggcaauaaagcaccuaguuuacaaugcagaugcugccagcuucaaauuuaugcaauucuucccauuuuuuuuaacauagggcuuuuuauuuuuuuuuugagacagagucauacucugucacccaggcuggaaugcaauggcgcgaucucagcucaccgcaaccucugccucccaaguucaagcgauucuccugccucagccucucaaguagcugggauuacaggcaugcaccaccacaaccagcuaauuuuguauuuuuuuuuuuuaguagagauggaguuucaccauguuggucaggcuggucucaaaguccugaccucaggugauccacccgcuucagccuccgaaagugcugggauuacaggugugagccaccaugccuggcuagggaauuuauauuauuauuuuagaaaacauaagacaucauauuguuagguuguagucucaagaucagguacaguuggccaggcgugguggcucaugccuguaaucccagcacuucgggaggccgaggcgggcagaucacgaggucaggaguucaagaccagccugaccaacauggugaaacccugucucuacuaaaaauacaaaaauuagcgucucaaaaaaaaaaaaaaaaaaagaucagguacaguugccccuugguagcagugaugggacugguucugggaccccuauggauacccaaauaugcagauguuuaagucucuuauauaaaugcccuaguauuugcauauaaccuauguacauccucuccuauacuuuaaaucaucucuagauuacuuauaaugcauaauacaauguaaaugcuuugcaaauaauuguuauauuguuugaaacuuguacucauuuuuuauuacuguauuuuuuuccccaguauuuuuuaucagcaguugauugaaucugcugaugcggaacccacagauaccaaggacuguaauucaaaucauaaaaugcacccuaggcaaagcccaccugggccucuuccucgugugcguggugggcucuaggcaggaucugcuuugcuuaauggacagagucagcccugucuucagaacaggagccugggaauuuccauuuuugacaagcuggaguuuucuuuuucuuuuuauagagacaggguuucacuccuguugcccaggcuggagugcaguggccaauacagugacacgaucucggcucccugcaaccuccgccuccgggguucaagcgauucuccuacuuuagcugggauuacaggcaugcgccaccaugccccgcuaauuuuugcauuuuuuauagagaugggguuucaccauguugcucaggcuggucucgaacuccuggccucaagcgauccgcccgccucggccucccaaggugcugggauuacaggagugagccaccgcacccgggccaacaagcuggaguuuucuaucagucaagucugggaagcacucugaaggguuugugaaauauuuguuacuugaccucuaggaaggcucaaguauucgcucucaggaggaucggcauagcaugguguucauaggcauucuggagucagguuagauccaaaugugagcucagcagcugugcccaugggaccuccuggagucucaucuuaccccaucugugaaacgggaggccgggcgcgguggcucacgccuguuaucccagcauuuugggagacugaggcggguugaucaccugaggucaggaguucaagaccagccuggccaacauugugaaaccccgucucuacaaaaauacaaaaauuggcuggguaugguggcgggugccuguaaucccagcuacucgggagacugaggaggaagaaucgccugaacccgggaggcggagguugcggugagccgggauggcgccauugaacuccagcaugggcgagacuccgucucaaaaacaaaaaucaaaaaacaaaaaacgggaaccgucccccaucguccuuugagcagucgcguggcugcgagccccgggcuggggccgcgcugacccucccgugccccucgcagaugcccgugcugaagcagcugggccccgcgcagcccaagaagcggccugaucgcggcgcccuguccaucuccgcgccgcucggcgacuuccggcacacgcugcacguggggcgcggcggcgacgccuucggggacaccucguuccugagccgccacggcggcgggccgccccccgagccccgggcgccccccgcgggggccccgcgcuccccgccgccgcccgccgucccgcaguccgcagcgcccucgccugccgacccgcugcuguccuuccaccuggaucuggggcccuccaugcuggacgcggugcugggcgucauggacgcggcgcgcccggaggcggcugccgccaagcccgacgcggaaccccgccccgggacgcagcccccccaggcccgcugccgccccaacgcggaccucgagcugaacgacgucaucggccucuagguucccucauuccccgcgcccuucccgcccggcaccccacuucuguauacauaaacggccaaggugugugcccgg

SEQ ID NO: 191714 - RNA, 18894 nt, Homo sapiens
gauccccgcccccuccgcccgcgccccgccccucgcagcccaguuccggacgcgggcccagccgcgccugcgccuccgcucgccuguggcugcgucgcgcgcucuuccucggagcuacccaggcggcuggugugcagcaagcuccgcgccgaccccugacgccugacgccuguccccggcccggcaugagccgcuaccugcugccgcugucggcgcugggcacgguagcaggcgccgccgugcugcucaagugaguacauucuagccccgcgugcgcggucaaggcgggcccccagcgcaggggccgggaaggcggcggagacccccgccccucgcacccggguccaggccccguagcucccgacccgcagugcccgcccggaguggggcaaaccugcgcucuggccggccaggucaccggcccaaggucacucggagggaagggcgagccugggcccuuguaaauguugcuuuccuuccagacuuuuaaacucuuuauuuuguuguuuuguauuauuuauuuguucguuuauuuuuaaaggcagaaucuggcucugucgcccaggcuggagugcaguggcgcgaucuuggcucacugcagccuugaccuccugggcucaggugauccucccaccuuggcguccccaggagcugagaucacacgugcgccaccacgcccggcuaauuuuuguauuuuucgcagagacgggguuuugccauguuggccaggcuggucucaaacaccugcccucaggugauccgccugccucggccuccaaagugcugggauuacagacgugagccaccucgcccagccuacuuaauuuaaacuuucuuaaaaauuagccucuguggcugguggccacuguauugcauggugcccuucucuccugugggugcagugcuguuuaccugcucagccuccuguugcuggacacuaucuuguugccagcguuagccucugugggacauggguguggugggcagagucgugacuccguagagggguccacguccuaauccucggaaggugugacgacauuaccucacgugucagagguucucgcugauguguuaagugaagcaucuuuuuuuuuuuugagacagaguuucgcuguuguugcccaggcuggagugcaauggcacgaccucggcucaccacaaccuccaccucccggguucaagcgauuguccggccucagccuccugaguagcugggauuacaggcaugugccaccacgccugucuaauuuuguauuuuuaguagagacgagguuucuccauguuggucaggcuggucuugagcucccgaccaaaggggaucuggccaccuuggccucccaaagugcugggguuacaggcgugagccaccgugcccggccaagugaaggaucuuaugauuaucauguagucuuuuuuuuuuuuuggagacagggucucucugucacccaggcuggagugcagucaugcugucacagcucacugcagccucacccucccugggcucaggugguccucccacuucagccucccgaguagcugacucuacaggcgugcaccaccaagcccugcuaauuuuuguauuuuuaguagagauggggugucagcauguuggccauggcuggucucgaacuccugaccucaagugauccuccugucuuggccucccaaagugcugggauuacaggugugaggcacugugccgguccugccuuguagucuuauaggguccuuauaagagggagcaggaggcucagucagaggggagauggaagauagaaggagagguuguugggugugguggcucacgccuguaaucgcagcacuuugggaggccaaggcaggcggaucacaaggucaggaguucgagaccagccugaccaacgugguaaaacucugucucuacuaaaaauacaaaagaaauuagccaggugugguggcaugugccuguaaucccagccacucaggaggcuaaggcaggagaaucgcuugaaccugugaggcgaagguuacagugagcugagauugagccacugcacuccagccugggcgacagagcgagacucugucucaaaaauaaauaaguaaauaaauaaauaaauaaaggagagguuccagugaggaugcagguugaagauggaggcggggccaagaguggaggaauguggcggucuguaggagcuggaaguggauucuucccuagagccuccagaaggaaccugacucuaccaauaccuugauuuauuccagugagacauguuuuggacucuugaccugccgaacuggaggaggaugcacuuaugugguuuuaagccacuaagucugugguaaugcguacagcagccuugggaaucucgugcagcgggcauuuuaaauuuaaauuuaaauuuuuuugagacagagucucgcucuguugcccaggcuggcaccauuucgacucacugcaaccuccgccuuccagguucaagcaauucucgugccucagcccccugaguagcugagauuacaggugugcaccaccacgccugugaagggguggccugccccuccacaccuguggguauuucuaguugggugggacgagagacugagaaaagaaauaagacacaaaguauagagaaacaacagugggcccaggggaccggcgcucagcauaccaaggaccugcaccggcaccggccucugaguucccucaguuuuuacugauuauuaucuucauuauuucagcaaaaaggaauguaguaggagagcagggugauaaugaggucagcaaaaaccaugugagcaaaagaaucuaugacauaauuaaguucaagggaagguacuaugccuggacgugcacguaggccagauugauguuucucuccacccaaacaucucagcggaguaaagaauaacaaggcagcauugcuguaaacaugucucgccucccgccauagggcggcuuuucuccugucucagaauugaacaaauguacaaucagguuuuauaccgagacauucaguucccagggucaggcaggagacaguggccuuccucucucucaacugcaagaggcuuuccucuuuuaccaauccaccucagcacagacccuuuacggguguugggcugggggacggucaggucuuucucaucccacgaggccauauuucagacuaucccacggggagaaaccuuggacaauacucuguguucaagggcagaggucccugcagcuuucugcagugcaucgugccccugguuuauugagacuagagacuggcgaugacuuuuaccaaguauacugcuuggaaacauuguguuaacaaggcacuuccugcacagcccuagaucccuuaaaccuugauuucauacaacacagguuuuugugagcuccagauugggucaaaguggcugggucaaagcuacaaauuaacaacaucucagcaaagcaauuguucaaaguacaggucuuuuucaaaauggagucucuuaugucuuuccuuucuauauagacacaguaacagucuaaucucucuuuucccuacacaucuggcuaauuuuuguauuuuaaguagagacggggucucgccauguuugccaggcuggacucgaacuccugaccucaagugauccgcccccgcccccccccacccccaaaacuuuggccucccaaagugcugggauuacaggugcaagcccccucaccuggccgggaaucucaugcagugagcauuuauaaaauaaugacugucacuugcugaaggcguuccacacgccagacacuggguggagccacuuauggagaacaugacagaggucccuuggugugaugugaugaugucuguguuucaguugggguaugugagugagcucagacaagguugccugagaucauucagucaggggcacguggggugagagugggcccacaggacugaccgugccgcuucucacccucagggacuaugucaccgguggggcuugccccagcaaggccaccaucccugggaagacggucaucgugacgggugccaacacaggcaucgggaagcagaccgccuuggaacuggccaggagagguaaaaucuccccugcuuuggcucucagagagauaucuguacauccaugcucacugcagcauuauucacaguccggagguggaaggaacccaggcacccauccacagaugaacagggaaacagaauguggcuucuauagacaggggcauaugauucagccuuaaaaaggaagggcauucuggccgggcgcgguggugcacgccuguaaucaguacuuugggaggccaaagcuggcggaucacgaggucaggaguucgagaccagccuaaccaacauggugaaacccccucucuacuaaaaauacaaaaauuagccaggaguuguggugggcaccuguagucccagcugcuugggaggcugaagcaggagaaucgcuugaaccugagaggcagggguugcagugagcagagauggcgccacggcacuccagccugggugacagagugagacucaaaaacaaaacaaaacaaagcaaaacaaaaaaaagggcauugaaacagaugaaccuugaggacauuccaugaagugaaauaagccagucgacagaagagcaaauacgguaugauuccacuuacaggagcuaccuacaguuaaauucauagagaaguuggaauggugcuugccaggggucaggaggggaggggagaauggggaguuacuguuuaauggaaacggaaguuuaguuuggcaagaugaaacaauuugagagauggaugguuguaaugguugcacaacauuaggaauuauuauuauuguuuuuuuuuuuuugagauggaguuuugcucuugucgcccaggcuggagugcaguggcaugaucuuggcucacugcaaccuucgccucccggguucaagcaauucuccugccucagccacccgaguagcugggauuacaggcaugcaacaccacacccagcuaaguuuguaauguguuggccaggcuggucuugaacuccugaccucaggugauccaccugccuuggucucccaaagugcugggauuacaggugugagccaccaugcccggcccagccauaaauguuuuuaauaccaaugaacuggacacuuaaaaauggcuaagagggcgggucucgguggcucacaucuauaauuccagcacuuuuggaggcugaggcaggaggaucacuugaggccagggguuccagaccagccuggacaccauagcaacacccccaucucuaccagaguuagccaggcaugcuggcacaggugguaccuauagucccaggucacuugagccuaggaguucaaggcugaaugagcugugauggcgccagcacuccagccgcggcagcagagugagacugacucaaaaaaaaaaaaauaauaauaaacaaaaagaaaaggggguuaagaugauaaauuuuaagugauuuguauuuuaccacaacaaaaaaaauuggaggcugggcauuguggcuuauuuguaaucccaguacuuugggaggccgcgggguggaucaccugaggucagaaguucaagacuagcuuggcuaacauggugaaaccgcugucucuacuaaaaauaaaaaaauaaaaaauuagcuaguugugguaggugccuguaaucccagcuacucgggaggcugaggcaggagaauugcuugaacccaggagguggagguugcagugagccgagauugcgccaccgcacuccagccugggugacagagugagacuccaucuaaaaaaaaaaaaaaaaggagaggauggggaauccucuugccuuggccucccaaagugcuggaauuacaggugugagccaccgugcccgaccaauucagugauguuuaguauagucacagaaugaugcaaccaucuuuaaaaucaaucuuagaacaucuguuacccuagaaagaaaccugcucacuguaacuaucaagcuguaauucccucuccccacccccugcccuagaaaaccaagaaucuauuuucuuucucuauggauuugccuauucugggcguuucauaggugugaaaucauauacauagaauucauguaaaugggauuguacgcuguguggucuuucgugucugguuucuuuccccgagcacaguguuucugacggucauccuugcuguagcaugagccagugcuucacuccuuuucacggccgucuaauauuccaucucuauggauggaccacauuuuguugucccuucauccacagaugggcauuugguuguuucuaccuuuuggcuuuugugaagaaugccgcagugaacauugguggauguguuuuuguguagacguauguuuucaugucucuggggucaguacccaggaguggauuauuaauuuaaaucuuuuuccauccuggguuuucaggaggcaacaucauccuggccugccgagacauggagaagugugaggcggcagcaaaggacauccgcggggagacccucaaucaccaugucaacgcccggcaccuggacuuggcuucccucaagucuauccgagaguuugcagcaaagaucauugaagguaggagaacgcuggccaugugggaugaggacugggauaggcggcucccagggccaggcucugagaagugaaugaagcaagcaaacuuuagagcagaguuuuggcaaacuaugaguuaggggccaaguccaguugcugccuuuuuuuguacagccugcaagcaacgacuuuauuuauuuauuacuacuguuauuuugagagggagucucacucugucggccaggcugagugcaauggcgcgaucucggcucacuguaaccucugccuccuggguucaagcgcggaccucagccuccugaguagcugggauuaagaugccugcuaccauacccugcuaauuuuuguauuuuuaguagagacgggguuucaccacguuggccaggcuggucuggaacuccugaccucaggugauucuccugccucagccucccagagugcugggauuacaggcgugggccacugcgcccggcugacuuuguuuuguuuguuuguuuugagacagauggggucucgcucuguugcccaggcuggagugcaguggugugaucuugccucacugcaaccuccgucucccgauuucaaaugauucuccugcuucagccuccugaguagcugggauuacaggcacccgccaccgugccuggcuaauuuuuuguguuuuagguagagacaggguuucaccauguuggucaggcuggucucgaacuccugaccucaggugaucugcuucccuuggccucccaaagugcugggauuacaggugugagccaccgugcccuaccugaauaauuaguuuguuugagacaggauccaucucugucacccaggcuagagugcaguggugcagucauggcucacugcagucucaaccugcugggcucaagggauccucccacuucagccucccaaguagcugggaguacaggcauacgccaccacacacagcuaauuauuguuuuauuguuuuguuuuguuuuuagagcugggguuucaccauguugcucaggcuggucuccaacuccugggcucaagugauccacccaggucagcuucccacagugcugggauuacaggcgugagccaccgcaccugaccuuauuaagcauuuauugaucaagugccuuccccaccaugguuaaagaaauauguguuuguuaugggacauuuauaaaauacugcaauguaaagaagacagaacuggcugggcacaguggcucacgccuguuaaucccagcacuuugggaggcugaggcagguggaucccuugaggucaggaguucgagaccagccuggccaacauggugaaacccugucucuacuaaaaauacaaaaauuagccaggcgugguggugcacaccuguaaucucagcuacucagggugcugaggcaggagaauugcuugaacccaggaggcggagguugcagugagcugagauugugccagugcacuccagccugggugacagagugagacucugucucaauaaaaaagaagacagaacuaaacaacuuugaucugcaccagccccaggagaaucacuuuuauggaucuuucuagucuuguuuauaauagguuuguguguguauuuauauauuuuuauguaaaacugggaccauccucuagcuuuucuauucuuguucaucuuuaaauagacucaagaauacacuaaaauuauuuauuguuuaguugacauguauacuuguauauauuauguacagcaugauguacauuguauacauuguagaauggcuaaaucaagcuaauuaacauaugcauuaccucaaauacuuaccuguuuuuguggugaccacauuuaaaaucucuucucuuaggauugcuugagcucaggaguuagagaccagccuaggaagcauagugagaccuuguguguaccaaagauuaaaaaaaaaaaaaaauuagccgggcauccuggcaugugccuacagucccagcuacucaggaggcugaggcaagaggaucacuugagcccgagaguucaaggcugcagugagccguauuugugccacugcacucuaaccuggaugacagagcaagaccuuuuuuuugagauggagucuugcucugucacccaggcuggagugcaaugaugcgaucuuggcucacugcagccuccgccuccuggguucaagcgauucuccugccucagccucccaagacuauaggcgggugccaccaugcccggcuaauuuuuguauuuuuaguagagacgggguuucacuauguuggccaggcuggucucgaauuccugaccuugugauccgccugccucagccucccaaagugcugggauuacaggcaugagccaccaugcccagcugcuuuguuucuuuucuagucuggcacugaaagggccaaagcuuucuucuucagagucaaugugccccgcucaguaaacggguacucaggaaaugaacaaggaaugggggaguugugggaccucauuuauuuagcagacgugaucucagaccugaccaggugcuggaggugugagaugaaccagagcuguccuugugccacucacagcccuagggaggcaggugcaggugcacauucguugguucauucauucauucauacugagccccugcugugcccuuggggaucaagaaagagccggcacuguugucggguaggugagaggcacuacggugagaucacaaagaacagugagagggcaaugccucagagucucagagguggaugaacauuuauuaagcaccugcuguguaccagguacagcacugucaccuucaugcacacugucccaggcaaucccacccagggcgccucugauccugucucuggcuuguggacacagguguccggagcacugaggucccugagacagugaggaccccggcuggacacaccugggcaggugaugccuccucucuuagccacacguuccucuuccgggaaauggaauaauuccuucuauuuucugggauucucuagagggguuuuuuuuuuuuucugagacgguaucuugcuuugucgcccaggcuggaggacaguggcacaucucggcucacuccaagcuccgccucccggguucaugccauucuccugccucagccucccgaguggcgggggacuacaggcgccugccaccacgcccggcuaauuuuuuauauuuuuuacuagagacgggguuucaccguguuagccaggauggucucgaucuccugaccucaugauccagccaccucggccucccaaagugcugggauuacaggcaugagccaccacgcccagccucucuagaggauuaaguaaagcugugucugugacuuuuuuagcaaaucaaguaccagcuucuugguguuuuccuaagaucaacagccaggaauaaagacagcaguggauuuaaaaauagugaagaucguccauuuuaugugguguguauucuaccacacuggggcaggccaggugcagcgguucacgccugucaucccggcacuuugggagacagaaguuuugggaagaucaguuugugagaugacacucugacaaagcuggaagcuguggcucuucccagcucccgacuagaaagaacacaaagcaaagagccccaggaagcagguacccacagccuuguuuaucagggaguuugagaucagccugggcaacauagcaagaccucaucucuacaaaaaauacaaaacaaucaggcaggcgugcaggcucacgccuguaaucccagcacuuugggaggcugaggcgggcggaucacaaggucaggagaucgagaccauccuggccaacacggugaaaccccgugucuacuaagaaacacaaaaaaauuagccgggcgugguggcgggcaccuguaacccagcuacuugggaggcugaggcaggagaauggcgugaacccgggagguggagcuugcagugagccgagauggcgccacugcacuccagccugggugacagagugagacuccaucucaaaaaaaaaauaaaaaacaaugaggcaggcgugauggugugcacuuguagucccaacuacuugggagguggaggugggaggauugcuugagccugggagguugaggcugcagugagggauuuuuuuuuuuuuuuuuuaagacggaguuuugcucuuguugcccaggcuggugcaaugacgggaucuuggcucacggcauccuccaccuccuggguucaagugauucuccugccucagccucccgaguagcugggauuacaggcaugcgccaccacgcccggcuaauuuuguauuuuuaguagagacgggguuucuuccuguuggucaggcugcaaccuccaucuccugguuucaaauaauucuccugccucagccuccugaguagcugggauuacaggcaccugccaccaugcccggcuacuuuuuuguuuuagguagagacaggguuucaccauguuggucaggcugguugaccucaggugaucugcccgccucggccucccaaagugcugggauuacagaugugagccaccacgcccggccugcagugagcuuugauuguaccacugcacucggggugagacccuguguccaaaaaaaaaaaaaaaaaaaaaaaguugaggcaguucccagauaaacaaaacaacaggccaggcacuguggcccacgccugcaaucccagcacuuugggaggccgaggugggcgaauugccuaagcucagaaauucgagaccagccuaagcaacauagccaaaccccauuucuacaaaaaauuuuaaaaguagcugcuuguggugucgggcgccugugguucagcuauguggaaggcugaggugggaggaucguuugagcccuggcggcggagguugcugugagcugagaucgcgccacugcacuccagccugggccacugagugagcuucccucucauaaaaagaaaaaaaaaaaaacaggcugggcgcgguggcucacaccuguaaucccugcacuuugggaggcagaggcggguggaucacgaggugaagaauucaagaccagccugaccaagauggugaaaccccgucucuacuaaaaaugcaaaaauuagcagggugcgguggcgggcaccuguaaucccaguacucgggaggcugaggcagcagaaucgccugaacccaggcgguagagguugcagugggccaugggccaagaucacaccacugcacuccagccuggguggcagagugagacuucaucucaaaaaaaaaaagaaaaaaaaccaaaacaaaacaccagaagcuggcggcacuccugggcgcccagcugugaguggagucucccugucccgccuuugggccuuacccgugcugcgccugcugccugcaucccccuucccugggucuccgcacgugggcccugccucauuuucccggucccaguuucugcgucaccuccugagaggggccuccugucagcuuccacgcagcucugucacggguagauucucucacgaguggaaguggcucucagcugcacuggaauguccgguccacacggacggggccucggcugugcuguccacccuguauuuccagugcccaguaauaggugcuuagaaaauacuuacugaaugaguaaguauacaguuguaccaggcaggugauguuauuauccuuuuuuuuuuuuuuuuuuuacaaggaguaaacugagucacagagaagugaugugacuuggccaggaucaugcagcuggucgggguggagccaggcuuugaaccugucuguccugcuccagagcugguauucaugacgggugugcugcaacccccuccuucucacacagagaaccagauggugucuguguguuacgcgcuggacaccuaauucacgauccccgccgaaaaccacuucgggagcauuaugaauuccauuguguccuccacccccaaggauagguugggauccugaacccccaucccucagcaugugacuucauuuagagguggguguuuacagagguccugaagugaaaaugaggucauuagggugggcccuaauccagugacugguguccuuaugaaaaggggagauuugcgcacagaaacagacgugcuagcugggcaugguggcgcaugccuguggccccagcuacuugggaggcugagcaagaagacugcuugagccugggagguugaggcugcagugagcagugauugcgccacuguacuccagcccaggugucagagggagacccugucucaaagaaauauaaaaaauaggccaaguagacugagugugguggcucacgccugcagucccagcacuuugggaggcugagguagguggaucacgaggucaggagugugagacuagccuggccaacauggugaagccccgucucuacuaaagauacaaaaaauuaacccgguguggugguggaugccuguaguccagcuacuugggaggcugaggcaggagaauuguuugaaccugggaggcagagguugcagugagccaagaucgcaccauugcacuccagccugggugacaagagugaaacuccaucucccccccccaaaaaaaaaaaaauaggcugggggcagugaaauugcagcacucugggaggccaaagcaggaggauugcuugaguucaagaguuugagaccagccugggcaacauagugagaccaugucugaaaaaucuaaaauuaaaaaaggaaaaaugaaaaaaaaaaaagagacagcuccaaagggaagaggaagggaagagggagagaggagauggucaccugugagccaaggagagagaccagagcggauccucccugagggcccugagagggaaccagcccugcccacaccuugaucugggacuuccagccucugggacugugauuuuuuuuuuuuuuuuugagauggaguuuugcuuuuauugcccaggauggaguguaaugaugcgaucucggcucacugcacccucugccuccugguuucaagcgauuuucccgccucagccuccugaguagcugggauuacaggugcaugccaccacgccuggcuaauuuuguauuuuuaguaaagacgcgguuucuccauguuggccaggcuggucucaaacuccugaccucaggugaucugcccaccucggccucccaaagugcugggauuacaggcgugagccacugugcccggccaggucugugagguuuuaaaccaccugucuguggcacuuuguuacggaacccgagcugagugguacagggaggaaggcccugugguucagcgcauuuuacagcugaggaaacugaggcugcagucuccaucuguguguccuuugguugcuuguaugagugagguggcagguuugggaaugaaaccacgccugcggugccggggcucccaccgguaaccucccguuuuuggccucggggcuccggcaggaaggagucccaaggcuuagauggaggugcggagggcgugugaguguccuggagcugcuguaacaauguacugcaaacccaguggcuuacacccucagacgugcauucccucacgguuccggaagccggcagucugaaucgcggugucccuguggcugugaccugugagacgggccauaauccucccagccucuuccacuuccagcgggggcggcccacccucaccuuggagcugugccucuccggucuuugccucuguccacacauggccuucuccccaugugucucugucucuguuuucccuuccuauaaggacaccagucauuggauuagggcucacccuaaugaccgcauccugacauggccacuucggcacagacccuguuuccggcacaggccacauucacagguugugggagcacaggaguguuucugcuggugcaucaggcuggggucuguccucaccgggaugucuccuccuccaccccucucuuccagaggaggagcgaguggacauucuaaucaacaacgcgggugugaugcggugcccccacuggaccaccgaggacggcuucgagaugcaguuuggcguuaaccaccugggugaggccugggcaggggcugcaccauggguucaagcgauccucccccgucguccucccaaagugcugggauuuuaggugugagucaaaagugaccuuuucaucauccuuaauccaggucacuuucucuugacaaacuugcugcuggacaagcugaaagccucagccccuucgcggaucaucaaccucucgucccuggcccauguugcugggcacauagacuuugacgacuugaacuggcagacgaggaaguauaacaccaaagccgccuacugccagagcaagcucgccaucguccucuucaccaaggagcugagccggcggcugcaagguacgggggcgcuaggcucggccucccucuugcuuuacucugagccuagagcggccuuuccaugauccuaggcugaugggaggccaaacgguggauccagaacagagucagcaaaaguagagcauguggaccacgcugcccgcuucuggugccugaagcagacaucacuaaucgaucguucuucugaggauugucuguucaucccagguggucuagucugccuggaucagauguccuucccugcugcuguugggcaggcagcucagccuuuuggcuccagccagugagucucaaccaggggcaguuuugacccgcaguugucaaugccuggaaacacagugaucacagcuggcuuggggagagauugcucugggcaucuggaggguaaaggcccagaugcucucaauguccuacagcgcacgggauggccccucacuccucccaacccacagcauccacagugcugagauugagaaaucugugcuaggccuuugcuucugaaagacggucuguggaccagcggugccagccccacugggagcuggucagaguuacaguaucuuaggucccaccgccacgcaccgaugcaggcucccgggguaagcucagcguucuggguuuaugaagcccuccaggaaagcucggcucccagcagccauguggcagagccgcuccgcaagauaagaccacuucacuaagauuccagagcaagagggacgaugggguuugagugcaggaagcagccuggugcccggaagccccacagcugggugugggcugccacagccucccaggugaggcuggaccccucccucagucuucucuuucuuucuuccccaggcucuggugugacugucaacgcccugcaccccggcguggccaggacagagcugggcagacacacgggcauccauggcuccaccuucuccagcaccacacucggugaguccccucccagccuggggucuccacguggagcccuccaccccugcuuucucagcccagggcccaggacccucccucagagaccgucccugaggccucaugccugcuccucgccuacgucuucugaggcacagagcacaggucccuuuccuccguugaccuggccugccagccucuaacagccccgggaagcaggcagagcccugcuggcggaugagaaaaccgugucucagaggaagaggccguggagcugacgccuggagucaggcuguacucaggguaacuccagcuucaccccaaaccagcugcaccuccuggggaagagcuguuaccccucugagccuguuucuucaucugcagagugcaggccuuaauaggacucaccucacagucacuggggggguuauacgagaccuuccuugaaagggccagcacaggaccccgcccagagaauagguggaacaaacaguuggagcuuuacuuacuuauuuuugagaugaagucuugcucugucgcccaggcuggaguacaauggcaugaucuccacucacugcaacuuccaccucccagguucaagcgauucuccugucuccaaguagcugggauuacaggugcacaccaccacacccagcuagaggugggguuucaccauauuggucaggcuagucucaaacuccugaccucaggugauccaacugccucccaaagugcugggauuacaggugugagccaccacccccaggcaguucaugcuuuaugacuaguguuuauaauccugaaaaacauggagugggugauugguuggcaucaagaaucuuaacuuggcgaggcuaauagccacgccuguaaucccagcacuuugggaggcuguggugggcggauuaccucaggucaggaguucgagaccagccuggccaccauggugaaaccccgucucuacuaaaaauacaaaaauuagccaggugugguggugugcaccuguagucccagcuacucaggaggcugaggcaggagaaucgcuugaacccgggaggcagagguugcagugagcugagaucacaccacugcacuccagccugggugacagagcaagacaccaggucucaauaaauaaauaaauaaaugucuuuuuuuuuuugagacggaguuuugcucgucacccaggcuggagugcaguggcacaaucuuggcucacuccaaccucugccuccucgguucaagugauucuccugucucagccucccaaaguagcugagauugcaggcgcccaccaccacacccagcuaaguuuuuauuuuuaguugagacaggguuucacacguuggccaggcuggucuugaacuccugaccucaggugauccaccugccucagccucccaaagugcugggauuacaggcgugagucaccacgcccagcccuuuuuuuuuuuuuuuuuugagacgaagucuugcuauugucacccaggcuggagugcaauggugugaucuuagcucacugcaaccuccgccucccagguucaagggauucuccugccccagccucccgagcagcugggauuacaggcacccgccaccacacccaguuaauuuuuguauuuuuaguagaaaugggguuucaccauguuggccaggcuggucuggaacucccgaccccagguaauccgcccgccucggccucccaaagugcugggauuacaggccugagccaccucgccuggccaaaaaaagauccuuaaccugaggcuggugccaggugcauuuaauaagauguuauuaaaggagaaaugggguagggugaggacuggggcugaccaagaggaagagagcuuccauuuuccuggacaaagccaggaaggcuccuugggggaggcagcuuuuggucugaucccuggucuggugggauuugccugggcagugccagggaagggaacugcagauggaggcagccaaggggaaagggcuagaggagggcucugugggacuccagggacccggagcucccugaccggggagcggggcuuccuuccuucucucugagcgaguguggacuaaaugcccugugggcugauugcagggcccaucuucuggcugcuggucaagagccccgagcuggccgcccagcccagcacauaccuggccguggcggaggaacuggcggauguuuccggaaaguacuucgauggacucaaacagaaggccccggcccccgaggcugaggaugaggagguggcccggaggcuuugggcugaaagugcccgccuggugggcuuagaggcucccucugugagggagcagccccuccccagauaaccucuggagcagauuugaaagccaggauggcgccuccagaccgaggacagcuguccgccaugcccgcagcuuccuggcacuaccugagccgggagacccaggacuggcggccgccaugcccgcaguagguucuagggggcggugcuggccgcaguggacuggccugcaggugagcacugcccugggcucuggcugguuccgucugcucugcugccagcaggggagaggggccaucugaugcuuccccugggaaucuaaacugggaauggccgaggaggaaggggcuccgugcacuugcaggccacgucaggagagccagcggugccugucggggaggguuccaaggugcuccgugaagagcaugggcaaguugucugacacuugguggauucuugggucccugugggaccuugugcaugcaugguccucucugagccuugguuucuucagcagugagaugcucagaauaacugcugucucccaugauggugugguacagcgagcuguugucuggcuauggcauggcugugccggggguguuugcugagggcuuccugugccagagcccagccagagagcaggugcaggugucauccugaguucaggcucugcacggcauggagugggaaccccaccagcugcugcuacaggaccugggauugccugggacucccaccuuccuaucaauucucaugguaguccaaacugcagacucucaaacuugcucauuuaaaagaaaaaaaaaagaag

SEQ ID NO: 191715 - RNA, 28370 nt, Homo sapiens
gggggccggccagaaacgggcuggggagggggggccccgcagccccccugggccaugcugacucccggggccugacccccccgggccagcccccccucccccagcuccgcggcccgccgacuggggggggccagcccagcccccuggggacccccggagagguggggggcagccgggggggccgggacggagcggucgccggcccccaccggagagacggggcgacggccgcagggggggcggccgggggaccggucgggccgggaccaagggcaccaugucguccggggccaaggagggaggugggggcucucccgccuaccaccucccccacccccacccccacccaccccagcacgcccaauaugugggccccuaucggcuggagaagacgcugggcaaaggacagacaggugagccuagcagaaggggacaccuggggcggggggcaggguggagguggcggcagaggcgggacucaggguauucaaauggcaggggcuggcugcccagaccccugggccccucauagagaagggacuugggauucagacuccugggucccuggauggaggggguggggggcgcagacucagguccuggaggagaggggcugggggccuggacuccugggucugagggaggaggggcugggcacuggacuccuaggucugagggaggagggccugggggccuggacuccuggguuucagggaggagggccugggggucuggacuccuggguuucagggaggaggggcugugcuuggacuccggagucugagggaggagaggcugguggccugcacuccugggucugaaggagaagggcuugggggccuggacuccagggucugagggaggaggggcugggggucuggacuucugggucugagggaggaggggacugggguccuggacuuuuggguuugagggaggagggacugcgguccuggacuuucaggucugagggaggagggccugggggccuggacuccugaguaugaaggaagagggucuggggucuggacuccugggucugagggaggaggggcaggggugcugaacuccugggucugaaggaggaggggcugggggccuggacuccugagucugagggaggagggcggucggaaccuugaguguugggacagggaguuuggggccccagugcuccaguccccauaggggcagaggcuggaggggcuccagggccagggaggggauggaggcggccugcagaguggggccgggcugggaccugagguucuugcugcaguacagcugcagaccggggugcagugcauccauccugggaaaccucuucccuccccacuguccucuggccuccaguucuccaggcagcagguuggggugacaggggccguggggccuaagacauucuccccuucucuggcaugcuggcucagagugggaaacaggauggagggugggaaggugggcugcagcaggcgcgucuccuggagcggcuguggaaagggcguucauccucugcuguugcugaacgcuggccaccggccgcggccuccuuccugccggauggaugguggguggaggugacaugggagcugaacgcccagagucucuaugaagcucagggccagagcuggcaggaguggggaccgacugggccguaacugggagcugagacccuagggaaaaggagagggucaaagucccagauccugagugguaagagugugaagguguugcugaccugaauuccugaguuacaggagaagaaggggucagaccuggacugggucugagggaggaggggcugggccuggagugcugggucugagggaggaggaacugggggucuggagugcugagucuaagggaggaggggcugggggucuggagugcugggucugagggaggaggggcugggggccuggagugcugggucugagggaggaggggcugggggccuggagugcugggucugagggaggaaggggcugggggggcuggauuccugggucugagggaggaggggcuggggucuggacuccugggucugagggaggauggaaugggggccuggacuccugggucugagggaggaggggcugggggucuggacgccugggccugcagcuuuaggggcuagucagggcuaggucuguggcuuugggggcucagguccuggagucgaggguccugaggagaggugugggcuaggagaccggacauacccuuggugucugugugcugucuguuagggcugccaugaagagaagacccaggaaggcaguugaggcuggggguucaggagaagguggagggugaucuggggaggggcaaaugugagauuauauucacugggaggggauucaggaggagguggaggguggucuggggagggggcaaaugugagacuauauucguugggagucauagggucuccaaaagauugaaaagcagagaauacaaggaauugauggagagagacagagaaagugggggggcgggggcuuggaggagacagacucggggagacacggugaggaaagaaugcguggcaggcgggcuccccaggacggagagggugagggccaggggguggcuggcagaggagaggggcaccuggcuggauggacagucaggaggaacggacuggcaggagggaggggaagggugguuuugugggagugugggcucucagccccaggaguucaggucugauguguucaggccauuguuaaacagccagcccaggaggaaggagcaaacaggguggccaaggggggacauaggcgcuggggacgaaggggacccggcggaacaccccacauuuucacccugcuccugcagggcugguuaaacucgggguccacugcaucacgggucagaaggucgccaucaagaucgugaaccgggagaagcugucggagucggugcugaugaaggugugugcgccugcugcagugugccugcgggugggggggccuccggggcugagggcaggggcggggccgugcugaccucuuuucccguguccccaccccucuugacccucagguggagcgggagaucgccauccugaagcucaucgaacacccacauguccucaagcuccacgacgucuacgagaacaagaaauauuuguagguauuuauagacacccagcccuaccccauccucccucuccagguuaccagggugggacuucuccagaaacagggccuagggggaccugggggaccugcagcucuccaggcuggaccgcugaaggcccaguuccuugccuguugcacagggaagccccugacacacagggaaccccacuguugucacgcuguguugggccugaggccaagggcaaccauccuccuaccguguccccagcuccagcuccucgcccuguggcacugcauggaaugcgcucugcuagacaagcagggugcccucgaccagacccaaucugcuaugggcagaugccuccuguuuguaaggcaaggggccuagcaaagcccaaaggaucuucccaaaccccaacucuggagcacuggagagccccccuccucccccggcauaacuucgggugccguggcuggacaccccaacaaugggccgccuuaggaggucugagucacuaucucaaagucaaucacccgccaggaaggauggggguggggguccagcuguccagacuccagagaaugggccucuuuguccaaacucuggugacccaaaggacagcugggcugggaagccggagaggggacagcccucguguucccccccggcacccagucccccggaugaacugacaucagguccgucgaugcuggcgcagguuucaccacacgggaagcugucugcccggcgcucaugggaccugcucucaggcuuucccagguguggugguagggaggggcuauuguccggaccggugcauggucgcucccacuccacucuuggcguagggaggcagggccaugggaguuuaugcuucgggcaggaaucccagccaucuaagagcucauagaaauugagcuuuuggggccaggcgcgguggcucaugccuguaaucucaacacuuugggaggccaagaugggcggauuucuugaagagcucgagaccagccugagcaacauggcaaaaccccgucucuacaaaaaauacaaaaauuagcugaguguggugguacaccuguaguccuaccuacuugggaggcugaggugggagaauugcuugaaccugggaggcagaggcugcagugagccaagaucgugccacugcauuccagcgugggcgacagagcaagacucugucucaaaaaaaaaaaaaaaaaaacuccaaacaacaacaacaacaaaaaaaaaugguugauggaaacuggaaccccgugucccagaggcuuaugggaagggaguuuggggguuuuuuuguuguuuuguuuuuuugagacagaguuuugcucuuguugcccaggcuggagugcaauggcucgaucucggcucaccacaaccuccaccuccuggguucaagugauucuccugcgucagccucccgaguggcugggauuacaggcacgcaccaccacgcccagcuaauuuuguauuuuuaguagagacgggguuucaccauguuggucaggcuggucuugaacuccugaucucaagugauccacccacuucggccucccaaagugcugggauuacaggcauaagccaccgugucuggccagaaguggggguuuuuaacuucuaggcgcugaugggaguugucgucuauugccucacagaagcuggcuuggacuggugcaaccuugcaaucguuaauacucgaaaaugaauucaaauuugaguuuccucacuccagagggaauuagaggcuuggcuuucuaggggcuaauaggaguagggguaucuucacuucccaggguccuauaagaauuggggucuuugaccuucaggugcuaauagagucgccuuaucuccugaaaccauuaugagucaaaguguugguuccccucugaagcugacaugggaggcucuacugcccagggcuaaugggacuugaguuugguuuccuagaggcugguggaaacuggagucacuuccucccagggagugaugggaacuggaaucucuuccucccaggaauuaauggaaacuggagucucuuccucccagggacccaugggaauuggagucucuuucucccaaggaucaugggaauuggaguucucugccaccaggagccaguggaagugggagaccaggcccuuugguccuccacaugccccuuccagcccucugcccccucuauauccuuuagguaccugguucuggagcacgucucggggggugagcuauucgacuaccugguaaagaaggggagacugacgcccaaggaggcccgaaaguucuuccgccagauugugucugcgcuggacuucugccacagcuacuccaucuggugagugggcagcuugagggggaggaggggcugagggcugcccagcagacaggcccuugggggcauguggagggcugagcaaaagccauguggucggcccccaaaccuuuaucccauugagacauaacucauacaccagaaaauuccuccuuuuagaguguguaauucagugguuuuugauauauuugcagugguauacaucugccacuguggaauuuuagaacauuuucucacccuguacccauuaaguaagcagucacuccccauuccccuccugcccccagcccccggcaaccuauguucugucuguauggauuuaccuauucuagacguuuuauauaaauggaaucauacgauacauggcccuuuuuguauuguuuuguuuuguuuuugagauggaguuuugcucuuguugcccagcaggagugcaauggugugaucuuggcucacuacaaccucugccucccagguucaauugauucuccugccucagccuccggaguagcugggauuacaggugcacaccacuacaccuggcuaauuuuguauuuuuuuaguaaagucgggguuucaccauguuggccaggcuggucucgaacucuugaccucaggugaucugcccgccuaggccuccuaaagugcuaggauuacaggcgugagccaccacucccggccucuuugcccaucuuuaauucaguuauuuuuuaaaauuugauuuagucuuuuuauuauugauuuguaacaauuuuuuauucuaggaacaagagauuacucuaggaacaaaauuauuccuaaaaauuauucuguaugaugacagcaagaacaagggggaaaauuuaacaaagaaaaaaagaauuguuuauucuagaugcaagucuuucaucaguauacauuuuuaaauuauuuucuccaagucugugccauguuuuuacauuuuuauaagucuugugaaaagcaaaagauuuuucauuuugauaaauuccaguuuguugauuuuuuuauuuuacaccucaugcuuuuucuuuuucuuuuuuuuuuugagacggagucuugcucugucacccaggcuggagugcaguggcgcgaucucggcucacugcaagcuccgccucccggguucacgccauucuccugccucagccucccaaguagcugggacuacaggcgcccgccaccacgcccggcuaauuuuuuguauuuuuaguagacacgggguuucaccauguuagccaggauggucucaaucuccugaccucguaauccguccgccucggccucccaaagugcugggauuacaggcaugagccaccgcgcccggccuacaccucaugcuuuuucuguccuauuuaagaaacuuuugcccaacucaaggucacuaaggucuucuguauauuuucuagaaguuguauaguuauagcucuugcauuuaggucuggcauccauuucaaguuaauuuuuguauauggugugaaguaaggguugaguaaggguuauuuauuuauucauuuauuuuuaguuuaguuuaguuauugagacagggucuugcuauguugcccaggcuugucucaaacuccugggcucaaggcaugagccacugcgccuggccuauguguccacuuuuaaagauuuuuuuuuuggcugggcaugguagcacaugccuguaaucccagcacuuugggaggccaaggcgggcagaucaccugagcucaggaguucgagaccagccugggcaacaaagugagauuccccccaucucuccaaaaaauaaaaauaauuagcuggaugugguggcgugugcccguggucccagcuacuugggaagcugugguaggaggauugcuugagcccaggagguugaggcugcagugaggcaacagagugagacccugucucaaaaaaaagaaaaguuauuauuuuuuucauugaauugacuuuagccuccaaaucagauauuaaaugugcaacguuuuucuaacuguucagguacaaaaugaaugccuucaucuuuuagccuccuucauuugcgcaucucucucacuaagauguguuuuuggagaugggguggggaucacgguagagggacucagacuuuggguaaagcuugaugauaaaaaggccaccuacuuaaauuuucgguuuuugucuuuuuuuauuuuuugagacggagucucgcugucacccauccuggagugcaauggcacgaucucagcucacugcaaccuccaccucccagguucgagcgauucuccugucucaaccuuccgaguaccugggacuacaggcacccgccaccaugcccggcuaauuuuuuguauuuuuaguagagaugggguuucaccauguuggccaggcuggucucgaacuccugaccucaggugauccacccaccucggccuccugaaguacugggaugacaggcuugagccaccgcacccggcccuguuuaaauuuuccacaccuuccuguugacaagauugucaaaacccugauauugaaacccuggccucuagggggagauauucaacguauuuaacaaguuugacccaguuaaugaccaggccaaaugaaaacugcagaauccuacacucccucucuccccagacaccaacccuuaaaccuugaggaguuugguucaagggugggaaggucccaagacaggaaccaaggauuuuaagaaccagcugcauaucagcuuuaccucaaaauagcucacuuuguacauauucaaauacuuacagauaaacuaauaugacaucugggauguccuacaaacuaauuuggguuggggaggaguauguaagggacagagaugagaucagauuggcccuaagaugaucauggaugaagcugggcgauggguaagugaggcuuccucuuacuuucucuccaguuuugggcacguuugugauugucuauuauaaaaaguuuccaggccgggcgcgguggcucacgccuguaaucccagcauuuugggaggccgaggcagguggauuaccugacgugaagaguucgagaccagccuggccaacauggugaaacccugucucuacugaaaauacaaaaauuagcugggcgugguggcacaugccuauaaucccagcuacucgggaggcugaggcaggagaauugcuugagcccaggagacggagguugcagugagccguaaucgugccacugcacugcagccuggucgacagagugagacucugucucaaaaaaaaaaaaaaggaaaguuuccaaagccagacauggugaugcacgccuguggcuccagcuacucaagaggcuaaggccagaggaucacuugagcuggggaggucaaggcugcagugagcuaugacugugguacugcacuccaggccgggcaacagaaagggaccccaucucuaagcauacacuugaucuuagccaaaaggccgagaagcaaugcccaucucuaaaaauaaaaaacaaaauaggccgggcgcgguggcucaccccuguaauuccagcacuuugggaggccaaggcaggcggaucaccugaggucaggaguucaagaccagccuggccaacauggugaaacucugucucuacuaaaaauacaaaaauuaggccuggcgcgguggcucaugccuguaaucccaggacuucuugaacccgggagguuguggugagccgagaucacgccauugcacuccagccuaggcaacagagcgagacuucgucucaaaaaaaauaaaaauacaaaaauuagcugggugugguggcacaugccugcaaucccagcuacucaggaggcugaaacaggagaaucacuugaacucaggaugcggagguugcagugagccgagaucaugccacugcacuccagccugggugauagaaugagacuccaucucaauaaauaaauaaauaaauaaauaaauaaggcugggugcugugguucacaccuguaaucccagcacuuugagaggccaaggcgggcggaucaugaggucaggagcucaagaccagccuggccagcauaaugaaaccccgucucuacuaaaaauacaaaaauuagcugggcaugguggugcggccuguagucccagcuacucaggaggcugaggcaggagaaucacuuggacccaggagacagagguugcagugagccgagaucaugccacugcacuccagccugggagacagagcgagauuccaucucaaaaauaauaauaauaaauacauacauacauaugauaaaaaauuaaaaauuuuuaaaaagaccaaaauuaaugaaugauaauaaauggucucucauccccuaaaaauccaaaaaguaugcagaaguguuccacugugagagccagucaguggggccugggccuccugggaggaaggaagaggccugagucccaccuggcugucucagccacagagaccuaaagcccgagaaccugcuuuuggaugagaaaaacaacauccgcauugcagacuucggcauggcgucccugcaggugggggacagccuccuggagaccagcugcgggugaguggggacugggcucccgagacccugggcagggguuuagaagcuggcuggaggcucacaucagcucucucccucagguccccccauuaugcguguccagaggugauuaaggugagugaggggcggauagaggggagagggguggaggcagcagugaggagcgaugaagucacaacuggccuucccuuccagggggaaaaauaugauggccgccgggcagacauguggagcuguggagucauccucuucgcccugcucgugguaaggcgcccucaccucuccugucauuucuagaucaaucccaccuggugggagcauaggacaguaccuuccauccucaggucaucuccugaauuuauuuaugaauuuuauuuauuuauuuugagacagagucuugccccgucgccuaggcuggagugcaguggugugaucucagcucacugcaaccucugccucccagcuucaagcaauucuccugccucagccucccaaguagcugggauugcaggcgcccaccaccacuuccagauaauuuuugaauuuuuaguagagacaggguuucgccauauuggccaggcuggucuccaacuccugaccucaggugauccaccugccucugccucccaaagugcugggauuccaggugugagccacugaacccggccuauuuauuuauguauuuugagacagagucuugcucuguugcccaggcuggagugcaguggugcagucuuggcucacugcaaccuacgccgcccggguucaagcuauucuccugccucagcuucccgauuagcugggacuacagguaccugccaccaugcuuggcuaauuuuuguaucuuuaguagagacgggguuucaccauguuggccagguugguuucgaacuccuggccucaagugauccacccuccucggccucccagaaugcugggauuacaaguaugagccaucgugcccggcagcugaauuuauuuuauuuuuauuuuuauuuuuauuuuuugagagaggaucucucucugucgcccaggcuggagugcaguggcgccaucacggcucacugcagucucaaucucccaggcucaagcaguccucccgccucagccucccgagcagcugggauuauaggcucuugccaacacgcccagcuaauuuuuguauuuuucacagagacaggguuucgccuuguuucccuggucggucucaaacuccugggcucaagugaucugcccaccucagucucccaaaguguugggauuacaugcgugaggccaccgaacccagcccaucucucgaauauuucacugguaaugggaaagauacuacauuaaccaacagaccaagauccuggaguucccccacucuguggggagcuaaccuuuucauucacagaacuguggguuaaaaagauaaaagaacuaugggauagucuccaggaagaaccccagaaaggaacaagucauccaggagcaccuggagggcuugauacaaugacuguuuaccagcugauucuagggcauugugauacuguaauaacaaguauaaccaggccgggcacggaggcucacaccuguaaucccagcacuucaggaggccgagcggaggcagaucaccuggggccagaaguuugagaccagccuggccaacauggugaaaccccaucucuacuagaaauacaaaaacuagccgggcuugguggcgcaugccuguagucccagcuacucaggaggcugaggcaggagaaucgcuugaacccaggagguugaguuugcaaugaguugagaucgcgucacugcacuccagccugggcgacagagugagacccuaucuaaaaauauauauauauagccagaucguaggcuaucagcccugcuccuaccacagggccuuucugccugggacacucugcuaccuauuagccuuguugcucaccuaguucauaucuagacuucuucaagcucucugcucaguugucacauuuccaggaagcuuccccugcccccacuccuccuccccacuccuguaaggucagaccccccugugguaggcucccuucuuccuggcaacgaucagaguugucgcugugcauuuuguugccuaauucguugaguggcaucucccuucccuucuguaucaucaacucccugaggucagggccgaugucuggggcaucugucuuuguguguuuuauuucauuuugcuggcuugccuuugcaaaccuaaaguugacacauguaaguccccagugaacaccuguagugagaauaaaucagcaguuguccgggcgcaaugacucacgccaguaaucccagcacuuugggaggccaaggugggaggauugcuugagcccaggaguucaagaccagccugggcaacauagcaagcaagaccccaucucaaaagaaaguuaagaaaguagccaggcauugccgggcgcgguggcucacgccuguaaucacagcacuuugggaggccgaggugggcggaucacgaggucaggaaaucgagaccguccuggcuaacguggugaaaccccgucucuacuaaaaauacaaaaaaaauuagccgggagugguggcgggcgccuguagucccagcuacucgggaggcugaggcaggagaauggugugaacccgggaggcggagcuugcagugagccgagaucaugccacugcacuccagccugggcgacagagcgagacuccgucucaaaaaaaaugaaaaaaaaauuagccaggcaugguggcaccugccuguagucccaguuacucaggaggcugaggugggaagauugcuugagcccuggaggucaaggcuguagugagccaugaucaugccaccgaacuccagccuggaugacagagugacaccucgucucaaaaauaaauaaauaaauaaguaauaaguagaaaagaaaaagaauacauaaguuuuuuuguuuguguguguuuguuuuugagacggauucuugcucugucacacaugauggaguguaguggcgccaucucggcucacugcaaccuccaccuccuggauucaagcgauucuccugccucagccucccaaguagcagggacuacaggcaugugccaccacgccuggcuaauuuuuguauuuuuaguagacaugggguuucaccauuuuguccaggcuggucucgaacuugaccuccgcccgccucuuccuccuggagugcugggauuacaggugugagccaccacgcccagccauaagcaguuuuuuuaaugucaggcacuguucugaucauguuauuucacacaauucccucagcagucccagggaggggaagugacuggcccacgggcacgcagcugauaagccgcaggccuggggucaguccuuggucucuuaaccaccaggcuacauaacggauacuaagggcaaugaggccagcuccaagcuggcuuccuggggcucaccacuccauggggagagcagccgaggugcucuggagacgagcuaagaauguucagaacucagcccuucuucacuugguggcuaaaagccugguucuggagcccauccagccgaguuccaaucccugcucccucucccugagcgagccagucacccuaccucaguguccucaucugcaccguggaaauacacaucauaccuaucauuguaaggguuuuguuuucauuuuuauuuuaucuauuuauuuuuucauuuugagacggaguuucgcucuugucgcccaggcuggagugcaauggugcgaucuuggcucacugaaaccuccaccucccagguucaagauucuccugccucagccucccaaguagcugggacuacaggcaccugcuaccaugccuggcuaauuuuuuuguauuuuuaguagagaugggguuucuccauguuggccaggcuggucucgaacuccugaccucaggugauccacccgccucagcuucccagagugcugggauuacaggcgugagccacuucccccagcccacugugaggguuuaaauaaaugcugcacgugaagccccuggcacaaugcuugaugauuauuauuaguaguuuauucuuuuuuuuuuguuucuucuuuuuuuuuuuuuuuuuuuuuuuuuugagaugaagucuuagucuugcucuguagcccaggcuggagugcaauggcuugaucuucuucgcggcaaccuccaccuccuggguucaaguuauuucuggcuaauuuuuguauuuuuaguagagaugggguuucaccauguuggccaggcuggucuugaacuccugaccucaagugaucugcccaccucagccuuccaaagugcugggauuacaggcaugagccaccgcaccuggccuaguaguuuauucuuguuccaauaguuccucaucauuugcagauuccauauuugcaaauuugccuaccugucaaaauguaucuguaacccaaaauaguccuggaggugcuuucacagucauuggcagacaugcccagagcaggggaaaccugagccgcccacccaaggugcagguuuccggcugaggucaaacaaagugacccuguuucagcucucauccuguaaacaaucccccuuucaccaccuauuucgugucacguuuuucacauuuuuguguuguugguggcaauuucguuguuuaaaauggccaugaagccaagugcuucugaagugccgucugguguuccuaagcgcgggaggcugugaugucccuucuggagaaagccccucugaugggcaugcuuuguucaggaaugacuuguagugcugcuggccaugaguuccgcgucaaugacacaguacauaugaaaggugucuuuaagcugggugcgguggcucacgccuguaaucccagcacuuuaggaggcugaggcgggcagaucacgaagucaggaguucgagaccagccuggccaaucaggaggcugaggcaggagaaucgcuugaacccgggaggcggaggcugcagugagccgaggucaugccacugcacuccgggcuacagugcuagacuccgucucaauaaaaaaagaaaagugucuuuaaacagaaacacauacaaacaaggucauguaaugacugguugacaaaaaugugacgagagggucaaaggaagcuuacuaacuauaguuccuccaguagccgugacucguucacuaguugagaguuugcagugacuuuauagaacagaacucucaagaauaacaagaaucaacuguauuguuguuauaauuuguuuugguuuuuuuuuuuguuuuguuuuuuguuuuuuuugagauggagacuuucucugucaccuaggauggagugcaguggugugaucucggcucacugcagccuccgccuccuggguucaaguaauucuccugccucagccacccgaguagcugggauuacaggcgcccgccacuuugcccggcuaaauuuuguauuuuuaguagagaugggguuucaccacguuggccaggcuggugucaaacuacugaacucaagugauccucgccccuuggccucccaaagugcuaggauuacaggugucagccaccaugcccagccuguuguuauaauauuuaauccagaccguacccuuccuggcaggaucauuauguccguuucacagaggagaggaaacugaggcucugugcuugagcaucaggcaaccagaagucaaacccaggcuuccgcacccuaagaucggcauucagaggugccuucucuguaucuccccauucuccguccacaggccucagauaccaggggcaacugggagcuugcaacacccggaaaagcccucaaaggcucacaccaucaccucccaugagucuuuguccauggggggucaccuuggcuccccuccaacccuugcccuggugauuggaagcauucccucccgucccguaugauacguucgcuuguuuguuuccuguccccucuggaaugcaacuucucugcucauuccaccaccuuugcugaugacuugagugucgagugugugucaggcagcgucccaggccaacuccaggagggcagggaugugauuuuguccccugcuucauggcugguggcuacgucagaaugcaggaugugguggggucuauggucagugcgucacagcagccagccuguaacaguccugacugugggcccagcacugucauguacuaggucaguucauucugaugcaguccgugaggugggugcugugacgacccauugccauuuucagagcagugacuugccugaggucaugcagguauaagccccagagcaaggauucaaagcaaggcaggggaccaggugcgguggcucacaccuguaaucccagcacuuugggaggcugaggcgggcagaucaccugaggucaggacuucaagaccagccuggccaacguggugaaaccccaucucugcuaaaaauacaaaaauuaggcugggugugguggcucacgccuguaaucccagcacuuugggaggcugaggcagguggaucacuugagguugggcauuugagaccagccuggccaacauggugaaaccccgucucuauuaaaaauaaaaaaauuagccgggcauaguggcauaugccuguaaucccagcuacucgggagguugaggcaggaggaucgcuugaaccugggagaggcagagguugcagucagccaagaacaccucauugcacaucagccugggcgacaagagcgaaacuccaucucaaaaaagaaagaaagaaagaaaagaaaaggugucagcagggcccugcuuccucuggaggcucuagggaaggauccuuccuugccucuccuagcuucugguguccuuggcguuccuucaguugcagcuguaucacucccaucucugccuccgucaucacaugacuguucucugugccugcguccucgucuccucuuauaaggacaccagucauugauuuagggcucagccucauucaggucucugcucccauugcaccuccugggagaagccucacucagucgcucgucauuguauagcuauuuguuuggagcugugcaagggcagaggccuguuuuguucacugcuggaucccugaccuguaacggaugcucaccuuuuguugaaugagugaaugagagacaaccguuucgaaacugcuguggggggaaagcugucuaaaaggaacagccuccacgcugcaauucuagcuucguaagcggggcuccaagcugcuccuugccaagugccugcugugccacggacgagcuaggggccuuuggcaaauugcugagccucucugugccucaguuuccaaccccuuaagguggagaucaccguaguuccccaccuccagugcuuguggugagggugaaaugugcuaaugagggguccugguuaucucuugcccagggggcucugcccuuugaugacgacaaccuccgccagcugcuggagaaggugaaacggggcgucuuccacaugccccacuucauuccuccagauugccagagccuccugaggggaaugaucgaaguggagcccgaaaaaaggcucagugugaguugagggggggaccggcggaggggggaacaguggccgaugaagacagaacccccuagaaaagucauggggauggguuuccagaaccugcucgucaguccccagggugacugggaucgccagcugagccgcagcccaagguccagcacagcugccgcuccaaacuggggagggggcuacgcaagauuggggcggggagcuccaggcagcgggagggcgcaggaguaaggaggcgaacaggaugccacugcgcaugcggcaaaguaaugcggccgguccgggguacacggagaccgcgcgugcgcggggcgaugcacucagucgccacuagagggcgauguaauaugucauccugcccccgguggggugggcggggagaugaucagggaccccaaaaccaccccagucuuucauugcgcgccuacaugugccuacgaccucacuucugcuucucuacgacucaccacccucacagcuggagcaaauucagaaacauccuugguaccugugaguaugggguaacuggacucuugggucccuggcggaaauaggggaggggccaaagcaguagaagcggcugggaggggugggaugccaggguuccugagaggcaacgggcuagggacucggacuuauggguccugggggaagaggacacagcuagagaaggagucuaggggucagaggcaggaggggcuaagcuaggaguccaggacucccagguuugagggaaaaagggacugggggccuggacuccuggauccgagggaggaggggcugggggccuggacuucugggucugaagaaggaggggccgggggccuggaccccucggucggagggaaaaggggcuggaggucuggacuccugggucugagauggggggcgaggucuggggcgucuggauuccuggguaugagagagaaggggccggggccuagacucggauuucgggguccgggaucauugagucuagaaugaagaaugcugaaucucagaagcccgguucccaauaauguuucuccacuuccccagaggcgggaaacacgagccagacccgugccuggagccagccccuggccgccggguagccaugcggagccugccauccaacggagagcuggaccccgacguccuagagagcauggcaucacugggcugcuucagggaccgcgagaggcugcaucgcgagcugcgcagugaggaguaagaccccaagaccccugcacccguguacccacguggggcgagcugcagcagcucccugcgcacaugcagagugcugggcgaggaacccuggccucucauggggcaugguuugaagcucccgccugggagugauggaaccagcggagaaaacggcccagaaacacgcugagaaaguauuaauagaugcugcgacauaguacuuacauauacauaguacuuacaaauaguucuugccuggauguuagguguuacaguguuauuauaauugagugaaacacagcugagauguacccuaaaccagagaaacugaccauacugauaccuagaaaaaauggaaccaugggcagaaauacagggagcggaggagaccuccucugagcauugauguuggaccucagcccucugcuaccucuuuccaccuuucccacccccugccuuagggagaaccaagaaaagaugauauauuaucugcuuuuggaucggaaggagcgguaucccagcugugaggaccaggaccugccuccccggaaugauguuggugagaaggcagggcuaggggaccagacaccugggucucgagauuggaagaggcuggccacggggaccccagauucccaaggaaagaaggggcugcaggcucugagcuuccagcuuuagacugcuugacuugcucuuugacauuuaucaaauccccucuccacucuaggccuguuuccccaugugugcaguuucugaggcaguuguacacagcugggugaaaccaucucuugauuggguugaaacuguugucccucagaccccccccggaagcguguggauucucccaugcugagccgucacgggaagcggcgaccagagcggaaguccauggaaguccugagcaucaccgaugccgggggugguggcuccccuguacccacccgacgggccuuggagauggcccagcacagccagaggugggagccccugucccuccaggaggauccacaaucccugggucuaggaguucaagauucuaaccccagcucuaccucaaaugugcuguguccuugggacaauucaccuccccucucugggccucauuuccucaccuggaaggacuguagaagugagggaacaucugugguuuuugaaacccucccaucugauuuuuuuuuuuuaaaucuauccuggaaacagaucccguagcgucaguggagccuccacgggucuguccuccagcccucuaagcagcccaaggguaaggccagguccccagugggauuuaagaaggagaaagggguggagacauggagcaaagauugaguagcagaaacuacaauuccugugcagucuugagacuugcuucuuugucccuggagggccaaagacccaaggccuccaaaguauuuugguccauuggccauuucuaccuccuuaggauugcaugccugaagagauuuuacaaaaguuaguugagugccugcuguguacuaguaucugcaccggcuggguuuucagcccacagcaugauagaaagucuuugcuauccuugcucuggggccugggaaggaggauacuuggacuacaaguugcagcaugcaccgggccagcguccgugagugugcgugugaguggggcuccuagagccuccugggaguuguaguccacucgcuuaucucagucuccuguccucugcagaguccggucuuuuccuuuucaccggagccgggggcuggagaugaggcucgaggcgggggcuccccgacuuccaaaacgcagacgcugccuucucggggccccaggggugggggcgccggggagcagcccccgccccccagugcccgcuccacaccccugcccggccccccaggcuccccgcgcuccucuggcgggacccccuugcacucgccucugcacacgccccgggccagucccaccgggaccccggggacaacaccaccccccagccccggcgguggcgucgggggagccgccuggaggagucgucucaacuccauccgcaacagcuuccugggcuccccucgcuuucaccggcgcaagaugcaggguaugggggcaugaacugccgaguccuaauguggggagagguuggggcuaaaaaucugguuccagggauguccgucuggcgugucuagagaggaagggacugggggccuggauucccacguucuagagaagaggggguuugaagcagaggugcaccuguuggggagagagguggggccucuagcucuggaggaggaccccgauugaagggcacgcgccuuuggggcucuggauuaccucccauuggcccgugguuugugagccccgcccaggagggauggcuuggccgaggcugcaacccaaggcucuggaacccugggagggggcgagugcaggccugugugcuggcaacugggaugaugcacagguguugaccacguucucugccuucccccuaccagucccuaccgcugaggagauguccagcuugacgccagaguccuccccggagugagucucacagggaaggaaagaguggggaugcaggggauucaugcccucggcgccuuccuaacccuccuccaaccacccccucccacucaggcuggcaaaacgcuccugguucgggaacuucaucuccuuggacaaagaagaacaaauauuccucgugcuaaaggacaaaccucucagcagcaucaaagcagacaucguccaugccuuucugucggugaggggccuggguccccaucgagccuggcccccgcagaacuacaagucccagcagccccuggggcuaaccaccuuagcauaggccuggcuuccuccuggggcucaugggauuuguaguuuuauggccagaguugguuagaagucgguaggcaggaaagauuuaucguggccagaggccuggaauuggggaaauaggauccugaauugcaauguccucaaggauuggugaguucccauuccccuacugcgagguuugaaacuagccgaagaaacuucccaggcaauguuaaggcugccccauugcuggucugugguuuuaugccuacggguggaugggacuuagaguuucugugacagauauggcuaugggaagcauuuguaaagggagcaagcaguguuucauguggucuuggagucugaggcugucaccuagcuaucagaguccucaugauguuagggggauguccaaccauuccucccuuacucgcugauaggauagagaaagcuacaaguccuugcaggcaguggggccucccaaugcauuuccuguccuucuuucccuccaguggcucaugggacucguaguuccuuggccagagcuggucguggggcuggguauccauuuccugggcucaccccuuccuguguuccuaccucgcucagauccccagccugagucacagugugcugucacagaccagcuucagggccgaguacaaggccaguggcggccccuccgucuuccaaaagcccguccgcuuccagguggacaucagcuccucugaggguccagagcccuccccgcgacgggacggcagcggaggugguggcaucuacuccgucaccuucacucucaucucgggugagucucuuggcuaggcugccugcagcccagugcugggacuguucacgacagcugagacaguguaggggcccaggagugcagcagcaggaggaggaaaugguguucagcuggugccgacucucugugcuccuccugcccacacagaccgccccacaagcccauccucuauuuccccacucucaucagcauuucccuggcauuuacaguguaaauaaugaaugcauuaucuccuugaagcuuccaagcagccuacugagguguuaguaaucacccauuuuacggaggagaaaacugagucauagggaggucaauggacuuggccagagucacacaauacacugucgcagagcugcagcccaacccaggccucccaacuucagaggagagagcccagcucuuccuauuacuuuaagaugguagagccaaagggugaagacacagcacacugcugucuaauaucagucugcccagagcagacauuaccaauugauggcagugcuuauuccugcuaagcucaguggcagccucaggaacuugaacuccaggcagccaugaccagucgaggcuuggcacaagaaaggaaaaccacuaaaauaccuugcuuccaguucugcuuucuguuuggucccuccauccugauagugagcauuuggauagggagggauaucgccgaucucuuugucaccaauauuaauaugucacaggugggagaggggcuugccccaaagauuucuaaaccaaacggcuguggaacuguggguguuccgucaccaaaaccaauuaugacucuuuauuuuucugucccccuuaaagacuaacaugcaggcugggcgcgguggcucacgccuguaaucccagcacuuugggaggcugagacgagcaggucagaaguucaagaccagccuggccaacauggugaaaccugucucuacuaaaaauaccaaaauaagccucgcgugguggugggcuccuguaaucccagcuacucaggaggcugaggcaggagaaucgcuugaacucaggaggcagagguugcagugagccaagauugugccacugcacuccagccugagcgacagagcgagacucugucucaaaaaaaaaaaaaaaaaaggcuaauaugcagaccuuucucaauuuuaagacuuuuucugaggccaggcaugauggcugacuccuguaaucccagcacuuugggaagccgaggugggaggauugcuugagcccaggaguuugagaccagccugagcaacauaauggaccucaucucuacaaaacaaacaaaaaaauuuauacacacacacacacacacacacacacacacacacacacacaauuuaaaaaaaaaaaaaaagcccagcacgguggcaugcaccuguagucccagcuacuccagagucugacgugggaggaucaccugauuccaggagguugaggcugcagugagccgugaucgcgccacugcacuccagccugagugacagaaugagaccuugucucaaaagaaaaaagaaaaagaaaagacuuucuccgauuucuuuuucuuuuuuuuuguuguuguuguuguuugguuuuuuuuuuuuuugagacagagucuugcucugucguccaggcuggagugcaauggcgugaucugggcucacugcaaccucugccuccuggguucgagagauucucuugucuuagccucccgaguagcugggauuacaggcaugcgucaccaugcccagcuaauuuuuguauuuuuaguaaagacaggguuucgccauguuggccaggcuggucucgaacuccugagcaaccucaagugaucugcccacaucggcauuccagaguguugggauuacaggcaugagccccuguaccuggcuccaacuuauuuuucuuacauuucugguccuucauggccuccgcuagaaacuaacagcaagcaauaguaucuauuugaauagaaaccaacaccuguuauuugaaguugaagguaugugaguuugaccgugauccuuaaauagcagcacagacccauuugcaaaccguggauugauguggccccagcggagcaggggagacggagaugcaggggggguguugugugcuugguggagggacuggguucugcaggcugggacggccuucccgguccuggacccccagucaguguuuuucugcccgccugugccucuaggucccagccgucgguucaagcgagugguggagaccauccaggcacagcuccugagcacucaugaccagcccuccgugcaggcccuggcaggugggugguggggccgugggugguggggggcguggguggcgggggccguggguggcggggggcguggguggcggggggcguggguggcggggggcguggguggcgggggcgguggguggcgggcagagguccagcaugagcaggugcucugggguuugguuugcagaggacgcccagcuggugggcuccuucaccauugucguagcugaggucuuaucugcagaguugugagcagguuccccgagaggcuggggccugaggagggucuccuuagcaaccugaggacuggcucccaggagucccuaagaagaugacaggcucuguguugggggucagggaacauccugccaacagagguucuggaccucuguccaggaggacggugacccaccguccugguuugcuugggacugaaggguguuucugggaugcagggcuuugagucuaaacccaggacaaauuggucaccaucuuugcaggucucacaagucaccucacccuggggcuagggccuaauggucccuagcaaccagaauucuaagcugaguucaugggaaugugcaagaucuugcucuggggaauccggccuucccgggcucccaguccuggucaucaaagacucaaauucucuagcaaucaggagagcagaggguuuguugcaaaggugucuuaguucguucaggcuacuauaagaaaauaccauacacugggcaacuuacaaauaacagaaauuuauugcugacaauucuggaggcugggaaguccaagaucaagcugccagcagcguuggugccuggugagagcugcuuccugggucacagacagcacguuggugcugugucuucacauggcagaaggggcaagggaacucucuggggccucuuuccuaaggacacuaaucccauucaugaaggccccacccucaugaccucaucaccuccuaacauaaccuccuaauaccaucaccuugggauuggguuucagcacaugaauuugggaggaugcaguguucaguagagagcauaaggggcacucgcccaagcaaccagagguagccagaauucucaagggaagagagcgccugcccuggaaaucagcccucauuccugagacacggggucacaggggacacagugaaacaggguacugggccccauugcagggcacguggacagccgucugcucugaggggagucaggcagcaucagccucacaggacccaugccccuuccuggaccccuggaccccguugaaaggaaacggcccagcguugaggccaggagccagggcagcuuuggccuugucaccagaaacucugagucccagggucaggucuuuugcucuggagccgugguucucaacuaggggagcugguuucaccccguguuuguuuucuauggccgccgucaacaaaugacacagccuugguggcugaaacaacacaagugauuuucguacaguccuggaggucagaagucccacauggucucugcaggcuaacagggugccuggagggcugcaccuggaggcucucuggcagagacuguuuccuuguguguuccaguuccuaggcgcucugguuaaggcccguuccuccaucuucaaagccagugacgccauauaucccucugacugaccuuagcugggaaaaggugacucagugggaccugcacagauacuccaagauaaucccccaacucguggucccucaccuuccccacagcacaggaucucuucugcugcaucaagaaacauagucacaaguucucgguauuugcauguggacaucuuuggagggggccguuauucagccuagcccaacccccuagggacauuuaguaaugucuggagacauuuuuccuccccucaacuggggaaaacagggggaugccaauggccucuuguagguggaggccagggaugcuguaaaacacccuacaauucacagaacagccccccacgacagcugggucccaaauggcagucgugcugaggugcagaaacccucuuuucucaugguugcuaggggcaaccggaaagcaaauuagguccacuggaccccguugccgaggaaagcuggccucagcaaccaggggucucaaaacgggcacacccuggaagauguaggacuaacaggcacccuggggggcucagccaccaucucauaaaggagaaugggguggggggugcaggccuccgagucaccgugguugcuaugacaagccccccaguuuuuguuuuuguuuuuuugagacagaaucucccucugucgcucaggcuggagugcaguggcgcgaucucagcucacugcaacuuccaccucccggguuucaaaugauucucccgccucagccugucgaguagcugggauuacaggugcgugccaccacacccggcuaauuuuuguauuuuuaguagagacgggguuucaccauguuggccaggcuggucucaaacuccugaccucaagugaucugccugccucagccucccaaaaugcugggauuacaggcaugagccacugcgcccggcccacucaguuucucuuaaaagaaaaacgaggucuccgccacgggaccucagguaacauccuaggccccauggaaauugcuggagaccacccagcaaccaguguuuccaccucaguccccaagaggagguggccucaggacccaggagacagugaccugagucaggcuggcccagcaugaggggccugagacccccccgacuccaccaguaggcucccuugagcccaguuccauggaacauuucucccuaacaaccaggguaggagagagucggggggccccucuugcugugaacguugagcaccguccuggcaggcuguuuccuagcgaacaguaucauaaccagaaucugagagucuccuaaagucaggcccggcccaggcccccuuggacuaaccuggccccaggguugcagggggcauagggugcagcccccguccuaggggagucaggccuugccacuugggguguguccuccgaguaaccaauucaaggccaggugcuggacggacugggccuuaucagggauuggagcuagagccucgggguuacugagaccgacugaugaggagacucugcccccauccccugguaaugggaaccccaacccugggcugcggaacccacgaaaaaccucuuccucccuugcagacgagaagaacggggcccagacccggccugcuggugccccaccccgaagccugcagcccccacccggccgcccagacccagagcugagcagcucuccccgccgaggcccccccaaggacaagaagcuccuggccaccaacgggaccccucugcccugaccccacggggccggggagggaggggaccccccuccaccccccuuccgugccccccaacugugaaucuguaaauaaggcccaaggaacaugucgggagggggguggacacaaaaaccggccuugcccugcagggauggggcuccacaggccgugcccaacugggggugguucuaggggaacagggggcgggggagcuguuucuauuuuauuuauugauuaauuuauuauuuuauuuauugaucaaucucucugcgggguggggugggggagggacgggagcugguugggguggcuuagcagauccggacagggcccucugucccugugucguccccaacccccucuucccgggccccuccuccccugguccuccccccacgaccuucuguacggauuugcucuccggaaggaauucugguuucgcgugauccugccugcguccgugucucugauuccgccggcggcaa

SEQ ID NO: 191716 - RNA, 38078 nt, Homo sapiens
augcguggugcgugugugaaggggggugcagcgcgcggucccggggucccggaggggagugcgcaggcgcugagucccugcucggcugucucgguggucgccgccggggucugagcccgggaagaccgagguaagggggcuggcgagagugugggugugucugagggcgugggcggcgcgcccgccacugcguggacguuccugccaaggcgcgcguggguuugcgcauccacgauggcgugggcgucugcgcgggugcuugcgugggcggugggcucgcgccugcguggguucucggcccgccacggcgugggguuugcgcccuucgcugcugugguucucggggcuugugcgcccaagugugaaguuggcgccgcgugugaggcgagccgugugugccugugugugagggagcuaugucgggaccgcggauguguaucgcugcgugacccacgcgaaggaaacaauggagccauugggaagccgggagugggugugugacgcugacugugaagauuuguguuucuggagugugugcgugugucagugucaggcugaugugggcguuuauuguagccuuggguuacugugugacuugccugggcgucugucugccacuuagcgucaguggcuuugcgguuaugagugugugacugugccuuucugguguauaucucacuguaaccauggaaauggaggcccacaggggaagaauucuuagcagcucuaagaugugaugggcugcccuggaaaucuguggaacuguuuaauugugcaugacuuuccuccuugguaaaauagcauauuaauagcaccugccuggguguuauugggaagauuaaaugggaugacguagcugaaacacccugcacagagcuugucacauacuaaucaccguguuuagguguugguuauggugcugguggucguuuuucuuugacccuauacagaggcagagguaguggugaauacuggaggacuuugcaucucugagcuucggacugggcuaucuuuguccacauaccagggcaucugaccaucuccaguugagcaguggugcgcugcccccgccaaccaccugcgucgucaguuuucugcauguguacauuugaguggaggacagagcccuccacugacgcuaaguaugguuguguccccuuccuaccaagguagcuuggaaaaauaagagcauggacuguggcgccccgcugucugguguugacuccugguuucaccacuggcuggcugugugacugagagagcuuacuuaaguccaccacuccucgguucacuuguaaaacaguaguaauaacagaaccaaccucagguuuauggugagcauaaguagaacuuggcacaaggaagugccacaucaaugaucaucguuuuauuauuagcauaauaaccgcaggcgucccacaccuggagaauaaaauccauagguagaaaugcaaaaggaugagccccagaguaaggguugcagguccagagguaaaauaacuuggacgucuagaucagggcuuagguucagaauuguguaggcaggguccugggagggcagcauuaggguagaggagguggggucaggaacaaaggaucuuccugauggagaugucccuagggagcccauggggucaagaacagaacuuugaagugucagggacuaagggauguuuccauauaacacaugggucuggaaauguuucuguccagaccaguguuucacagccuuggcacugugacauuuggggccagauaguuuuuuguugggaggugggaggggcugcuauucuauguauuauaggauguugugcagcaacccugggcucuauuuaccaggccaguagcacaccgcgccucccucuggguugugacaagcgaaaaaaaaaugucuccagacacugucagauguccccugcaggggcaaaaucacucugauugagaggaccgugaugcaagcgcauggacagaccgaaggcaugaugacagggagaagaguaagggagcuggggaaggcggggcacggagagaugauaaaaggauaguguucugagaugagaagaaacggccugcagcccggguaagcuccgagaugcauucauucauucagccagugagugccuaccauggauugggcacugugcuagucucucaacaaaacaggcaagguuuuuacucagcuggaacuugcauuuaguaggagagacaaaaauaaagucuauaauaggugcugauagguacuuugaaaaguaaagcaggguaaagggauuacaggguguuuggcagguguucuuuuuggagucaacauccaggucucccaugggcauuuuggucaacuccagagccaggaaggaccaccagcagugacccuuugguaucacuugauuggggaaucuaagaguuugacuuugaucuuaaccaaagacuuuucucuucacugaggucuggacuucaacagaaagaggucagaucucuagcccuguccuugagacucugagacucgaacguuauucuaaacgaugccuucaauguuacucucaccuuggaaugcuuuauuuaaaaaaagaaaaaaaagggcgggucagacucaauccccagagauucugauuuaauuggucuggcauagugaacugccaucagcugugacuauuuauuagaaagcucccaagagacuaauguacgcacaggguuaagagcuacagcucugagugccugcagcucaggcuccuuuggggccucugggaaugagauaaauugauuuggaggagucagggggaggaugcaagugaccucugcuuggcuaucuuaucaaaaacaguccucacagcugcacuucccugcaguagggguauuccuagccccauccugcaagugagguaaccuaauguguucccgggcaaaguggggaaauggcaggcuagacaugcauaugcauagccuguguucuuccugugacagcugugcugacgucuuuggagaaauugccuacguaugucccuggccucuggggcuggcagguucaggccaggagugauuuuugaauauuugacagcugguacagcaaaagcugacuggcccaaaggaggcaaugaggcuguggcagugcauuuaauggcugguuuucaguauaucaggacccucccccaauucaauacccagcacagcccccaaggcucaaaggggugccagggcaggaggggaaggccccucaguuauuugccucagaagggaggcacaaccacgguucaguaacucuuugaagcauguucccauccagguuccagccguccucaccucaggaggacauagcuuugugccuuucaaagcccuuucucaucuaucaucagggacucggaagacgagccagguuuacagcccugccuugaugugguaugugcgauccagccuucuuuuauuucauuuguuguuuugaagauguaauuauacguucaugacacaaaaugccaaagcggguuuuggauuuuuccauacucacacauauaaccugguuccuuucuucagggacagucacugcuacaaacuuuuuguuuaucuuuccagagccuuuucaaagucauguauuuguauacuauauuuuguuuuuuucuaaaugacuuuucuauguuuuugcccuuauaauaccauuuuaucuuggagguuuuucagccuuggcgcaguugauguuuugaaccagauccuucucugcucuggagggcuguccugugcauugcaggauggugagcagcaucccuggccuccacucacuagaugccaggggcaccccuacucccagaugugacaaccaaaaauagccucagacauugcaguuuucccauagggggcaaaauuacccccaguuaggaaucacuacuaugguucuacuuuguuucuuuuaauauguggugucucauuauaugcauguaauauucacuuagccauucuccuauugaugggcuguuagguuguuuccaaucuccugauggugguaguaauaaugaaaaucuuagcauuggcccugcuuccuggcaccacucuaaauguguuacguauuuugacucauuugaucuucaccacaacccugugaagucauuacuguguuuugucucaucuuacauaugaggaagcucaggccgggagaggacacauagagugucuaaguccacacagauagcggacggcagaguuaaauacugaacauagacagccugcugcaggcccaccccuuacccaaggaaauguacugccccuuucuauaaacucugccauugugaauaccuuugugugucucucauugugcacaugugcaaagaugucugaagacauguacaggaaauaagguugcuggauuaaagaguacaacagggguaaauaacguguaucuucggucuuaaagacauugccaaauugcccuccauugaauuuacaccaauuuaucuccuccagcacuggauaagaauucuaaucucagccuuuuuagugggucucagucuucguuggucucuuggaugcuugguaugugguugacccuugaacagugcagggguuagugguaccaacccccuguacuguagaaaauccacauagaguuuucacuccccaaagacuuaaguacuaauagucuacuggucaccuuacugacaccuaagcaauaaccuacacagucuauuaacacauauuuuguguguuacauguauugcauacucuauucuuacaauaagcuagagagaagaaaauguuauuaagaaaaucauaaggaaaauauauuuacuguucaugaaguagagugguuuucaucgucauggccuucaaguugaguaggcugaggaggaagaggaggagcuggucuuacugucucagagguggaagagguggaggagccggaagggggaggccggagagguaggcacacucaguguaacuucuauugaaaaaaaucugcauauaaguggacccucacaauucaaacuaacauggcucaagggucaacuguauugugaguugaaaaggaaaaggaaggcaagcaaugaccauguuccaguuaccgaagacaucacauguaaauauccuaacagcagaggugagguagguuuucuuuaccccauuguauagaugagcaaacaggcuuuguguaacuuuuucacagccaguaauuggcagaggcaagcuuugaauccaggauuaccuaauaucaaacugcuguucuuucuuccccaguagugccgaguuccuugaagaaaauuauuuuauggacaauguaugagucuguuuucgugcugcugauaaagacauacccagacucacaguucuacguggcuggggaggccucacaaucgugauggaaggugaaagacacgucuuacauggccacagggagaaugagagucccuguacagaaccaucagaucacaugagacuuacucacugccaugagaacagcaugggggaaaccgcccccaugauucaguuaucucccaccgggucccucccacaacacguggaaauuaugggagcuauaauucaagaugagauuugaguggggacacagccagaccauaucagacaagaaucaucuucucaaauuuggggugcguggcugagugcacacaccugugaaaacugcgggaugaaugcauuacaacuuccuggaacaagucauuuuaccuaaguaauuggaaggggaaagccaacugaucugcuuaucugguaaaucauuuaaaacaugauuuuuacauuaacacaaacccagauuuauuaugaaguaauaugcacaaaugaacguguuucaaaacaagaaaucaaaagaguuuucuguuaugggcagcugcuuugggauauaucucaaaccauagaaauaggcauuagcccuccuguacucuucagggauaucugcccaaaguuuaagaauucccaggcaaagaauagggcuuuguucucaaaggcccugcagcaguggugugcuggagcuggcucacccaagccauucagccccaugccaggugacaucaguucaauagcuuacaaccugcuguggugggaguguguauuagucuguucucacacugcuauaaagaaauaccugagacugguaauuuuuaaagaaaaguuuaauuggcccacgguucugcagguuguacaggaaacauagcagcuucagggaggcaucaggaaacuuuuacucauggcagaaggcaaagugggaggaggugucuuacauggugggagcaggagaaagaggcaggggggguggggcuacacacuucuaaacaacuggaucucgugagaacucuuaucacgggaacagcaccaaagggauggugcucaacuauucacgaaggauccacccccaagauccagucaccucccaccaggucccacuuccaacauuggggauuacaauuaaacaugggauuuggauggggacacagauccaaaccauaucagaguauuuacuccauggaaguuguaaacacuauaaaucaccccugcagcaagcugcuuauuaaacauuccccagcacaccguuguccuagggucuaacacagcccagaauucagguguccaggauucagggcaggccucuugguccccaucucuguacgaaggaaaccucgcucagaaaagucagaaucgaaggccagucugcucaguucgucaccgagcccucgcuccucagucuuaacaugauaugcucaaauuuuccccaacuccuguggccacucuacuaugacagaaacauacauauggggauguuuuccggaagcauuucaccacaccgaugccucccgugcccugccaggguggauaguggacuccugccaugugugaggagugcagagugugcggcuuguggauagggccucaaauccaggcuccaucaguuaaagcucugugacaacaggcgggucaucgucccucucucauccccgcgauggaagaugaggacccugggugguugauuugccauucaagguuaaaggagauggugugaugcauagaaaggagccagcacagcuuucauucucaucgucauuaacugaggaggugacgcugcugcccaggcauggagcacauucagcacacacaccugagcacgugcauagagcaugugggcuaaggacggucaaugcgaccuuuucccaaacucacaucccacagaacuggccccaccuggcacuuguaaccucaacagcagugaggguaaauagaguuuaccuuaacggagcacugacugauaugaucucaucucauccuccagcagcccuuuguccucccuuugcagauguaaaggagggagguaaagacccagcaagguucaguaacuugcccaaggucacacagcugcacacaugagaacauuggucaaugcauuguccgguggaggacaagagauaaagccagaaggcaaaugugcucacaauggaauguguuuccgcugugaagaaguggcaccugauacaugugaagcauaccccuaccccgguuuagugggugagggaaggcuccuugaaaaaguguugguaaagaaaguuaauauuuauuacaaagccauucagucauucaguuagcaaacacuuaagcccuuuccgugugcuggaugcuggucuaaggcacuuggaauacagaguugccuguccucaggacgguugacaguaagcauaauaagcaaauucugcagcgaguuacaccacgauaagagcugcugaaaaaaaauaucugaaccagccgugaagggugguggggggcagcuugcauuauuaaauagaaugguuagugaggcuugcugagaaggugagguuugagcagacugaaggaagugagguggggcuguggcagccccuucagggacuagcagggaggcacuggcauggggguggggguguaggacccaaacgugauucuucauucuuacaacucccuccagaaguagguucuguauuguccccaauugagaggugaggaaacuguggcacagagagguucaguggcuugcccaggguaacacagcugauaggaacacuugccacccucagucugaccccagagugauguguuuaccaccacugggggccgccucacccuucccucugacccuggcuaaaacaaggcaggacccugagcuuccucagcaugagggagcucuggaugugcgugcgugggugugugugcacgugugcaagagggaggcaggcagggcugauguuucagcgcuccuuucugccucuuggaguggccucacaggccggcuucagcgaucaccagccgaccucuucaucucacccuagcccuguaauuccccugaauuacagauguuuucagcaccaggucacugacaaaagaagcccauuuauugggcaugaggacuggaaggaaauaguggaagggucacuguguucauuuccucuugcugcugugacaaauugccgcaaacuugauggcuucaagcuacacucauuuauucucuuacaguccugaaaggcagagcuacgaagccauggcagcaggugcuccuucaucuucaaggccagcagcauagcuuccaucuugcaauuucuuuuucugucugacucugauccuccugccuccguuuuauaaagaggaccuuuguaauuauguugagcccacuugggcaauccaggauugugcuauugagaaauaacuauuuagccuuuagccuguuuccuggcauaaaacuccugaaaucuuacaauuucuaaagugaugucugugaacccaaaauaucggagacaagucucagucaauuuagaaaguuuauuuugccaaggcuaaggacacaccugugacacagccucaggagguccugacaugugcccaagguggucggggcacagcuagguuuuauauguuuuugggagacaugagacaucagccaguaugugugagauguacguugguuugguccagaaaggugggacaacucgaagcaagggcccugccuuucaggucauagguagauaagagacaaacaguugcauuccuucaagucucugaugagccuuucacugaacacacaguuuacaugugacaggaggguagaggaguagucacuuaugccuuggucuggcuuagugaaauagggcaaagggagcaaucagguaugcauuuaucucaugaguucuguguguccucuguccaaaaagaauuuucuuuugggcauauugugagggagguacgugguuaguaauaaaaugggaaacagguuugccugaagcaguucccgaagugcugggauuacaggugugaggcaccaugcccuuuucuuuuacaugucuuuuguaugcuaaugagauggcugguggcuggcagccccuggguagcuucaggauaggguuggucaccaggaagaccaaggcaggacuagacaguugggacauugagcuccacccuucaaccucuggggaggggagaaagacuaaagguuaaguugaucaccaagggccaguaguuuaaucuugccuguguaaugaagccaccauaaaaacucagaaggacaggguuugaagagcuucuggauagcugaacacauggagguuccuggaggguucccaaggaaggcauggaagcuccacaccaccucacacauaccuuguauuucuacacauuucuuucucuguauucuucggaauagccuucauaaucaaccaguaaaugucaguauuugccugaguucuguaagcugcuuuagcaaauuauuaauaauugaacccaaaaggggauugugggaaccccagcuuaaagccagucagucaaacauuccugaaguccagacuugcaacugguaucugaagguggggcagguggggcagucuugggggcugagaccucaagcucugggaucugauucuguccccaggaacauagugucagaauugaguuggaggacacccagcuggggccgcugcagaaaugauugcuugcuugguguguggaaaacuccucacacauguggucauggauuguuguggugugacagcagaggaaaaaugguuuguguguuuuccauuuucaggauaauuucccccgcccccaagauccuuaacuucaucacaucugcaaaguuccuuuugcuguguaaggugccauauucauggguucuggagauuaggauguccauaucuuuggggggguggccauaacucuggucuaccacagucacuaaugcccacagugcccucauuucccccccaccccauucccaggcagaugaagucaaguauuccccuuagcaugauguggccggcauggcacacagugcuaauuagaggccccuccuggaccauggcucaccugcaugggaccccgccccuucuugcccagugaguguugcuggaaaagagggucccaauccagaccauaagagaggguucuuggaucuugcacaggaaggaauucaaggugagucacagagcacagugaaagaagcaaguuuauuggaaacuacccuguuauagaguaggguguucucagaaagcaggagaaggaaugggaaacuguaaggagcugucauuaaaccuggaaugugcagaugcacucacuaaagguagggcuguuugugcuaucaaugaccauucauccuucagccuaagccuggucauugauguuaucucugaguaaagugggcugcacucucaggacaucuggacauucugcaggcuuggugggagauguucugugugucuauaaauuuucuguaauuguaauagguggucagcucaggauguggcuacuuucauacuguaagcauuaaccuuauagcaggggccuugugagcgccuagcuacucacuuuaagacagagucacucuagucauguuuuauuaaaccagaggccugguaaccaggggucccucuaacaagagcaccagagaagugggguguggcucagggcaccauccugaggggcugggaaaccacaccuccagcugccucccauuggggccaggacauugaucaugugcccaccucaacuccaucuguugcagaaugacuguucgcuggauccucauucuaaggcugauacagcugaggggugugauagaguggggguuaccucuuacuggcuuauguuucggagucugcagggccaccucccagguuccagcauucucgagggccucccaggacccaaccuguagucaugcucacagcuaaugauuuauuacagccaaaaaaugcagagcaguaucagcaaagggaagggugcacagagcagagccuggggaagccagggccaggcucccuggaguccucucccagugcaguccugagugacauacuaauucccuuaguaacgaguuagaacaacacaugcgaggugcugucuacacagcaugcccauuagagacucaguguccacauuuguuauugugagcugguuacgucggcauucucugguuggcagauaacaaaauugcagacucccaggaggaaagcagggguucaacauaaggcguaaauuguaugcucccugcaccacaccaugaagcugaagguauucuuaacagucaggaaaaguuuuauauccguguagggaauggucucccagccagguccuuagacgccagccuggggcugacccugcacacaggccucuugggagagcagccucaagccugcccugcugaucuucucugcucagcuuguuuccucugacaugggcagaggggagggugccacacaguaggguuaagagccaggcauuuggggcaaaugucuagguuugaacccuggcucugccacuggucuaccuuaugacguugggcaagugauuccucccucucugugcuuccaccuucccaucuggaaaacggcgucagaacuggacuugccaccagaugugagaauugaaaugauaauccucaguguugcuuagcacauggaacauuuauucaucuuguuaauaauucaucuuaguauucguauucuuacuacaacuucauccuacaaagagagacauguaauaauccaagcauucuucugccuagcuucucuuaaauaggauaaggccaucuuaggauccauguuuuguaucaaaacauauccauuaccuaacucugaacucaagccugauggccuuggauuuaucuucuucuaccuccaccccuacggggacgaaacaaacaucuguagagggaacauccauuauuuccauuuuccaggcuguguccugcuguacuuuuuucauuacaaagucacaaaaagcuuuuggggauauuucugcuguuguuggcagcaggguaugacgauggcauucuuuggaggcgugugcuggaacauuuagggaugaacugucauucuacaacuuucagacaacugccuuuuuauaaaaaaggguaggaaaaauguuaacauuuggugaagaguaauuaggcauucauuguaucauuuucucaagaugucaagcuuuccacaguaagggaagugaaaaguauguccccauuucuguccucuccaaagacaaauguggagggccagggaauggcugcagcagaacugugucucugggaugggguuucagcacacugaggaucugguugaguuagucaacaaguguuuauugagcaccugcucuaugcuagguagguucucagcccugggaguagagcggugaacaaaacaaagucucugcuuuccagccuagaucauuguguguguuuagggaggggggagguacuacccacauaaacacccacauaaagaagcuguuuucagaaagcgguaagugcuauguggaaaauggggcaauacaauaagagagcauguggcagcacugccccacagaaacauaaugugaggcugauaauuuuacauuuuccagaggcuacauugaaaaggguaaaaagcaacacauuuaucauuaaaguuaauuuuguuuuguuuugcuuuguuuuugagacagggucucacucugcuacccaggcuggacugcaguggcaugaucuuggcccaccucaaccucugccucccaggcucaagcaauccucccaucucagccucccaaguagcuaggacuacaggcacacaccaccacacucagcuaauuuuuuaauguuuuauagagacagggucucacuacauugcucagguugcucucaaacucuuaggcucaggugauccuccugcaucagccucaaagcauugggcuggcccauuaaaguuaauuuuaauaacauuuaacugacuauaucaaaauauuaacauuucaacauguagccaauauaaacaguuaucaaugaaauaguuauuuuuucauacugauaguuuacauuuuuucauacugagucuuugaaaucugauacaaauuuuauacacacgguccaucuagacccuuaauuuucaguggagauaccugaucuguacuuaauuuccuaaaaccuuuggaaaagcagagucacauacccaaguuguuccagacauacuuuaaaguuuuacgguaaccaaauugaguaucaguuuuucauuuuaaauuuacaguaaauuuuaauaauuuuagcaauaauuuuaaauuuuauuuuauuauuguuuuaauagugaauagauuggagugaaaaugaguuccgggcugggcacaguugcucauguuuguaaucccagcacuuuggaaggccuaggcgggcugauugcuugagcccaggaguuugagaccagccugggcaacauggcaaaacucugucucugaaaaauacaaaaauuagcugagugugguggcaggugccuguggucccagcuacuuggaaggcugaggugggaggaucgcuugagccggggagguugagguugcagugagccaagaucacaccacugcauucccgccugggcaacagagcaagacccugucucaaaagaaaaaaaaagggaagaaaaugaguuccucaguuccacuaguuuuauuucccgugcucaguuuucauauguggcuaguggcauucacauuggacagcauagguauagacugauacagggcagagauucuuugagauggguggauagaggggcccucuugaggaggcgaucugaccacaucuuccuuccuccacuccacccacccuagucaugccaccaacaucuuccccggauuucugcaaagcuaccuagugaguccuguccucacuccugcucccucuucugacacacaguuaacccaccauauagacaugccacaaauuuuuguuaaauguugucugauggugucacuccccuucucagcucccccuccucccccagugaugucacacuugagaucaaaucccagcugcucagcaccccuuucaugauccggcccugccugccuuagcccacccuccccgcugcacucacucugccucaguacacagaccuugcucuccucacaccuagccugcgcccacccaugacgcugacaccugcugugccucuaccuggaaugcucuuccccuagcacccacauggcucaugcucucauauuuagaccucagcucaaugugaccuccucagagacaccuucccugaccauuccacgacucuaaccccugcccuggccuguuuauucuucauagcaaugaccauguccaucauugugcuuuauauggacuuucuuucccuacuggaauguaaggugcuugggagccggcacucuuccacuuuaacucacugcucuccccccaguaccugggacagcuggacacccaguaggugcucaguaaauacuugucagauggauggccagaggucugugcaguccuuauuugccucaugaccaagaaccugcuaugaucuuaggcacaaaaaggguuggccgugcccuucccugaccgugagcaggugaggggggacaggaaugcgccagguguucugacaucugugugugugugugcacgugcauaugugugcaugugugucugugugugugugugucuccagguuagguaggggccuguggacucuggcacugccucaugaccugucuucuccccacagcccugccuuaccagcucucugcccaucucucaguguggacccuaaagggggaggaaaggaugccuucugcacgggggaaauccaaauccaagguaaguggcaauuccucuuccuuccggaacaccccaucgugucuugugagauguggaccauuugcuuuccuuccauggagacuuguugccuguuggagauccauccaacaccuagucuuugguuuucucccguugccaugagggaugagaaccugagaagggcccagcagccaggaaacugcucagcgagccucucuccauucccagugugcacauggccacuggccuguuuguuuagcauucccaggggcuuugccagugccaggagaaaugcccuccccaagagaaauguccuccguggaggaagaugagagccacugugauuucucagcauggagaugaaugcccagguggggccugcaguagcagaggggacuugacaugugcucuggaguuagucuuguugugugguuuuguaucuccuuguaaaacccauauuuacauggaggaaaucucuuuaacuaaggucccaagacuaaaaggcaccacauagcccugcuauuccauugacugcacuggugcaggcagugagguuguaugcguagccuccuguggucagcaugcuccacgacugucaaucauugagugguuuuuccaacaggcaucucaaaugcaguuucccauaacaaauguguuugcuuucaguuggguguauuaguugccccuugcugcuguaacagauuagcugcaaacuuggcagcucaaaacagcacguguuuauuaucaugcaguuuugugguuggcguccaggcacaacaugguuuagcugggucaucugcuuuggaguucacagggcugaaaucaaggugucagccggcuguguucucauuuggggcucagguccucuuccagacuugcugguuauuggccagauucaguuccuuccuacacuuuccaccugacccucauuuuucaucuucaagacagcaagaaccaauaaccaacuggccaggucaaguccaagauaaucugccaaggucaagugaucaguaaccuugauuauacccucaaagaaccuuuugucauguguaacauauucacauguuucuuggagagcaagugguuaggagauuaaaucaggagcugucugggcugaacacuagcuucuccauuuacuagcugugagaccugcaguaaguuuucucaucucucugggccucaguuuccucaucuguaacauacugugauuccgcugacagugccucuaucacugauucacaugagcacuaagugagccaguacagucaggugcuuagaagaaugcuuugacuuuguaaaugccugguagauccagguugccacguguucuuaaugcaacauaauuuuaauaacagcuaugucuuauauuguauuuuauuuaacuuauuuaauacaccugccccuuuuggccucagaacccugaaugcuuccugaaugauucuugguaccuugugucucccauguuuaagaugugugcaccauuuccuccagccauguggaagcacaaguccauggugaauagacauuugauuuuucauuucaggcaccuauaacauuuggggacuuagccaucuacuucucccaggaggagugggaauggcugagccccauucagaaggauuuguaugaagaugucauguuggagaauuaccggaaccuggucucgcuugguaaggcucuucgucccccacaauccagaaccagccuauugagggacaugcaucacucugggucuagucaggaaaauggaagccacugcaguuucuuuuuuaaaagagcuuuauugagauauaauucacauacuauacaauucacccauaaaaaguacacaauuaaaugguuuuuauaauaguguauucagaguuaugcauccaucaccacaaucaauuauauuuucauuauuuccacccaaaaacccaguacccauaagcagucacucuucgucuccccuggccacucauccccccagguucagcaacuacuaguccacuuucuaucucucugguugugccugcucugggccuuucauacauaugaaaucauaaauauguggcuucuuugauuucuaauguuuuugagguucaucauguuguagcaugugccaauaccucauuucuuuucauugccaaagaauauguaugguauggauagaccacauuuuguuuauccauucaucaguuaauagaugggcauuuggguuguuuucacucuuguuauuuugauaugcugcuaugaacauauacaaauuuuuuguguggauguauguuuucauuucucuggggcauauaccuagggguagaauugcugggucuuauggaaacucuguagguaacucuugaauucuuuugguauaaauuuuuuuuuuuuugauacagagucuugcucuuucgccaggcuggagugcaguggcgcaaucucagcucacugcaaccuccgccuccuggguucaagggauuccucugccucagucucucgaguagcugggauuacaggcacgcuccaucacacccagcugauuuuuuguauuuuaguagagaugggguuuccccguauuagccaggauggucucgaucuccugaccucgugaucugcccaccucggccucccaaagugcugggauuacaggcaugagccaccgcacucagcccucuuuugauagaauuuaaggaauugauuuaagagguguuguugaaaggugaauaguggacauugauguaacacagagacaguaauugcaggaugcugccaccauuccugggguuggagggacaaagggaagaguuugggguuuuuagcgcuuuaaggaagguccccucggaucugggacucagaacuucugaaggagggggcagugugcugccugguuuguuuauacuucugaggagccagaugaaacugguucugggaguacagaacuaaaaaacccagacauagaaaccaacaaagccccuauugguggauguugacaggaagcagcuggugaagcagaagugaagacagcaaggcccccacccuggcaccacaaaacagauaauagaagggugagggucuggagcagaaagacaguaacuucauaaccagccucaggaguuucugacucaauucucaggaaaauaguuugcuuugucgaauuaaaauuuaacaacucuacuggcuauaauuuagauuccugccuuuccaugugagauuuaaacaaccaaacucaacaccgcacacucuaacaccagauguuuggagguuuucccacacacaccaaacaguucucuagcacacuccagcuggguguccuccaauucaauucugacacugucuaccuggagauagugucagaucccacaggguaagagcccagucccacaggacuguccccuacuucagaggccaguugcauguccaggccuuccaacugaccagcucuaaauuagcggauucccaugacccucuccucaaguucagucauuugcuagaguagcuuucagaacucagggaggcgcuuuacuuaugcuuaccaacucaguguaaaagauauuacagaggaugcaguugaacagccagaugcaagagaugcagaggguaaguuauggggggagggacacagagcaugcacccucuacugcaccaccuuccacguggucagcaacccugaggcucuccaaacccaguccacuggaguuuuuaaggaggcuucagguaggcaagguugauuaaaucauuggccauuagugauuggcucaaccuccagccucugaccccuccccagaggucaggagauggggcugaaaguuccaauccucuaaucacaugaucggcaaccagcccccaucugaaggcuguccaggagcccccagucacagucuucucauuaacauagaaaagacacauaugcaggagauucccaggguuuaaggagcugugugccggaaacagggaugaaaagcaaauacauauucuuauaaaucacaauaucacacuccccauucuccagcugcccuucacauccucugugcucccuucaugcuacuaaaccugcauuccuguugaugcagagcguggcucugacuucuguggugcccacauuuaugaucauuucccauguuugucccacguacaggucuuuccuuucggagaccaaaugugaucaccuuauuggagaaagggaaagcacccuggaugguagagccaguaagaagacgccgggcuccuggugagugacagagaaccaaggcauaugucucagucuacuggggcugcuauaacagaaugccauauauuaggugacuuacaaacaccagaaaucuacuucucacaguucuggaggcugagaaguccaagaucaaugcaugagcagauucggugucuggugaggacugcuuucugguucauagguggcaccuuuuugcugugucugcacauggaggaaggagugagggagcucucugggagagagauuauaggugauuauagaugauaucucauucaugagggcuccaccuucgugacuuaaacaccucccaaaggccccaccuccuaauaccauuaccuuagaugguaaaauuucaacauaggcauuuggggagacauaaacguucaaucuguugcagcauagaggcagguguucugcauaagagcucauguaauugugagggggcaaucucuuuaagagauuauuugugugccucucccacugaaggcuccaggccuguacagagaauucaagucucuucaguaugaguccuggaggaagaaaaagcaacauuuaguaagcccuuacuagguaucaagcacucuucuaaguucagggucuuccucccaacaaccccauaaggugggugcuguuauuaccccuacuuuauagauaagcaaacaggcccagagagguuuguugacuugcccaaggucacccagcuaggaaggagcagcagaggaggguuugaggcccagacccucuucagagcgccaaacagccucugccuguuuccagaagcucagcucuccacacccuuaugcccaccugucccccugcaucucugcuuucguauuuccuuucagagaagguguagacugcccucucuguuaauacuuacgauaacauucaaaucugcaugauuuuugugauucuuuuaaaaauauuuuuuaacucuuuucuccaaguguucuuuucagcuacuuuucaaggauucauugacaaauagguuccucuuugguuggccaaguuauauauuuuguauguuuguuucuuuaaguagcauucauugaguuucugcuuagaugggaugcgucaucuaggagcuagggaucaacauuuugguguaggcugggagaaaacggcaccaccucgagcgucuggcuuuggugacguccagguucugaggguguguaacggaagccagauggaagcacagugcaaaaagaagacacgugcauuauuuuacaucuuaauuucaacaugaagaaauauccuuuauuaaaauacuguuuuuaaguuuagaagaaauuuagucauauaacaaaguuuagaaaaaggaaaagacaaaaacaguuuauacauagaguuaucacugauuacuuguuuauuuaaugaaauuggauuucaucguuauuauaagguuuauauauuucugcuuuuuucacauuuuguuuuaguagaaauguucuauguuacuagucucucauguccuauuuuccauuuagauucuaauuuauuauuauuaacaucagcguaucugcauuaagugcuuuugccuguuuucuauaguacugagucacagagggggagcucuagauacuucugaauuacuuugcagaagaauugucauaucaccagcccccaguaaaaaacccuaggcacuaggucuuuaucuagaagacauuucucacaauugcgaggucucacaauugugaaauuucacaaauuguggguguguugucgcaauuuguugcaggaggaaugaagugcagccugugugacugcacagggacacagcuccugaaagcugugaccaguuuccucuagagucugccccauuucccuuugcacacuuugcuuugaauccuuuugcuguaauaaaucauaaccaugacuacaacuuaaaaaggagaauuaucaaaucagcaccaucaauagcaacaggguuugauuuuucauacucacuaguauuggauauugccauuaaaaugucucucuuuauuuaguaaaaugaauuaauagcagucagcauuuauugagaacuuacuuugugcagauucugugcuaaagccuguaaguucagcauuucauuuaguccucacaacacuuguagaaaucucugucauucccaagugacaagaugaggguuugagucuuagaaauguuaaauaacuugccuaggaucuccuguccgggagaugcaguagaagguuugaagccuuggcaguucaccuuuuuaaauuuuuuucucuuuaauuuuuacgggauauagagguguauauauuaauauuuacagggcacauaggauauuucaauacaggcauauaguguguaagaaucacaucaggguaugugagguaucuaucaccucaagcuuuuauuauuguguuacaaacauuccuauuguacucucucaguuguucuaaaauguacaacaaaguauugcugacuguauucacccaguugugcuaucaaauaguagauuguauuuauugcaucuuaacuguauuuuuguacccacuaaccaucuccuuuuuucugcuacccuucccagccucugguaaccauccuucuacucucuuauauccaugaguucaauuguuuugauuuuuagcucccacaaaugagugagaacaugugaagguugucugugucuggcuuauuucccuuaaaauaagguuuuccaguuguauccauguuguugcagauuacaggaucucauccuuuuuuauggcuaaauacuacugcaugacuguugauggucauguggcuauugugaguagugcuguaauaaacauggaaaugcagagaucuuuuuuauauacuaauuuauuuuuuuggggggguauauaccaagcaguaggauugcugaaucauauauuaguuccuauuuuuaguuuuugaggaacccccccauacuguugucaauaguggcuguacuaauuuacauucccacaguguacgaggguuccccuuucuccauauccucaccagcauuuguuuugccugcuuugggauaaaagucauuuuaacuggggugagaugauaccauguaguuuugauuugcauuuuucugaugaucagugauguugagcacuuucucauaugccuguuugccauguguacguaugucuuugagaaaugucuaucagaucuuuugcccauuuuuuaauuggauuauuacauuuuuuuccuauauaguuguuugagcuccuuauguauucuaugguuaucaaucccuugucagauggguaguuugcaaauauuuucucccauucaguagauugucucuucacuuuguugauuguuuccugugcugugcccaagcuuuuuaacuugauaugauucuauuaguccauuuuuaguuucauugccuguguuugugggguauuacucaagaaauauuugcccagaccaauguccuggagacuuuugcccguguuuuguuuuaguaguuugauuguuuuaggucguagauuugucuuuaauccauuuuuauuugauuuuugcauauggcaagagauuggagucuagugucuucugcauguggauauccaguuuuuccagcacaauuuauugaagagacugucccuuccccaauauauauuuguaacaucuuuguugaaaaugaauucacuguagauguauggauuuauuucuggguucucuauuccauuccauuggucugugugucuguuuuuaucucaguaccaagcuguuuugauuacuauagcucuguaguauaauuugaacuuagguaauaugauuccuacaguuuuauucuuuuugcucaggauggcuuuagcuauucugggucuuuugugguuccauauaaauuuuaggauuaccuuuucuauuucuaugaggaaugucucugauauuuugauagggauugcauugaaucuguagauuaauuuggguaguaugggcauuuuacuaauaauuauucuucaaauccaugagcauggacuaucuuuccauauuuuuguguccucaucaguuucuugcaucagguuuuguaguuuucauuguaauuucacuguguuuguuaaguuuauuccuagguauuuuauuuuauuuguagcuauuguaaaugggauuacuugauuucuuuuucagauugcucacuguuggcauauagaaaugcugcuggauuuuuauauguugauuuuguauccugcaacuuuacuaaauuuaucaguuguaauaguuucuagguggauuuuuuaugauuuuccaacuaaaagaucauaucaucugcaaagaagaagaauuugacgucuuccuuuccaacuuggaugccuuuuauuucuuucucuucucugauugcucuagcuaggacuuccagugcuauguugaauguagaauaauaguugugaaagugggcauucuuuuuauuuuccugauguuagaggaaaggcuuucagguuuuuuuuccauucaguauuauacuagccaugggucugucauauacggcuuuuauuguguugaggaauguuccucuauaaccaguuuuuugagggaucgcaucaugaagggauguuaaauuuuaucaaaugcuuuucagcgucaacugaagugaucauauguuuuuuguccuucauucuguuuauauauaucauugauuugcauauaucaaagcauccaggcauuccugggauuaaucguucuuguucaugaugaaagaucuguuuaauguguugaauucaguuugcuaguauuuuguugaggauucuugaauuaauauuaagcucuuuuuuugauguguccuuggguuuugauaucaggguaauacuggccuuguagaaugaguuuggaaguauucuguccuccucuauuuuuuggaauaguuugaguaggauugguauuagguuuuuuuaaguauuugguaaaacucagcagugaagcugucagguccuggguguuucuuugcugggaaacuuuauuacagcuucaaucucauuguuuguuauugcucuguucagguuuuggaugucuucaugauucagucuugguagguuguaugugucuaggaauuuaucuauuucuucuagguuuucuaauguauuggccuagguugcucauaguagucucuaaugauccuuugaguaucuguaguaucaguugcaaucauuccuuuugcaucucuggucuuaucucuuuuuuucuuaaucugauuaaaaguuugucaauucuguuuauguuuuugaaaaaauuucauuuuguugaucuuuuguggcauuuuuuuuuuuuugagacagagucuugcucugucacccaggcuggagugcaguggcacaaucucggcucacugcaaccuccacugccauguucaugcaauucuccugccucagccuccugaguagcugggauuacaagcguccgccaccacgccuggcuaauuuuuguauuuuuaguagagaugggguuucaccauguuggucaggcuggucuugaacuccugaccucaggugauccgcccaccuuggcuucccaaaaugcugggauuacaggugugagccaccgcgcccaggcucuuuugugguuuucuaauuuaaauuucauuucuuucugcucugauccuuacuauuucuuuuuuucugcgaauuugggguuugguuugcucuugguuuucuaguucuuuaagaugcaucauuagguuauuugaaguuuuuuacuuuuuugguguaggcguuuauuguuacaaacucucuucauacugcuuuugcuguaucccauagguugcagcauguuuucauauguuguguuuucauuaucauuuguuuugaggaauuuuuaaauuuuaauuaagaaauuucuucaggccgggggugguggcucacgccuauaaucccagcacuuugggaggccgaggugggcggaucaccugaggucaggaguucgaaaccagccuggccaccauggugaaacccugucucuacuaaaaauacaagaaauuaaccaggcauggugguggauggcuguaaucccagcuacucgggaggcugaggcaggagaaucgcuugaacccaggaggcagagguugcagugagccaagaucgcgccauugcacuccagccuggacaacaagagcgaaacucugucucaaaaaaaaaaaaaaaagagauuucuucauugacccacuggucauucaguauuauauuguuuaauuucaauguguugguauacuuuccaaaguucuucucauuauugauuucuaguuuuguuccauuguggucagagaagauacuugauaugauuucaauuugaaaguuuuuuuuuuuuuuuuuuuuuuuuuuuuuuugagacagggucuugcucugucacccaggcuggaauacaguggugcgaucacaacucacugcagccucaaccuucuaggcucaagcaauauucccaccuuggccuacugaguagcugggacuacaggcaugugccaccacgccuggcuaauuuuugcauuuuuuuuaaagaugggauuucaccauggugcccaggcuggucuuggacuauugagcucaagcaauccaccugccucagccucccaaagugcugggauuagaggugugagccagugcacccagcuuuuuuuuggauuuuuaagacuugucuuguguccuaauauuucauggucuauaccugagaaugauccaugugcugagcagaauguguaaccuguaguuauuggaugaaauugucuguaaauaucuauuagguccauuagguccgauguuucuuuguugauuuucugucuggaugauuugugcaaugcugaaaaugaagugguuaagucuccaacaauuauuguauuguggucugucucucucuuuagcucugaaaauauuugcuuuauguaucucggugcuccauuguuggguguguauauauuuacaauuguuauaucccuuugcugaauugauccuuuuagcauuauaugacuuucuuuguaucuuuccauacuuuuugucuuaagcucuauuuuaucuaaauauagcugcuccugcucuuuuuugguuuucauuugcaugggauuuuuuuucccucccuuuauuuuuagucuaugugugucuuuauaggcaaaucauguuucuuauagggaacagaucauugagucuuuuuaaaaauucauccagccacucuguggcuuuugacuggagauuuaguccauguacauuuaauauuuauaaguagagaccuacuacugacauuuuguuauuuguuuugguuguuuuguggccuuuucuuuuuccuucuugucuuccuugugaaagugauuucuugaauuauauuuuuuguguaucucuuacauauuuuuuauuugaggucagcaugaggcucguaaauaauaucuuauaacccauuaauuuaaacugaugacaauuuaacuuugcaaaaacaaaccaacaaacaagcaaagagaaaacuaauaaaaacccuauacuuuaaauuuaucuccucugcuuuuaaacuuuuuguuguuuauauuuuaauacugugugucuugaguuguuguaguugccguuuuuuugucaguccgucuuuuagucuuccuacuuaagauaugaguaguuuacacaucacaauuacaguauuauaauauuuuguauuuaucugugcaguuacuauugcuagugaguguuguauguucagaugacuuuuuauucgucauuagcauccuuuucuuucagacugaugaacucccuauaggcuuucuuguaggagaggucugguguugacaaaaucucucagcuuuuguuugucuaggaaagucuuuauuucuccuuccuguuugaagggcauuuucacuggauauaauauuccaggauaaauguuuuuguuuucuucagcucuuuaaauauaucauaauucucucuccuggccuauaagguuuccacugagcaaucugcugccagauguauuagaguuccguuuuauguuguuucuuuucucuugcugcuuuuaggaucaugucuuuaucccugacauuugggaguuuauuaaauuaucugagguagccuucuuuggauuaaagcugcuugguguucuauaaccuccuuguacuugaauuuugacaucuuucuccagguuuggaaaguucucuguuacuaucucggaauacacuuucuaccccagucucucugccuucucuuuaagccacuaacuccuagauaugcccuuuugggucuauauacuagauccuguaggcaugcuuuauuauucuucuucccuuugacuccucugacuauauuuucaaagagcccaucuucaagcucacuauuucuucugcuugaucaauucugcuguugagagacucugaugcauucuuuaauuugucaacugaauuuuucagcuccagaauuucugcuugauucucuuuaauuauuucaaugucuuuuuaaaauuuaucugauaggauucugaauuccugcucuguguuaucuuggauuuuguugagcuuccucaaaauagcuuuuuuuuuuuuuuuuuugagacagaguuucucucuguuccccaggcuggacuacaaugauggcaugaucucggcucacugcaaccuccgccuccuggguucaagcaauucucgugccucagccucccgagcggcugggauuacaggugugucccacuaugcccagcuaauuuuuuuuuauuuuuaguagagacgggguuucaccauguuggucaggcuggucucgaacuccugaacucaggugauccacccgcccgccuuggccucccaaagugcugggauuacaggcaugcuccaccaugccaggccaagauagcuauuuugaauucucugacugaacggucacauuagcucugucacuccagaacuggucacuguugccuuauuuaguucauuuggugaggucauguuuucccggauggucuugaugcuuauggauguuugucaguaccuggucauugaugaauuagguauuuauucuuaucuuuguagucugggcuuguuuguacuaguccuuccagagaagacucuccauguauucaaaggggcuaggaugugucuuuguucacugcagccauguuugcauuaggggucaccccauggccaguaacucugugacucuuguagacucacagaaguacugccuugguggucuuugguaagauccaggagaauucccuagauuaccaggaagucauucuuuucccuuacuuucccugaaugaauggagucucucugucucugugcugagcugccuagaguuggggaagggaugauacaaacacucccauggccaccaacacugggacugugcugggucugacccgaagccagcguaguacucauucuugcccaaggccuguggcuaccacugccuggcuaccacugauguuuauucgaagcccaagaggucuuaauucaucaggugguaaauucuuccaggccuguuuuucccuuuagggcagcgaguugccuucuggcccaggguaggucuagaaaucuuguccaggaccuauggccuagaaugaggccuucaggacacugcuuggcacuuuuuuuuuuuuacugugguugagaugauauccaaguugcaagacaacguccucuuuacucuucccucuccccuuggagcugccagcugugcugccuggaguugggagagaguugauacaaacacucucuuggccacuccagcuggugugucacugguaugucacuggguagcagguaccccaaguccacugguucugagccaagcacagcacuaggauuugcccaggaauugcaguccuuguggccuagacugccuuucagauuuacuuaggacaccagaguguuuuagucugugguggggguacuugcuggaacucaaguuuccaccacugugguggacaauucuuaggcuagagcugauuuaaaugcuuccucugggggugcuggccaaauucugccccacguugcuuucugcugugacagggcagcacugaguuccaaugcagagucccaccaucacuccauucuuccuccuccaaacacauagauucucucuuguugccaugcugcacugccaggcauugggggagggguggugcaggcauaugaugacugucuuuucuacccuccucagugccucuuucuuugaauacgauguuaaaacuugauacuuugauugcucaccuaauuuuugguuccuaugaagguguuuucuuauguggauaguuguucaauuuggcguuacugcagagggggcaaucgcuggagggcucuauuuggccaucuggcucuuccacuuucuccuuuuuaguuguuuuguuuguuuuuugagauagagucucccucugucaccuaggcuggagugcaguggcaccaucucagcucacugcaaccuccgccuccuggguucaugcaauucuccugccccagccuccugaguagccgggauuacaggcacacaucaccauacccagcuaauuuuuguguuuuuaguagagaugggguuucaccauguuggucaggauagucuugaacuccugaccuugugauccacccaccucggccucccaaagugcuaggauuaaaggugugagucaccauguuuguuuguuuuuuuuuaaggagacagggacagggucuucuguuacccaggcuggaguguaguggugcagucauggcucacugcaaccuuaaacuccugggcucaagcaguccuccugccucagccucccaaguaccaguuuguuucuugagcccuuguggauagacuggauauccauauugguuuacccauacuggauaggccauaaaucuuucuuguagauuuacuagcauuuguuuucuguuuuuacuuauucucgugaauuguuuuuucgugaucuuuccccuuuuaucuagcagugacuuuuuuauuuucugcuuguauaguaagcuuucauauagaaaauacauuaaccauaugacauuacauuugacuucaaauauuuccccauucuuuccuaagucuuuuuauuuuauuuaccucuuauuuuucuacuugguuauaugaaaguuuuuuucauuuuugugugauuggaaguauuggcauucacauuauaauuuuucuuuuuauuuccauaguuagaaagaauuugggguagauuucauauuauuuuaguuuguaaugauuuuguacuuuauauugaacuaauuuaccugggauuaauuuuggugucuggugugguuuaaggauuuccacauugaagauggggagaugggcugaggggauauguuaguauuccacacaggaaggaacaaaggaagguacaaaggaaaaggaagggaagcuaagaguuuuaggaaaaugugagagggagaagcagcuuaacugaugugacuuaaugggauguggggugggaaggacuauaggaggaaucuuggguuucuuguuuugcugaugcugcuagcuucacuauaaacauuuccauuaucuuccuguguuaauuccuuauuuugucugguuguuuucuggaacuucuacuaauaauaauuauaaugguagcuacuaccaguuauuaagcaacugcagguccacaaagcuuucucuagaacccuuggagcaagauguguuucagaauucagaauggugcagauuuuagaaaggugaacaggucauauacuauguguggcauaacauacccagcaggggcuggagcaguaccccaaaaucaaacacauugagauagcugcaaagacuagacuuccuaagagcaauaaauggaggcuaugaauagccucauugcauuucagaugggguuucacuccaaauauguauucaaaaaggaaaagaaaaaaggaaagaagacuuugguucucagcuuuuugaauacuggaauggcagauuagaggucauagcaugugccagaaaucucgcacauuauuucuaauucucaugaaaaccuugugagguacgugauuauuaucuauauuuucaagauaauaugcuuaugguaauagaguuaacaagugugucacaagauuaugcaguuaaaugaaaaacaccucaguuaauucaguaaugucugccuuuaaagcacaccuaugaaauagaaauauaaugugagccacauauguacugaaaaaaucuuuaguauccacauucaaauaaaaaucuaaaaccagugauaugguuuggaucuguguccccaccaaaucucauguugaaauuuaauccucaguguuggagguggggucugugggaggugauuggaucauggggguggauuucucaccaaaucucauguugaaauuuaauccucaguguuggagguggggucugugggaggugauuggaucauggggguggauuucucaccaaaucucauguugaaauuuaauccucaguguuggagguggggucuggugggaggugauuggaucauggggguggauuucucaccaaaucucauguugaaauuuaauccucaguguuggagguggggucuggugggaggugauuggaucauggggguggauuucucaccaaaucucauguugaaauuuaauccucaguguuggagguggggccuggugggaggugauuggaucauggggguggauuucucaccaaaucucauguugaaauuuaauccucaguguuggagguggggccuggugggaggugauuggaucauggggguggauuucucaccaaaucucauguugaaauuuaauccucaguguuggagguggggucugugggaggugauuggaucauggggguggauuucucaccaaaucucauguugaaauuuaauccucaguguuggagguggggucuggugggaggugauuggaucauggggguggauuucucaccaaaucucauguugaaauuuaauccucaguguuggagguggggccuggugggaggugauuggaucauggggguggauuucucaccaaaucucauguugaaauuuaauccucaguguuggagguggggucugugggaggugauuggaucauggggguggauuucucaccaaaucucauguugaaauuuaauacucaguguuggagguggggucugugggaggugauuggaucauggggguggguuucucaccaaaucucauguugaaauuuaauccucaguguuggagguggggucugugggaggugauuggaucauggggguggauuucucaccaaaucucauguugaaauuuaauccucaguguuggagguggggucugugggaggugauuggaucauggggguggauuucucaccaaaucucauguugaaauuuaauccucaguguuggagguggggucugugggaggugauuggaucauggggguggguuucucaccaaaucucauguugaaauuuaauccucaguguuggagguggggucugugggaggugauuggaucauggggguggauuucucaccaaaucucauguugaaauuuaauccucaguguuggagguggggucugugggaggugauuggaucauggggguggauuucucaccaaaucucauguugaaauuucauccucaguguuggagguggggucugugggaggugauuggaucauggggguggguuucucaccaaaucucauguugaaauuaauccucaguguuggagguggggucuggugggaggugauuggaucauggggguggauuucucaccaaaucucauguugaaauuucauccucaguguuggagguggggucugugggaggugauuggaucauggggguggguuucucaugaauggcuuagcaccauucccuugguggugucuuagcaauagggagugauucuuacaaaaucugaucguuguaauauguggcaccuccuccacacucucucuccuuguuucaccaugugaugugccuucuccuacuucgucuuucaccaugaguaagagcucacugaggccuccccagaagccaaggaggugccagcaccaugcuuguacagccuacugaaccaggagccaauugaaccucuuuuguuuauaaauuacccacucaaguauuuauuuauagcaauauaggaacuuccuaauacaaacagguaaaauuaauuuuaguaauauauguauuuaaccuaauauauccaacauauuauaucauauaaccagcauuuuuacaaugagauacuuuauacuuuuuuguaguaaauuuucacagucuggcauauguuuuauacucauaguauaccucaaaccagccacauuucaauuccucaguagcuacaggugacuaauggcuacuauauuggauagcauaguucuaaagccuguguuuaucaugccacauucacucagguuuauagucaguuugccauacaaguaguuauuuuauaucaccuuggacuuuggcacccuaugccagccauauugaucuauuuuacuacaaaauagauuccuucuuuuagucuaaucucuuaccuauuuuucugagcuuuuccugcuucuugcuaaagacuucaccuuuguaaauaucuaaauacagucauaugcugcauaaugauguuucaguccagucaacaacagacuacauauauggccaugguucuauaagaucauaaaacuguuauuuguacuguaccuuuucuacauuuauguauauuuagauacauaaauacuuaucauaguguuaaaauugccuacaggauucaauacaguaacgucauguacagguuuguagccuaggaacaggcuauacaauauaacauagguguauaguaggcuauacuaucuagguuuauguaaaucuacuguaagauguuugcacaaugaugaaauugccugacaaugcaugucuuacaacauguucccauuguuaagcaacccgugacuguacucaauucuaauuuuuacuaguucuuuuuaaauuugaucuuaagaauacauuuuuuaaaaucuacaacuuuauugagguaaacaucauaaaagucacuauaucuagaauauaauuaaaugauuuuggauaaauuuacagaguguguaaccaucaauaugauccaguauuagaacauuuuuaucaccccuguaagauucuucauguccauuuucaguuaauccccauuccuaccuugagccccaggcaaccacuuaucuucugucucuguagacuuaccuuuucuggacacauucucuaauaaacauacauuuauccauugaacaaccuguggaguucaaugugccguauauggcauaaaaguuaucguauaaauaaaaucuuauucauuuucaaauuacacucuucugaacucugguuauuaaauaucucuguaaagccuuuaguauagucaucaaaaccacaauaaaacacuaaaaaguuauguuuugguaaucauaauuguuguugugauuaauaaugauaauuacauuuauauuguagaaucuucauuuuuucagcauggaaaaggagaaacauuuaauuccuuuaugucuuucagacucggggucuaaaugugagaccaagaaguuaccuccaaaucaaugcaacaaaucugggcaaagcaucugccagaaacuaguuucugcacaacaaaaagcuccuacacgaaagaguggcugcaacaaaaauucaguccuaguaaaaccuaagaaagggcauucagggaagaaaccuuuaaaauguaaugacugugguaaaaccuuuagucgaagcuucucucuuaaacuucaucagaacauucauacaggagagaagccuuuugaaugcaguaauuguagaaaagcuuucagacagaucucauccauccuacuucaucagagaauucacaguggaaagaaaagccaugaaugcaauaaauguggggaaagcuucaaucaaagaacaacccuuauucuacauaugagaauucaugauggaaaggaaauucuugacugugggaaggccuugagucaaugucagucuuucaauauacaucagaaaauucauguuguugggaaugucugccagugcagaaagugcggaaaagccuucaaucagaugucaucccuuuuacuucauaagaaaauucacaauggaaagaaaacacauaaauauaauaaaugugggagaggcuucaaaaagaaaucagucuuuguuguacauaaaagaauucaugcuggagagaaaaucccugaaaaugcgaaggccuuaagucagagucuacagcaaagaagucaccauuuagagaauccuuuuaaaugcagaaaaugugggaaauuauuuaauaggauuucaccccugaugcuucaccagagaauucacacuucagagaaaccguacaaaugugauaaaugugacaaguucuucaggcggcuuucaacccuuauucugcaucuaagaauucauaauggagaaaaacuauacagaugcaauaaaugugagaaggucugcaaucggcauucaucccuuauucaacaucagaaaguucauacaaagaaaaagaaacuauuugaguguaaggaaugugggaagauguuuucuggaacugcaaaccuuaaaauacaucagaauauucauucugaagagaaaccuuucaaaugcaauaaauguaguaaaguuuucggccgccaaucauuucuuauugaacaucaaagaauucauacuggagaaaaacccuaccagugugaggaauguggaaaagccuucagccaccgaauaucucucacacgacauaagagaauucauacugaagauagacccuaugaaugugaucagugugggaaggccuucagccagagugcacaccucgcccaacaugaaagaauucacacuggagagaagccauauacaugcaaaacaugugguaaggccuuuagucagcgcacaucucuuauucuacaugaaagaagucauacuggagagaaacccuaugaauguaaugaaugugggaaggcauuuagcaguggcucagaccuuauucgacaucagagaagucauucuucagagaaacccuaugaauguaguaaaugugggaaggcauauagucggaguucaucccugauucgacaucagaauacacauucugaagaaaaagccuaagguuguuuuaaaucuauaaaaucaacgaaugaggcuaucaaacauauggcaaauauguauuugucuauaauguaaauuuuguguauaugggaccauuugaugauaugucccacuuugaaagccaaagagcaaaagucauuggugauuuugaccucaggauuugaaauuaacugaaggaaacucagaaguuuggucagucauugugaaugaagaucauuuuucauuugauaagaauuacuggcugggcgcaguggcuuacaccuguaaccccagcacuuugggaggcugagacaggcggaucacgaggucaagaguuugagaccacggugaaacccugucucuacuaaaaaauacaaaauuagcugggcgugguggugcgcaccuguaaucucagcuacuggagaggcugaggcaggagaaucgcuugaacccaggagguggggguugcaccgagcagagauugcaccacugcacuccagucugggcaacagagcaagacucugugucaaaaaaaaaaaaaauuaccgauauuuuacuuccagcauaguuuuaaagauaauuuauuggucacauacaacaaaauagaauugugaaguccauuauagggcucugagccugauuuaaggucacagaaaaaagaauuugagucuguuucucagaucuagaauuaucaaauauaaggaacuucucggcaaaacagggugccacuuucagcugacaaacuugugggugagaauaaagaaaagugagucuuuagguagauaaaguugucacucauaaugguguguaacaguagaaaccuuacuuuaccaucuccacggauaugaggauauaugaucuucauggugugaacgucuaacuuggcugagacaagcuaucaguaaaagaaccaagauauagugaagaaugaggauuucagagccaggagaaaucaguauuguuuuauuuggaaauaaaucaucuauauuuauaugaguaaacauugguauuuucauguaacaauacugguaugcaauaagugguguaauaugaguuguuauggacugaauguuuaugucccucccaaaacuaauuauguuaaaauccucaccaucaaugugauguuacuuggaaaugaggcauuugggaggcaauuaggauuagaugaggucaugaggguggagcccucgugaugggauuagugccuuuauaagaagagacaucaggcugagcccgguggcucaugccuguaaucccagcacuuugggaggccaaggcgaguggaucaugaggucaggagauugagacaauccuggcuaacacggugaaaccccgucuccacugaaaaaaaauacaaaaaauuagccaggcacaguggcaugugccuguagucccagcuacucgggaggcugaaggagaagaaucgcuugaacccaggaggcggagguugcagugagccaggaucacgccacuguacuccacccugggcgacagagcgagacuacgucucaaaaagacaucagaaagccugcuugcucucugcaccaugugaggaugcaggaagaagccagcugucuacagaacaggaagagaacccuacgagaaccuaaccaugcuggcgaccuguucucagacuuccagacuucagaacugugagaaguaaauuguuguuuaagccacccagucuaugauguuuuguuauggcagccccagcuaauauauggaguggaaagccuagauuuaucuacuggguucuuuuccugucagcaguucaacauguguaguagcuuucagucucugcuguuugugccaaauauauaagaaauaaaaucagauaacuuuuuuguaauuggaucaua

SEQ ID NO: 191717 - RNA, 21058 nt, Homo sapiens
ccugcgcgaugggggguuccagcgucgacucacggaguccuucggaugagagcgucugggugccagacgaggccggggguuuguuuugggugguuugggaguccgagcucgagggcugggccaggaagggcaggcgaggcgggcggcuccgacgcgggucgcgaaggcccagccgcguccucuguccccaggacgacuacauuucccagaggccagcggggcgcgcguacucgagucugcggggcggaggccgcggcucggggcugcugggcguucggggcggcuuggggcggcgggaccacuggagugagcugugggagagaugggggugugccuguguguaaaagaucugucagagugugaggcuccgugagagggugugguuucugugugugugugugugugugugugacagaccgagaguccagugugagaccaggguauguucgugugugacagagcgagacgggccagugugagagaccagugagugugagagagauagggaugugccugcauuugaaagagagcgugugaagcucagugagagguugcgagguguguggguguguaaguguguaacagaccagguguccagagcgugagaccaggauguauucgugugagagagugagacgggcuggauggagugugagagaccagugagugugagagaugggcgugugccugugugugaaaggccggucggucggugggugaggcucaaugagaggccgguguguguucgagagagagaagaaucaccauguaugcgagacuagacugugcaagaacagagugugagacugugguauguuaaugugugaaagggagaccagugagugugagaaauggguguuuugggugaaagacccgucagugugugaggccguguuaugugugucugacagacugagagagaccagagugugagaccaggguguguucgugugugagagacaacauagcgugagaccagugagugugagagagaugagcacguggcugugugugaaagaccagucauuaugugaggcuccuugagaggcugguguguguguaugagagagagaaagagacuaaacugugagaguccaaagagugagacuagguuauguuguuaugaguuugugagagagagggaggcgaucaaaguauaggacaaaguuauguuuccuggcuuacgacuucuaagauccuuggaaucuccaaaguauuaagugucuuuuugcaugcuaaugauuggugggcuggcagccuguagguugaucacgguaagggauggucacaagaacaaucuaggcaggauuagaggguugggauuaccugccccaucccucaaucuccagggaaaggaaagggagccacagguuaaacugaucaucaguggucagugauuuaaccagucaugccuacauuaugaagcuuccauaaaaacccaaaaggacuggguucaucaaacuuccagauagcugaacacuggagguuccuguaggaugagccccuuccuauauaaccuuguccuaugcauuucuucaccugcauccuuuguaauauccuuuauuacuacaaacguguuucccuaaguucugugagcugcccuagcaaauuaauugaacgcaaggagggggucauaggaaccccgauuuauagcuagucagaagcacaaguaaaacaaccugggguuugcaacuggcauuggaaguggggagcaauuuuguagggcugagcccucaaccugugggaucuuaugcugucuccagguagauagugucagaauuggguugcccuagaggucacccaccugguauucacuggguugcccuagaggucacccaccugguauucacugaagaacuuauugcuugccugguguguguguguguguguguguguguguguguguguguguagauccccacacaucuggucuuagaacuguuuuguguugugugaguggaguaggagaaacaguuuguuuuuccucuuugucaccugaguguguuaucagggacuggauugugagaauccagagugugagaccaggguauaucaaugugugagagaaauagaugugccugugugaaagaugaacaaguaugaggcucccuggagucugagaaagaucaugugugugucugaguaaaagcaagagacuagacugagaguucagugauugggagagacugggguauguuggugugagugugugagagaccaauggguaugugagagacuagaguaugucucugucuggacugguagguugugagaggguguaucacaguaugaaaaagauuggagugagagugaccaguauguauuuugugugcaugagauaaagcaguuggaauaugagagaucagaguguguuuguguaucugugugagacacuggagcauuugaguaacugaggccucuuugaaagauaccauugaauguguauguaugagagaccaucauguuuauaugugugaaagagggagagaaagacuagugaugugguugugugagagaccaaaaugggugagaaagaaacuaugugaaccaugguguguuauccaaaaggcuuuacaaauauaaccucugugagguugugaagcaugcaugugugagugagacagagauaagggacagugagcugugugugugagagaaguaagauuggggguaugugugaagguguuggugaaucaccacgugugcuuauauucauguccucaggcaauggaaaugugacuguguauaugugcuuguuuuggggugcuugugauuguguccuccgugugaccaugaaaccuguguuaguguuuguaugucacccuguauacccauaauuguggcccuguaugacugcuguguauggagagacuacuuggaagauugauaggauuggauucuuuaugaguguggcuguuuggaauuguguguugccgggauaggaaauguggaauagaauuccuguccccaguccaaggguuucaguaagaagcaaagcuggggugacugaagcuccuaacugaagcaggagacacccucacuucugugugacaggaggguaauuaaggggcugggacagaggugagagugaaaguggcagaauugagugcuaaagguuccaucguuucagggugaggaaagugaaacagugccggggggugggucagggaugcagugguggggauugagugaagaaggaggauaacccuggccucugguggcauuugggagucagauuuuccuuuuucuuuuguuuuuuuuuuuuucccaaaaaccccauccaucuggcccagaaaggagccagauuuucaaacaguagacuuucaaagcaugaagcagagacccaagaagagaaugacuccaccuuuaccuguaaaauggaggaaaugacuauuuuauaggauuauuugaaaaauaaagugagauaaucuaaucuaugcagaguaccuaaugcaucugaaugggaagguagcucuuugaaaaagauuaaauuuaggaccucaagcaugaaaaaaaaaaaccguuaugaguuuuagcccuucaguggccauagguugcucauacccaguuaugggaucaaccaaagcugggaagaagaagacaguuuuaggcuagugauucugggagugcagcaucucuggccucaucucucucuaaccuuucccuuccuucagccuugcccucccaagacacuguucuucaagagaaagaccagaagagaaggcaaaaaugaauguugaaguaguaaaagucaugccccagguuaguggauauuuucuuucucuucaugaaaggcagucuugcuguuuaggacuuuuuguaaugcuucuuuucuuuugaaaauucccugauuaacaguccaggagccuaguucccacuucucucaggggccacugucuuuaacucuaauuaccuaaugagugaguaauagcuuaguauaaaaagucauggaggucccucugagauuccucuucccaccuuguguacauuuuaaauuuaguguugacucuugugaaaagacuugauuuauguuguguggaauauacauguggauauguuaguacuagugaguugggcuccagguuaaaugugcaugcagugcguuuccuauauauagaaugcauuaggaauuauuccucuaccugaaguuuucuccaaaucucuaauuauguccuuaagauaaauucuuuaaaaguuuuucuuuacauuuuaaguaugaauuaccaaccucauucguucaccugaaaaaucuuauucuacuuaauuuuugcaaauuuuauaaauuuaaauaggugagaaguugacaugguacaaaauuuacaaacaaauuucacccuuaacucccaguuauuuuaagaaguuauucucaccauguaucucauucagagcuauguuaugccuuugcguguauacaaaaauacuuucuucccuucaaaguuaaugauuuuucgugucuuguugaugaaauuuuugucuaccuuuagguccuauuuuucuucuaagauuuguuuuauccuucacaguuaaguuucugguaagcuuagacuugauuuuugugguuuucuaucaugguagggcugaaauuacauuaacuuuuuauguuaaauuuaauuuacauuagauuuuuacauuuaauuuacauuacauuuuuacauuacauguauaauuuauaauaagugaggcagagauuuauuuuuucaaguuggcacaauggcauuaauugaauuauucaucucauucucacuaauuugaaaugccaccuauaucaugcacuaaauuccuguguguauuugguucuguugcuguacuacacucaguuuuacuugaauuucugcuuuuaaucuuuuaauuuuuaaauauuauauugcacauguauaagaaacaauguauaaaaaggaauccuuaauucucccacugugaaauuccccuccucacauuuuuucuaaguggaaaauguguuuucaugacauacaugagugucagauguccauaauuaaugcuuaauuaauuuauaugcuucauauggaaaguuacguuaaauuaauuuugaaacacugcuuuuuuuucuugugcugucagaguucaugagauauuaaaaaacauuuacauggauucugggcaucugugucuuccucagcauuaaaaccauuuugugaguuaccuaacauaauuuuccaaagauacagaccuuuuaguuugugugccucauguugucauuaaaauucuaccugaagucacaagcaccauacacaacagaauuaguccccuccaauuugcccuauagaaguaaguugggaucuccacaauacaacuuacugucuuuaguuuugauauuuaaccucauacuccugaauaauguuccauacacuauuucuugauuauuuuaguuuuagaaaugauccaguaaccuacuacuauagaugauaaagaugcaguccauuaaccccaccaccugaaaugcacacacacaugcuuauuugauagacuguaaacauuauucacuauuuuuguuuuaagucaguguucagcguagcuuggugucuuucaucaauuuggaaauuuuucaaccacaaauauucugaaacuuuccucuuuuucuaagaucacaauuauauacauaacugacacuguuuuauaugucacuuaugcuuuaauucucucuuuaauucucuaaucuccuguuaagcccauaauggaauucuuaacuucuguuauugcauacuuaguucuagaauuucuauuuaauuguuuuauguaauuuucuauuuucuuccugaauucacuaccuuuccuuuuagcuccuuaaaaauauuaucauaauauuuugguauccuuguuggauaauuccauuaucuggaucucuuauguguuucuauuuugugauguuuugaaaauuaucuuguuuuuugucuuaaaugccucauuuuggguuuagugcuagacuuuauauauuuuuaaaagauaguuugaagcuuugauguccuccucuugagaaggucuacuuaaaaaauaaauuuuauuuuuuagaauaguuuuagauuuguagaaaaauugcagagauaguguagagaaaucuuauaccacaccaagcuuccccuauuaauauuuuacauuagugugguacuuuuguuaaaauuaaugaaccaauauugauauguuauuaguaacuaaaguccgugcuuaguuuagauuuucuuucauuguuuuaacuuuuuaauuuuuuuuuuuuuuuuuuuuuugagacagaguuucacucugucacccaggcuggagugcaguggcaggaucauagcacacuauaaccugccucuccaguucaagcaauucucgugccucggccacucgaguagcugggauuauaggcaugcaccaccaugcacagccaauuuuuguauuuuugguagaggugggguuuugccauguuguccuugccaugcuauguaggcuggucuugagcuccuggccucaagugaucuaccggccuuggccucccaaagugcugggauuauaaguguaagccacugcacccggccaggcuuucuuagguuuuaucuaauguuuuuuuucugugccaggauucuaucuaggaaauuacauuacauuuaauagucauauuuccuaagacuccucuuagcugugauaguuuuucauacuuugcuuaucgaugaccuugucagcuuugaggaauacucaguuauuuuguagaaugucucaaaucugaugcuuuuucaugauuagacuaggguacuguguuuuggggaggaagacugcagagguaaaguuccuuuuucaucacaucaaaucaggggugcacacuguaaacaugauuuauuacuguugauguuaauagauguuaacuuaauuaacuuugagguaguguuugucagguuucucuauaauaagguuacucuuuuuucccucacuuuuccauacuguacuguuuguaaggaagucacuaugcacaaccuacacuccagaagugggaaauuauguucuaccuccuuaagggcaaacauaaaucauuugaaagaucuucuaaaugagauauuugccuauuuuccucauuuauuuauuuagucuuaauuuagucacuuacucaguauuaauccuccuggaaauuucauaaauuaucugauaccuugcaauaaaugguuguguccuuaaaaagaaaaaagaauuacaagcucuucagaugcuauccauugggauuuacuucauugguuauagcauuaucaguuaaaaaaaaucacuacauauacaugcauacauauauguaaaguuauucuauagauauugguaaaauucugguaguauauauacuagauuacuaaccauaaguaccaggaucaaaagcaguuuuuucugugggaacagccaaagcuccucuguccuuaauagucagcaaaauuauccuaaauauuggaaagaaugugaacaccuuuugcuugcauugaggaauacaucucauuuuauaagaauaugugaaaugaugguucuuaguucucaacucacuagaaggugaaaacuagaauucaguaaaacugugaguacacagagaaauguaaacaauuuuguaauucuuuuauaugaaaaauauauuaaacauuuuccuaaagguauguauaucuucuaaagucccguacauugaauaucuguuuaaaaugugcuuuuaaacacuaaucuucagaacaaagacaugauacagagauuacuguuuaaagcgaauuaaaaugugcucauaaccuugucuuuaguuauauuuuugauaacuuugcaaaucaggcacuaagauuaagaagauauucauuuucaacggaaguaaaucugaaggugaaaaaugcccacaauaacuuuuaaaauuucuuacaagcugcuggugauuauaacuggucauuaauuuuucucuaagaauauuuaaaaguuauaacuucaauuucauuuuguucugcaacuguggguucuaccaaccguggguggaaaacacaguauucacugaugcagaccuaagaaaauugcauucuuaaacauguuuuuauuauuuaagaaaaaaaaaucagcuacauuaguucaaugccuuucuccagccccugccaauaaaacuuggaucccauggaguaucauuugaaaaauaucaguuuagauauuccuuuuaugcuuuugaagauucaacacagguguguguucucccuugaagccgucuucacugccuuguaguuaugcacccauauuucccuauguucggaaucgauuggccccauuguacccaaugcaguuaaacacuuccauaaguacuguuuuggcuuggaucuuccuauuuauguuuuuucucuucuaugaguuauuucucaccuaaaguagagacacuuuggaucaacucagaguuaucuuuggacacgagcauugguugguuaagaauauauuugucacuucaggacuuagugacauucaaggauguggcaauagauuuuucccaggaagaauggcaauggaugaacccugcucagaagcguuuauacaggaguaugauguuggagaacuaucagagccugguaucacuuggugaggaucuuuucccuccugcauaaucuaccuuuaaggaacuuuuuugucuauauauuauuaaauuugcuuuuauuauauguaggucagaauggaauuugggaauggaaucugagaaacagaggauauugagggacugaagaaaacuugagauuuagaguuagugaauuuggagaauaucaaauauuccaugcauacacccuuaaggcaauugggaacacaagacacaaugugaaucucaccagucuccucaguuuccuuguucucucucuccuacagaauuacuaucaccacuagacaacaacaagguucacaaagaauauauagcuagauuacuauaaauucagaauaucacuuuuaaaaucuguaucuuuguauuaaguaacaaacugaagacacaaacugaaaauggcuucagaucacuuacuguuagggaaauuccuauggaccuuucuucuaagcacuggggccaccccauuggcuagauuagcuuucuguucuccagaagcccuuuugauuaugcuugugguucauugagcuucuugaaacuaaauuuauaucuuaaaccaaauuugggagauuuuuagccauuauuucuucaaaucuuuuuuucuguucuuuucuguuuuggacuucaguuacaccuauguuagauuguuugauauugugcccuagguaacuaaggauuguuucacuuuuaaaaaucuuuguucuguuuuaauuuuaauuuuucucucgcucucuuuuuuuuuuuuuuuuugagacagucuugcucuguugcccaggcuggagggcaguggcgcaaucuuggcccaccaccucccagguucaagcaauucuccugccuuagccucccaaguagcuggauuacaggcacccaccaccacacccagcuaauuuuuuuuuuuuuuuuuuuuuugaaacggagucucgcucugucgcccaggcuggagugcaguggcaccaucucggcucacugcaagcuccgccuccuggguucacgccauucuccugccucagccuccugaguagcugggacuacaggugccugccaccacaccuggcuaauuuuuuuguauuuuuuuaguagagaugggguuucaccauguuagccaggauggucuugaucuccugaccucgugaucugcccgccucagccucccaaagugcugggauuacaggugugagcuacugugccugaccuaauuuuuguauuuuuaauagagacaggguuucacuauguugcucagguuggucuugaacuccugaccucaggugaucugccuaccucagcaucccaaagugcugggauuacaggcguaagccacugugcccagcucagauuggauaauuucuguugauucauagucaaauucccugacucuauccuuacccucaauguuugguuaggugcaucuagugaauuuuuaaguuucagauguuauauuuguuaaauuauauaauauuuauuugguucuucuuguaguuucguuucugagauauccuguguguacauuuauuucaagcauauuugccuuuauauucuuaaguauugauauaauaauagcuguuuuuaaaucaugugcuauuucuucuucguuauugcagugugagcgucuauugcuugcuuuuucuaaugggcaugauucacuuuuuccuuuucuuaugucaaguaauuuugaauuuuaucauguauacuuaaauaaaacauuguagagccucuggauucugucauauuccccuaaagaguauugauuuuuuucuaaagcaggcaauuaucucaaaacuucaaacuguuucuagggaccuuuuaaaauaccucauuuacuacugugugauaauauucagaaaauguugggcuaaauuucugcccucaagccccucauaaaauaguucacagaguuaacuguuagcagucuuacuaggcuauuccagaguuuuauguagucuguccuucagaugugcuuuaucucuuaucuaguauuccuacuauaucauuccaccagaauuaagguacuggcuuuuaguucugaaauaacccaaaacaugaccaauuuucaugucuuuuuuuuauauguaggucuuugcauuucuaagccauaugugaucuccuuauuggagcaagggagagagccuugggagaugacgagugagaugacaagaagcccauucucaggugaguguggaagaaccagagaggggaaucuuuuugacauaauggcucagccauuuuuagaggugauaccuucucacuuaugcaucucagaaacucuucauaagccuuacaggccuggagagaaaacugaaacuuuaugcuucacaugggccccucaaauaucuucucuuccacuugacugucuucucucuaagaacuaauauucuguagagauuagagaaucuuaaaucucuaagauuuuuguuuugcaaaaaucauuauccagcuccuuaccaucccgucuuucgcuuugccauacagacuuauauaaacuucuauguuucuuaaaucuuuucuuaacucuugaauuagguacugcuuacaaauuauaauguacccugcugcucuuucauuccuuuccuguagcagauaggaaaaaucuaaacccuguuagccucuuccugaucagcuccuuccuacuucuauaaccucauucuuuauuacuuuuuagcuuuuucauuauacuuuaguccagaguuugcuaaauuaugugagauacccaggguauguuucaagugaguuacagguauaccaagcuacugagucucucaagagccuugggagacuagauggcuccagagguaauuccaaaucugauugccucugagucacaggcaguaucauucuuuugccugcuccaccuguguuuuacaaaugucauauuagggucaacuuuucugaacucaccaagcuuuuuacugacucaggcauaugcacuuccuguuuccucuacccagaguguuccucuccuggggucugucuauccugaauaucaaaucagagcuaaaaaaucaucucaucagaggccuucccuaaccaccuuaugugaugaacauuuccccaucccaacccaauaacuguccaccaagccacuguuuauuuucuuucuaacacucaggaaagccuacaauuaacuugcuuauguuuaaugcuuauauucugccucucccacugaaauuaaaguuccaaaagaaaagggcauaucaauauaugcccuuacaauuauggcuuaaagcauucuccuuucccuucuguaacaguguuugaucuuuuggaauaauuuggauccuaaauuucccguguccuccaaauacaauagucccccuauucaagguuuugccuucugcaguuuguuacccacaguccaccacuguccaaaaauauuaaauggaaaauuccagaaguaaacaauuuauauguuuuaaauugugcaccauucugaguuguaugacgaagucuugcaccuuucuguucuguccugcccagaucaugaaucaucccuuugucuagcacauccaugcuguaugcccuaccugccuuuuagucucuuagucucgucuagcuuuucagaucuguuguguguagugaauauaggguucaguaucauuccggguuucuggcguccacugggucuugaaauguguccacuguggauaaggagggaugacuauacccacacaucagaagggaaauagacccugcuuggauguacuuuauacuuugguuuuguaugaagaugccaucugccucaaauagagaaacagaaaagaacuuuccugauaauuggcccugugaagaacaaguggaagaagggaaaaggggaaaaggaagaagcuauaagucuggugggaugcugagucaauguguagauauaaguauuauuguaugcauaagauaucuuagugucuguuaaaaaaggccaggaaaugaggaacaaccauggcucucuguaggaaauuggaguugaagacaaucuucaugugacaaaaaaguaaaaugugagaaaacaguagaugauggacucagcauucugugucuuuuucuaguauuguucucuucagucugucuacguaggaaaaauuauaggugauuaguucauuaaccccacauugccucaauucuugaagcaugggugcccuggucugaauguuugugugccccugaaauucauguugaaaucaucuucucuagagugcuggugguagguggggaccuugggaggugauuaggucaugagggcucaugagugggauuauuaccuuuauaaaaggcccaaaggagcuuccuugccccuuccacugugugaggaaacaggaagaaggcaccaucugugagaaagccagcccaugccaugggccuugaucuuggauuucccagucugcagaucugugagaaauaaauuagccauggccggcuaauuuuuuauaaguguauuagucuguuuaguuauaaguguuguuuguaaguguauuagucuguucucaagcugcuaauaaagacauaccugagacuggguaguuuauaaaggaaagagguuuaauugacuuuuagugccacauggcuggggagcccugacagucauggcagaaagcaaaggaggagcaaagucacuucuuacaugguggcagucaggagagagcuugugcagggggacucccauuuacaaaaccaucagaucucgugagacuuauucacugccagugaacaguaugggggaaacugcccccaugauugaauuaucuccaccuggccccacccuugacauguggguauuacuacaauucaagaugagauuuguguggggacacagccaaaccacaucaauaagcuacccacuaugugguacagucaugggccacauaaacaauguaucuauccauuauggacugcauauaagacagucacacaagauuaugauggaacugcccuauacagguauaacuuuaaaaaaaucucuucuggcuaggcgugguggcucaugcccauaaucccagcacuuugggaggccgaggcaggcagaucacgaggucaggagauugagaccauccuggcuaacauggugaaaccccgucucuguuaaaaauacaaaaaaauuagcugggcaugguggcaugugccuguagucccagcuacucgagaggcugaggcaggagaauggcaugaacccgggaggcagaacuugcagugagccgagauugcgccacugcacuccagcccgggcaacagagcaagacucugucucaaaaaaaaaaaaaaaaaaaaacucuucuauugcugggcaugguagcucacaccuauaaucgcagcacuuugagaggcugaggugggaggauugguucagcaggaguuccagaccagccugggcaacagcaagaccucaucccuacuaaaaauaaaaaauuagcugggcaugguggcaugcacuugguacucccagcuacucaggaagcuaaggcagaaggaucacuugagcccaggaguuugaggaugcagugagccaugaucaugccauuguacuccagccugaugacagaggggacccugucucaaaaaauauauauaaaauguccucauagcauauuuuacuguaccuucuuuauguuuguauauguuuagauacaaaaauaccauugugcuucaguugccuauaguauucagugguaacauguugugcaggcuuguagaccaggagcaguaggccauauagccuaagugugcagcaggcuacaccauccaucaagguuuguauaaguacgcucuguaauugcccauccguaaugaugcauuucucagagcauuucuccaucauuaagugacacaagacuauuuuguuauagcaacccaaguuauucaagacacuggauauuccugauaccaugaagaccuggacuacaaagcauguuaauaccucaaaaccuuucuugacugcucuaguggauuugaucucucccaucucugaacuuuuauaacaauuuaaucuuuaucucacacuugauuauguuuuguauuaucuucucaaaacuuuuuuuguuggucuugucuuccuaaauuacuuucuaaacuuuucaagaacaauuccuucauuacuuugauaucacaaaugcuuagugcauaauguauaauugcuuaggaaauauuggauuagucgaugauuugcuauggaugacauagaaaaggaaagcccuuccuuugccuuuucuugaaaccaccuuuucccucagguuuucucucaguaucaucucuucaauacaaauuucuuuauauuuuacugauaacuuuguauauaugcccagauuucuucuaucuaugguaagugauguagcaauauauuuuuucuuuuuuucuuuuuuuuuuuuugagauggaguuucauucuugucacccaggcuggagugcaauggcacagucuuggcucacugcaaccuaugccuccuggguucaagcaauuuuccugcuuuagccucccagguagcugggauuacaggcaggugacaccaugccccgcuaauuuuguguuuuuaguagagacaggguuacaccacauuggccaggcuggucucuaacuucugaccucaggugacaugcccgccuuggccucccaaagugcugggauuacaggcaugagccauugcaccuggccgauguugcaauaauuuuuaaagcacauuuauuccuucuguaaacuuauauucuaggucaggaguuaagaaaguuacucgugguaguaaauaagaaugugauuaauaguaguuauaucaaccuacauaucauuauaaaauucauuucuucaaaaggggaaaugguaaaacccuguuaagcaguggcuuaaggugcugggugcaguggcucacaccuguaauccuagcuacucaagagaaggugggaagauugcuuaagcccaggaguuagugagccaugaucaugccacugcacuccagcccggacaacugagugaaacccucuuuuuuuuuuuuuuuuauaaaaagguggucuaagaggugauaauuuuaccaggcuguugaaaguaagaugaaagggaaaaucucuuaauaugcagauuaaaguucagggaacucugagaauuggagaguuugcuguauugaaacauguagaugauuucauaggaacaccauuuucacauuaugaaaagauaaccauaggauuucaccuaaauccuaagauaaucacaagccauaggguauaugguuacuggagaucuccagagacuuuucagcagcaguagugauacgauauugguauuuaaacaaaguuaacauaacuguauaugaaaaccaauuacaaguggaagagaguagaugaagagagcuuaauuuauagucuguuaggucaauacaggcaugaaauauuaccauugcagacuacuucucuaggauuucauccuacauugagguuuuuguuuuuguuuuuuguuuuuguuuuuguuuugagacagggucuugcucuguugccuaagcuggagugcaguagggcaaucauggcucacugcagucucaaccuccugggcucaagugauccucugaccucagccuccugaguaacugggaauauaggcauguaccaccaugcuugacuaauuuuuguguuuuuugcagagaugguguuuugccauguugcccaggcuggucuugaacuccugggcucaagcaauccaccucagccuccuaaagugcugggauuauaggccuaaaccacuacaccuagcccauuucgcuuucuuagucaccucucccauguuccuucaugagcugucuuucuuggggucucccugaauguuuuccaguugacaugccuguacauaacagguuuugugagauuuauuaaauauuuuuaaauuaccuuuuucacaaugucuccuuuguuguagcccaugauaaagggaacauucacuuuuuuuuaauaucuuucagauugggaaucuauauaugugacacaggaauuaccucugaagcaguucauguaugaugaugcaugcauggagggaauuacuagcuauggacuugaguguuccacuuuugaagaaaauuggaaaugggaagaccuuuuugagaagcagaugggaagucaugagauguuuagcaagaaagaaauaaucacucauaaagaaaccaucacuaaggaaacagaauucaaauauacuaaauuugggaaauguauccaucuggaaaacauagaagagaguauuuauaaucacacaucagauaaaaaaagcuucuccaaaaauucuaugguaauaaaacacaagaaagucuauguaggaaagaagcuuuuuaaauguaaugaaugugacaaaaccuucacccauagcucaucccuuacuguucauuuuagaauucauacuggugaaaaaccauaugcaugugaggaauguggaaaagccuucaagcaaaggcaacaccuugcucaacaucacagaacacauacuggagagaaacucuuugaauguaaagaauguaggaaagccuucaaacaaagugaacaccuuauucagcaucaaagaauucauacuggagaaaaaccauauaaauguaaggaaugcagaaaagccuucagacagccugcacaccuugcucagcaucagagaauucauacuggagagaaacccuaugaauguaaagaauguggcaaagccuucagugauggcucgucuuuugcucgacaucagagaugucacacuggcaaaagacccuaugaauguauugagugugggaaggcuuuuagguauaacacaucuuuuauucgucacuggaggaguuaucauacuggagagaagccuuuuaauugcauugauugugggaaagccuucaguguucacauaggacuuauucugcauaggagaauucauacaggagagaaaccuuacaaaugugguguguguggaaaaaccuucagcucggguucaucccguacuguacaucagagaauucauacaggagagaaaccuuaugaaugugauauaugugggaaagauuuuagccaucaugcaucacucacucagcaucaaagaguacauucuggagagaaaccguaugaaugcaaggaaugugggaaagccuuuaggcagaauguacaccuuguuagucauuugagaauucauacuggugaaaaacccuaugaauguaaagaauguggaaaagcuuuuagaaucaguucacagcuggcuacucaucagagaauucauacuggagagaagccuuaugaauguauugaauguggaaaugcuuucaaacagagaucacaccuugcccaacaucagaaaacucauacaggagagaaaccuuaugaguguaaugaaugcgggaaagccuucagccaaacuuccaaucuuacucaacaucaaagaauucauacuggagagaaacccuauaaauguacugaauguggaaaggcuuuuagugauagcucauccugugcucagcaucaaagacuccacacuggccaaaggcccuaucaguguuuugaaugugggaaggcguucagaagaaaguuauccuuaauuugucaucaaagaagucauacuggagaagaaccuuaagaauguagugcauguggccaagccuuuaguuaucaccaauccccuacuguuaaucagagaugucccacuggauaaaaaacauauaaauguaagaaauguagaaaaaccuucagccaggaggcuggcaagauggccgaauaggaacagcucugaucugcaguucccagugagaucaacgcagaaggugggugcuuucuguauuuccagcugagguaccuggcucaucucauugggacugguuagacagugggugcagcccacggagggugagcugaagcaggguggggcguaaccucaccugggaagugcaaggagucggggaucucccuccccuagccaagggaagccaugagggacugugccaugaggaauggugcacuccggcacagauacuacgcuuuucccauggucuucgcaacccacagaccaggagaucccccuugggugccuaugccaccaaggcccuggguuucaagcacaaaacugggcggccauucgggcagacaccgagcuagcuguaggaguuuuuuugauagcccaguggcaccuggaaugccagugaaacagaaccgcuuacucccuuguuaagggggcugaagccggggagccaagugguucccaugcccacugagcccagcaagcuaagauccacuggcuuggaauucucccugccagcacagcagucugaagucaaccugggaugaucaagcuugguggggggaggggcgccaaccauuaccaaagcuugaauaggugguuuuccccucacagcguaaacaaagccauggggaaguuccagcugagcagagcccuccacagcucagcaaagccucuguagccagacugccucucuagauuccuccucucugggcagcgcaucuuugaaaaaagugcagauaaaacccucaucucccugggacaaagcacgugggggaaagggguggcugugggcacagcuucagcagacuuaaacauuccugccugccagcucugaagagagcagcaguucuuccagcacagcgcuugagcucugcuaagggacagacugccuccucaagugggucccugacccccaugccuccugacggggagacaccucccagcagggguccacagacaccucauacaggagagcucuggcuggcaucuggugggugccccucugggacaaagcuuccagaggaaggaacaggcagcaaucuuugcuguucugcagccuccaccggugauacccaggcagauauggucuggaguggaccuccagcaaacuccagcagaccugcagccgaggggccucacuguuagaaggaaaacuaacaggaauauaaucaacaucaacaaaggacauccacacagaaaccccaucugaagguuaccagcaucaaagaccaaagguagauaaauucacgaagaugaggagaaaccagugcaaaaagccugaaaauuccaaaaaccagaaugccucuucuccuccaaaggaucacaacuccuugccggcaagggaacaaaacuggauagagaaugaguuugacaaauugacagaaguaggcuucagaaggugggaaauaacaaacuccucugagcuaaaggagcauguucuaacccaaugcaaggaagcuaagaaccuugaaaaaagguuagaggaauugcuaacuagaauaaccaguuuagagaagaacauaaaugaccugauggagcugaaaaacacagcaugagaacuucgugaagcauacagaagaaaaaccuucagccagauugaaugcuuuacagggaagaauucauacugcagagcggucuuaacaauguaaagaaugugcaaauguccucagacaagaugcacaccuugcucauuagugaguucauuucaggcagccagcucuuccucacccacuacaucaccaaguccuguggauauaucugcuaaauauuuuuggaauuuauccacuucuuuugguuccccaguccaaaacacagucauuucaccuggacuauuucaaucauuacacagguguccaaccuuuugucuucccugggccacauuggaagaagaaaaauugucuugugccacacauacaauacacuaacauuaacaauagcugaugagcuaagaaaaaaaaaaagucugugcauaguuuuagugauacaccaccuccgauaagcaaaaaaguccucacauucaauggguugcauacccaugaauucuaaaacuucauccucuuuugucccuuucgaguuaacauuacagccacagugaccuuucaaaaaugcaaauuaaguuacucuuaaaacucuaguuaaaauacuugauguacauaaagugcuuagcaaaaugaccaacucauacuaagugcuuaguaaauguuagauaaguauucuccagaauugauguaaauuauuuuuaaacagugcauucuugaaagcaguauggcagucauaaaaauuuuggaaccaaaacaguaucuuuuuuuaagcuaaaaaaaaaguuuuaaauggugucuuucuauguugcccaggguggucucaaacuccugugcucaagugacccucccaccucauucucaaguggcugcaauuacaggcaaccagccugacuuaaaacaguaucuuaagguagauggugauuagcacauguaguaugcuuaacauuuaauauuauaauaagacaucacagcggcugucucaugauuaaggcuguguucccuuguuggugaggaaauuaauuaugacuugauaaauagaacauguuuuaagaaguggcuauauagcucuggauaaaacgaacaaaagaauuagaauuccugcggggaauauauacaagacuuuauuuagucaaguaaaaaaaaaucacuaauguuuaacugaagaaagagaaauugaauaauauaguucuauuucaacauguggguucacagauuuauucuaaccuuccaaguaaaguuguuccacuaguaa

SEQ ID NO: 191718 - RNA, 13489 nt, Homo sapiens
uuuugguuaauguuggguguguuucugcgguuugugaggugagaggcgcuggagcuauggguccgaaccgcggugucugaacccagaaggugaagaguccuucuugcugcacagaggcagaucuuaggccccguaacggcgcccgccgcucccggcagugcuuuccccgcguacucgggauggcggcggccgcgcugaggcucccggcucagguaauugugccuucccugcccucaggucaccucauccuaacccgaauccugaagcagcgagagagcggcgacuguucacaggucugcagcccggacccggcgucgggacacugaggcguucgcgggagagguccuuguuucugacaccugugggaugcgguggggagagcgacaggcacagggaccggcgcgggcuauggccuggaggacagacccgggaggauggaaccugggguccacaggcgccuguagggaacaacgugugaggcgaagcuucuccuggaagagcaggcugggggcuguguauucgcugugaagacgcuagaagccauggagaguuucgaagaaaggagggaugcgauccaaguccaggcuuuuaagguuucccaaaggccaaaggaagaacauaguagaggagaugaggaccuuaggguucugggagguugacuccuuuguugauagaucacauaggugguagagaugacauuuugcacugagacacgcaggucaaccagucugaggucaccuggcuccagcgauaagaaaagguucaaggagaccugagcuuaucagauccccuuuguaacgucugcuuuccccucagacacuccuggcuacaaaagcacguaaagaacccacugagggggucgggcaagguggcucccaccuguaaucccagcacuuugggaggccgaggcgggcggaucaccugaggucgggaguucgagaccagccugaccaacauggagaaaccccgucucuaacaaaaauacaaaauuagccaggcguggugaugccgcaugacuguaaucccagcuacucagaggcuaaggcaggagaauugcuugaacucgggaggcagagguugcggugagccauugcacuccggccugggcaacaagagcgaaacucuggcucaaaaaaaggaacccacagagggaauuagaggguguuccauucccucacuggccuuauuccccauucacauguucucuagcuugugauguccugggacucuuacuugccauuuuuucaguccuuugaucugagaacacuggagaaacccuaaacccagaauccuaaguccaugacacaggauguauggagguauucccauuucugucaacccauguaaacauacuuugaagguuaacuacagaguugguaccaggucaugaaaugcuuagagguaaaaauucgguggggaggcaagagggcggcgaggaggugauguuaccacagucccauuugucugcaggcaucaucuggcugcaaagaagagaacacacuguguuugagggaggaggaaggaggaucagaguuuaaacuccugccauaaugcaggugaggguuacuggaccauauuaaugaguaaggagcuguggcuggauucaagauucacaguuuguaaaauggcaacuagauuuuccuuuuuuuuuugagcgggagucucgcucuaucgcccaggcuggagugcaguggcacgaucuuggcucauugcaagcucugccucccggguucacgccauucuccugccucaaccucccgaguagcugggacuacaggcgcccgucaccaugcucagcuaauuuuuuggauuuuuuaguagagacgguuucacuguguuagccaggauagucucaaucuccugaccucgugauccaucggccucggccucccaaagugcugggauuacaggcaugagccaccaagcccggccaugcccggcuaauuuuuaauauuuuuaguagagaugggguuucaccguguuagccagauggucuugaucuccugaccucgugaucuacccgucucggccucccaaagugcugggauuacaggcgugagccaccaagcccggucgguaacuagauuuucuaauagacugugagggcaugaaaggggaaucagguaugaccaccagguuuuuggucuuagcaucugcagugauggaagcugcaucaacugagaugagcacauaguagguauaauauucauuggggaugugaagaauguuguuuugaccauguuaagagucugagauaguuuagccuccauuaugacauugacacacuucaaauuuucaugguaaaucuuuugugggggccaggaaggggugguugcaggcugagggcugaauuucuugcuugggucccuggcugacauugccacaggagaaggaggcaagggcucaugaagauaggguaugucagacaacaugguuugucagggggcauaggcuuuccaaggguagaauagauaagagauguaagcagaagcauagaaauaauugaaggaagaugacacuugggccaaggcugguacuuauucaccacucuguggacucaccaagauuuugagaaaacuuuguuggugcuuggggguuuucauucggccugguggauacaugcucaggguaaauuugguuaucugugacagacauugggccugggguggacagcugaugggcugggauuuuauuuauuuuuuucuuuuguuuuccacuuuucuuagaccauucuccauaacaagggagugggauuuaaaugacucuagguggacagaggaaagucgucauuguagaggggucaccaagugcaacacagaaguggaauagggccauggauaucuaaagccccaccugguucuguggggauguggagccaugcaagaaggccuucauagaaugacuugggacugcauugcuauugggagccaugagaauucugugguaauauuggauccuguuugaauuugccaagcauacucugaauucugucagccacauuguggcauaaggccgaaaaugaaaggccaaugugaugugcaacguugguguguggugauacuguaugaccucaaauggccugagcacaaauccccuucccacucuguucuauuggauaauguauccuggccuaacaacccuuuucauuaagggaucaggcacaguuucugguuauuauacuuuguacuggguuucaauuccauuucuacucagaauuauuuaagcaagucaguggcacccuccugagaaaucaggggcuaucacacccucuucauccuacaaagugugcauaacacugucccugguuuccauuuguuguccacagugcaacccccauguggcccucucugccaggcugugaguuauuugauuuugaaauugcuguggauggcauauguacagucucaggugucaauuguuuccccaacacuauaacccuaaggggagaaucccacucagagcaguagaaggaaaagaaggggauuaaaauacuuuguuggccaggcuugaaggcucaugcuguaaucccagcacuuugggaggcugaggugggaggauugcuugaggccaggaguuugagaucagccugggcaacuuagcaacaccccaucucuuaaaagaaagugguugauguugcacauacguaagaucccaucuccacagaaggcugaggccuggggcuaagggguuugaacuuuccaugagccaugaucacacuacuccccuccagcuuaggcgaccaaaggagaaccugacuaaaagaaaccaaaacuguaauuuguguuaaggcucaaaagaagcugaugguugggggaugucauguugggcuggccgugacaugugccugugcuaucuaaagaaugauguguaaggccgggcgugguggcuuaugccuauaaucccagcacuaugggaggccgagguggguggaucaccugagaucaggaguuugagaccagccuagccaacauggugaaaccccauuucuacuaaaaauacaaaaauuagccaggugugguggugggugccuguaaucccaguuacuugggaggcugaggcaggaaaauugcuugaaccugggagguggagguugcagugagcugagaucccgccaccgcacucuugucugggcaacaagagcgaaacuccaucucagaaaaaaaagaaggauguguauuuagagagggaguacgucuaauggacccaggcaacugcacugggcuuuaugugagcucggauauaccacaggcauuagcugucaggaggggguggacccuuuuauguuaagaguacagcauagccgggcacgguggcucacgccuauaaucccaacacuuugggaggcugaggcggguggaucacgaggucaggaguucaagaccagccuggccaagauggugaaacccugucucuacuaaaaauacaaaaaugagccagaagugguggugggugccuguaaucccagcuacucgggcggcugaggcagagaauugcuugaacccaggaggcagagguugcagugagcugaggucaugccacugcacuccagccugggugacagagcgagacucugucucagaaaaacaaaaaaacaagcacagcauagaucccuauuuuuccccuacuucuuaauugcugauggcuauacugagugaccagugggcccacgaagagacaaaggcaccaguggacuaguuucuccucugugcugaggaucuugggaggaggaugggcaagggggugggggugugggagagguggauugugguaccucagcauaggagcuguuugugguuucaucugucaccaucauagcagggcacuguggcauuugaagauguggcugugaacuuuucccaggaggaguggagucuccuuagugagguucagagaugccuuuaccaugacgugaugcuggagaacuggguacuuauauccucccuggguaaguuccucacacccuacccuauuuccugaauagaucucugcccuuccccuuuucucccauuggcaagacugucuuuuaucaugucaggaccaugggcacagcuuccuucuccacuucucuggguagguuuugugguugguaggucugagguuuguguacugccuuuucuccuugagcagucccaauacgugcuuugcugcagacucucagggaaggaguuagagucaggugucucguagucaaucuaaugcauuucaccuugcaugucccuguguugcuguuugacuuuguccagaucugagacuccuguguguccagguucuacuuccuuccuuuagcugacauuacuugaugccugccuguggcaggaauugccaucacucccguugucacugccuacauagaccaaaggcaagacccuccuuagaaauucuguuuuuaggccgggugcgguggcucacgccuguaaucccagcacuuugggaggccgaggcggguggaucacgaggucaggagauggagaccauccuggcuaacaaggugaaacccugucuccacuaaaaaauacaaaaaaauuagcugggcgugguggcgggcgccuguagucccagcuacuagggaggcugaggcaggagaauggugugaaccugggaggcggagcuugcagugagcugagaucgcaccacugcacuccagccugagcaacagagcaagacuccgucucaaaaaaaaaaaaaagaaauucuguuuuuaguaauuaguuuccuuuccuguguguugucauguuuugaaccacuguugcugaaaacuaccagcacauauuggcaggaggaagaggauagggaguccagugauguggccuuugugaccagccagcauuucaauuuaaucagguggaaauggccuuccuggcucaucacuguuugcugccacagaggcuaguugccccaguucugcccuaucuuugccuuaguacuuacaucauccagguuccauguacuucaucauugugauggugggauggagaguccucagugcugcagaagaggcaguugaauccaggcucagccugauguucucagagggagccugucacugaggaguggcaccuggugggagggcaugaguucgagauuuucuucaaaucguaucagaaaccuauucuauuugacuaguauuuuuguggccaguaggcacuguuucugucuuuuccuuuccauucuugagagcaucagauuugucaguuguacaccuugucacuuguacucugauguccaucccccaacgaaucuuccagucucuggacuccacaucucacccauuuauuuucucauguuuacuucuagagugcuguccgauacuggcauacacauuguguauuagcaaguguguacaaauuguguuuuguuuuugguuuuuguuuuuguuuuugagauggagucucucuuugucgcccaggcuggaguacaguggcgugaucucagcucacugcaagcuccaccuccuggguucacgccauucuccugccucagccucccgaguagcugagacuacaggcgcccgccaccacgcccggcuaauuuuuuuguauuuuuaguagagacgggguuucacuguguuagccaggauggucucgaucuccugaccucgugauccacccaccuuggccucccaaagugcugggauuacaggugugagccaccgcacccggccaagugugugcaaauuguuaaacuguucugaccaagagcuguugucuuguaaaucauuuucuuaggccuggacauagccuucuauauagcauuaacaugucaucagauaauuucccgcagacaagugguuugcaaaggaaagaguuauacagcaggugcauuggcuuacaccuguaaucccagcacuuugggaggccgauguggguggauuucuugaaccugggaguuugagaccagccugggcaacaaggcgaaaccccaccucuacaaaaaguagcugggcguauuggccugugccuguggucccagcuacuguggaggcugaggugggaggaucaccugagcccaggagacagagauuaugccacugcacucugugcuggaugacagagugagauccugucucucaagaagaaaaaaaaaauuguagaccuuggcucaauucucuguguugcauguaugcuaaugcccuucauaucaugaggccgacauucugugaccuuuauagcccaguaaugauagccucaucuuccacgugaagccaacuuucuguuccugcaaauauuuccauggaguaauuccuugguuugucagacacgcuugugggugggcugugccuucccaccagaguuaacuugaauucaucagcauuuucuugcuuucagguuguugguguggaucagaagaugaggaggcaccuucuaagaagagcauuucuauacaaagagugucucaggucagcacuccuggggcaggugugucucccaagaaggcccacucuugugaaauguguggcgcgaucuugggagacauuuugcacuuggcagaucaucaggggacacaucacaagcagaaacugcacaggugugaggcaugggggaauaaauuguaugauaguucaaaccguccgcaccagaaucaguaccuuggagagaaacccuauagaagcaguguugaggaagcauuguuugugaagagguguaaguuccaugugucagaggagucaucuaucuucauucagaguggaaaggacuuuuugcccagcucaggauuacugcugcaggaggccacucacacuggggagaagucaaacagcaaaccugagugugagucucccuuucaguggggagauacucauuacagcuguggagaaugcaugaaacauucuagcaccaaacacguauuuguucaacagcagagacuucccucuagagaggaauguuauugcugggaaugugggaaauccuuuagcaaauaugauagcgucaguaaucaucagagaguucacacugggaaaagaccuuaugaauguggagaaugugggaaaucuuuuagucauaagggcagccuuguucagcaucagcgaguucacacugggaaaagaccuuaugaauguggagaaugugggaaaucuuuuagucauaagggcagccuuguucagcaucagcgaguucauacuggagaaagaccuuaugaguguggagaaugugggaaaucuuuuagucaaaaugguacucucauuaaacaucaacgaguucacacuggagaaagaccuuaugagugugaagaaugugggaaauguuuuacucagaagggcaaucucauucaacaucaacgaggucacacuagugaaagaccuuaugagugugaagaauguggaaaauguuuuagucaaaagggcacccuaacugaacaucaucgaguucacacuagagaacgaccuuaugaguguggagaaugugggaaaucuuuuagucgaaagggacaccuuaggaaccaucagcgaggucacacuggagaaagaccuuacgaguguggagaaugugggaaaucuuuuagucgaaagggcaaccucauucagcaucagcgaagccacacuggagaaaggccuuaugaguguagagaguguaggaaauuauuuaggggcaagucccaccucauugaacaccagagaguucacacuggagaaaggccauaugaauguaaugaaugugggaaaucauuucaagacagcucuggguuucguguucaucagagaguucacacuggagaaaaaccguuugaguguagugaaugugggaagucauuuccucaaagcuguucccuccuucgacaucggagaguucauacuggagaaaggccuuaugaauguggagaauguggaaagucauuucaucagagcucuucccuccuucgacaucagaaaacucacacugcagaaagaccuuaugagugcagagaaugugggaaauucuucuccagucuccuugaacacaggagaguucacacuggagaaaggccuuaugaaugcagggaauguggaaaaacauuuacucgaaggucugcgcauuuuaaacaucagagacuucauacucgaggaaagccuuacgagugcagcgaaugugggaaauccuuugcugaaaccuucagucuuacugaacacaggagaguacacacuggagaaaggccuuaugagugcagugaauguggaaaaucauuucaucgaagcucuucucuccuucgacaucagagaguucacacagaaagaaguccuuacaagugaaaagaaauuugggaaauucuuuagcuaaaccucugugcaucuucuugaucagaggguucuuacuggaucaggaccuuaugagugugacaaacgugggauauucuuuaugcagaagucuuguuuuauuacauacagaagagcucccacugcagaagggccucuugagugcgaugaaugugagaaagccuucugccuucugucauuggauaacagauuguucucauaaggaaaacacuguacacguacaggaaauauuauuucuuguaaaacauaacacuggaggagaugccuuaugacggagccaucugccuaaauugacauaccuucagcaucugcauaaacucaauuauguuggagcuguguggcauuuuucacccugccggguucccuugccagacaugaugucgguuaucuggcaaaagccauuuuaugucggccacgaggcagguguucacugugcaucauucauucaccccaugauguucuggaaguaaaccuugguugucuuucguuggccagaggaauuggugaguagucucagcugucauuccuuucucauuucuuucggaugagcgagaccauggaucugucucaguacugguccagaggggucuucugucagcuugaaaagauggacuaccuuuuucagggaccuuaugggucucaugugauauuuuuuuuuuuuuuuugagacagagucucgcucugucgcccaggcuggaguacaguggcgugaucucagcucacugcaagcuccgccucccggguucacgccauucuccugccucagccucccgaguagcugggacuacaggugcccaccaccaugcccagcuaauuuuuuuguauuuuuaguagaaaugggguuucuccguguuagccaggauggucucgaucuccugaccucaugaucugcccuccuuggccucccaaaaugcugggauuacaggcgugagccaccgcacccagcgggucucaugugauucuuuaggcucuuaaguuccaaccaaagaacauucugcuucccauugcucugauuugugcaaugaauaaggccuuauuguuuaagcuuccuucagucuugagaguuguauuuacucuuucgggugguuuggaaacaacuggguucuggugucauaaaggggcagacagcuuuuguugggaucacuagacuuugugugccucagaggggacaguaugaugacagaauauacugucucuucacuuguggcauaguuuucauggcugcccaaggccuccaaagacuccagaacuuugugguccuuauuuguugacuagauacuccaauaauuucuggguuuauagauaaaccugagaagggaacaguguuugugacauccucugaugcuucugagaucgacacgaaaauuuccucucuuuuacaagggauauugcauucugcucaguacugcugagggaaaucuguucccuagguccuggaaugcagccaugugcucugauauccagaguuucguaguguggugucccagguuaugagauuauaacaggaagucauaauuuauagaauuucugcauuuauaggcaguggaggacacugcaagaacagaguuggaaugcacgucauccacauugauucaguuacuauguaugugguggacugucagguacagaaauucucagaaccuccauaauuaugaaucuuguguagcugaggccauugucaaaggaaauaauauaaaggauucguggauuccuguacccuuucucggcuguucaccucaaggcaauuccugcauuggcaggaggaagaggauagggagaagggagaucucuuaguccagugauguggucuuugugaccaaccaguguuccaauuuaaucaggugaaaauggccuuccuggcuuaucaguauuugcugccgcagagacucauugcugcacuuaggacaugaggagauuuuguauaguugucaagcauguuugucaaaaauaauagaaaauccauguuuuucuuuuuuuuuuuuucuaagacaagguguugcucugugacccaggcuggaguacaguggcgagaucauaguucacugcagccucgaacuccucaagcaauccuuuucccucagccucccaaagugcugggauuacaggccucagccaucauguccagcccacauuuuucuuuugaaucaauucuuuaaagccauaauaaggaauaaaugacauucuguaaacuauacauauuuaaacuguaccaugugguaaguuuagacuuucauagaaacccaugaaaguggccaggcacgguggcucacgccuguaaucccagcacuuugggaggcugaggcaggcggaucacgaggucaggagaucgagaccauccuggcuaacauggugaaaccccgucucuacuaaaaaaauacaaaaaauuagcugggcgugguggcaggcgccuguagucccagcuacucgggaggcugaggcaggagaauggagugaacccgggagguggagcuugccgugagccaagaucgcaccacuguacuccagccugggugacagagcaagacucggucucaaaaaauauauauauauguguauauauguguguguguguguguguguguguguauguauauauauguauauauguauauauguguguguauauauguauauacauguauguauauguauguauauauguauauauauguguguauauauguauguguguguauauguauauauauauauauuuugcaucccuuggcauaaauggguuagguaagugugucacuaaauagaaaaauacucccgucugcaaugaauuagaaaguugcuuuugauucuuucuuaauuuuuuuuguuuuugagacagaauguccgucugucugcccaggcuggaguggcacgaucucagcucacugcagccuccaccuccaggguucaagcgauucuccugccucagccucccggguaggugggauuacaggcaugcaccaccaugcccgguuaauuuuuguauuuuuaguggagaugggguuuuaccauguuguucaggcuggucuugaaguccugaccuugugaugaucugcccgccucggccucccaaagugcugggauuucaggcaugagccauagugccuggcccuuuuuuuuuuuuuuuuuuugagacagugucacucuguugcccaggcuggaguacagugacacaaucacaauucacugcagccuugaccugcuggacucaagucauccucccaccucagccucccaaguugcuagggacaggcaugugccaccacgcacagcuaauuuuuaaaauuuuucuguagagauuaggucucacuauguugcccaggcugcucucaaaacuccugagcucaagggaucuucccaccuuggccucucaaaaugcuaagauuacaggaugagccacugugccuggcaugcuuuugguuuuuuucuugcaauuuaacaaaguggugucccauauauuuaaguaucaaauguauaacugaauuuucuuucuuuucagggaucucaagggcauuucccuuugcccaccucaccuuuucauauuugguaaacuguaugcauuugccuccagcccaagauuauaaauaugaacugauuaugaucugcauguucucucuuuggguucaagcauuuccuuacagaagagccaccguggaagucauggguaaauauguguugaauugguaacucccucuuggagaauuucuugugaauuacacagcaauaggggaacucauuuaacuggagacauaaucucaauuuguaaaguguggcccauuuucuaacauuuuuauuuugcauacccuccccucucuucucgauugaugaaacuaacaaagagguuaauaaaagcccaucucgucauguacagggacucaugccuuuaauuccaguguuuugggagacuaaggcaagaacauccuggaggccaggaguucgacacuguauaacagauauaucugacagcaguaacucaagcacacccuaagaaugacccuguggucuaagaagaguguugguucagcguuccaaacgaagaaauccaggaguggccaaccuggagguuucugaaccccuggccuguuccuuggaaugaggcccuuuguuuugagcuaggcggagggugauaagugaaaauacuauauaaacugcaugcuucuuucaaaugauagugguuuuuuuguccagccugccgcuccuggacugcccuguaucuaaguccucaauaaacccuaugucucauuu

SEQ ID NO: 191719 - RNA, 14672 nt, Homo sapiens
ggagaagccaagagaggcaggaagagguggcaaaggagugcuggagaagauaaggaggcugagcuccgacagggagcagggaggaggggccaucuugagacuggugcccugcgagcuccaccccaccccuccaugcaguuccccaugggccccgccugcaucuucuugaggaaaggcauugcugagaaacagcgggugagguggggagugagggggaagggcggugggcggggcaaagggagcaggggugugggacaaagaaggggacaugauggugccacagaaccaggggaacagguggauagagcaggagcugagaagguauaagaaauuccaaggacccugguggggucauguaagccagugagauaaauggguggggguaaaaucaaaagucaggagcaaagagaaggagagaaaaggaagaaaaaugaaaagggaaagugggaugaugucauuguugagauuaccaucauucuuuucuauggaugcucauugugauaaugguggugaugaugguggugguggugaugauaaugaugacguuaauaacaauagcugccacuuauuaagucauuguucugugcccagcccugugcaaagggauuugcacaccugauguuauuuacaccucagaacaacucaugaggucagugacuuucauucccauuuuacaggugaggaaagugaagcucugagucaugaagucauuugccuuaagcuuacacaguuaguaaguggcagggucggccaaguauaguggcucaugccugaaucgcagcaucuugggaggcagaggcgggaggaucacuuauguccaggaguuugagaccagccugggaaacacaagaccccaucucuacuaaaaauacaaaaaaauagcucagcaugguggcaugcaucugcagucccagcuacucagguggcugaggcaggaggaucgcuugagcccaggaaguggaggcugcagugagcccugauuaugccacugcacuccagccugggcaacaaagugagacuuugucucguuaaaaaaaaguaaguggcagggucggguuugcuugauuccugugggcaugcuuuuuaaaauuuuuuuauuuuuccauauauaccaacuuguccagauaugugggcauacuuuucauuguuaggcuuuaagaucaccaaaaaaagagaauaaaaaaggccaggcaguggcucacgccugugaucccagcccuuugggaggccaaagcagguggaucacgaggucaggaggucaagaccagccuggccaagauggugaaacccugucucuauuagaaauacaaaaauuagccgggugcaguggcaggcgccuguaaucccagcuacucgggaggcugaggcaggagaaucgcuugaacccgggaggcagagguugcagugagccgaguucgugccacugcacuccagcuugggugacagagcgagacugugucucaaaaaaaaaaaagagagagagaaugaaaaaaagggugauaagggaccgcaaggaggggaucagaugaaagagaagcugagggaaaggcuccagggauaaagggagaugggaaggcuaaagagaccagaggucaguagaauuuccuuguuaacaugccauguauauguaagcccaacccuucagguaugugcaggaguagguggggcagcaauaacuggacauucucagaguguuuaggaacuggucaugcuggcacugacccuccugccugaaagccauugaaugcuguuuccaugcacagagauucuaaccuuuggcaggaagauuggaggcaggugagaaaggagugaaugggggcuagugugaagaauucugacuugggagucaggagcccugaauucaaaucccaauacugugucugacuugccccaugaccuccagggagcaggugaaugccuuccucccuugggaggggaucugcugcuugugagcugugugaccuugugcagguuccuuaaccucucuguuccucagcuuucucauggguaagauggaaacgagauguagaucugcaucacagagcaguacugagguuuaaaugaaaugauuguggaaacugccuggcacagagucaccacucugaaugaguuagcugugguugugaagucucacuuuuuucaucuggagauuggacuccccaguguuuaagacccccuuugacacaaugugauggguguuugucucagaaagggagaaaaagggagauugggauucgugggugggagagagacaucgagagggggguggggagccaagaacuguggaacaggagucaggagaugggaaaaggaaugggagggauggaggaggagagagagaauggaaagagaaccacgagagcguggggaggagcuugggagaacaaggagacccuuuggagaaugggugacccucucuccaaauucccucucaucugcauuccuuuccaggaaagaccacugggacaagaugagauugaagguaacaccgucuuccccaguugcuuccacguugccauccacccaccugaccugcccucagucccuuugugcauuuccguauaaauuccauuacauggaauuuuuacaaucccucucucuucccacucaacuguaauuuuguagaacucuuucucguggcaguugaaggacuucccaaaguauuucgaaggcauauccauccucaaguaucuccaagacucaggagugaaaacaaaugaguuucucucuuggugacuuugagguuccccauaacuucauccaggaaucugaaggacgccagugcucucauuuaguggucucaggaaugaugccucuuuugcuaacacauuucauacaucacuccuuuuugaauuuuuuuuucuuuuuugagacagaguuuugcucuuguugccaggcuggagugcaauggcacgaucuccucucacugcuaccuccgccucccagguucaagcgauucuucugccuuggcugaggcagccucccuaguagcugggaucaaaggcaugagccaccaugcccagcuaauuuuuuuguauuuaguagagaugggguucugccauguuggucagucuggccucaaacuccucaccucaggugauccacccaccucgaccucccaaagugcugggauuacagccaugagccaccacauccggccuugguuuuuuuguuuuguuuuguuuuguuucuaauguacgcuccuuuaaggagucucuaguuggagccucauugauagcuucaagagaugccacucuuccccacugacugcuucaaguucccccaaaguucucucuuaacuuucagagcugcgggaagcauuucuugaguucgauaaggaccgagauggguucaucucuuguaaggaucuggggaaucucaugaggacgauggguuacaugcccacggagauggaacugauugagcucggccagcaaauccgcaugaaccgugaguccagggaaugggagggauggccgggguuagggaagggaucagggcagaauugggaaggauguagagguuaagaguagaguuggggguggagaggaggaugagagggacuagaagucuggaagaaaacaggucagauucgacucaggaaggcagcauuugaagugguuaaaagcuuuuagagauaggucuggguucaaaucucaguucuauuauuuacuaauuacagucauuuugaaaagugaaguuauccgcuacucuucaguuuccauuuccucaucuauagaggaagaugccucucuccuuaccucaugggacuguggaaaggaagagaaggaagagauaaagaugcugaugcaguuaaagucuuagccuccaguaaauucuuauuaaagguaguuauuacuaucaccacuaagauucaucaguggagcacgagauuggagcuguauuggauguuggaaacaaacuuggagcuggagcuaauguuggugaauacagcugcaaaaaggauggauggauuuuuggauggagaucauaacugauuuuuagauuuuagcuagaauaaaauuccuauugaggcugggcgcagugucucacaccuguaaccuguaauuccagcacucugggaggcugaggugggcagaucaccugagguuagggguuugugaacagcaugggcaacauggugacaccccgucucuacuaaaaauacaaaaaauuagccaggcgugauggcgugcaccuguaaucccagcuacucgggaggcuaagguacgagaaucgcuugaacccgggaggcagagguugcagugagccgagaucgcaccauugcacuccagccuuggcaacagagugggacucugucucaaaaaaaaaaaaaaaaaaaaaaaaaaaagcuauuggguuugcuucugggcauguaacgaacuaaacaagguugaauucaagguaaugauaguauucauaucugaaaaaaaaauuguaugcucauuuaauucaugcuccucuuuguacaggucuacagaggaggagaaacaucuuaaccaacugucugaaagucacacaggcaguuacuuccaccauaccacacccuauccacuccuguucaggcuagagggacaugaguuuggagcuuggaguuagcugcuggagggaggaagucaaagacggcucuuauagggcagggagaagggagcugaucuaacugacucgaagcacaaagugagguaauggaaggccagggcuuguggggucucgcuaauccugugccaucuuccucaguggguggccguguagacuuugaugacuuuguggagcugaugacccccaaauugcuugcagaaacagcugggaugaucgguguccaggagaugcgggaugccuucaaggaggugaguuaacagugucauggugcuggugaugguagaggcagacccucugaggucugccuguaauuagccaaugccauggacagcacccaccaaccaggcccccaccuuuuuuuuuccagccauggugggaucaauaaauagggaagaaaaauaacguauuccaaacaccugcaauggaucaaugccucuguauacuuuaucugauuuaauccucaaaaaaacaaacaaacaaaaacaaaaacacgcacacaaacacauuaggaguaagcaagcagucauguaucccaauuaaacagaugagaaaagugaggcucaugaagauuauaaaucuuauccaagauccugccaucucuagaauaaauguuaggacuuuuuuuuuuugagacgggguuucacuguuguccccaggcuggagugcaauggugcaaucucggcucacuacaaccucugccucccggguucaagccagucuccugucucagccuccuaaguaacugggauuacaggugcgcgauaccacacccagcuaauuuuuguauuuuucguagagacgggguuucaccauguugaccaggcuggucucgaacuccugaccucaagugauccaccugccucggucucccaaagugcugggauuacaggcaugagccaccgugccuggccagggccucuauucuuagugccuguaacaggaagaauccaagaauuugagaucccagaagggaaugcaaaguggucaucugguacgaaccacuugcugcagacauacuaaaaaauaucagacccagugagaauaacagacuugcuuauauccccugauaaaauaccuucucguucugagagcuuucagcaacacaaggugaaaauaaagaguaguagaguguuugggagcaaaggauuuggaaccaggcaaacauggguucaaauccuaggaggccuccaccuauuggcugugcaagugccucccccagcuucuuauaaagaucuacagcuggccgggcucaguggcucacacccauaaucccagcacuuugggaggccgaugcagguggaucacaaggucaggacuuuaagaccagccuggccaagaugcugaaaccccgucucuacuaaaaaugcaaaaaaauuuagccagacaugguggugggcgccuguaaucccagcuacuugggaggcugaggcagggaauugcuugaaccugggaggcagagguugcagugagcugagaucgcaccauugcauuccagccuggguuauaagagugaaacuccaucucaaaacaaaaagaaaaaguugucuggauugagaagugcuguaaguguaacgugaacacuguauuaagacuuaguaugcuaauauaauuagcauaacguacuuguauacuuaaguaaacuucuaggcuaaguauccuaauuaagcaugcuaagcaccuacuaagaacuuagaacuuacugccuuaugaaauccaguguguauaaaaagaaugcuacuuacauagcuaaauuaauaauuuuuaaguggauuacaugaugaaaggauaacacuuuagauauauugugucaaauaaaagagaauauuaaaaauuaguuucauuuguuccuuuuaacauuuuuuuaaacgucacuacuagaaaauuuuaaggccaggugcaguggcucaugccuguaaucccagcacuuugggaggcugagguggguggaucaccugaggucgggaguuugagaccagccugaccaacauggagaaaccccgucucuacuaaaaauacaaaauuagcuaggcguggugguacaugcguguaaucccaaguacucaggaggcugaggcagaagaaucgcuugaacccgggaggcagagguugcagugagccaagaucgcaccacugcacuccagccuggguaaaaagagcgaaacuccaccucaaaaaaaaaaaaaaaaaaaaaaaaaagcugaauaguauuccauuguguacuuaugccauguuuucuuuauccacucuucuguuuugauggacacagguugcuuccauaccuuggcuauugugaauagugcugccaugagcaggggagugcaaacaucccuuugauauacugauuucaauuacuuuagauacauacccagaagugguauugcugggucauauggcagcucuagguuuaauuuucuaaggaaccuccauaccauuuuccauaauagcugugcuaauuuccauacccagcaaaaguguaccaggguucccuuuuauccacauccucaccaacacuuguuauuauucaucuuuuuaacaguagccauccuaacagaugugaggugauauuucauugugguuuuaauuuaaauuucccaaaugauuagugaugcugagcauuuuuuucacgaacuuguuugccauuugucugucuucuuuagagagauagcuguucacgucuuuugcccauuugucuucuuuagagagauggcuguucacgucuuuugcccauuuguccucuuuagagagauggcuguucacgucuuuugcccauaguuauuagauugaugcaaaaguaauugugauuuugccauuaaaagcaauauuugucauuaugcaguauuauuaauuauaggcacaaugccacacagcagaucucuagaaccuaucuugcguaacugaaacuuuauacccaugguacaauaucuccccauuucccuguccuccuaacccccagcaacuauccuucuacucucugcuucuaugagugugguuauuuuaaguacuucauauguaaguggaaucaugcaguauuucuccuucugcgugguauauauuuaaaugcaauauucagccuuacaaaagaaggaaauccugccccacacaacaacacaaaugaaccuggaggacaguaugcugggugaaauaagccagguacagaagacaaguauuucuaagugucuugcuugcugcuccgugcucagucccaagaacggugccuuccacaugggcacuacugacacauuuuuuuuuagcaauauggauacauauguguugaauuaaugaacugccuccaaagcucugcccugcacacccuuaacuagucuaccagaaagucuaguacguucaauuuccaaaacaucggggagugaacucuccuucuugagcucugcuggugcuaacuggcucaaaccacaaccaucuccuaccaggaugaucauggcggcccucuaauugguuuccuggcucccaucgugguccuacuguggucuguucucuacacaacaggguuucaugcucacauucuuuuaaaauguauaucagaucuggucacuccccugcuuaaaauucuccaguggcuucuugucuuacucagaaccaaauccugacaacgucccaugacacacaagccccuacguacuugggcccugccuucugcaacacugagaccuugucuauuucaugcucauuucuccccagcucacgccucccuaaacacuccccacuucugccucuuccucaaguacaccuuccugccuuacggcacuuguuaacuugcagcuuccucagccuacagcugugucauccaaaauaaauacaauguaagcagcaugggucauuuaaaauuuucuuucucuuuuuuugagacaguuuugcucuuguugcccaggcuggaguagaauggcacaaucuuggcucaccacaaccuccaccucccagguucaagcgauucuccugccucagccucucgaguagccgggacuacaggcaugcgccaccacgccuggcuaauuuuguauuuuuaguaaagacggaguuucuccauguuggucaggcuggucucgaacuccugaccucaggugauccacccgccuuggccucccaaagugcugggauuacaggcaugagccacugaguccggcauauucagcuuuuaaaaagaaggaaacucuaucauuuacaacaacaugaauaaacaugaagcacauuauucuaagcuauauaagccaggcacaaaaggacaaauaccacaugauguuacaugcagaaucuuaaaaaauugaacucaugcaaauaaaaagaaaggugguuagcagaggcuggggagccacagagaaggaauggacaguugcuugucaaaggguacaaaguuuugguuagacaggaggaauaacuuuugagaucuauugcacagcaggauaacuauaguaaauaauaauguauguuucaaaaaucaccuaaaaaguaaguuuuaaauguaucgcugggcacuuuggcucaggacuguaagccuagcacuuuggaaggacaagguggaaggguugcuuaaggccaagauuuuaagaccaaccuggccaaaauagugagaccccgucucauuaaaaaaaaguuucggccgggcacaguggcucaagccuguaaucucagcacuuuaggaggcugaggcagguggaucaacugaggucaggaguucaagaucagccuggccaacauggugaaacccugucucuacuaaaaauacaaauauuaaacagguuugguggugcgcgccuguaaucccagcuacucgggaggcugagggacgagaaucgcuugaauccaggaggugaaggcugcagugagcugagauugcaccacugcacuucagccugggugacagggugagacugucucaaauaaaaaaaaaaaaaaaaagaaagaaaaaaagaaaaaaaaaaacagaacaaaacugucuuuuggagcugacguucuaguggcucacauucccaaagcuuuuaucucagugcuugacccacaguaagcgauagguaaacuccaucaucucguggcuaucaucauugucauugcugauauaaucuauuucugcuucuauucaguuugacacgaauggagauggggagaucacccugguggagcuacagcaggccaugcagagacuccugggggagcggcucaccccccgggagaucucugagguuguccgggaggcugauguuaauggagacggcacaguugacuuugaaggugacauugacggggcgugguggggagcgggggcagccaccgcaggaauccacuuccaacucacugucagauuuuccaaguuggccacuccuucucacuccucuccaaguuugagaauggaagcggguggcagguuuuggaagcauuuguucugucccuuucuucccaggcuauucauuucaaagagcugggugucgcucacuucugguggcuccgaggaacaccucagccaaggcccuuuccuucccaugcucaggacgcccuuccgccuugcccauuccuuguuaguuugcagggcaccuuuuauccuaggaagaacuugucccaucagaaagagacuggacuggcuagcagcuggagcucuggggucagguucaggggcuucaaauucaggaucaucgcugacucagcauguggcuuaugcuacucccuuuuucucuuuaagggucaguuuucccaucuguaaaaugagguggaugaugacaccuuuuggagaaaacuaaaagaaaucaugcacaaagcaccacuguauuuuuaaauuuuccuucccugucuuugcucaaguuguccuuccgucuggaauacccuuuccccucuccccuggcuaacuccuaguuauguuccuggaagguaccucccaccucucuuacugggcuccgugucccucugcuggcuccccaguaauaccucccgcuugcuucugcaguaauacggauucguggcaucucuagaguuuauugccuauuuccuucugagaccauggaccaauuccuucaucaucacuauauccccaaauccuagcacugagcccagcaugaguauauuggaucacugaauaagugaaaaggauugggguucuacauggaugagacgugggguucuuuuuuaugugaggcauaggaaggcaugucggccggacaugguggcucacgccuguaaucccagcacuuugggaggccgaggcgaguggaucaccugagguuaguaguuugagaccagccuggccaacauggcgaaauccugucucuacuacgaauacaaaaaaauuagccggaagugguggcaggugccuguaaucccagcuacuugggaggcugagacaggagaauugcuagaacgcugggggcggagguugcagugagcugagaucgcgccauugcacuccagagcaacacuccguccaaaaaaaaaaaaaaaaaagcaugucaaguucuaauugugacauucuuugguucaaagaucucagcaccuaucugcugcuuauggacaaaaauccaaaauucuggccgggcucaguggcucaugccuguaauuucagcacuuugggaagccaagguuggcggaucaccugaggucaggaguucgagaccaggggggccaacguggugaaaccccaucucuacuaaaaauauacaaauuagcuaggagugacagugcacgccuguagucccaggcuauacgggggcugaggcaggagaauugcuugaacccaggagguggaggcugcagugagccgaggucacaccacugcacuccagcccgggcaacagugagacuccaucucaaaaaaagaaaaaaagaaaaaaaggccaggcgcguggcucacaccuguaauccuagcacuuugugaagcuaaggcaggcagauugccugagcucaggaguucaagaccagacugggcaacaccgugaaacccaucucuacugaaauacaaaaaguuagccaggggugguggcaugugccuguagucccagcuacuugggaggcugaggcaggagaauugcuugaacuugggaggcggagguugcagugagaucgccccacugcacuccagccugggugacagagcgagacuccgucuccagaaaaaaaaaaaaaaaguccaaaauuauuugucugauaugcaagucuauccaucaucuggccucgcccacccacccagccuguaucuucuguagcuauucucugaacuuuuaaguucuggcacaaacuuggugccugcuuuauguucuccaaccuccguuccuaggcaucagaugcuccguccacuuaccacaucuuucagucucauccaucccucaggaacucacaucaaggcaaccuuugucaggaagcuucucuccauccuucccucaugucuuccucccagcugugaagucuuacagaaguuuuucuguuccucuccauggaaguuaucacagcagaccuugcuguguugaguuguauuagcuuccaaggccuccauccuagauagagaggaggaagggccauucucuaaaccauauaugcuguaugucccaguauggaaacacaguagaggcugguuggacaccugcuagaucuagccaggauuaggugugcaguggacaucaagugacaucuggagaagguggggugggggugggagaugauccucaggccaaccaaaggcaagggaaggucaggaugaccucaagacccgggugggcagcaagaucgucuugagccacagcaaagucaggugcaaccugcauuccuuccaggguucaccauucacuauccacguggccucagguauguuggugacccucgcuggcguaaguuuccuuaucuguaaagugacacuuaucccuccaggaugguugagaugaugaaaucucauagugacaaucacagguuuuuuggguuuuguuuuuuagauggagucucacuccgucacccaggcugcacuacaguggugcaaccuuggcucacugcaaccuccaccuccuggguucaagcaauucuccugccucagccuguggaguagcugggauuacaggcgcccgccaccacgccuagcuaauuuuuguauuuuuaguagagacgggguuucaccauguuagccaggccagucucaaacucuugaccucaagugauccacccucccugacgucccaaagugcugggauuacaguuaugagccaccgcgcccggccaacaauagcuguuuaugggauacuuaaucuguuuugugagcauuaugccauuaauggucuuaaaaaccauauaaggaaauagcaauacuaggauucccauuuuuuaaauuuaauguuuuauuuacaugcaagauuauuuucauaacagaaaugaagaaacugcaacauacugaaauuagucuuucagaaguaggagcauaauaauaaccacaguaguuuacauggggugacugugauggcaggcacgguucugagcaaauuuuauuuaccuauuuaauuuuuuaauuuuuuuguagaguugggggugucgcuauguugcccaggcuggucucgaacuccugggcucaagcgaucugcccaccucggccucccaaaguucugggauuacaggcgugagccaccgagcccagccuguaagccaauuuuaucucaaccucaugagguagaucuauuaaacaugccaacuugacagaugagaaacugaggcacaggguuaaguaacuugccacagagaucugauucccauuucauagauggagaaauggaagcauagagggauuaaguaauuucccagggaucaccagcagugccugccacauaggaagggcucaaaaaauaauguugggggcuuuuacaacgagaugccuuacuggggauuuuuuuuuuucuuugcagaguuugugaagaugaugucucgcugaggagguccuggaagcuccagacccucuccaccuggucaacauggagcaagcgcuuguggagaaccaaagcccaaaagccccagauccccuuaaagcagagagggagggcaggcgggagggagggcauuggcaugcggcgcugugcauggggugagacccagagcgguaucuuugccaggaugggggcgucugcagaacuagauuaagaaggaagagucuguggauggaaauaggaagcgugggaggguccaguugccacccccaaaaauuccaaugauucuugacaucuuuucacuucacguaguccuaagucccugugaccugccagagucucuuccccagcuuccccuugggugaaaauagucucuucuccuguuggguaucaaaagguucagaacguagucucuacucuuccccugccugcaucaacuguugcaaaucccguuucucucucccgguaaggggacaaauuauacuuuauucaggugaugguuacaugaacagcccagacuucaccacuacgcaauauauccauguaacaaaaccgcacuuguacucccuaaaucuauagaaauacaaaaugaaauaaaaaggaugcaaaucagucacagagcuggaaacagaguuguuguugaggcugggcuuggaaauggcucgugcaaguggcauucaaagucaacuccuuccuuuuccugauuuccuggaagcacugucugguuucucucucucucucucucucucucucucucucucucucugucugucugucucugucuccccucccacaucccuuccuuuguguaagauacucaggggacugaauuaaaccacaaaucuggauuaucaagguuuagagcuagcugauccuuggggaauuaauccccugaaaaaaugucaucaugcaaagagagagaugacaggaucccccaaauccccaguucagccagguuguugcaaagucuuuccuagaagccuccuaccuccgcgcuggucuguccuggaccacccagaggcugugucucuguuagaugggucgucuguuccgucccucacguccugacaucgaucugugccaugaaacagaaaagagagauuccuccugaccuccgcccaaagcaagacacuccagcaaugcaaagguuaaaauaaaagucaaaauaaagaauuaacuuca

SEQ ID NO: 191720 - RNA, 6102 nt, Homo sapiens
uucaguuaaauucauccaauauuuauugaaucgugaacgguugcaaacguugccacaaucagaaacccacccauccugaugccucucuuggcuuccccuugagaaggaugccugaggcgggauguccccccaaacuccaggggacaacuggggaagacaugggguaugcaaagagauaugaugaaaccacgggacaggaggaggguggggugguguggauuccggggaagacacauacacacagacucucccgcucagaggcaaagaccgggggcgucaaucucugcccccaacagcagccacgagaacaucagggaaagaccagguguccacaagacuuuucaguccuuccuaucaugaagcgucugcugagaggggcugggucaaggucccuggacuguggagagaaaaagaggugguugggguagggagucaguuugcaggaacagaggccaggcguggggcccauguuaaaaggaagaaagauagccgggugugguggcucacgucuguaaucccagcacuuugugaggcugaggcgggcggaucacuugagcccaagaguuugagaccagucugggcaacauggugaaaaaaacccaucucuacaaaaacuagaaaaauuagcugggcgugauggugcacaacuguagucccagcuacuugggaggcuguggcaggagaaucgcuugagccugggagguggagguuguagugagcugagaucgcgccacugcacuccagccugggugacagagcgagacucugucucaaaaaaaaaaaagaauucaaagccugcaugguggcaccccaccccacgcucaacagcaacaguccacaaugcauucagcugaugcagcuuuggaauuaggcaauuccauuuuucuuuuccuuuauguuagagggauuugcuuuguuucagaccugcacauaaggcaagauaucguuucugcauuacuucaaauuggcacgucccaauucacauugaacaugaccucauucugcucugguaaagaauuuuaggaaauggaacuugaguuuaacgcauuugaaaacuaguuuucuggcacaaggcacacugggagcugguacuuggguccacaguguguugggaugggauacucuguucuagaucaacauggaaugggaacuggugcugaagguuagaggggaguaaaaaguauggccaggcgcaguggcucacgccuauaaucccagcacuucgggaggccgaagcaggcggaucaccugaggucaagaguucaaaaccagccuggcuaacacggugaaaccccgucucuacuaaaaaauacaaaaaauuagccaggcgugguggcaggcgcuuguagucccagcuacuugggaggcugaggcaggagaauggcgugaacccgggaggcggagcuugcagugagccgagaucacgccacugcacuccagccugggcgacagagacuccgucuuagaaaaaaaaaaaaaaauuugcccagcaugguggcagacaucuguaauuccagcuacucacgaggcugagacacaagaaucccuugaacccaggaggcagauguugcagugagccgagaucacacuacuguacuccagccugggcgacagagcgagacuccaccucaaaaaauaaacuaugcuccaggcccugcagugccagagaccagaaaaagggcuaguaacuguucuagaauggguuggguuucacgcuuaucuggaccauacuggcuuacaaacuggaaaaucagacucagaaggugcuggaaaguaguucuuuguuccugagguucauauagaaauugccacuuguuccacaauguauuaggcuggaaacaauacuugguucagagugcuuaaggaggccaagcacgguggcucacgccuguaaucccaacacuuuggaaggccaaggcagguggaucaccugaagaccagccuggccaacaggaucagaccuacuaaaaauacaaaaauuagccgggcauaguggcaugugccuguaaucccagcuacuugggaggcugacacaggagaauugcuugaacucgggaggcagaggcugcagugagccgagaucgcgccacugcacuccagcccgggagacagagcaagacuccaucucaaaaaaaaaagaaagaaagaaagaaaaacagugauaaggaaccaguagccaacuccaggaacuaguggucaauucuagugcuuaggagcugguucacauuuuucaauugcuggguugggaaggggggcucagguuuacaguguguugggagcuggugguguauuucauucucggcucuauggggagaacugggagucagcucuaggguuuuuuuggagcagacaauccauucuagaguuagcauuuguuucuagagcauucuuggacucauguucaguuccaaaguggguaaguuucuggagcuggaucaggucuggaauauuccuagaacuaauucucagguucagagcccggugauaauuagugaccuacucgaaauuguggagcaaggaaauucugucucaaaacaugcugggaacuuggccggacgcugucacaugaccugcuggguugggaacuguuucuuggcaaugggacaaagaccuagaguuccggauucugaaccguuggguugcuagcacuuuucauucccaaaccaggagagcuguuuuagggcagcccucugaccccaccaccaacucagcugucaucuugcauaccccaucucagcugucauccugcauaccucugacccuaucucagcugucauccugcacaccucugaccccaucucagcugucauccugcacaucucugacccaucaccaucucagccgucauccugcacaccucugacccaucaccaucucagccaucauccugcacaccucugacucaucagcaucucagccgucauccugcacaccucugacccaucaccaucucagccgucauccugcauaccuuugacccaucaccaucucagcugucauccugcacaccucugacccaucaccaucucagcugucauccugcauaccuuugaccccaucucagcugucauccugcauaucucugacccaucaccaucucagcugucacccugcacaccucugaccccaucucaguuguuguccuccaccaaccgggucuaacuuuaucccgcucgcucuggggacacacgugaugucccccccaucucccaggcucuccacccugggccaaggagucagagcauggggcagggagaagauccaaaggguggugucccugucuagugggcccccucaccucugccuucagggcgcauuagcccugagccaaggcggcuuugauggcggccaccaacuucagaaacuugcuuucuguguccacguagccaucgccuuucuagggaggggaggaagagggaaggggugagcugggaccgagacaccaaccucagccccaaccccaugcuagccccaaaaccaggcaggacggacagacagacauaccuucuuagagugaaucaacuucccggcuaccaucacuucaaagaacccgguggccuggggaguucccucgccgcacugaggaaaggggguaggggagauguuggaggggcuaagauguccucuuggggagacccuccccuucccagggggaugagaacaugggugaagggcguagggcugaccuaaccccccugcagugccauccaggccuaacggaccgacacaguggcugugcucaagucuuucuccccaucccaagacucacgauguccaggcggccggggaacucaucuucuaacuucuucuugagcugaagauacugaaaacgcggugagaggucacagcaggggucauaccagucagcccccucccaauaugcacucuaccccuccccagcucccaggaaugccccccgggcauccacucugcuuaccuuggacuuguagccucaagcgccacugguaggagaguccaagacauuggggcccaggggagagagggagaagugggggaucggggagaggaggguagacacaggcgguguggggagagagcaagauggggccaggaagaaauaaagaggaacacagaugaccaagcagaagaggugacagaugcccucaagagagaagacaggcaccagccaggcagaguuuugggacacagcacaggggguggcgcggggacacacagagacacacagaaaaccaacaccaagcaagagacagagaagggggaggggaaaaaggggagagaggagacaaggagaccacaaauacgagagacggggacgggggaaaaccaggagaacuggauuaggagaagaacagcacacguaagguccccacccacucccugugcccaccacccucacccacagcccucgcagcacuccaaggaaaacccugcggcuccuggauucuuacaccacgcccagcuaauuuuuguauuuucaccauguuggccaggcuggucucgaacuccuaaccucaggggaucggcccgccccagccucccaaagugcugagauuacaggcaggagccaccgcacccggccccgcagcuccuagauucugaacaccuucccaguccccagggugaaauacaggcucacccaacccccacagcaggcuauuucgggacuggaaucugguguacaggccugguaggcgucucaaaaugucacucuugccucugcuuugucgagcaggcagagacguuggaaagcugccgacaaacccagguuccaguuaccccugucaccugcaguccagacuugaagcuacugaccugcccccaccccagucccagccucaguuuucucaccuguaacauagaacuaaaauuccucucuuuaauuuacuuuuuuuuuuugagacagagucucgcucugcuguccaggauggagugcaguggcacgauuucagcucacugcaacuuccgccuuccgggcuccagugauccuccugccucagccucccaagcagcugcgacuacaggagugcgccaccaugcccggcuaacuuuuuaaguuucuguagagacgaggggggggucucccuggguugcccaggcuggucucgaacucuugggcucaagcgauccacccgccucagccucccaguguuuggauuacaggcgugaucaacggcaccuggccuaaaauuccccucucuuaagggauuccugggaggauaaauucauugaacacguauuuauuaaauaccuacagcaugccacacaguauuaggugcuggggaguggagagaacguaauuuauauccuauccuauuauacccuuccugagacuugcagaaauuaagcguguucgguauugacacagagccucccucuugccacagacggaaaacugaggccagaaaaggagugggguucguggccaagggaacccacugggcagaggccaacaauucaagugcuucugaaacacaggcugagacauucucgaaccuucugggcucucacuguccccaccccgcgacuguucgggauauugggggaggggaagccuuaggguggaggagccuuaggucccuuuacaaagcugacccccagccccuuccccagcggagccccggagucggggguucgaaauugacacacacucgucucagccccaccuuuuauaacccgagaugcccagcgugucacaagucgaagacggggccuagggacgaccgcccucuguuuuucgccccuccguacgcccaccccacccacauacaggggcucccuuuucccauacaagggcucccauggguccucuccccggggcucccugaccccggcuccgagaaucgggucccggcgggggucggggacgggggccgcuggccgcugggcuuaccaauaaacgacucggacggcgagagccauggcucggggcugccacauccgcugaggagcggacgcccgggccacacuaaccucccaccuggacgcgcuaggucugcgcgagugcggcgggaaccugcgcagaaaggauggagccucggcuuccccuggcgccaaccaaugccagggaggggcggugggcggugggcggagaggcgccaaggcggaggauaaggaacccgc

SEQ ID NO: 191721 - RNA, 11531 nt, Homo sapiens
cccacugaucagcuagaagagauuuuuuauugaagggcgagucuccggcaucugauggcagcuacaaccuggggacagaggaaaggagcugagggugggugagagggugccccauacccccugccgaccugacacccccugccuuucaguuucccuuuggggacccucccaaccccgcucugguuucagggccucuucugggcauggccaaggggguguggcucagccacuagccacacucuggaaggggcccugggacucggugggcaccacggggugggagaagggcucccuuccuugcgccgaagccggguggacucacuggaucucacggaacgcccgcuucuccaccagcuucaccuuguacuugcguuugaaccuggagcagggacaauggagcaaucagugcccggggccaaucccagaugcccucgccccacagcagccccggccgccccuuacuuggcucucucucgaggcucgaucauauuccuccucuggaagcucuugaaccggucucgaaggauguugcccucgggcuacaggacagagagggaggccucagcagggccuggcagaagcccaagggccuggaccucuccucgggguccuggcagggcucagccccaugcagucuccccccagggcagccugugggcaccagggacucagccuggcccucagcugcuggggcucaguguugggaugacagccaccaaccuauggccaucucuaagcugggcuuagaggagucacgggaagugggcuggugacgacacagaaaaggggacagcgagggcaaaggcuggaucagagggagaaggcacaguccgcucaugagcacaacuggcuggagccccacggccgggucggcccaggcguguggcugacagaggagcugggcuuccucaggggcacuggggagccacagcagguuccgagcaggggagggacaggguugguucugagcuucaggaaggucccucuaguccuaaaggugaccgggacugcaacagggaccagcuggaaggaaaggccuucuuagggucccggacucaaaccuuagccuggccccucacccugggaucucaucccagcaucccgugcccucagccccugggcauuggccccacuggcccagcccaggggcagccauggugucgcccauagccccuggggggcacggggagcaaggauggugucaucacugggcacggggcuccacggcaggacacagugagcaccuucaggguccugagcgagucugucagcuccgagcucagcugcacgucgaugucaggugccugguaccugcagaacagggcggguguucagaaauaucacccccgcggggcccaggacacccaguccaaagcccccuccuggagaagaaggggccucugagaaugugggguuuugugggggaagagguggucucccgauggggggggugggcaguuccugaacaaaggcaggaaggugucaggaccugggacccggcccccuccccagccucucccagaacccccggccugguucucacuugagccgccccagccuucggggcuugucagccucagccucccgccgcgccugccgccgccucugccgccgcgccagcuccgccagccucagggccaccugggccuugaucccgcgcagccggaacagcuccuggugccggagccgggcggcccgcaacgcggccugcuguacccgcuguggagacgggggagggucagggcucaggccggugcugcccacacagggagaccuucucucuacacagggagccuucccugcacaaaccugccuguccccggaggcccuuccuaaccccgucacaucagcggccccuccagugccuucccagcagcuguuugcugaagccccuuuugucauccaucuccccuggucugcggugcagaaaccuccccccaccccgccccucaaacagaagcgccagggacccugucccaccccagcccgagcccugccuggaagaggcugggaaaugagucucagcugugaggaucccaaacagcccaaaccacaggccacaugcggggcuuggggugugcaggcugcccgcagcacccagggcagcccauggugggaggaaggaaggaagggggcgaggcaucagaggcaggccccgcuggcccaggcgcucaccagccugugcacagccuucucccgccgccgcugcugcuccgucuucuucucugugguggccaggcgggcgggcgugggacagaccucggcauccccagccuccggccccucgcccuggccuggcucccccucaccauccgacuccuccagcagccccucgcacagcuccuggaauguggacuccuggggaggcggggugcagugucagggguggguaggaggcccggggaggggagggagugggcaggugcggggcucaccuggguggcggccugcuccguggcgggcagggccagcugccgcuccagcuucuccgccuccuucugccgcugcaacuccaccucgugggccgcugagagcagggucugaggggcgggagugaggaugggucccugaaccccuccugggacacugagacuagacccucuuaccucccaucugucccucauccagugcccguggaucccgccccggcccaggcuuuccuccccacaccccgucuaccagcacacccacccugcacagagccagagggcaccucaaacccucgcccucacaccugcucugcacgucugugaaggcagucugaccugcacgcuucacauuuuuuuuuugagauagaguuucugucuuguugcccagacuggagugcaauggugugaucucagcucaccacaacccccgccuccuggguucaagcgauucuccugccucagccucccgaguagcuacuauuacaggcaugugccaccauacccggcuaauucuguaacuuuaguagagaugggguuucuccauguuggucaggcuggucuugaacuccugaccucaggugguccaccuaccucggccucccaaagugcugggauuacaggugugagccaccaugcccggcccacaguuucaucuaugugaauuggucagggugggcuggucccugagacaggaagccuggcagcccaagaccacacgagacagggaauugcgggggugauggcugacaugugugagguuuccuuuacggacagugaaaauguucuaaaauugacugcggggaugguuacacaauggucacuaaaagccacugaaucacauacucuaacuaggcugaccguaugguuaagugaauuuuaucucuacgaaguaguucuguacaaaucuaaaagugaaugucugaucuccacgcccccucccacaucugguccaggaacagauggcagugagcggcacccucacgcuuucaaccaugagcacacuguugcuuuuuuccgcagacacuuuucucuaccagaugaggaagcugccucuguuccuggcuagcuaucuccuucuuaugaaugcugaaaacgauucggacaagcgguccugcaucuaccgcaaacaucucagcaucucuccagucacgugaccccaugagaagggcuguuccuugagggaggguugugcuuguuuuuugagucucgcucuguuacacaggcugcagugccguggugcgaucauagcucacugcagccuggaccuccugggcucaagcaauccucccaccucagccucccaagcaguugggaccacagaugcgugcugccaugcccugcuaauuuucuguauuuaguagagacaggguuucaccauguuggucaggcuggucuccaacuccugaccuccaaugaucugcccgccucagccucccaaagugcugggauuacaggugugaggcaccgcacccggccaagggagggguuuuuguccccuuuguccacagcaucugugcucaacagaugcccgcuaaaugcacaguggcuccagcuagacuuucccaucgcugagcuagccucgcccauauauaacugucacuuggcugccagugugccaccgugucaccacagccuuuuucaucucugccccacaggcuuccuggaaggcgccacggucucucucaacucugugccuuugcagugcuguucccaccaccuggaaaacccacuccccuccucccacugcaaaccccucccucagccucugccucggcucaggcgaccccuccucccgggagcccuuccugaccccccaggcugggccaggugccccgucugggcucccagccccaaccacucugcccaucacugucugggaacaggucucuugcacuggaccgugagccccguugcggacaggcccagggcugucugggucauuggaguucccagcacagggaggaagcuagugaaggccugaccaagaggcagagcccacugaggagggaggccuggacggggcaguguaccugguggucuucaaaggauggauuguaggaagcuccggcaggcgccaccuccacggcgggugccugggacggcuuggugugcaggcgugcuggccgcuguggagaaaaggccgaggcaggguaaggccgugcguuggggcugcgggugacccaggacacagccauggggcagaugcuccaggccuugccagugguugggugugggaagagcucaaggggcauucaggugacuccagagcaagacuccaucucagaaaaaggauagcagccuauccucugcuacccacgaggcugagccccggagauuguaagcaccugggcucuaacacuugggguccagcagcucaagaaggaggcugcaaauccaaacucaaacccgugacacuucugccacuugccagcacgggcuccaccuucucaugugcuaccucuuuacauucuccccaccgacccaugaucuaaguacaauuucaucuguauuuuauuuuauuuuuuuuuuugagacagaguuucgcucuuguugcccaggcuggagugcaguggcaugaucucggcucacugccaccuccaccucccugguccaagcgauucuccugccucagccucccuaauagcugggacuacaggcacgugccaccaagcccagcuaauuuuuuuuuuguauuuuuaguagagacaggguuucaccacguuggucaggcuggucucaaacucccgaccucaggugauccaccugucucggccucccgaagugcugggauuacaggcgugagccaccaugcccggcccucaucugcauuuuagaggaagauauagguugcagaaaggugagaccaccuucccaggaucagucagcacuggagcugggacaggaaucccagccaccuggcuccagcacagaguucucggccacugggauggaagggcucugagacagacucuacugcaggaacacagagcagcucccggcccuccucacccucccaucacccaggaugcccuucccacacaucucaccuucacuccuuucuucuuggucugcuccaggaaaaacucauccuggccaaccaacggccuguccagggggucuguggauacagcgaggggagcugcugggacagucccagcauggaagaggcaccaaaggcucccccccaaucccuccacauuucaaaaaggugacccugaagcucaggcaagggaaggacugauucuagaccccaagggccuugaucaccaggacaaaacugugucuggacggguucagaaaguggaagagaccaaagcugaaggcuuccuuuccugaagccucacaacucaggaaaggaaaagcacgagugggaaacggccgccccuucaggacgcacgacucugcugggaggucaccaaagcacccacaaagcacucccuuucacacuguacucucgugcagugcacaacacacacaaacugcacauggccguccuguccccauucauaggugacagcaggaucacucacugucugaggcccagaggucguagaagggccgcucuacgguguccuggggcccgggcuuggcccuuguugcagaaggguugaggagccgggccugggcccugcgcaccucccggggcagcucgcccugcuuggccagcuucucccauagcugcuccuuccgccugagcuucuuggcguuggggaccuggugggcgaggacgcuggucggggagagggggcacaagugcagcaggugagguggcagccugaacggcagcagggccuccuccccgucgggcuuccuccaccauuaaggcagcuucagcacccccucuccaaaagguggcacuccgcccccucuucagagaacuccucuccccacgucugucuccagccuaggccuccccucugagccccagacucaacgaagcaacagccccguccuggacauaccccaggcaccucacaccaccacgucaaaaccaaccucagcaucacccgaaaucccacuccuccacauccccaucucaggggaaggccagcuguccacccucucacccgcucaugccccaagacccaccugaugugccuccugaacacgccucccacucagccccuccucuccaaccccgaagcccccagcuggguccaggccccuccucaccugccucggcccagcaccagggcacccagacucccucccucuaaucugcacuccgaagcccaaaccugagccugcccuacccuucaaaugacccucaccuaccagcccccagccccggaaacccuuuaggaccagagucuggugggaaagaagggcccagggaugcugggacacucacucuuugggggcagggacuuuggauguguucucgaggaugaggucaacccgaagggguuucuugagaagcagugacuucuucuggacuuugguucucuucuuugucagcccuaagaaugggaaagagaacaagucaaggccucagcccuacccacugccaaagaccacccacccuauucaccuccaugggagccaucagaccugaaucccaagucaccccaggagacuuggagguccccaggcuccuaccuggagguagaggccccuaaggauggggcccaaggugcccaagcucugacccuccacaaccaagugcugggccagcaggaggcaggccccaugcuggggacacgaagagucacgcccacagccacauaggagggucuuccagacaaacagggaaccucuucccugcaugguggcucacgccuguaaucccagcacucugggaggcugaggugggaggaucgcuugagcccaggaguuugaugccagccugagcaacauagugagaucucaucucagggggaaaaaaaaaaggaagaaagcaagucaucaguugacacugaagcccagggagggccacagaaguggacuugggacccaggauggccacuucucagcauaacuucuaguucucugguuuuuacugucuuuuuccucccacaaagauaccugugguuuuuacuucaaaagccuaacaguuaaaagcaguaacucuacagcaaaacacucuagaauggaauaacacccuugcauggacugugggaccucacacaagaggcuuagcuccuccgugcccccaaaaugaggauguggauaccucccucacuaggccguuaugaagauguaaucauuuaaggcccacaaagcacaggggcugaccugguugacugcucacaaccacuaugaucuuuguccguguuuccuuacuaaaguggaacccauaaacugccucuuuccugccccccaaagaggcuucccacucgccaaagcacgccgguaacuacuuucccaucuguucauuacgggcaggucacugacuuacccuuuacacucacacaccagaucaacucacuucggucaaggcugacuucucuaauaaccccccacuuuuuuuuuuuuuugagacagagucuuguaacccaggcuggagcggagugcaaugaugcgcucuuggcucacugcaaccucugccucccagguucaagcaacaauccugccucagccuccugaguagcuggaauuacaggcaugcgccaccacgcucggcuaauuuuguacucuuaguaaagacgggguuucuccauguuggucaggcuggucucaaacucccgaccucaggugauccacccgcaucagccucccaaagugcugggauuacaggcgugagccaccacgcccagcuugagacagagucuugcucugucgcccaggcuggagugcagugguaugaucuuggcucacugcaaccucugccucccggguucaagcgcuucucaguagcugggauuacaugcguguaccaugacguccggcuaguuuuuguauuuuuaguagagacgggguuucgccaugcugcccaggcuggucuccaaccccugaccucaagugauccgccccaccucggccucccaaagcgcugggcuuacagguguaggccacugcacccagacucuaauaaccacuuuuuaccugccuauuggaagucuccuguaccucagggcagcuccuuccacucuaucuggucacugaaccagguccgcucauuuucauuaaaacauacccuuugacugaucucacacaagcucacucucuugcucauuaaagcagaccccuucgcuugcuuccaggcuguucauuagagcagaucaucuguucuuaguuuguuuuucuacauauugaaguaaacacuauuacucaccagagcaaucccucccucacgccucaucuuguuucagcagauccccacccuacauucuagcaacuuaaggcaagcaaguuaagacguguguuacccgcucacuaaagcaaguccucuuauuccuauuaaagcucaucuuggccaggcgcagcggcucacgccuauaaccccagcacuuugggaggccaaggcggguggaucaccugaggucaggaguuugagaccagccuagcugacaugaugaagacccaucucuacuaaaaauacagaaauuagccaggcuugaccaggcgugguggcucaugccuguaaucccagcacuuugggaggccgaggcgggcggaucaccugaggucaggaguucgagaccagccugaccaacauagagaaaccccaucucuacuaaaaauacaaaauuagccgggcaugguggcacaugccuguaaccccagcuacucaggaggcugaggcaggagaaucgcuugaaccugggagguggagguugcggugagcugagaucacgccauugcacuccagccugggcuugaaacuccaucucaaaaaaaaaaaaaaaaaaaaaaaaagagagagagaaaagaaaagaaauuagccaggcuugauggugcagccugcagucccagcuacuugggaggcugaggcaggagaaucgcuugaacugagaucacaccacuguacuccagccuggaugacagcgcaacacugucucaaaaaaauaauaguaaucccaggcuggaguucagcggcgcgaucucggcucacugcaaccuccaccucccagguucaagugauucuccugccucagccucccaaguagcugggauuacaggugcccgccaccacaacuggcuaauuuuuguauuuuuagcagagacgggguuucaccaucuuggccaggcuggucucgaacuccugaccucaggugaucugccugccugagccucccaaaguacugggaauacaggcgugacucaccgcaaccggcaggacugaguuaagcagguccuugacuugcuuuucugcaagcuaaaaagagauccuuuaauguguuucuaacuuauucaucaaggcagacucccagcagcuuaucugugcauggagaucacugacaucucaaaagaaaaaccugccuucucuaaguucgucuccagcuugcuuucugcccauuugagguccccuuguuuauauuaagguugaccuguuuccgcagauauuugccuuccaagccacaucauuaacacagaucucagaggcuaccguaagcugacuaacaaugaauaaccgccauuccacaccacaaaagccucuccucaccuuuuuccuuggagccaguguccacgaagaagaguuuuucauuuggggccucugacaacaagccacugggggacagaaaugcagaacaucagccagagauguuggagaggaaagagauuuaaccuggcagguccagccuucaucuuccgcuuagucaagucccgccaccggacucuuccaggcuaaggcuucgcccagcaguuuacagaacuuaguauuuaggaaggacugccaggcgcaguggcucacgccuguaaucccagcacuuugggaggcccaggcggguggcucaccugaggucaggaguucaagagcagccuggccaacauggugaaacccugccuuuacuaaaaauacaaaaauuaggcugggugugguggcucacaccuguaaucuuagcaccuuagggggccggggcggguggaucaccuaaggucaggaguucaagaccagccuggccuguaacauggcaaaacccugucucuacuaaaaauacaaaaauuagccggacgugguggugcaugccuguaaucccagcuacuugggaggcugaagcaggagaaucacuugaacccaggaggcagagguugcagugagccgagaucgugccauugcacuccagccuggacuacagagaaagacuccgucucaaaaaaaaaagaaaaaagaaaagaaaagaaaaauagccgagcgugguggcgcccgccuguaaucccagcuacuaaggagcugaggcaggagaaucgcuugagccugggaggcggagguugcggugagcugagaucgcgccuacuccagccugggcgauagagcgagacuccgucugaaaaacauauauauauacauauauauacacacacacauauacacauauauauauacacacauauacacauauauauacacacacauauauacauacacacacacacauauuuagaaaacagcaagcuaagguggaugcauggaacguauuuaugcuaaaaauuauucauuguuuaccuaaaauccaaauuuaauugagcguccuguauauuuaucugcuaaaucugguaacucuaucaagcucuccagcuucccaugcugaguccccugcccaugcucuccauuuccucggcgguccccgggacaggagcccccaacccccgacccccgacccccgacccccgacgaguccacgcaagcacgccuggccuugcaccugggcgcaggaaccgucccaccucccggaagucccgcccaacguacccgcucgugcgcuccuguagccgcacgucuuccaggaacuggucaaccuccagccccagcggcuccugagcaagccgccgccagccccgcuucuuauuucuugggccucgccgccgccgccucagcgcuggguccaccgaagugggccgcagccccaggaaaccagaaucggcaucgcuuuucgagcugcgcuucccaccaacgccacugccuccugccgccaucuugucaaaggaagaacucagcca

SEQ ID NO: 191722 - RNA, 11531 nt, Homo sapiens
uggcugaguucuuccuuugacaagauggcggcaggaggcaguggcguuggugggaagcgcagcucgaaaagcgaugccgauucugguuuccuggggcugcggcccacuucgguggacccagcgcugaggcggcggcggcgaggcccaagaaauaagaagcggggcuggcggcggcuugcucaggagccgcuggggcuggagguugaccaguuccuggaagacgugcggcuacaggagcgcacgagcggguacguugggcgggacuuccgggaggugggacgguuccugcgcccaggugcaaggccaggcgugcuugcguggacucgucgggggucgggggucgggggucggggguugggggcuccugucccggggaccgccgaggaaauggagagcaugggcaggggacucagcaugggaagcuggagagcuugauagaguuaccagauuuagcagauaaauauacaggacgcucaauuaaauuuggauuuuagguaaacaaugaauaauuuuuagcauaaauacguuccaugcauccaccuuagcuugcuguuuucuaaauauguguguguguguauguauauauguguguguauauauauguguauauguguguauauauauauguguauauguguguguguauauauauguauauauauauguuuuucagacggagucucgcucuaucgcccaggcuggaguaggcgcgaucucagcucaccgcaaccuccgccucccaggcucaagcgauucuccugccucagcuccuuaguagcugggauuacaggcgggcgccaccacgcucggcuauuuuucuuuucuuuucuuuuuucuuuuuuuuuugagacggagucuuucucuguaguccaggcuggagugcaauggcacgaucucggcucacugcaaccucugccuccuggguucaagugauucuccugcuucagccucccaaguagcugggauuacaggcaugcaccaccacguccggcuaauuuuuguauuuuuaguagagacaggguuuugccauguuacaggccaggcuggucuugaacuccugaccuuaggugauccacccgccccggcccccuaaggugcuaagauuacaggugugagccaccacacccagccuaauuuuuguauuuuuaguaaaggcaggguuucaccauguuggccaggcugcucuugaacuccugaccucaggugagccacccgccugggccucccaaagugcugggauuacaggcgugagccacugcgccuggcaguccuuccuaaauacuaaguucuguaaacugcugggcgaagccuuagccuggaagaguccgguggcgggacuugacuaagcggaagaugaaggcuggaccugccagguuaaaucucuuuccucuccaacaucucuggcugauguucugcauuucugucccccaguggcuuguugucagaggccccaaaugaaaaacucuucuucguggacacuggcuccaaggaaaaaggugaggagaggcuuuugugguguggaauggcgguuauucauuguuagucagcuuacgguagccucugagaucuguguuaaugauguggcuuggaaggcaaauaucugcggaaacaggucaaccuuaauauaaacaaggggaccucaaaugggcagaaagcaagcuggagacgaacuuagagaaggcagguuuuucuuuugagaugucagugaucuccaugcacagauaagcugcugggagucugccuugaugaauaaguuagaaacacauuaaaggaucucuuuuuagcuugcagaaaagcaagucaaggaccugcuuaacucaguccugccgguugcggugagucacgccuguauucccaguacuuugggaggcucaggcaggcagaucaccugaggucaggaguucgagaccagccuggccaagauggugaaaccccgucucugcuaaaaauacaaaaauuagccaguugugguggcgggcaccuguaaucccagcuacuugggaggcugaggcaggagaaucacuugaaccugggagguggagguugcagugagccgagaucgcgccgcugaacuccagccugggauuacuauuauuuuuuugagacaguguugcgcugucauccaggcuggaguacaguggugugaucucaguucaagcgauucuccugccucagccucccaaguagcugggacugcaggcugcaccaucaagccuggcuaauuucuuuucuuuucucucucucuuuuuuuuuuuuuuuuuuuuuuuuugagauggaguuucaagcccaggcuggagugcaauggcgugaucucagcucaccgcaaccuccaccucccagguucaagcgauucuccugccucagccuccugaguagcugggguuacaggcaugugccaccaugcccggcuaauuuuguauuuuuaguagagaugggguuucucuauguuggucaggcuggucucgaacuccugaccucaggugauccgcccgccucggccucccaaagugcugggauuacaggcaugagccaccacgccuggucaagccuggcuaauuucuguauuuuuaguagagaugggucuucaucaugucagcuaggcuggucucaaacuccugaccucaggugauccacccgccuuggccucccaaagugcugggguuauaggcgugagccgcugcgccuggccaagaugagcuuuaauaggaauaagaggacuugcuuuagugagcggguaacacacgucuuaacuugcuugccuuaaguugcuagaauguaggguggggaucugcugaaacaagaugaggcgugagggagggauugcucuggugaguaauaguguuuacuucaauauguagaaaaacaaacuaagaacagaugaucugcucuaaugaacagccuggaagcaagcgaaggggucugcuuuaaugagcaagagagugagcuugugugagaucagucaaaggguauguuuuaaugaaaaugagcggaccugguucagugaccagauagaguggaaggagcugcccugagguacaggagacuuccaauaggcagguaaaaagugguuauuagagucugggugcaguggccuacaccuguaagcccagcgcuuugggaggccgagguggggcggaucacuugaggucagggguuggagaccagccugggcagcauggcgaaaccccgucucuacuaaaaauacaaaaacuagccggacgucaugguacacgcauguaaucccagcuacugagaagcgcuugaacccgggaggcagagguugcagugagccaagaucauaccacugcacuccagccugggcgacagagcaagacucugucucaagcugggcgugguggcucacgccuguaaucccagcacuuugggaggcugaugcggguggaucaccugaggucgggaguuugagaccagccugaccaacauggagaaaccccgucuuuacuaagaguacaaaauuagccgagcgugguggcgcaugccuguaauuccagcuacucaggaggcugaggcaggauuguugcuugaaccugggaggcagagguugcagugagccaagagcgcaucauugcacuccgcuccagccuggguuacaagacucugucucaaaaaaaaaaaaaagugggggguuauuagagaagucagccuugaccgaagugaguugaucuggugugugaguguaaaggguaagucagugaccugcccguaaugaacagaugggaaaguaguuaccggcgugcuuuggcgagugggaagccucuuuggggggcaggaaagaggcaguuuauggguuccacuuuaguaaggaaacacggacaaagaucauagugguugugagcagucaaccaggucagccccugugcuuugugggccuuaaaugauuacaucuucauaacggccuagugagggagguauccacauccucauuuugggggcacggaggagcuaagccucuugugugaggucccacaguccaugcaaggguguuauuccauucuagaguguuuugcuguagaguuacugcuuuuaacuguuaggcuuuugaaguaaaaaccacagguaucuuugugggaggaaaaagacaguaaaaaccagagaacuagaaguuaugcugagaaguggccauccugggucccaaguccacuucuguggcccucccugggcuucagugucaacugaugacuugcuuucuuccuuuuuuuuuucccccugagaugagaucucacuauguugcucaggcuggcaucaaacuccugggcucaagcgauccucccaccucagccucccagagugcugggauuacaggcgugagccaccaugcagggaagagguucccuguuugucuggaagacccuccuauguggcugugggcgugacucuucguguccccagcauggggccugccuccugcuggcccagcacuugguuguggagggucagagcuugggcaccuugggccccauccuuaggggccucuaccuccagguaggagccuggggaccuccaagucuccuggggugacuugggauucaggucugauggcucccauggaggugaauaggguggguggucuuuggcaguggguagggcugaggccuugacuuguucucuuucccauucuuagggcugacaaagaagagaaccaaaguccagaagaagucacugcuucucaagaaaccccuucggguugaccucauccucgagaacacauccaaagucccugcccccaaagagugagugucccagcaucccugggcccuucuuucccaccagacucugguccuaaaggguuuccggggcugggggcugguaggugagggucauuugaaggguagggcaggcucagguuugggcuucggagugcagauuagagggagggagucugggugcccuggugcugggccgaggcaggugaggaggggccuggacccagcugggggcuucgggguuggagaggaggggcugagugggaggcguguucaggaggcacaucaggugggucuuggggcaugagcgggugagaggguggacagcuggccuuccccugagauggggauguggaggagugggauuucgggugaugcugagguugguuuugacgugguggugugaggugccugggguauguccaggacggggcuguugcuucguugagucuggggcucagaggggaggccuaggcuggagacagacguggggagaggaguucucugaagagggggcggagugccaccuuuuggagagggggugcugaagcugccuuaaugguggaggaagcccgacggggaggaggcccugcugccguucaggcugccaccucaccugcugcacuugugcccccucuccccgaccagcguccucgcccaccagguccccaacgccaagaagcucaggcggaaggagcagcuaugggagaagcuggccaagcagggcgagcugccccgggaggugcgcagggcccaggcccggcuccucaacccuucugcaacaagggccaagcccgggccccaggacaccguagagcggcccuucuacgaccucugggccucagacagugagugauccugcugucaccuaugaauggggacaggacggccaugugcaguuuguguguguugugcacugcacgagaguacagugugaaagggagugcuuugugggugcuuuggugaccucccagcagagucgugcguccugaaggggcggccguuucccacucgugcuuuuccuuuccugaguugugaggcuucaggaaaggaagccuucagcuuuggucucuuccacuuucugaacccguccagacacaguuuuguccuggugaucaaggcccuuggggucuagaaucaguccuucccuugccugagcuucagggucaccuuuuugaaauguggagggauugggggggagccuuuggugccucuuccaugcugggacugucccagcagcuccccucgcuguauccacagacccccuggacaggccguugguuggccaggaugaguuuuuccuggagcagaccaagaagaaaggagugaaggugagaugugugggaagggcauccugggugaugggagggugaggagggccgggagcugcucuguguuccugcaguagagucugucucagagcccuuccaucccaguggccgagaacucugugcuggagccagguggcugggauuccugucccagcuccagugcugacugauccugggaagguggucucaccuuucugcaaccuauaucuuccucuaaaaugcagaugagggccgggcaugguggcucacgccuguaaucccagcacuucgggaggccgagacagguggaucaccugaggucgggaguuugagaccagccugaccaacguggugaaacccugucucuacuaaaaauacaaaaaaaaaauuagcugggcuugguggcacgugccuguagucccagcuauuagggaggcugaggcaggagaaucgcuuggaccagggagguggagguggcagugagccgagaucaugccacugcacuccagccugggcaacaagagcgaaacucugucucaaaaaaaaaaauaaaauaaaauacagaugaaauuguacuuagaucaugggucgguggggagaauguaaagagguagcacaugagaagguggagcccgugcuggcaaguggcagaagugucacggguuugaguuuggauuugcagccuccuucuugagcugcuggaccccaaguguuagagcccaggugcuuacaaucuccggggcucagccucguggguagcagaggauaggcugcuauccuuuuucugagauggagucuugcucuggagucaccugaaugccccuugagcucuucccacacccaaccacuggcaaggccuggagcaucugccccauggcuguguccugggucacccgcagccccaacgcacggccuuacccugccucggccuuuucuccacagcggccagcacgccugcacaccaagccgucccaggcacccgccguggagguggcgccugccggagcuuccuacaauccauccuuugaagaccaccagguacacugccccguccaggccucccuccucagugggcucugccucuuggucaggccuucacuagcuuccucccugugcugggaacuccaaugacccagacagcccugggccuguccgcaacggggcucacgguccagugcaagagaccuguucccagacagugaugggcagagugguuggggcugggagcccagacggggcaccuggcccagccuggggggucaggaagggcucccgggaggaggggucgccugagccgaggcagaggcugagggagggguuugcagugggaggaggggaguggguuuuccagguggugggaacagcacugcaaaggcacagaguugagagagaccguggcgccuuccaggaagccuguggggcagagaugaaaaaggcuguggugacacgguggcacacuggcagccaagugacaguuauauaugggcgaggcuagcucagcgaugggaaagucuagcuggagccacugugcauuuagcgggcaucuguugagcacagaugcuguggacaaaggggacaaaaaccccucccuuggccgggugcggugccucacaccuguaaucccagcacuuugggaggcugaggcgggcagaucauuggaggucaggaguuggagaccagccugaccaacauggugaaacccugucucuacuaaauacagaaaauuagcagggcauggcagcacgcaucuguggucccaacugcuugggaggcugaggugggaggauugcuugagcccaggagguccaggcugcagugagcuaugaucgcaccacggcacugcagccuguguaacagagcgagacucaaaaaacaagcacaacccucccucaaggaacagcccuucucauggggucacgugacuggagagaugcugagauguuugcgguagaugcaggaccgcuuguccgaaucguuuucagcauucauaagaaggagauagcuagccaggaacagaggcagcuuccucaucugguagagaaaagugucugcggaaaaaagcaacagugugcucaugguugaaagcgugagggugccgcucacugccaucuguuccuggaccagaugugggagggggcguggagaucagacauucacuuuuagauuuguacagaacuacuucguagagauaaaauucacuuaaccauacggucagccuaguuagaguaugugauucaguggcuuuuagugaccauuguguaaccauccccgcagucaauuuuagaacauuuucacuguccguaaaggaaaccucacacaugucagccaucacccccgcaauucccugucucguguggucuugggcugccaggcuuccugucucagggaccagcccacccugaccaauucacauagaugaaacugugggccgggcaugguggcucacaccuguaaucccagcacuuugggaggccgagguagguggaccaccugaggucaggaguucaagaccagccugaccaacauggagaaaccccaucucuacuaaaguuacagaauuagccggguaugguggcacaugccuguaauaguagcuacucgggaggcugaggcaggagaaucgcuugaacccaggaggcggggguuguggugagcugagaucacaccauugcacuccagucugggcaacaagacagaaacucuaucucaaaaaaaaaaugugaagcgugcaggucagacugccuucacagacgugcagagcaggugugagggcgaggguuugaggugcccucuggcucugugcagggugggugugcugguagacgggguguggggaggaaagccugggccggggcgggauccacgggcacuggaugagggacagaugggagguaagagggucuagucucagugucccaggagggguucagggacccauccucacucccgccccucagacccugcucucagcggcccacgagguggaguugcagcggcagaaggaggcggagaagcuggagcggcagcuggcccugcccgccacggagcaggccgccacccaggugagccccgcaccugcccacucccuccccuccccgggccuccuacccaccccugacacugcaccccgccuccccaggaguccacauuccaggagcugugcgaggggcugcuggaggagucggauggugagggggagccaggccagggcgaggggccggaggcuggggaugccgaggucugucccacgcccgcccgccuggccaccacagagaagaagacggagcagcagcggcggcgggagaaggcugugcacaggcuggugagcgccugggccagcggggccugccucugaugccucgcccccuuccuuccuuccucccaccaugggcugcccugggugcugcgggcagccugcacaccccaagccccgcauguggccugugguuugggcuguuugggauccucacagcugagacucauuucccagccucuuccaggcagggcucgggcuggggugggacagggucccuggcgcuucuguuugaggggcgggguggggggagguuucugcaccgcagaccaggggagauggaugacaaaaggggcuucagcaaacagcugcugggaaggcacuggaggggccgcugaugugacgggguuaggaagggccuccggggacaggcagguuugugcagggaaggcucccuguguagagagaaggucucccugugugggcagcaccggccugagcccugacccucccccgucuccacagcggguacagcaggccgcguugcgggccgcccggcuccggcaccaggagcuguuccggcugcgcgggaucaaggcccagguggcccugaggcuggcggagcuggcgcggcggcagaggcggcggcaggcgcggcgggaggcugaggcugacaagccccgaaggcuggggcggcucaagugagaaccaggccggggguucugggagaggcuggggagggggccgggucccagguccugacaccuuccugccuuuguucaggaacugcccaccccccccaucgggagaccaccucuucccccacaaaaccccacauucucagaggccccuucuucuccaggagggggcuuuggacuggguguccugggccccgcgggggugauauuucugaacacccgcccuguucugcagguaccaggcaccugacaucgacgugcagcugagcucggagcugacagacucgcucaggacccugaaggugcucacuguguccugccguggagccccgugcccagugaugacaccauccuugcuccccgugccccccaggggcuaugggcgacaccauggcugccccugggcugggccaguggggccaaugcccaggggcugagggcacgggaugcugggaugagaucccagggugaggggccaggcuaagguuugaguccgggacccuaagaaggccuuuccuuccagcuggucccuguugcagucccggucaccuuuaggacuagagggaccuuccugaagcucagaaccaacccugucccuccccugcucggaaccugcuguggcuccccagugccccugaggaagcccagcuccucugucagccacacgccugggccgacccggccguggggcuccagccaguugugcucaugagcggacugugccuucucccucugauccagccuuugcccucgcuguccccuuuucugugucgucaccagcccacuucccgugacuccucuaagcccagcuuagagauggccauagguugguggcugucaucccaacacugagccccagcagcugagggccaggcugagucccuggugcccacaggcugcccuggggggagacugcauggggcugagcccugccaggaccccgaggagagguccaggcccuugggcuucugccaggcccugcugaggccucccucucuguccuguagcccgagggcaacauccuucgagaccgguucaagagcuuccagaggaggaauaugaucgagccucgagagagagccaaguaaggggcggccggggcugcuguggggcgagggcaucugggauuggccccgggcacugauugcuccauugucccugcuccagguucaaacgcaaguacaaggugaagcugguggagaagcgggcguuccgugagauccagugaguccacccggcuucggcgcaaggaagggagcccuucucccaccccguggugcccaccgagucccagggccccuuccagaguguggcuaguggcugagccacacccccuuggccaugcccagaagaggcccugaaaccagagcgggguugggaggguccccaaagggaaacugaaaggcagggggugucaggucggcaggggguauggggcacccucucacccacccucagcuccuuuccucuguccccagguuguagcugccaucagaugccggagacucgcccuucaauaaaaaaucucuucuagcugaucaguggg

SEQ ID NO: 191723 - RNA, 33887 nt, Homo sapiens
ccgccgcagccgccgcagcagcagcagccgccgccccaggccccccccauggagcccgaggccccggauucccgcaagaggccccucgaaacgccccccgagguggucugcaccaagcgcagcaacacgggaggugagaaagggcugcggcucggggcgggggagcgggcagggggccucgccuuucuccauccuuucccccccucccguggcaggugcaagggcucuggggaggggagagacaccccuccccgaggcgggggacagagcggggaguugaggagggggcuggacccccuccuccucucgcugaggcccggggcugggagcuuugucugcgaggagaggggugggggggagggggugauaaguguccuuggggggcgcagaagauggggggcgugggagccucagggcaggugucuguguguccuugaggggugugugaugugacccuuucggagcagggguguuccccgagcucgcguguccuggcugggggaggggaaggaguagaggccuguggaccgggagcuucccagccucccucccuggggauguccugaacaaggguugucccagauggaggcuuguguggcccuggccggaucgugcguggggacaggcuggguagguguguggggugaaauggaggaaaugguggguguguaaagcuaggugggagaaugugaggcuaggacagguguguaugugugugcguguguguguaugugugcccucuacagccuggaugugugacauuagggaucaggaauaugacagcauagggggguguaugagaaagacaggggacaggggcugggcuccauguuugagacccuccagcggguacgugugacaaggaaaggugugugcuugucacccccaagggggcuguggcagagugugacacaugagagggugugugugacaugcaaggaggugugugggggacaccgaaugggcuggcucugggugucagccagaagaggccguguagaucagaggaaagggguccagugugugugacacaggcguggcuggugaggggaugugacaagaaaagggugugggugugacuccagagaggcuguggcugggugugacacauggaggugugcaacagugacaucagagggggugugugcaacagggaagguggguguaugacgagggagaggcuggggcuugugggugaaacgcacgaggguguguaaaaaggagaaggaaggauggguccccaugugacagggcacgugugcauaugacacccagcuguguguauggguguaacaaggagaggugugugugugaaauggcugagugugugacaccagagauauggggaugauucugcauguguuugacaagggaggcuguguguguguccguguguauuggagauugccgaauguuugacaccacggaaggcagugugagggaagagaggggcucucccugggugugugacccaaggagguguguguaccagagaagaaaagccgagcugggaacucuaggugcaugcccugccguggggggcucagggaagaggugggguuuuuugggguccucagagcccuguccucuagcucccugguaggagggagaccccgcagcggacaagccccuccccgcggucaccuugccaaaaucuccacuuccucuggccuuuuccuccggaugggagagggauggcuucaggcagagugcacccuuuccucuccgccaggccuggcaguggguggggugggggccuccuaccuccucccuacagaugaauacaagccgacuuucuuccucccauccuagcccucccccaccuccauccaggugggacaggaaucagggacccccuggaugccugugaggguguccagcagaaauuggaggaaagggaaguugggggaggggaugggagggaguuuccuguccuucuuccugcucccccacccccagcacacacaugaauauguccccgacuuccuucccuccuuccugccccacugcuguucccaguccuggagaggucagggacccaggaggucccugagcccagccagacugucuagcccuccaccaccguccuccagaggguaggggguucccaccuuucucuacagggacugagaugcuuagaaucugaucacuucucagcacaacuuaacacugaugccacugcugcuaauaacagucacaucugccuacuuggcaccuacuacucugagacauggguuaauaucucaguacaaccccugggagacaugauuugagcaucuuuacagaugaggaaaacugaggcucagcaaaaugaaaccgcuugcccaaggucacacgguuucuaagugauggagcuagaauuuacccaacccuaggcugccugguuccggagcuccuggacguaaccucugugcuauccugccucccuccacagcggggaaacuaggaugagccuuuagggaccaucuccuccagacugucucccaccccgcuucuguuuacucauggggaaacugaggccgggagaugcagagggacaggccuccauugacagaaacacacucaggggcagggcugggcaaggguccaggacuuugaucccaaaauugagggcuucuuucaauaauauacauucauagcugggggaugcugggccaacccauccccuuuucugagccucaguguccucaucugccaagugggcacauaaaaaugaccauaaggggcugggcacaguagcucaugccuguaaucccagcacuuugauaggcugaggcggguggaucauuugaggucaggaguucaagaacagcuuggccaacauggugagaccccaucucuacuaaaaauacacaaauuaucggggcaugguggugggcgccuauaguccgagcuacucaggagguugaggcaggagaaucgcuugaauccaggagguggagguuuuagugagccgagaucgcaccaccacacuccagccugggcaacagagcgaaacgccaucucaaaaaaaaaaaaaccaacaaaaaacacaaggauaauacuaacaauagcuaccuauauuauuguuuaaugucuuacgugcaauuucauaucacucucccaacaugcuaugauggaauaauaauaaucaguuauaauaauggcuagacuuacgauacugcaguaugccaggaacuaucaugggaagugcuugacauggaucaauuccuuaauccuuacaacaauucuaucauguuaacccauguuacagaugaaaaacugaggcacagagagguuaagucacuugcccaacgucacucagcugauaagcagcagaaccaugaugugaacuuaggcggcuggcuccauuguguggggagacacuagaauggacccuauuuuuagauggggaaacugaggcucagagggcuuuuccugggugucccagcaagcaguggccuacuggacagaugagauucuugccccacuccugcccgcuucugggagcagaugggagaaguggaggagaugguggcaguucacacuugcuucugggcacugugaguggcuggcagaugccgcugggaggaaaacaaggcacuaagggcaggaagacuugggugaagagguuggacggaaacucuagucagggacuccuugcagaaauaaaugaccccagucuggcaggacaauaacaaacaguggcccccuugauacagaucguaacucuuaagcugcaacaauaaugaccccuguacuccugacuauauucccaccucugucaacccccccaaaauaaaaacccauauacagacauacauacauaucucacacccucaacguagcuuacaccagccagaucuugcuccuaacaucccucuuuuuuuuuuuuuuuuuuuuuuuuuuuucugagacagggucucacucugucacccaggcuuggaguguaguggugcagucauggcucacugcaaccuugaccucucaggaucaggugaugcucccaucucaguuuccccaguagcuggaacuacaggugugcaccaccaagccugacuaauucuuugaauuuuuuuguagagacagggucuugcuauguugcccaggcuggucucaaauucuugaucucaggugauccacccacuucauccucucaaggugcugggauuacaggugugagccaccauucccagccacaucccucauucuuuguuuuuuguuguuguuguuuauuuuguuuuguuuuguucuguuuuucugagacagagucucgcuguaucgcccgggcuggagugcaguggugccaucucagcucacugcaaccuccaccuccugaguucaagcaauucucguaccucagccucccaaguagcugggauuacaggcaugugccaccacgccuggcuaacuucuguauuuuuaguagagaugggguuucaucauguugaccaggcugaucucgaaccccugaccucaggugaucuacccaccuaggccuccuaaagugcugggauuacaggcgugagccagcacgcccggccacauucuuuaucacgaagucaacaucaccagguuaagagccccuccuagaaugagcucuuucaggauucauaucuugccaccgucaugugcuugguguggaauccucaggcgaguuauuucacuacucugagccucagccugcuugucugaaacauggaggcaggaagaucuaccucucuggguuuugugcauuagaugagauugcauaugugaagcacauagcguaaggcugguagaugguaagugcucaguaaacagucgcuaucaucaucaucaucaucauuauuauuauauaaguguaugucauuuucccuuuucaccauccaccauccaauggugauucacuccaagaaaaccguggcccaucugccuuucuuucacuuagagaccgucacaacucaaggcagcaucacaccuuucagcaucucaucccuacauaagcacacucuaguuguauugcauuucacaccaaauaggcaacaccgccauucacagaaacacaucacaugccugaagucccaccccuccucggcaguacugcucccaccccacacccucucugccagcagcauccccacaggcucccgaugacaacaccgaugucaaaccccagccuccucguacccucauagaacaugccagcucucccuuccccagcccccaaacaaaaccaugaggugccaugaggacaacacccaacauugauguugcaucuggacacacuaacaccaaaaacaacaccucaacaacccacaccccuucagcuuuaccuuugucauucaugacccccaagaucaaagccaccuuagagggugaacucucugacacuaaaauaggccacucuuacuacaacaccccaaaucucuuggguaggcaauuguuauuuauggaagggggaagggaguauuggcugauuuuuuuuuuuucuuuuuugagauggagcccugcugugugaccccggcuggagugcaguggcgcaaucucggcucauugcaaccuccgccucccagguucaagugauucuccugccucagccucccaaguagcugagauuaaaggcgugccacaaccaugcccggcuaacuuuuguauuuuuaguagagacaggguuucaccuugucggccaggcuggucucaaacuccuaaccucaggugaccugcccaccucggccucccaaagugcugggauuuuugaaagccgucagaagcaucccugaggggguggauacaaaaggagcaagagcagagacucagugacuagaaggggaaagacggcaccuuuccaagguggaaauguuugaaauugcagcaggaaauuagucaggagaccugaacuugcuaucuucaguucuucagacucuuacaucggguagagggagcugccuggacucaagggaagagugaagagugggaugggaaugggugggugcggaguucuggcauguagauucugccucacuacaagggagaacuuucucacaagcagugccuugguuguucaaacagggugggcgugcguaauggcugagggcuccgaguucagcugaggucacgugucugcccuugcugugaggaaggcuggucaauagagaccugguuucuuucuggggagguaggacucacauggugggaaacuuccccaaacagaaaagaugugcauaaaauucugggaaggaccagcacagacugaugcucacaacggggacuccugggaauucaagugcugagucucuacaggugggaggucuuagccaaucacuguucauaggagacucacuagaagagggggcuccaggcgucagauuugcacuagucugauacagggaccaucaagccacccacaagaugauuuaaggugguccauggacaaacuuuuuuuucauuuuugaacauuguauguuuauauuaauguauguuagggagaacaaaaacaaccagcccuucaagcuccaauuguuagcaacgauuuuuaaauuucuucuuaauuuuuuuuuauuugagacggaguuucgcucuuguugcccaggcuggagugcaguggcaccaucucagcucacugcaaccuccgccucccggguucaagcaauucuucugcuucagccucccaaguagcugggauuacaggcaugugccuccacgucuggcuaauuuuuuguauuuaguagagacgggguuuuaccauguuggucaggcuggucucgaacuucugaccucaggugauccaucugcuucggccucccaaagugcuagaauuacaggugugagccaccacacccggccuaauuucuucuuuaaauggaugcauuuaggccaggcgcgguggcucaugccuguaaucccagaacuuuggaaggcuaaggugagcagaucccuugagcccaggaguucaagaccagccugggcaacauggugaaaccccgucucuacuaaaaauacaauaaauaaauaaguaaauaaaugcauuuaaaauuuaaaaggaauuuaaaggaaagggaccuugucuguucccugcugcauccccagcaccugaaccaaggacuggaaggucaugggugcucaggaaggauuuguuggaggaagggaaggaagaaggagagaaaaagagaagaaagaacaauuccaguacagaaggacauaaaaggggcaaaauucuagaagguggcaugagaaagacaggaauuagagagaggcugagugcagagaauggagacaaggucuggcuuguaucagugagaggacauuccuccuccaagaaggagggaaaaguuugggacagcccccuagggaaaugggugauuaacaaaguaggaucaccccuccuccuaccucucaacccaacccccaaaccccacguauagggugcuugcucugugucugaugcugugauaagcacugaacuuguguucaugguguaggcaaugcugauaaugaugauaucuaacauuucucaaaucuucuaugugccugggaccauccgaaguaccuuuccuuacauuuccucauuucauuaaucacaguaaccccaugaaguagcacuaucaugauucccauuguauagaugaggaaagcugaggcccaaagaggugaggagacuugcccaagggcauagagcccaucaguggcaaaaugcacuuuuuuuuuuuuuugagacacagucucacucugucacccaggcuggagugcagugacgcgaucucagcucacugcaaccucugccuccuggguucaaacgacucuccugccccagccucccgaguagcugggaguacaggaaugugccacuaggccugacuaauuuuuguaguuuuaguggagacgggaguuucaccauguuggccaggcuggucucgaacucaugaccuuaagugauccacccgccuuggccucccaaaacacuaggauuacaggcgugagccacugcgcucgaccauaaacgucacucuuagucuagaguugcuucugcuguuucauacaaaaauucucagggacaguuuaaagaaguacaagagagagggggcagaagauggggaagagggugaccccaguuuucuucagagaaaaugaauaccuuccacccucagagggaagcagggaagaugcucuggcugggagagaagauggggagugaaauugaagaagcagagagaggacggaguccuagggauuagugagaauucccuccccaucuuucugagccuucuggagauaaaggaccccuuaucugugacaaguuuagggugaggguggggaagaggacauauccgugaguccauggaagagaaugaauucaguaggggucaggaugauugguaggaaggcaccagagagggguuaauuaccuaauaggcuuaauggucugauuaagcaaguuuaagaggauugccuuggugucaggaaacuccuuaauucuggacccuuccccaugccugcaaagccacaucuagccccucuuaccacacccccaucuuacacacauaagggaacacagaacuuucaucuuaagaggccaggcagaggccaggcauggugacucacgccuguaaucccaacacuuuuggaggcccaggcaguuggaucccuugagcucaggaguucgagaccagccugagcaacauggcaaaacuccaucucuacaaaaaauuuuaaaauuaccuaggagugguggcaugugccuguagucccagcuacuugggaggccgaggcaggaggaucacuugagcccaggaggucgaggcagcagugagcugugauggcaccacuguauuccagccugggcaacagagaaagagaaagagagagagagagagagagagaucagagaguguuagagcaguuucucuuuuaucuguucuguauguugagguuuuacgugagacauugaaaauaggcuuccuggcugggcucuguggcucaccccuguaaucucagcacauguuagccuggcuaacauggugaaaccccaucucuacuaaaaauacacacacacacacacacacacacacacacacacacacacacacacacacaaauuagccgggcaugguugugggcaccuguaaucccagcuacuccgcaggcugaggcagaagaaucgcuugaacccgggaggcggagguugcagugagccgagaucgcgccauugcacugcagccugggugacaagagcgagauugucucaaaaaaaaaaaaaaaaaaagaaaaagaaaaagaaaaaaagaaaauaggcuuccuuugcuuaaaaguugaaaaaccauugggggaugguuuaagaccuuaaaauuuggaagcaggauggccuaacuccucccuuucuuuucccagugcuuauugcaaaccuaguaugugcuguucaaguuuuggggacacuguucaagucccuaggacaugggugagcucuauggaugugauccacaguggaccucugugaucaguuacucugaaggcaugaaacggggauucauccuaucuuugggguucaaggaaagcuuccaagaagaagaaacauuugagugagaaccuaaaggacaaaagauauugacugagggggcccgggcgcgguggcucacgcuuguaaucccagcacuuugggaggccgaggagggcagaucacgaggccaggugacccagaccauccuggccaaaauggugaaaccccgucucuacuaaaaauacaaaaauuagcugggcgugguggugggcaccuguagucccagcuacucgggaggcugaggcaggagaauggcgugaaucggagaggcggagcgugcagugagccgagaucgcgccacugcacuccagccugggcgacagagcgagacucugucucaaaagaaaaaaaaaaagaaacugacugaggggaagagaagcugccaggcacagagcaugcacaaaagcccuaaggugggaaggagcagggcacguuuaaggaacaaaauaugcacugagccugaggcucacggaggaagaugaggaagugaagcuggaaagguggguggggccaagucacaaagggucgccaggcuggaguggagugcaguggcgcgaucucggcucacugcaaguucugccuccuggguucaagcgauucuccugccucagccucccgaguagcugggacuacaggcacgcgccaccacacccggcgaauuuuuguacuuuuaguagagacggaguuucacuauguuggccaggaugguauccgucucuugaccucgugaucugcccgccuccgccuccgccuuccacagugcugggauuacaggcgugagcuaccgcucccggccgcaaagggucuucuuauacugagaaguguccagaauuuccauccuggaggcacguaggggcaacgggcaggggaggcuagaugcuugccuugagacuacauuaacaaaaugcuuuucacauggucaaaaaaacugguuuauaauaagcaaggugcgguggcucacgccuguaaucccagcacuuugggaggccgaggugggcggaucacuugaaaucaggaguuugagaccagccugaccaacauggcgaaaccccgucucuacgaaaaauacaaaaaauuagccacgugugguggcgggcgccuguagucccagcuacucggaagucugaggcaggggaaccccuuacacccgggagguggagguugcagugaaccgagacugcaccacugcacuccagccugggcaauagagcaaggccguaucucaggaaaaacaaaaaaagaaaaagaaagaaagaaaaggaaaagaaaaauuggccuauaacaaagaauggccaaaacuccacaagcugccgcuggcacugcaucuaggucuucgaggcuguccuucaucguguugguccccccaggaguggaggguguuaagcaaugaugggaggagacugaaucagaauuggauuugaaucugagcccaguagcuguguucguguccuugggcuggugaugaccgugggcugguaccuucacuucucugugccccucugugccucaguuuccucuuguguaaaaauggagcucauuccacccgccucaccgggagguugugaggaacggacgagaucaagcucacaaagcacucagcacagcgccugaucaaaagugaguguucggagcauccccagcguccggccuuccucugccuccccgcucaccgcuuccaccugucagaccgccgucaccuccugccuggaccauugcagucgccaccucacugggcccccaccucucccaccguugcuucucacggucugcuccccucaugggcaucagaggaauccuccuaaaaccuaagucaggccacaucccucccauggcuccaucucacuugggguaaaaguuaaggaccucacuguggccugcgagccccaucaccccucaccaccagcaccccucucuguccucaucuccucccauucuuccccucucucauucagccccaggcacaggggccuccuuagucccucuggaagagcacaggcacagucccacuucagggccuuugcacucacucguccuucacauagccaugugguuccguuccuuccuccauauccugaugaucauaauaguucagagcauggacuccaaaucucagcucugccaccuacaaguguccuugggugauuucuucaccuuuguuuccucaucuguaugauggguuccuucauaggauaagugugaaaauucaaaggacugguauuuggaaaguacuuagaacaguauagcaccuaucaggugcugcaaaagugugugaugaugaauaaagccugccacauucuuaggaagagcuucccuggccucccucucugacacugcagccucccacccucccugacccccuuuuccugccuuuuuugugucaucaggagucccaccaucugacaugaaauauacugucugucuuccccaccuagaagaauguagcuagcugugcgagcucuuggcugaaucacuaaaacucuuucggccuuauuugccucauuugcccacaaaucggggagcuuugucuauuuucuucuuggcuguuucccuagaccagugccaggcacguagcaggugcucaauaacuauuuguugaaugaaugagugaaugaagaucauuauuuguauuauucuccauacugcuacugugaccccugggguuuccucugcucacccccuccaaaggugaagaccccucccccgcugacuccccuccacccugugugcccccgcagaggaaggcgaauacuuccugaaggugcugauccccagcuacgcggcgggcuccaucauuggcaagggcgggcagaccaucgugcagcugcagaaggagaccggagccaccaucaagcucuccaaguccaaagacuucuaccccggugagccccggcccaggucucugcccuaggccccccgcccuuccucccuuucucccucccaccugggcccuagaugagggggaaggucugcccuaaggacagugacagugguggggagggggccuccccuuccccuaaggggacagagcugcccccagcccgaggggccuggccgagcagaugggggugggggcagggcaagacaacgggccugcugcauauucaugagcucauuugcaugaugcgcuggcagaugugucuuuucccacacaccugcccccucuggucaguuggaggagcgaggguggggagggaggcaggugucagggcgucccuccgggcuugggggccagccagccauguuccacacacuugcuccccccuuuggaauucugucacccccucuugcccagucucacugguuuucucugucucggugucauucuuuaugugucucccucucauucuguuucugacuucucgucucuugcuccccucugccucccucugucucuugccccucugucugccucucuguccaucucucugguucuguuuggauaccccccaucucuuguccucuucaucuguccucugcuuucccugucccuccccucaucuuuccuucuccuuuugucuuccugucucucuccccauccuuuccuucccuccaccucucauagucucacguuuuuccuuuccuccucucucucucugaacucuguucaaucauccauucaaccaguaucuacuagcccccucucacugagguccuccucugcgggcgucacacauuucuuucugccucucccuuccugugucucuuuuuuccuaagucucagcucccuccugguuuuuucuucccuuccuccaaacccagucccuuuucugccucucccccugcuccauccuucucccccaaccauacauuuuccaaggccccuccacucucucuauucccuccaaagucucucaccucucccuaucucccucccaagaccaaugcccgacaagcaucgacaucuaggacuccagggaaggccuccugaauugcaucuuugguccagugcugguucuaguucauccuuaauccccuuggauuuuuuaggucaaacaccagagcuggagcccagggucaguacgcacucauuuucucucucucucuuucucucucucucucucucucucccucucugucucucucucucuccccaccccgucucuccucucuccuaucuuucccucucuccucccucuuucucucucauucucucucugcucuaucuucucuccucuucucucucucucucucuccaccauccaccccgcccccagccucccaucucacuaagcagcuuuggcaagagguuuagagaaaaaucgagugaaccaggcacaccuccuccuuuucucuuccacccuggcccaguuuuccccacuccccuguagcccacaagauauggauaagaccucuguucggaauguuccuccgaggacacuugguuccuugcuccuggaucacauucugugccacgagacaugucguccccucccagcccauugacacaccccacaggccaggcagcugggaaacccagaaggcgggacagacauugguccuaccaggucaaacaguauucagacaagcaacaggagccagcgucucuccucagccccuggacauguggucagcccccauccccacuccuggcgugcaacuuccagaucauacagcaugagccggcugcugacucagagaagcaggacacagcccccuacauccuaguccuacaucccacaggaauguaggaaaauggaaaagcuacugcaggagacaaaaaacacuucccuccacuccuggcgugacacccugucauucauucauucacucauucauucaacacacauucucugagcacuuccucuaugccagcccggugccagacagaaauggggacaauagcaguggcugaaaugucccagccuugcuuccuugguucucacaucccagucagggaagcagacgucacaccagugaugacccagaguggucagggcugggacaggaaguccagagguugguaguuggagcccaaguggcacaaaggacccagcccagggaggucaggaagagcuuccuggaagagacgaccagagcaguagggaaggaugagcgagguaaagugcagggaagugugcccaggaagacaaaauggcauacucggaggcugcugagcaguuuggucaauguagccaaagcagacagaacaugugagaaaugacaguggagaaacugaaagggcacucugggccuaguagguuagcaugcacacacacucacacucucacaugcacacucacacacagucucacacgcucacacucacacacgcugacacgcacacugucaugcucacacacacucauucacacucacacccucacacccacacacacgcuuacacacagucacacacacugucacacauugucacacaugcuuacacacacucacacucauucacacacaucccacucacacacacgcuuacacacacauugucacacgugcucucacacucauucacacucacacacaccccacucacacacaugcucccacacacacacacucucacacacacacacacacacagcacuugggugucuacuacaugaaauaaaaaccuaccuggcacuuaacuccaagagaagggcagaacacacaaccuccccuccuuugugguggaucccaaagcccuagauucaauccauccaggucauacauggagcaacugaaaugcagaaaaaggcaagcaccugcgcaagggccacacagacucccuugcgucagcccagauccacccugaggauucuauuuuuuuuuuuuuuuuuuuuugagacggagucuugcucugucaccaggcuggagugcaguggcgugaucucggcucacugcaaccccugccuccuggguccaagcgaguccccugccucagccucccgaguagcugggacuacaggcaugugccacuaugcccaacuaauuuuuuuauuuuuauguuuuuguauuuuaguagagacaggguuucaccauauuggccaggauggucuugaucuccugaccucgcgauccacccgccucggccucccaaagugcuaggcuugagccaccgcgaccggccacccuagggauucuaaaacaccgucugauguugaacaucugcuugaagcuuuauacccuaacugcugaagaaaagcacagacacacacacacuuuuuauuuuguauuuauuuauuuauauugaggcagggucuuccucuguuacccaggcuggagugcaguggcacgaucguggcucgcugcaaccucaaccuccugggcucaggugauucucccaccucagccuccugaguaacuggaacuacaggugugcaccaccaggcccagcuacuuuuuuuuuuuuuuuuagacagagauucgcuguuguugcccaggcuggagugcaguggugagaucucggcucacugcaaccuccgccucccagguucaagcgauucuccugucucagccucccgaguagcugggaucacaggcguccauuaccaugcccagcuaauuuuuuguauuuucaguagagacaggguuucaccauguuagcaggcuggucucggacuccagaccucaggugauccacccgccucggccucccaaagugcugggauuacaggcgugagccacugcaccuggccuguauauuuuuuuuuguagagauggggucucgcuauauugcccaggcugaacuccugagcucaagcccuccauccaccuuggccuccuaaagugaugggauugcaggcaugagccacugugucccaccacacacacuucaaaaaacauuuuuauaguuuuauaacauaccucuaucaacgugcauacucuugaaugacuacuuaauacauucauauucuuuuuaauaucaaaaauacaaaaauaaaacugucaucauuuuaugccucccuccaagauacacacauagagcugaucacuccaugcaccccaaauuuagcagaaugcacagacucugaagccagacaccuggguucaaaucucugaacauccacuaccaucuaagagaacuugaacacaucuugagcccucucugugccucggcguccuuagcagggaaucagggacaauaauaauauugccuacuucauauauuaagugaacacguauguauaaagugcuuuggucaggugcgauggcucacaucuguaaucccagcacuuugggagaccaaggcggguggaucacuugaggccagacuggccagcauggugaaaucccaucucuacaaaaaaugcaaaacuuagacgggcgugguggcacacgccuguaaucccagcuacucaggaggcuuaggcaugagaaucacuugaacugggaggcagagguugccgugaucugagaucgcaccgcugcacuccagccugggcgacagaaugagacucuugucucagggaaaaaaaaaaaaagugcuuagaauggugccugaggcuuggguuguauaagggucagcuauuauuagacacucuuguggggcuuaaccaaccuccccaaaagccccugugggcccccuuguaaaaacuacaaggggauggaaggucaaagacuuccugaguuggaaggaagcuucacagagaggcaaacccucggccagcucuuccuggggcauccaccucccccuaccccgccccccaguucccaccccaacccacacccuuuccuauuuacaccagacggaggcagacugcaggcugacucacccuuggcucagaccaagccauuguucugggguggggaaggggggguaguaagagugaggaacauggcccaaagcgggugggggaugucagcuacacaagugacccacagacagugacgcccagacacauggcgaggcuggccugccagacugggaaauggcaauugaggagucagggucgugucaccagcgugcugcacugaagugcuugcuggacacugacacacaccccagguaucccagacacacagguacacagccacacggugccuggugcacacucaagacacuuuuuguuuuuuuucuuuuuuuuguuuuuuuuuugagacggagucccgcucugccgccaggcuggagugcaguagcaugaucucggcucacugcaaccuccgccucccagguucaagcgauucuccugucucagccucccguguagcugggacuacaggugcgugccaccacgcccagcuaauucuuguauuuuuaguagaaacaggguuucaccauguugcccaggauggucucgaucucuugaccucaugaucugcccaccucggccucccaaagugcugggguuucaagcgugagccaccgcacccggccacacucaagaccuuuuacauucucaggggcagaauccccuucaaagagagagagacacacucacacuccacgcaucacacacaucccggcucacccaggcacgcacauucucacacugaccagucaaguuuucuuugucucgcuguaauucacauguucagacacacacauacacaaacacaccagucauccaaaaaguccuacaaacugacaccugagucuaccugucugucucuccuucucagguucacacacacuggucauagggucuuuccugucuccuguacauauguguauauucacacuggucauccaaauagucucagaaacauccagaagugugucucucuuucacuuucacaaacacacguacacacacaaaugcagacacauacacugccauccagucucaaagugguauauauucauuguguagccucuaucccacuuugugagauucuuuuguuucuuucucucaaacucucacauacacucagcucugucucacaaagagucuacauaaccuucaucaucaaagcgacaccaaagucugucccacacacaagggcacgcacgaacaucuucaccggaaucacugugucacauagucuguucauaaggcagucucugcacuuuaucuucuacaaacacagauuaggaucaucuagcuaguccugcucaaguacacacacacacacacacacacacacacacacacacaccacucaccagccucgcagacacacacacuggucacagugucacccagaaucucuuucacacacauaucccaauaccccccaguuucucucucccccgugcccccacucccuaacacucucaugcagaaaugagaaggaugcccaggacagagccacagccaguaucuggagaaucuccaggaaagacccucccuccccaguuccuugguccucacuccuccaugagcagucuuugacccacccugcucuccccuguccacaccccugcccucccccaccccucagcccuccaucugguggguucagacaggcacucaggccucuccucugccucccccaucccccagcucuucccccauccucuccaaaaagcccagaggccaacgcugcaggcuuucagggguugccaugacaacagggccucgucccucgucccccugggggugggcugaggacccggccagccagaccgauaaggggguuccaguuacuguggcaaccguugcaggccugagcucucugcuuccagaaggggaggggggcggagugagugaaugguugccaaagcaaccagggaaccgcaagaacugagaagaggcagcugagcccugucuccccugcccagggcugcugugggcaucgcaaaacauuuaagcaucauucuuccaucccuagagguuguuuuaggggagggagaugaagugcagauuauaaaacaggauggcacucauucucccagcugcccaucauggccugccagcccaugcccgcucccccaggcucaccgugugaucagucagguccacucucuggaccucagcuugccucuuccauuaaauggggccugucucucaggaauguucccauuccugucucaugagugugcccucucucucccuugcucaacaggaaccacagagcggguaugccuaguacagggcacggcagaggccuugaaugcugugcacagcuuuauugccgagaagguccgagaaaucccacaagcgaugaccaagccugagguggucaacauccuucaaccccaaaccacgaugaaccccgacagagccaagcaggucagcuggggcagagacuggguugcuguaaagcuguugacauucacaaagaaacauuccucccacaucacugcuuacugugagguucaaugggacaaagcugauaaaaaucucaucagucaaagaccacaugguagugguuaguauuauuuuuagggagucagcucuaauagaauagaaaggacuccagaacauuuagagugggcuugauucagagagggagugaaggucugggagaauguggcaugauucccuauuguucgauccuuucuuccuaggauucucuaguuccucuucucucuuccaccucaucccauugucucucugaacgaccugccucccacuuccugcuaucaccggaagugaccucagugacaguucagccacauccagaagaguuuacaaauggccucucauccuccuucccuccauaauuaacguauggggguagaggugguguuucauuagcgagagaagaggugggucccucuccuacacagcccucuccaggaaggaauggaagggggaaggcagcgccccuccguugccucaguuacggggaagcaguggcauaggggcguggcagggaguggccaaucgcuucccgggccuguccgguugccaugacgacggcgcucacggggcaggugggcuccccucaaagcugcaggcagcgcuguccggacccggaagugcguaagggaacggaaacgcggggcuggcucccguuuucucucccguccccacuccccuaugcaugcguacuccgugcaauggggcgagaaccccugggcugacgggagggccccuugcgagggcucguuaacgucuaccuagaggcaaagacaggagagagggaguccguaaaaucuggaauucuuggguccugucguugcccugagguggggcagagcacaggccugaguuccccuaagcucauggggaaauggugggcggagaagccuggaggagagcugcaggguggagcgcucccaaaaaagaccgcagggcuuggggcguguagcgcggacgcuguccuuggugcugaagcuccucgcuccccgccagguuucucccgaaucccuucccaccagcagcgcacaaguuauucacaguuuacagggaggcgagggcauugccucuucccuccgccuuggucguggccacaagggacucaggguucaucaggaguuugugaauguugcaaggaaaauggggucagcaccaucugugccugagccuucuacccccucccccuaauccacaggagcucugagacaguggagucgaaagguuauagaaccaggauuuauucccugccuuauuacucgaguguuccaaagacugagggagaucauagcugaaaacucaggcucugggcucuguuguuuaguugaauccuucuccguacaguacuuacguccuaugugaccuugagcaagugacuuugauuucuccaauccucauuuuucucaccuguaaaaugagauucauuaugaugccuccuuaagggugaugguuaguguucguugauguuugaaaagcacauagcuuauguguauaaugcauagaaaguuagccccaaaaauguucucuguuguuauuaugggauuuuugagucaggaaacaggucuacuucuuuucugccuuggacuugcaguguuacucagagccccuuuccuucuguagaccucaguuucucuuuuauuacagugcagcagcugggccaaaccagggauuauaaauuaaauaacuaaaguauugaaaaagguaacaaaagccuugaggguuguugcucucuggagaggguaugccaucuuuaaagggagaagcugccacucaaauccaccgaauuauugcacuuugggaacaugaacauagugcuaccacaucuuccaaauuuuucaaaagaagccauaaauuuuuuagaucaacugacuuuaaaaugcuuuauuauuauuauuauuuaauauauauuagucugaggcagagucacacucugucacccaggcuggagugcagugguaugaucuaggcucacuggagccucgacaucccaggcucaagcgauccucccaccucagcccacugaauagcugggacuacaggugaacacgaccacgccuggcuaauuuuuuuuucuuuucuuuuuuuuuuuuuugaaacggaguuuugcucuuguugcccaggauggaguacaauggccuggucucagcucacugcaaccuacaacucccggguucaagugauucuccugccuuggccucccaaguagcugggauuacaggcaccuguuaccaugccuggcuaauuuuuuguauuuuuaguagagaugggguuucaccauguuggccaggccagucucgaauuccugaccucaggugaucugccuuccuuggccucccaaagugcugggauuacaggcaugagacacugcgcccggccccuggcuaauuuuuguauuuuuuguagagacaggauuucaccauguugcgggcuguucucuaacuccuggacucaagcaauccacccgccucagcuccccaaagugcugggauuacaggcgugagccauugcgccaggccaacucugcuuuuaaaacacuaugaaggucaaaaaaacauguauggcuguaggcugacuggggccugaggaucaccagauugccacuucuggguuauaccaguggcucucaccccuagcugauaucugagucaucuggguagcuuaaaaugcagauucauggguccuguccagaaccacugaaucaauauuucugguaaggcuuaggaaucugagcauaaacucuggcccgggaucagauccugacucuacugcucauuaccugugaaagaacuugugcaaguucuuucuuugugccuccauuucccaaucuagaaaaugggguaauaauaacaccuaucuuaggguugugguggaaccuagauaaguuacucuauuaaacuguuagcuguugaugcugcuuuuguuguuauuguugguggugguaguaguaguauuugcaaauuuccaugggcuugcaaaucacuggggcagauggucucugguccuucuggcucuaaaacuucaacaguucuauggcucugugauuccaagauucuaagcauguauuaucuaagauucuacuguucuaauguccugggauuccaagauucuaugagucugcaucugcagaucuuucuaagaugcuguaguucuacaauucagggucuaucaugaaggcagcugccauuggcuuagcgcuucccaugugccaggcacugggcaucacuuuagucauugaauguuucccauaacaggccgggagcaguggcucaugccuguaauuccaacacuuugaaaggccgagguggguggaucaccugaggucaggaguucgagaccagcguggccaacauggcaaaaccccaucucuacuaaaaauacaaaaaaauuagccgggcaugguggugcacaccuguagucucagcuauucaggaggcugaggcagaagaaucgcuugaaccugggaggcggaggcugcagugagccgagaucgcgccacugcacuccaaccugggugacagagcaagacuguaaaaaaaaaaaaaaaaagaauguuuccaauaauaauauaggguaggugugguuaugcuaauacuggagaugagaaagguaaggcacagagaggugaaggcauuugccuaaggucacacaguuacuaaagaauaaacuaggaggcuggacguaguggcucaugccuguaaucucagcaccuugggaagccgaggugggcggauuacuugaggccaggaguucaagaccagccuggccaacauggugaaaccccaucucuacuaaaaauacaaaaaucagccagacaugguggcaggcgccuguaaucccagcuaccccagcggcugaggcaggagaaucacuugaaccugagaggcagagguugcagugaggcaagaucgcaccacugcacuccagccuggcugacagagcaagacuuugucucaaaaaaaaaaaaaaaaaaacaaccuacgauuuggaccuugcuguguuguagaaacagcaacccugcugacugagugacuccagagagcaggcuuccagugucucacugaauauuugcacaaaucguauggaucgggaauaguaugcccauuuuacagauguggaaaaagaggcucugagaaguaaagggacuuucacaggccaccagcuaggagguggaagagguagaaauuuucuuaaaaccuaacuuuauuuuucccacaugauuaaccccuuguccucaaaccuuuucuuggccaaucuauccuuccuucacugcucuaaaauacugcaucacagacuaaauaccacuccugguugugguugugaacaugcuguuccaucuucuugauuugucaggcuguuuguuuuuccugguguuuuuuuuuuuuuuuuuuugaaauaacagcucuguugagcuauaauucacauacuguaagcuuuacuguuuagaaguguacaguuuaguaguuuuguuguauguucacagagucguacaucaguuaccaucuaauuccagaacauuuucaucaugccaaaaagaaaccuugugcccaugagcagucacucaccauucccccagaucccagucucaacgucuuccagccacuaaucuacuuuuggucucuguggacuugccuauucuggaucuuuuauauaaacagaaucauauaauauauggucuuuugugucuagcuuuuuucacuugauguaauacuuucgagguuuaucuauaguuuagcaugugucaaaacuuuacuccuuuuuauagacaaauaauguuucauuguaugcauagaccacauuuugcuugucuguucaucaguugauagacauuuggguuguuucuccuuuuuagcuaugaugaguaaugcuucugaacauucauguacaagucuuuuuguagauauauauuuccagcucucggguagauaccuaggguggaauuguugggacauaugauaaaucuauguucaacuuuuugaagaacugccagacugguuuccauaauagcuguaccgcagaugugggauuuaaauccagcuccauccauggggauaacaaugacaauaaucauuucuuuuucuuuucuuuucuuuuuucuuuuuuuuuuuuuuuuugagacagagucucccuccgucccccaggcuggagugcaauggcgcaaucucggcucacugcaagcucccccucccggguucacgccauucuccugccucagccucccgaguagcugggacuacaggcacccgccaccacaccuggcuaauuuuuuuguauuuuuaguagagacgggguuucaccguguuagccagaauggucuugaucuccugaccccgugauccgcccaccuuggccucccaaaguucugggauuacaggcaugagcccccacgcccggcugacaauaaucauuucuugagugcuucuauggcuuauauuaauugcacacauacaugaugcccuaugcuuggcacauaguaggugcucagcacaugucacuuauuugaaugaauaggugaugacuucacccacagggccaagcagaaacauagggacugagguguaaucugccaaugguagcaguugugagucaccugaagggcacucacucucaguuccagcuacuuguggucaugcuuggauuucaagcucaccauuacaugcauaagcucaauuaagcuucaucauaguccuaugaggaggucugaauauccuuguuuuacagaugagaaaacugagucucaaagagguuaggucccuugcccagcaucagacagggagccaggauuuaaacccaagcaggugacuccagaguccaaggcagcuuuucagggauuuguaugcacagacugcaaauggguagccuggcuaguacauugcauuguuucuacuacacaaaucuuagacauuuuuaagagauugccaacauuuaaaaacuaggaugcuggccaggugugguggcucaggccuguaaucccaguacuuugggaggcugagacaggcggaucacgaggucaggaguucaaaacgagccuggcuaacauguuaaaaccccaucgcuacuaaaaauacaaaaauuagccgggcgugguggugggugccuguaauccuagcuacucgggaggcugaggcaggagaaucgcuugaaacuggaagacggagguugcagugagcugagauugcgccacugcacucuagccugggcaaaagagcgaaacuccgucucaaaaaaaagaaaaaaaaaaaacuagggugcuucacauuuuacaaaucagcauuuccaacucaucuggaaaauguccaucaggcuuaguuuggcugcccaauugcauaguacucuaccacuccccacccccaccagguaagauacaccugcugccuccacccauucgccuuccugcuugggccugugggcgugucauccuucagucuucauccgucuauuuauucgcucacccuuugcugaguaucuacuguguuccaggcacuuuucuaggcgcugagaacccagcaguaauaauacaggcaaaaaucucuaaccucguggauuugaaauucuuuuacagagaaacacaaaauaaacaaggagauaaguaaaauauagaggauguuagagagugaaaaauacuaugaagaaaaauaaagcggagaagaggaaaagggaauguuagggcauagauuuuuuuccuuuuuauuuugaaaauguuuaaggaauaguccccauacacugcacuuagauucaccaguuguuaacauuugugcaugcaugaacacaugugcaugcauguguguacaugcgcgugcgcacacacaauuuuuguugugauuuuuuuuuuuuuuuuuuuagacggagucuugcucacucaccaggcuggaaugcaguggugcgaugaucucggcucgcugcaaccuccgccucccagguucaagcaauucuccugucucagccucccaaguagcuggaacuacaggcgugugccaccacgccuggcuaauuuuuguauuuuucauagaaaugggguuucaccauguuagccaggauggucucgaucuccugaccucgugauccgcccgccuuggccucccaaagcgcugggauuacaggcgugagccaccgugccuggcugaccucaugacucuuuacuccuaaguacuuuaacauguaucuuccaaggacaaucuccuacauuauuguauuacugucaacacaccuaaaaacaaaaacaaacaaacaaaaaugcuaauucuauacuauugucucauuggaaaguccauauucaaauugcccuaaaauaucuuuuauagcuauagaggauuuuucaaucugagauucagucaacauucgugcuuugcauuugauuguuacaccucauuagucucuuuuacucuagaauaaaugaagauuccuuuuucuuguucacaaggucuggcucgaucacccagacuggaguguagugaugccauuuuggcucacuucaaccuccaccucuugggcucaagccauccucccuucucagacucccaaguagcugggacuacaggcaugcaccaccacacucaguuaauuuuuguacuuuuuguagaaaugagguuuugccauguuguccaggcuguacaacuugugagcucaagcgaucugcccaccucagcgucccaaagugcugggauuacaggcaugagccaccaugccuggccuuuuuuuuuuuuuuuuuuuagauggagucucacucugucauucaggcuggagggcaguggcaugaucucggcucacuugagaaucacuugaacccaggagguggagguugcauugagcugagaugaugccacugcaccauagccugggugacagagcaagacugugucucaaaaaaaaaaaaaauaauaauaauaauaauaaagucagggagaccaacagggaauagagcauggggagcucugucacagcaacacccccuuucuccuacaaauauuuugucauguucacuugacucucugaaauacuauucauauucauauauacacauauagacauaucuacacccguaagacuuuuugacagcuuuauugagauauaauucacauacaacucacccuuuuaagguacacggcucuaggcccaguaugggggcucaugccuguaaucccagcacuuuaggaggccgaggccggaggaucacuugagcccagaaguacaaggcugcagugagcucugaucacaccacugcacuccagccuggguaucagagcaagacccuauuuaaaaaaagagaaacauaaaauacaugauaaauaaaguguacaguucauuggcuuuuauuauagucacauaguuguacaccuauugccacaauccauuuucaaacauuugcacugccuucaaaauaaauccuuuuuuuuuucuuucuuucuuuuuuuagaggcagggucuugcacugucacccaggcuggaguguaguggcaccuguuauagcucacugcagccucaaacuccugggcucaagugaucccuuagacuccugaguagcugagacgacaggugcacaccacugcauccagcuaauuuauuuuuauuuuuuguagagaugagguuucaccaucuugcccagguugaucucuaauuccugggcucaagcagucucuggccucugccucccaaagugcuggauuacaggcauaagccaccgagccuggccuccaaaagaaaucuugaucaucuuagcuaugaccccucgaucucccaccucagcucacccucucccuaaccccaagccaccacaaaucuacuuucugugucuauagauuugccuauucuggacauuucuguaaaaggaaucacacaguauauggucaaccaucaacacuuucuaauuccagaaaguaucuauuacccaaaagaaauccuaugccuguaggcaguuacccccaauccccuuccucccauucccuggcaaccacuaaucuaccuuuuuggcucuguggaucugcauauucuggacauuuauguaaaugaacucagcuguggucuuuuguaacuggcuucuuucacuuagcauaauuuuuucuagauucauccacgcuauagcauguaucaguacuuuguucauucaacguauugccaaguaauauuccauuguauggauauaccauguuuuauuuaucccacgagacuuuuuuaaauaaagaagaaauaaaaggaaggugauuuguuauaaaacaagaugaauuuuauuuuuugcuucuuuguuguuguuuuuguuuuuuguuuuguuuuguuuuugaaacagggucugcucuguugcccaggcuggaguacaguggcacaaucacagcucacugcagccucaaccuccugggcucaagugauccucccaccucagccucccaaguagcugggaccacaggcagaugccaccacaccuggcuauuuuuuguauuuuuacuagagacagguuuucaucaugaugcccaggcuggucuugaacuccugggcucaagugauucacccugccucagcuucccaaagugccgggauuacaggugugagucacugcacccagccaaggugaauuuuaauauguaaauaaauagucaggaccacaauagaaggaauaaugaauuaggcagcugcucacaccuaagcauagcuaagugagacaacuacauauguaaagugauccagaguauaauacuggagacuuaaauaauacaaaugcuguugcuacugacgccagguuuucuaaaaugaugaaaacuuuuagugaagugcagagcaaaacaaagcacaaucugcucuugauuuacugguaguugcguuccuggaaauuucaguagcucuuaaaaccaugcaaacaauacuugguacuuacaugugucaugggguugggcucugagcucagagauuuuuuuuauuuuguuauuuuuauuuacuuauuuauuuugggggggauagggucucacugugucaguuggguucugggcucagagacuuuuuuuuuuuuuugagucaggguuucacuguguugcccagguugaagugcaguggcacaauuacagcucacuguagccuauaccucccaggcucaagugauccucccaccuuagccuccugaguagcugggacuacaggcaugugccaccaggccagcuaauguuuuuaauuuuuuuuuuguagagauggggucaugccauguuacccaggcaggucuacaacuccugggcucaagugauccucccaccuuggccucccgaggugcugggauuacaggcgugagccaccgugcccagacgugggcucagagauuuaaaaacaggcucuucaucagcaugaauguccaacaggacauucaaaaguagucauauagugucugggugcgguggcucacaccuguaaucccagcacuuugggaggcugagguggcuggaucacuugaggccaggaguucgagacuggccuggccaacauggugaaacccugucucuacuaaaaauacaaaaaaauuagcugggcaugguggugggcgccuguaaucccagcuacuagggaggcugagguggcagaaucccuugaacccaggagguggagauugcagugagccgagaucgcaccacuguguaccagccugggugacacagugagacuccgucucaaaaaaaaaaaaaaaaaaguagacauauagggccugggacagcucuuucuugugagggacugacucuccauugugggguacagacaccuaugguccuccccacugacaguccacaucuucccccaguccuugcaacaaccaaaaccaccacccccacaaauuucucagacacccccaggguuuaaggggacaugggaaggauuuuugagagggaggaauuuauguguagaaaugcucucggaggugcaaaaggacaugacugguuuugaaaugucuccacaggaauuaagauugaucagacuugcagaugcuuggacaaaugggugguugaaggauggcugcucugcaacugagaaaggagaggucaccagauucaaaugaccaacuucuucauccuggagaguucccgucccaggaauuagaaggagauugaaaucuagauucuuggguucccgauccauugugugacauccaagacauccacuuacgucugccuucucagacaaaagccuucauguuaucuucauuuuacagacaggacaacuagauuagucugcuagggcugccauaacaaagugccagagacuggguggucuaaacaacagguauuuauaucucaugauucuggaggccagaaguccaagaucaaggugucagcaggguugguuucuucugaggccucucuccuagaccuucuucucccugugucuucacacagucuucccucugugugcaucuguguccuaaucuccucugcuuauaaggacaccagucaguaaauuagggcccgcccuaaugaccccauuuuaccuuaauuaucucuuuaaagacccucucuccaaauauagucaaauucuaaaguacuggaaguuacgccuucaacauaugaauuugaaggggacacagugucagcccauaacaacagagaguucaacgagaagaccaugucuaggggagcacaauggaucaggaacccaagagccuagauuucagcuccgucacuaacuggggaaccuuaggacaaguccuuucaccucuugggccucaagaggcucaucuguaaaguaaggcuuaaugaaggcuuuuccagggcuggaagucagaguacguaacacuagaaggcaugggugggccauugugcaagcuuggagugagauccuggagggccccauuggauuagccauuaagcuuuuagaugcuggacgcagaggaaguacuaagagucccagguacaugggacagggugguugaggggcuacugaggggaccucaaauacuggcuauucauuaaccaaccauuguggauauauuucaauuuuuuuaaaaaaaauuuuaauguuagaggcaagaucucgcuauguugcccaggcuggucucaaacuccugggcucaaguuauccucccaccucagccugucaaagugcugggauuacaggccugagccauugcaccugaccugaaauauuucaauauuuuuaacaaccaguuggaccauacuggugcauaucaaaaggccaugcugggccugauuuuggaugcuggagaggagggguagggaaugaccuggggcgucucagucuccagccaccguaaagacccucccuucgccaguuugguggcucaaaucuguaauuccaacacuuuaggaggcuaaggcaggagaucccuugaggccaagaguucaagaccagccugggcaacaucgcaaggccccaucucuacuaauauagauagacaaaauuauauauauauauauauauauuauuuuauuuuauuuugagacagggucucccucugucacucaggcuggagugcaauuuggcacgagcucagcucacugcauccucccucuccuggguucaagcgauucuccugccucagccuccugaguagcugggauuacaggcaugugccaacacacagcuggcuaauuuuuggauuuuuacuagagacggaguuucaccauguuggccaggcuagucuggaacuccugaccucaaguaaucugccugccucagccccccaaagugcugggauuacaggcgacagccaccgugcccagccuaauuuaauuuaauuuuuuaaaaaaauaaaauuaaagacccucccuuuugcuccccacgcaggccaagcugaucguccccaacagcacggcgggccugaucaucggcaagggaggcgccacggugaaagccgugauggaacagucaggagcaugggugcagcugucccagaagccggagggcaucaaccugcaggagcgcguggugacggucagcggcgagcccgagcaggugcacaaggccgugagcgccaucgugcagaagguacaagaagacccccagagcagcagcugccucaacaucagcuacgccaacguggcaggccccguggccaacuccaaccccaccggcucuccguacgccagccccgcggaugugcugccagccgcggccgcagcgucggccgccgccgccuccggccugcugggccccgccgggcuggcuggcgugggggccuuucccgccgcgcugcccgccuucucaggcaccgaccugcuggccaucagcacggcgcuuaacacgcuggcaaguuacggcuacaacaccaacucccugggccugggccucaacucggccgcagcuuccggcguccuggccgccguggccgccggggccaacccagcagccgccgccgccgccaaccuccuggcauccuacgcgggcgaggccggggccgggccagccggaggggccgccccgccgccgcccccgccucccggagcccugggguccuuugcguuggccgcagccgccaacggcuaccucggggccggggcgggcggcggggcgggcggagggggcggcccgcugguggccgcugcagccgcggccggggcggccgggggcuuccugacggcggagaagcuggcggcugagagugccaaggagcugguggagauugcggugccugagaaccuggugggagccauccuggggaaggggggcaagacguugguggaguaccaggagcugacgggcgcucgcauccagaucuccaagaagggcgaguuccugccaggcacgcggaaccggcgggucaccaucacgggcagccccgcggccacgcaagccgcucaauaccucaucagucagcgggucaccuacgagcagggagugagggccucaaacccccagaaagugggaugaggccuguggugugugcucccacccuuuucucuccucccaucuccuccucuucccucuccuccucccccccaacuccugaccucagcuugguguaguccugcuccucuugggauggggcugggguaggcccgacugcacccuccccuucugguagucauaggcaggauugagugacgguugggaagggggcucagaagcccccuccccagcccggaacugaccccuccuuccucccucccugugcuuggcugggccugacccuuccugucccagggcccaggucugugugauaucuguauauauugcauuuuguugauuuuaauagaaaacaaagcguuauuuucucuuuc

SEQ ID NO: 191724 - RNA, 12582 nt, Homo sapiens
cgagcccugacccaccggcggcugcggcggagccggugagugacccguggcccgacucgguccccacccuccgcgaccuucgcucucccugccgucccccguagccuccguugucuccuugugauacgggacccccguuauuuccagagcuccccuuaauuucuggcaauccccagagcccccacaauccucgcagacccugaucccuaauauuugaucguuccagcucuuccagugauacaggagcucccaccucaccauuauuccuggacaucccucuaagggcccuucucauaucggucuuacagacgccccguugcccccuagagccccuagagcgccuccucugcuccagauuccccccuucuugcugcauccccccuuccgcaucuccuuaucuucaugcaucuaagacccccccgaggcacccccauccucccuccauuuccuauccucccgugcccccauucucuaacuccugcagacaccuccucuccucgcacuuuuccuccuuuccuuccaucccuccagacccucccccaauuucuaucaacucuucagcguggcacuucgcgccgcgcgaaguccgagccaagcgcucagccggugucagcuacucuuaggcgcuuccgacuuacccgggugcccgucgcccccgcccgccccccgcccccacuccugcccccggggacuaaggagcucucggcccggcggucugggagaggcggcggcggggggaccccgaaccccagccagccccgugcgcccuuugcccgcagcgccggcgccccccaugcgccagacggcaggacggcggcgucggggggcgccauggccucggcggcggcgggcgaagcggaggaaaccacccgguugcgcaagccgcgcuucucauucgaagagaaccagauccugauccgcgaggugcgcgcccacuacccgcagcucuacggcgcgcagagccgucgggugagcguggcagagcggcggcgcgugugggacggcaucgccgccaagaucaacgguaucaccagcuggaagcgcacgggccaggaggugcagaagcgcuggaacgacuucaagcgccgcaccaaggagaagcucgcucgcgugccgcacuccacgcagggcgccgggcccgccgcggaggacgcuuucuccgcggaagaggagaccauuuuugccauccuggggccagguguggcggcgccgggggcaggugcuggggcggaggagcccccugcggcccccucuucacagccgccgcccccaagcgccugcccucagcgcuacguguugucggaagaccgccgggaggaccgacgugcaggugagugucuucagaguaggcugugugccugcgcuguugcaagccuuuuacaugucucaucaaagccuugcugcagcccugugagguggaugcuguccuucgccccauuuuauagcuagggaaacugaagcucagaaaaaugaaaugacuugccucaguuccgauagcuaguaacugucaagagccaggaauggaaccagauuuaggaggccugacucagguccacaccuggggucaucagcacaggcaggauuucauuaaaugcagugucgaguagugacucuggaggcaggcugccugggcuccgaucacaacuuugccacugaacugugucaucugaguaaguuacuguacuucaguugcugcaucuguaaaauggagauaaaaauagucugcaccucaaagcguugcugugaagauuaaaugagcuaauauggguaaguugcuuaguucagcaccuccucaacucucauuguuaguucuugauagaaucaucaaugcgguaagaugcauacuauuucacuauuucauaaauaaaagacucagacauguuugguaauuuucccaaggucaugccuuggauagagguguggagagcugacuacagaaacuuccugcuuagccuugauucuggauuauuucuucuacagccguucccugagcaccugccccaugcucgaugagguuggggacacauggaugacugagccagucuaguagggggguggggaagacggugaugacuugagggagcagggcugggguaggggaucccagggacugugggagcccagagaggguuucugauuucggugggggggggggugguccaggagggcuuccuggaggaggggacaucagagcugagaugcaaagaguaagaaugaagaacugggaaaguauuuuugguagagggaacagcauguacaauggcuuggaggcaagaaagcuuggccaguuugggaaacuaaaagaaguugcggggaaaagaguguagaguggaaagguugaagaaaaguaacauuuugagaugaguucagagaggucagcaaaggccagaccauacugggccuuuaggccaaggugaggaguuuggauuuuauccugacugcuaugagaagccacugaagaguuuggagaaggggaggaacaugggcaugaucaaacaagacaguucaagauuaugugauucagagagguucauucacccacccaaggucacacagcaaguaagugacagagucaggacucaagcauaagugugcguccaacccccaguccauggcacuuaaccacugagcaagauugcccagcaauaacaagaguuaauauugaccaggaguuaaugagugugccagaauuagauuacacguggcuuggaagucaaggucaggaauuuggacuuacuauuuuuuuuguuuuguuuuuuguuuugagacggagucuugcucuguugcccaggcuggagugcaguggcgaaaucuuggcuugcugcaaccuccgccuccccagguucaagugauucuccugccucagccuccugaguagcugggauuacaggugccugccaccaugcccagguaauuuuuguauuuuuaguagagaugggauuucaccauguugaccaggcuggucuggaacucccgaccucaggugauccacccaccucggccucccaaagugcugggauuacaggccugagccaccacgcccggccuggacuugcucuugagggcauucaggaggcaugaaaaucuccuaagcaggaaggugacacaaucacaugggacccuuguucucaaaccuugaaucaaaccucaguguuuccaucugugagauggccccauaggaccagagcagagauggccaacuuauuuuuucagaaacuuguuaccacuucauucacucguuuagcaaauauauauugagaaccucauccaaggcagacgcugugguaggugcagggaauaauguagagaaaaagacaaaauccccuucccuuauggaaccgacauucuuuuuuuguuugcuuguuuguuuguuuguuugagacugaguuuugcucuuauugcccaggcuagagugaaauggcgcaaucucggcucaccgcaaccuccgccucccagguucaagcaauucuccugccucauccucccgaguagccgagauuacaggcaugcgccaccaugccuggcuaauuuuguauuuuuaguagagaugggguuucuccauguuggucaggcuggucucgaacucccgaccucaggugaucugcccgccuuggccacccaaagugcugggauuacaggcgugagccaccacacccgaccuggagcugacauucuauguaguuggaggaaacagaccacaaagaagucccaaaacagacuguauaccaggagguggugagaacuaagaggauaaauaagucauauucagaggauggugagucauggaagggggcuauacagacaggguaaucagggagggcuucucugagaaggugaaauucaaguagagaugggaauagaguaggccugacagacaucugggagaagggcacuccugcuagacuagaggaaacagcacgugcaaaagcucugaggcaggaacacgcguagagcauccucgauuagaaucuuacacaggccuggccaggcacgguggcucacgccuguaauacuaguucuuugggaggcugaggcagguggcuuaccugaggucgggaguucgagaccagccugaccaacauggagaaaccccgucucuacuaaaaauacaaaauuagccacgcgugguggcgcaugccuguaaucccagcuacucaggaaggcugaggcaggagaaucgcuugaacccgggaggcagagguugcagugagccaugaucgcgccauugcacuucagccugggcaacaagagcaaaacucagucucaaaaaaaaacaaaaaaaagaaccauacacaggccuggcaugguggcucacgccugaaaucccagcacucuguguaguaccagcucacacacucauuuacaaguagggaaacugagggccagcugcgguggcucaugccuguaaucccagcacuuugggaggccaaggcgggcggaucaccugagguuaggaguucaagaccagucuggccaacauggcgaaaccccgucucuacuaaaaaauacaaaaauuagcuggacgugguggcacacgccuguagucccagguacucaggaggcugaggcuggagaaucacuugaaccugggagguggagguugcagugagucgagauugugccacugcacuccagccugggugacagagcgagacuccgucuuaaaaaaaaaaaaaaagaaaagaaaacaaguagggaaacugagauccaaaguuugcaaauaaauaugauuuuaacuuuuaaacaguggaagccaggcacagaggcaugccuguaaucccagcacuuugggaggcugaggugggaggauugcuugaucccaggagggcaagaccagccugggcaacaaagugagaccccaucucuacaaaauaauccaaaaauuagccaggcaugguggccggcgccuuggucccagcuacacaugagguugaggcaugaggaucccuugaaccugggaggcggagguugcagugagccaugaucgcaccacuacacuccaaccugggcaacacagugagacccuuccucaaaacaaccaaaaacaaacucuugcaggggcacugcugugacuccugugagccuugugggcaugaaggcugggcuacuuucuguuccuuuuuacucaguagacuggaaaagccacguuucugcaauucccacguuccuuauaaggaagauuugucacucacaccccaggcccacagcccuugcccaaggaaugguuaggagcauggacucuggccuggugugguggcucacaccuguaaucccagcacucugggaggccgagguacacggaucccuugaggccaggaguuugagaccagccuggccaauguggugaaaccuugucucuacuaaaaauacaaaaauuagccaggcaugguggcauaugccuauaauuccagcuccucgggaggcugaggcaggagaauugcuugcacugggagguagaaauugcaggaaacugagauuacgccauugcacuccagccugggugauggagugagccucuaucucaaaaaaaaaaaaaggccauggacucuggccaggagcaguggcucacaccgguaaucccagcacuuuagaaggccaaggcgggaggaucauuugaggccaggaguuugagaccagccugggcaauauagcgaggcucccaucucuauaaaacaaaagaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcaguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaagaauggacucuggagucaaccuggguucaaaucccuuuucugcauaucacucuaugacaccucucucugagccucaaaucaccucaucuauaaaauggggcgaugaucaugguagcaccuaccccagagaauggcugggaagacuagguggaaucacuuaagaggggagcuuagcccagggccuggcgggagcagguguccugucacuguccgcucuacucaucugucucccagccucccuaccuccugcugguggcuggcccagggaggcuggacucccagcagucaggguaggagguggcugauuuguuugcuugcuuguuuguuuuugagacagguucuugcugucgcccaagcuggagugcaguggugugaucuugggucacugcaaccucggccuccaggguucaagcgauucuugugccucagccucccaaguagcugggaucacaggcgugcaccaccacacccggcuaauuuuuguauuuugaguagagacaggauuucaccauguuggccaggcuggucucaaacuccugaccucaggugauccgccugccugggccucucaaagugcugggauuaccggcugagccaccgcacccggccuggaugguugguuuuuuguuuuuguuauuuuuuuuuucucuaucuucucucuuucuuuggcuggcuguuuuugagagaagagcagggugaucugauuuggccaaggagcaggaggccagcuuccccgaggaaggaacauccaaaaaaacauccaagcugaugcaagaggcagugugagccuggcccagggaacgacaugugggaagacaggcggaguugggggcaagugcugaggccccauagccgugggaagaggcuggacuuucuccugugggugcugggcacucuggggccugggacccaaucagcgcugagucucuggaagccccaguucuuuucucguuaaagaaaaaauguugugcuggacauuguucuaggcgccggguaaacagaagggagcaauacaaagcccugccugauggagcugacaucaggaggaggagacagacagcagacacagagccauaccgugccagguggagauaagugcugggagaggaaucagguaggguuaggggagaaaaaaagaaggagauggggccagccugagcaacauggcaaaacccugucucuacaaaaacaaaacaaaaauuagccaagcgugguggugcacaccuguagucccagcuauagcuacucaggaggcugaggugagagaaucgcuugagcccaggaggcagagguuguagugagccgagauugcaccacugcacuccagccugggcgacagaaugagaguccgucucaaaaaaaagaaaagaaguaggccugauguguuugaggaucagcaaggaggccaccguggcuacagccagguaacccaagagggagggaugggagcugaggucaggaaggcaaugggggaagaucgugcagggcccuagaggccucaaggacuuugcuuuuacccugagugaggugagagccacaggacgguuugagcauagaaacaauaucugacuuguguuuuuuuaaacaauuauauugcaauauaaggccgggcgcagugcuuacaccuguaaucccagcacuuugggaggcugagguggguggaucacgaggucaagagaucgagaccaucuggccaacauggugaaaccccgucucuacuaaaaauacaaaaauuagcugggcaugguggugugcaccuauagucccagcuacucaggaggcugaggguggagaauuucuugaacccuggaggcagagguugcagugagccgagaucgcaccacugagcuccagccugggcagcugaaugagacuccaucucaaaaaaaaaaaagaaaaaagaaaaaaauguauauauauauggcgauauaauuuccacacuauacaaucaccucaaaguguacgauuugcuugagaccaggaguuugaaaccagccugaggaacauagugagaccucaucucuacaaaaaaauaaaauuauccugguguggggucgcaccucuguggucccagaagcucaggaggcugagaugggaggaucgcuuaagcuggggagauuaaggaugcagugagccgagaucucaccuuugcacuccagccugagcgagagagcaagacugugucucaaaaaaagaugaaaauuaaggccaggcacgguggcucacgccuauaauccuagcacuuugggaggccaaggcagguggaucacaaggucaggagauugagaccauccuggcuaacauggugaaaccccgucucuacuaaaaauacaaaaaaauuagccgggcgugguggagggcaccuguagucccagcugcucgggaggcugaggcaggagaauggugugaacccaggagacagagcuugcagugagccgagaucacaccacugcacuccagccugggcgacagagcgagacuccgucucaaaaaauaaaaaauaaauaaaaauuaaaaauaaaguguacaggaucaggcgcgguggcucaugccuguaaucccagcacuuugggaggcugaggugggcagaucacgaggucaggagaucgagaccauccuggcuaacacagugaaaccccgucucuacuaaaaauacaaaaaauuagccgggcgugguggcgggcgccuguagucccagcuacucaggaggcugaggcaggagaauggcgugaacccaggaggcggagcuugcagugagcugagaucgcgccacugcacuccagccugggcgacagagugagacucccaucucaaaaaaaaaaaaaaaaaguaaaauaaaauacagcguacaauucaauggcuuuuaguauauucagaguuaugcaaccaucaccacgaucaauuuuagaacauuuucaucacuccagaaagaaacccugcaccucuuagccauccccaaucucccaucuucccugucuucccccagcccccggcagccacucaucuacuuucuguuucuauagauuugccuuuuuuuuuuuuuuuuuuuugagacggaguuucgcucuuguugcccaggcuggagugcaaugaugcaaucucagcucacugcaacuucugccucccggguucaagcgauucuccugccucagccuccugaguagcugggauuacaggcaugcaccaccaugcccagcuaacuuuguauuuuucguagagacaggauuucuccauguuggucaggcuggucucaaacucccaacaucaggugauuugcccaccucagaucccaaagugcugggauuacaggcgugagccaccacacccggccuauuuuuauuuuugagacagagucucgcucuguugcccaggcuggagugcaauggcacgaucauggcucacugcaaccuccgccucccggguucaagcgauucuccugucucagccuccccaguagcugggauuacaggcauaugccaccaugcccggcuaauuuuuuguauuuuuaguagagaugggguuucaccauguugaccaggcuggucuugaaguccugaccucaggugauccacccgccucggccucccaaagugcugggauuacaggcaugagccaccacaugcggccaaauuugccuauuuuggacauuucauauaaauggccccugugaucugugguucuuugugacuagcuuguuucccguagccuaacugacuuguauuuugguuggaccccucaggcugcugguggaaaaagauacugucagggacagggguggaagcagagagcccucagggaggcgaugacugcagugguccuggugggagauacuggugguugggccagggugggggaccaggaagaaagaaguuguauguauuuaauuugaaggcagagacgauagcuucuguauguggauggugucuuaguaaacaaaacagugaagguguuuaaccugagcagcugggaggauggagcugcaucagcugagauggggguggcugaggaaggagcagggugggggaggaucagaagcccagcuccgagcaagugaguuuggggcguuuuucgacaauugagaguacacagcuggagacaggagucuggagcccaggcgagagguucaggcugagcccaggaagcugggagccccuguaugcaaacuguucaagcccaugagcaugaaugagaccccaggugaguacagacugaggaaaccuaccaggcugggggcugaacuggaaaauccugcuguccugguuggagagagucucagggaaguguccaccagugcccagacaccccagcucucucccagaccucucucucacuuccucaggauccagcaguguggugcaguauccauauaguucagaaccucgucaaauguuggcccuuguccgagcgcaguggcucacaccuguaaucccagaacuuugggaggccgagguggguggauugcuugaggucaggaguuugagaccaaccuggccaacauggcaaaaccccaucucuacuaaaaauacaaaaauuuagccaggcgggguggcgccugccuguaaucccagcuacuuaggaggcugaggcaggauaaucguuugaagccggaagacagagguugcagugagccgagaucacgccacugcacuccagccuaggcuacaaagugagacuuugucucaaaaaaaauuaaaaaaauaaaaaaacuguuggcucuuacugugagugagaugggagcugccuggccuagcaagggacuuccaggaccuguuuccacuaaagcuggcaggacuuuuucuccuccggguacaaagacuggccugccauggagcuucucuuccaaggcaugaucugacuuagguuuuaaaaggaucauucuggggccaggcgcgguggcucacaccuggaaucccagcacuuugggaggccaaggcgggcggaucgccugaggucaggaguccgagaccagccuggccaacauggugaaacccugucucuuauuaaaaauagaaaaaguagccgggugugguggcggucaccugaaaucccagcuacucgggaggcugaggcaggauaaucgcuugaacccaggagguggaaggugcagugagccaagauugcaccacugcacuacagccugggugacagaccaagacugucuuggggcuggggggcgggggugagaaggauaguucuggguucggguaggggggaggugagggaaggagugggaaaggggaaaucaaggcagcaucgagggucgcucaccccuuaccuguauuucucucucuacagauacaucagcccacagcaaggcgggcuccagcagcccggagccaugggcccggcccuccugcacuccccaggaagggggcugcccacggcccaaggagcgugagucaccacccccuucggcccugcagccgguccagcugccucgccuggccuugucuccaccacccccagccccuccacugccacccccaccgccacuggcccaaguggcacccucacccccuagccccccacccccuccucggccuccacccacgcucucggccucagaccccucccuggacuuccugcgggcccagcaggagacugccaacgccauccgggagcuggccggcacccuucgacagggacuggccaaacugagcgaggcccucagcgcucugcugccccuucugccaggaaccccaguugacucccugccuccaccucugcccccacccccacccccaccgccaccucccaggccuguccugcccccaccggcccccaagguggagaucaccccagagcccguguccgugguggcugcugugguggacggggcagugguggcagccaggggagugaucauugccccaaggagcgaggagggggcaccccggccccccccagccccgcucccuccgcacgacucccccccacacaagcggagaaaagguuucccuacacggaaaaggcgcggccgauggaaaucuccgugaaaucuacuaucuaugauccugccugcaaccccucuccccagcuuggcgcagucgaggggggcgaugcucucugcccaucccagcugcacccuagcucccugcuccagggaugugagcacccacucccugugcuaguuagugccugauucucuggggggggccucaguaaugggcccccccaaccccuuucucugguacagugcugucugccuggcugccucccuuaacccugacuucuaagccaucaauuucauguuauuuauuauugcccuaugugggguggggagggaaccucucgggucugcacaucuccccuucccuaacaguuccuguucuugacuugaagagaauugacccgugggggacuccccaccuccccaacccagacuuuggagcgggugggaguuguaagacaaaucaaaauacggaugacaaagaggauauagccguguauaccccagggagaggaggcgccgaguucugaugggagagguacagguuggguucucugccuaccauugcugucucugacuuccagagcucaacccccuccuuucucccaguggugacaagauaucaauaaacuuauuuuuaauacaa

SEQ ID NO: 191725 - RNA, 57098 nt, Homo sapiens
acugacgcacgcauggccacgagagggcgggggaggagugaagagguugaggcgccccgcccagucagcaagguugcgcgugcccugugagaccgccaagaugguggugggcgcguucccuauggcgaagcugcuauacuugggcauccggcaggucagcaagccgcuugccaaccguauuaaggaggccgcccgccgaagcgaguucuucaagaccuauaucugccucccgccggcucaacgugagucugacccgaauucccuccaaccuuuuuccuuucuccaaccccugucaggugguugcuuaggggauggacuucugucuacgaccaaucacagcccgaaccggcaaaguccaguggccaauagugggggguuucugauagaggggcguacggguggcccaguagugagggcggggcggggcguaaggggcgggucaaggagccaccacgcgaguaggaaaugccagccgauaaaggaagagagcgcuuggagacugaugcccuguuaaaccaauagugugagagaugggagaaauuuggacggggcuuuccaggauagaggagcuaggggaggggcugaggagaaaccggacgggguccuuugcccggcuguccuugggcaacuucauuucaaaagcggcaccgugugccucaguuuccccacugaucuaggaggugcuuguauauccuccguuuaggacgucgacgugccucaguuuuacuguagucaauaagucuggauuaggggcaugguucgggggugaagucuggguucuggagacauggccugggaauccggaaaaggacuuugagccagagaggacauucaucuguguacucauuaaugcgcucauacgccguccuuucauucgguugacagacuaugcggccuuuuugcucagcacugggagauauacuccugauccaucacugucaacccagaguggucgggaaagugggagccccggagcucagaggaacuggcugacccagggaccugaggccagcagggcugccuagagggggccgcccgagcucagaucuaaagggcauaguaagguccggcgcgguggcucacaccuguaauaccagcacuuugggaggccgaggcgggcggaucacaugaggccaggaguucgagaccagccuggccaacauagugaaacccggucuguacuaaaaauacaaaaauuagcugggugugguggcgcacaccuguaaucccagcuacuugggaggcugaggcaggggaaucgcuugaaccugguagguggaggcugcagugagccuagauugugccauugcacuccagccugggcgacacagcaagacugucucaaaaaauaauaaauagaaauaaagggcuuaguaaacacccaaaauauaaacuacuuuaaaaaggugaucuugccgggcgcgguggcucacgccuguaaucccagcacuuugggaggccgaggugggcagaucacgaggucagaagauggagaccauccuggcuaacacggugaaaccccaucucuacuaaaaauacaaaaaaauuagccgggcgugguggcugggcgccuguggucccagcuacucaggaggcugaggcaggagaauggcgugaacccggaaggcggagcuugcagugagccgagaucguaacacuguacuccagccugggugacggagcaagacuccgucuccaaaaaaaaaaaaggugaucuguguugugcuacgugggacauaaaauaagggaauuuagcaucauuggcugggucagagaaccacugaaaccgccuuugcaaaauuaugacugacacagcgaaagagaucuaaguuaacuuacuccaucuugcuucuaaccuccaagcuauccuuguucauuccugggcaaaggcugaacuaacuuugggagagauuuaguuuguaguuuauaguuuaaacaaacaugguaacagcccuuucccaaagcagaccuccuucuugucuggcgacuggauugccuuuguaggacuaacauuagccacaagauuagaaauuaugguuuaggagucaugcagcuggaggguacaagauucugacccucccuaaacugcuccuaagaucagugcuugagauauuucacagacccugcacuugauggaucagcuggccuuacccagaucaauaaacuggcccaucugaucuuguggccccccaacccaggaacugacugagcgcaagaagacagcuccgacucccugugauuucaucucugaccaaucagcacuccuggcucacuggcuuccccucacccaucaaguuauccuuaaaaacucugcuccaccgagaucgcaccacuacacuccagccugggcgacagaccgagacuccgucucaaaacaaaaacaaaaaacaaaaaaacucugcuccagcugggcccauuggcucgcaucuguaauccuagcacuuuggaaggcugagggggguggagcaccugaggucaggaguuugcaaccagccuggccagcauggucaaaccccgucucuacuaaaaauacaaaaguuaggcgggcuugguggcgggcgccuauaaucccagcuacucgggaggcuggagcaugagaaucgcuugaacccggggauggagguugcagugagccaagaucgcgucacuucauuccagcccaggcgaaagagugaaaauccaucucaaaaaaaaaaaauaaaauaaaauaaaaauaaaaucucccugaaugcucagggagacugauuugaguaaugguaagacuccuggcuggggcgcgguggcucacgucuguaauuccagcacuuugggaggccgagguggguggaucaugaggucaggaguucgagaccagccugaccaacauggugaaaacccgugucuacugaaaauacaaaaauuagcugggugugguggcgcacaucuguaaucucaucuacucaggaggcugaggcaggagaauugcuugaaccuaggagguagagguugcagugauccgagauugcaccacugcccuccagucugggcaacagagcaagacugucucaaucucaaacaaacaaacaaaacacccucccgcacagccaacucugcgugaauuacucuuugucuugcaguucuccucucuugaugaaucagcucugucuaggcagcgggcaaggugaacuccuugggcgguuacacaccauucaucccuccauccauucauuauuuccuuuagcugguauuuugugagccucugcccugugccaggccuugugcuggcaaugcuggcgaaacagcagggaccaaaccagcaccaaucugugcccucaaggaauuccuaguccugcgggggacagacguaucccccaacagugggcagagcugagaugggggagcccacugggcaccugacauggcaugggguucagggagggcuuccuggcagaggagacaucugaauugggaccugaagggugaggacaacaccaggacaaggcguaaggaaagcacuggggcagagggaggagcacacacaaagcccacaugauuaagggagugcacuuuuuuucccccucuguaaguuuggaugcuuaaaguuugcuuuccagggcccggaauucuugguuguucgguguuugguggggucuuuguuggggcugcagcucuuagaaugggaaaguauuagauuucacaguuaccaaagugcuuuccuguuagccaucucauuugacccccacaacuguuuuguccccauguccggaaagaggaaugacuuccucugguuuauagaagggaaaauggagguguugagggcagcaguuaauugcucaggucauacgcagagauuugugccagaggcgaaacuuuggacacugaauuccuagacccaguuuguuuccugucucugccugucuuccaaacacugugacauucuuagcguugugguuuagaaaauggcuucuggagcugggcgcaguggcucaugccuguaaucccagcacuuuggaaggcggagguggguggaucaugaggucaggaguucaagaccagccuggccaacauggugaaacccugucucuacucaaaauacaaaauuaggcaggugugguggcgcacaccuguagucccagcuacuugggaggcugaggcaggagaauugcuugaaccugggaggcagagguugcagugagccaagaucacaccacugcacuccagcuugggcgacagagcgagacucugucucaauaaauaaauaaauaaauaaauaaauaaauaaauaggcuucugugcugggcgcggugccucccaccuauaaucccagcacuuugggaggccgaggcaggcagaucaccugaggucgggaauuagagaccagccucaccaacauggagaaaccccgucucuacuaaaaauacaaaauuagccagacgugguggcgcaugccuguaaucccagcuacucgggaggcugaggcaggagaaucgcuugaacccaggagguggagguugcagugagccgagaucacgccauugcacuccagccugggcaacaagagugaaacucugucucaaaaaaaaaaaaaaaaaggccgggugcaguggcucgcgccuguaaucccaacacuuugggaggccaaggugggcagaucacgaagucaaauuucaagaccugccugaccaacauggugaaaccccuucucuacuaaaaauacaaaaauuagcugggcgugguggcacgcgccuguaaucccagcuacucgggaggcugaggcagaagaaucacuugaacaugggaggcggagguugcagugagccgagaucgugccacuacacuccagccugggugacagagcgagacuccauaucaaaaaaaaaaaaagaaaaaaaaaaagaaagaaaauggcuucuggagucagacugacauagguuugaaucccuacccagacuggugacuuuggguacgucauuuagccccucuuagcuucaauuuccgauucuguacauuggguauuauguaauggucacauuaacugggcuuguacuuugugccacggcuugucugcagcaccuuccagccucuggcacuggguccucaccaguuaugaugagguagauacuauuauuauuauuauuauuauuuuguguauauacuauguaugcauuaugcuguaaauaauauuuauuguguuguggugaggauuaaguaaauggauauaaaauguuaagucagugccuggcauagggucauggcugucacguagauguuauagauacaacaggcaggaaaaagcaaaacaucuugcccucagguaccuuacauucuuguggaggaagccagacaauaaaugaaauaaauaguuggcugggcccaguggcucaugccuguaaucccagcacuuugggaggcugaggcuggugcaucacuugaggucaggaguuugagaccagccugggcaacauggugaaaccccaucucuacuaaaaauacaaaaauuagccaggugugguggcaggcaccuguaaucccaguuacuuaggaggcuuaggcaggagaaucacuugaacccaagaggcagagguugcagugagccgagauugcaccacugcacuccagccugggugacagagugagauuccaucucaaaaaauaguuaaaagaugaaguauauuagauagcaauaauugcucuaggaaaaaaaucaggguuguagaacaaggaguauuuaaaggaaggcuauaagccuagauaggauugucagggagaacucacugaaaauaugccaaggagggagggaacgagcagcauugccaucugggggaagaaacguuccagcccagaggaucccgcaugcacacaggaccugaggcaugagcgugccuggcacacaggacagaggaaacugaugacgggaaagggggacaguuuguauggggccugugggucacugcaaaugccuuggcuuuacucugaguggaacaggacuuacuggaggguucugugcagcagaaggacaauaucagaguucuguuuuauuuuauuuuauuuuauuuuuugagacagagucgcacuccgacacccaggcuggagugcaauggugugaucuuggcucaccacaacuuccgccucccggguucaagugauucuccugccucagccucccgaguagcugggauuacaggcaugcgccaccacgcccggcuaauuuuguauuuuaaguagagaugggguuucuccauguugaucaggcuggucucuaacucccaacgucaggagaucugcccgccuuggccucccaaagugcugggauuacaggcaugagccaccacgccuggcccgggagcagaguuuuuaaggauaacuuggugggugaggggaagccagugagccaggagugcugauuggucagagaugaaaucauaggaauucagagaugucuugugcucaguuaguuccuggguggcggugggggagggggagggcgggcacaagaucagaugagccaauuuuuugaucuggguggggccagcugauccaucaagugcagagucugcagaauaucucaagcacugaucuuaggagcaguuuagggagggucagaaucuuguauccuccagcugcaugacuccuaaaccauaauuucuaaucuuguggcuaauguuaguccuacaaaggcaaucuagucaccaggcaagaaggaggucugcuuugggaaagggcuguuaccauguuuguuuaaacuauaaacuaaguuucucccaaaguuaguucagccuucacucaggaaugaacaaggacagcuuggagguuggaaguaagauggagucagucaaguuagaucucuuuugcugugucagucauaauuuugcaaaggcaguuucaggauuacaggcgugagccaccacgccuggccucaaaaucuaaaauauuuacucucugccccuuuacaggaagaguuuucugacccugcucuagaauaguaucccugcccuuguuuuuugacauugacauuggagccaguccucugauugauagugugucccgaugucuggagucuccugauugcuuccccgauuggauucauguugaacauguuuggcgggaacaccacagacucgaggugccuccuaaggacaucccuucaggggacuccugaggucuauuuguucugucauuugugauggugauuuggaucgcuugguuaagguguaaccaugucaagaaccuuuccuuuuccucuuaguaaugaauaaccaguagauuuguuuacaagguagagccagcaggauuucccauggauugggugugagacagccgacuggaggaggggcagguuggacagaaagaccuggagcucaguuagggacaggucgaguuggagaugcuaccagauauugcaauguacuggcuucuuacauuuacaccuuuuaauuacaucauuagugucuucacacugcugauugcccuuugcuguggcccccagccauggugauuggaauuucccagggugcacuggcggcccugcuuucucucaggucaggcguccugagcugaccagcaaauccaguaucuguaccuuuggcugagauacuuuugacucagcaggcugcgcccagcugucucacaggagaggcuggagcaguagcuguggcugccugaggaaagaacaguacaugcuagaagcauaaaucaucgaugaugcacccuguuggggaggcaaagaucuuuuuaaacacagaauuccuuuguuuaaauuauuuuaacccaaaaguaaaggagguuggugauguuaggcagguugaggccaugccugcaaagugcacuuuuggugcucccagggaggcugugagauaucucugggcaguaggaaaauuccagcucaucuguguuuauuccuuuggcgcgcacugguccuuuuucugguuuaucacacacaguaggcaguagagugacuggucccccaaagauguccacauccuuaucccaagaaccuguugaauauguuaccaugcacagcaaaggugacuuugcaaaugugaucaaaugaaggauuuggggauggggagaugauccugaauuaugcaggucaggucagugugaucacagggguccuuauaagggaaagagggaggcaagagagggaaugauuugagggaugcugccccgcuggccuugaagauggaggaagggaggcaugagccaaggaaugcgggcagccucuggaagcuggaaaagccgaggagauggauucuccacuggagacuucagaaaggaacacagcccugcggacaccuugagauuagccuagugaaagccauuuuggacuuuuuuuuuuggggggggggggauggaguuucauucuuguugcccagauugcagugcaguggcacgaucucaacucacugcaaucucugccuccuggguucaagcgauucuccugccucaguccccugaguagcacccaccaccacaccuggcacccaccaccacaccuggcuaauuuuuuguauuuuuaguagagauaggguuucaccauguuggcuaggcuggucuugaacuccugaccucaggugauccaccugccuuggccucccaaagugcugggauuacaggcgugagccacugcgcccaguuuuuuguuuuguuuuguuuuguuuuuugagagggggucucacauggucgcccaggcuggauuacaguggcaugaucucagcucccugcaaccucugcaucccgguuucaagcgauucuccugccuuggccuccugaauagcugggauuacaggcgcaugcccuaauuuuuguauuaucaguagagacggggguuucaccauguuggccagcuggucuucaacuccugaccucaggugauccacccgccuuggccucccagagugcugggauuacaggcgugagccaccacaacuggcccccauuucagacuucugacuucuggaacuguaaaauaauaaauuuagggcaggugcggugguucaugccuguuaucccagcacuuuagaaggucgaggcaggaggaucacuugaacccagggguucaagaccagccugggcaacaaagcgagaccuugucccuacuaaaaauaaaaaacaauuaguggggcauggugaugcaugccuauaguuuuagccacucaggaggcugcggcaggauugcuugagcccaggagaaugaggcugcagugagcugugaccgcaccccugcacuccagccugggugacagagcaagacccugucucaaauaauaauaauaauuugugcuguuuuaagccacugcauuugugguaguuuguuauaguggccgugggaaacagauacaccaugaucauucauucagguugcugaggucauuuuuucagaagugcucagcucuguggccauucuuaugaauuuaggccauggacuugguuucaguuuucuuuuucuacauagccaucugauccaaagcuugguggcuuaccguaguaacucuuagccaggugcaguggcucaugccuguaaucucagcacuuugggagguugagguggguggaucacuucaggccaggaguucgcgacuagccugggcaacauggcaaaacccuuucuuuacuaaaaauacaaaaauuuagcggguaccuguggucccagcuucucaggaggcugaggcaggagaaucgcuugaaccugagagagguggaggcugcagugaaccgagaucgugccacagcacuccagccugggcaacagagcaagacccugucucaaaaaggcaaacaaacaaaaaacccagucacucuuaguuucuguuaccuuuguggcuugccugggcucagccggacaguucuuuugcugguugcugcuuggcaggcucucauccaggugcagguggagguggcugggcuggagucaucuggaacuggcacugggacuggggaguugguucccucucagcguagccucugggccucucuucuccacguggucuuuccugcaggguagcugaauaucucacauggcugcucaggacuccccaacagccagauuuucaugagggaagaagcagaagcugcagguuauuuaagggcaaggccuggaaucuuccagcgucauuuccaccacacuauuggucaaagcagcuccaggcacagaccacagugggugugggaaagaacugcacagggugugauacgaaggggucccugauggcacagucugccacagaguaggcacucuuggcuucggaucuuggcacugcugcuuauuagccaugugacuuugagcaggcagcuugaccucuaugagccuccauuuccauauuuaucaaaugggauacuaauagaacuuaucucccaggauucuugugaggaugcagcaggauaguggauaggcgagcccuggcccgggacaugcccaucugguugcuacuacaggcuacaggggguauacauggaauccguuuuuuuuuucuuuuuuuuuuuuuuuuuugagacagagucuugcucugucgcccaggcuggagugcaguggcacgauuuuggcucauugcaagcuccgccucccggguucacgccauucuccugccucucagccucccgaguagcugggacuacaggcgcccgccaccacgcccagcuaauauuuuuuguauuuuuaguagagacgggguuucaccauguuagccaggauggucucgaucuccugaccucgugauccgcccgccucagccucccaaagugcugggauuacaggcgugagccacugcgcccagcccccuuuguuuuuuuugagauggagucuaacuuuguugcccaggcuuuugccuuccugaguagcugggauuacaggcgccugccaccacgcccagcuaauuuuuguauuuuuaguagagacgggguuucaccauguuggucaggcuggucuccaacuccugaccucaagugauccgcccgcuguggccucccaaaguguugggauuacaggcgugagccaccgcacccagccggaaucccuucuugucauuacugcccaagugccaaaaccucugcuucuagauaaagacuucgugcacucagauccuugcccugcuguuuacgugguguguguccugcaugagucccucugccuuucuguaccgaauagcacuuaaccucauaguucugauguucccucagcaccauucaguaaacaguguuuacuguuuacuguuugcagcgcggccucgaaccaggcugccugcuuaucuguccccgcucugccacuuucugugugaccccagggagaguuauuuaaccucucugggccucaguuuuaugcuuguaauuggguuguuauguggauauuaagauccauaaaacauagaacuguaccuggcccucaaguacucuguacauguuuauuuacuuauuuauucauuuuauuuguuuauuuuuugagacagaguuucgcucuuguugcccaggccggagugcaguggcgugaucucagcucaccgcaaccuccaccuccuggguucaagugauucuccugucucagccucccgaguagcugagauuacaggcaugugccaccaugcccagcuaauuuuuuguauuuuuagugagacgugugaauauaagaugagauuuggguggggacacagccacaccguaucacuuggccugggggauggggacuaugcugugggggaauugggcaggcaacagccuuguguagaaccaggucucuggcaagguaccuggugaacuagaaaaaaaccuccgucugaaggcacacaagcuuugcccuagguagagacugauacauucuccucugagaauuuguagccacugacugucccucaugugggcuuggggccucuuugaaagguccuggaaguugcaggcugagaaugaaccccuagggguaccuaauuguaucuaagcaccuggcaagggcaaacauaaacucuuccugccugugcucucucugcccaggccuuggagaaauccuucagauagaguuccagcacauacaagcucacaguaaaaaaaaaauauauauagauagauauauaucgagauauauaucuauauauauaguaugauauauauaucuauauauaguaugauauauauagauauauaucgagauauauaucuauauauauaguaugauauauagguauauauugagauauaucauauauauaguaugauauauauagauauauaucucauauagauauauaugauauauaucgauauauauauuuauauacauauaucaugauauauaugauauauaucaauauauauauuuauauacauauaucaugauauauauccauauaugauauauauaucauaugauauauauaucucauaucucauauaugauauauaucucauauaucucgauauauaugauuauuauaugauauaugauauauaucauauauugauauacauauaucaugauauauaucgauauauaucgauaaucucauauguugauauauaugagauauauaucgauauauaucucauauaugucgauauauaugagauauauaucgauauauaucucauauaugucgauauauaugagauauauaucgauauauauacuauauauauuuuuauuuuuuauuuauaugagauauauaaucauauauaucgauauauaugagagauauauauauaucucauauauauaucagaccaaccugaccaacauggagaaaccccgucucuacuaaaaauacaaaauauauauauauaucaauauauauugauauauauauauacaccacaugaaaaaagcagccaccaugagcgagagccagcagaaaaacauggcaggucacagccugcaaacguggaauuaucagauguggauauaaaauaccuaagcuuaucuguuaagaggauaaaagagaaggauauuaaaacacaaguaaaaugaaaaauugccaggaagcuggaaaaagaauuaaacaaaacuucuagaaaggacagcuacaacaguugguguucagcucucaauagaagggcuaacuaaccaccagguuaaacacaacugccaagaggauuggggagcugaaaggugcacaauauggaggaaaacuagugagcuuucuggggcacuuccaguagaugcccaggagugcuaccugcagguccugauuugguggacguagggaagggguggacguguuuauuuuuagcagucucuagaguacauucucacacgcaccaguguuugaaaaucacuuugcuggaguuuauuuauaaucaccagagcgucacaucaguuauauuauauggcagccaggcugcugcuggugaccuccaaacauuuauuauuauguucuccuaucaaggaaacacuucugagguuccuucccuagcauauauguaugcacguguguacacauauguaaaauuauuuagcagucagccaggcacgguggcucaugccuguaaucccagcacuuugcgaguccaaggcggguggauccccugaggcggggaguucaagaccaaccugaacaacauggagaaaccccgucucuacuaaaaaaauacaaaaaauuagcugggcaugguggcgcaugccuguaaucucagcuacuugggagacugaggcaagaguaucgcuugaacccgggagguggagguugcggugugccaagaucgcaccauugcacuccagccugggcgacagagcaagacccugucucaaaaaaauaaaauaaaauaaguaaauaaauaaauaaaugaaaguauuuagcagucauguauagcgcuaacauauaauaguaugguuauauuauaugcauuuaaaaacauacacaaaaauuagagggaugaaacgaacauaaaaauuuuuaaaauaaacuuauuuauucaugccccccccccccaaauaguuuugcugucaccgaaaacauuuuccuaugcagacauuauuaaguaaauuuggaaacucuuggugaaacccucugugagagucuggcuuugaauuuuuuuuuuuuuuuuugagacagagucucacucugucgcccaggcuggagaguaguggcacaaucucggcucgcuacaaccuccaccucccagguucaagugauuauccugccucagccucccgagcagcugggauuacaggcuucugccaccacacccggcuaauuuuguuuuguuuuuguuuuuuuccccaagauggagucucacucugucgcccaggcuguagugcagugguucaaucucagcucgcugcagccuccaccucccagguucaagcaauucuccugccucagccucccaaguagcugggauuacaggggugugccauuaugcccagcuaauuuuuuuuuguauuauuauuggagauaggguuucaccauauuggccaggcuggucucgaacuccugaccucaggugaucugcccaccucagucucccaaagugcugggauuacaggcaugagccaccgcucccagccagcuuugacauucuuuguauguggcugucacagcuggcaaagaccuaacuaaggcacauagucucagauggaagaagugugucauuggcugcguuuaaucucgcugcuccuuuuuuagucccacccuucauuaugcagaggcauuugcuggaauuugcucauguacucauggcuaaaucuucuggccgauuucugaacagggaucuuuuucagaagccccuguguagagggcuggcugauuugcaaccugagugcaucccagggaaucuacuugcgcuggcugcaagcaauaugccaaguggacaggagagggcgcccgugucagccuggggauggcgccugccugagaaagcaccagaggccaucucggucauugaccccgguguaucucuguauuaguuugugcucaucuguaauuaauugaaaacccagccaguaaaugucaaucaaaccuuaaaucaaaaggguguuuuuugcuggcuuuucaguaagcccugaggaaggccuguucuugguugguuugguggcucaguggugucauugggaaccugaggacuccaucucugcuguguuggugcucaggcaguccucauggccucaguagggcugcugcggcuccaggcauugugccuuuauguuucauaagggaggaagucuaugcguguguguauggaggggcggguggucagguaagugaggguaacgcuucaaggaggaaaauccuuuuccagaagcccccaggaaacuccccucacugccagcuuaccacaaccgggucaccucccaccccuugguguaugggagguugcaguggugaguaucggcuucuaaacucuaauggagguggggaggauggaauuacuaagacaguagagaauaauauaaaguagcacugguaaucagacgcacugaaguuguucugaaaucuuuuuuguuuauuuugagacagagucuugcucugucgcccaggcuggagugcaguggcgcgaucucggcucacuacaaccucugccuccuggguucaagugauucuucugcuucagccuccugaauagcugugacuacaggugcccgccaccacgcccagcuaauuuuuguauuuuuaguagagacgguguuucacuauguuggccagggaggucuugaacuccugaccucaaguaaucugucugccuuggccuuccaaagugcugggauuacaggcgugagccacagcgcucggcccuagccucucuguuaauugcguccucugagccuuagaaaccccugaguauccucuauaccaaguugaguuggucucuccaggccugggaggagaguagagguggggaucauuuucugggguguggcuaugcuucaguccauuaggaggcugaguaauucauucacucaacaaaucuuuauuuagugccugcugugugccaggaacuguucuaagaggcaugacucaguagucaacagaacaaagauccuugcucucauggggcacauuugaggguauuaguuaccugccuagugaccccagggcacagaggggugccucaucccggauuuccugccaaauucccaggcugaauccagugguccacccugcgucacauccccaucccagcaccgucucuguggcccagggaaagcagugcccuaauuggccaggcucaggagugggguuaccuccuccugaaucccuugaaccaaaaguuggggagauaggaucccccaggaugcugggcagauggaaccagucaugccccucugguaacuggagcauuguguguuacugcagucucggguugcuguaauggaaagaucaagccaggucugugggaggaagcacugccuauugcggccugcacaauucuguuaauacuuggagcacuguuagggcaagcuuaaaacuggcuggauugggcgggggcacaguggcucacaccuguaauccuagcaauuugggaggccgaggugggcggaucaccugaggucaggaguucgagaccagccuggccaacauggugaaaccccaucucuacuaaaaauacaaaaauuagccagaugugguggggcaugccuguaaucccagcuacucgggaggcugaggcaggaggguggcuugaaaccaggaggcagagguugcagugagccgagauugugucacugcucuccagccuagguggcagagcaagacucugucucaaaaaauaaauaaauaacaaaauaaauaaauaaauugacuggauugccaggugggguggccaacacccguaauaccagcauuuugggaggcuaaaacuggagaaucacuugaccuuuggaggcucagguuguagugagcugagaucguaccagugcacuccagcuugugugauagagugagacugugucucaaaauaacaguaauaaucauugucaucaucaucaucaucugacuggaucacaucuggggaagugcaaccagggcagagacuggcuugaagcuacguuuacccugaauaauaauuuauugacugauaauaacagcuuuuauuuaauaugcuuuccauuaucucagcaaaugaucuuaaccaccuuauuuagggaguuuaugaccauccugguuuuaugagugaggaaaucucucaaagcgagagaaacagguucccugaggcaguacaggauaagaagucauaucccacuggcucccaaacuccuccucuuauguuuaauuauuggcacuugauuuuuuugguauauucuuuguugagauauaguaucuguacaaugcaagguacagaucuaaaggcuacaguucaaugaguauugguacaugcauauacccauguaacuaguacccaagauauaaaacaucgucauuacucuagaaaggucccuccuccccugcucugucuccuuaucugacuucucuccuuguugauuaguucugcuuguuguucaacuugauauaaauggaaucauacacuaugaaauuuauguuuagcuuuuguucauuugauacuucugagauacuucuugcugaauguaucaauaguucauuucuucuucuucuuuuuuuuuuuuuuuuuuugacacagggucucccccugucacccaggcuggagggcaguggcacaaacacggcucacugcagccucaaccuccugggaucaagcgauccuccugccucagccuccugaguagcugggaccacaggcacaugccaccaugcccggcuaauuuauuuuauuuuuuguagagauggaucucacuaaguugccgauaguggucuugaacucaugggcccaggugauccucaccgcuuggccucccaaagugcugggguacaagugugagccaccaugccugucuaguuuauuuuguuauuuuguuuauuacucuuaauaaaaguguauucuuuucuuuuauuacaguauaugaauaugccaugcuuuguuuaauaacuguccuagugaugggcauuuggguuguuuccaaguuauugcaaguaaaggugcuaugaacauuuguguacaagccuuuauauggauguuuucauuucucuugguagaaaugaaauucucccaguaauuaucuaggaguaaaauuucuggguuauaugguaagguuauauuuaauuuuauaagcagcuggcugagccaggugcgguggcucacgccuguaaucccagcacuuugggaggcuaaggcgggcggaucacaaggucaggagauugagaccagccuggccaacauggugaaacccugucucuacuaaaaauacaaaaaaaaaauuagcugggcaugguggcacgugccuguagucccagcuauuugggaagcugaggcaggagaaucacucgaaccuaggaggcagagguugcagugagucgagaucauccacugcacuccagccugggcgacagagcgagacuccgucucaaaaaaaaaaaaaagagaaaaaucaggcugguggaucaucuaagggagugguggcucacuccuguaaucccagcucauugggacuccaaggcggguauuaucaucugaggucaggaguuagagaccagccuggccaacauggcagagcccuaacucuacuaaaaauacaaaaauuagcagggcacaguggucugcgccuguaaucccagauacucgggaggcugaggcaggagaaucacuugaacccuggcagcagagguugcagugagcugagauugcgccuuugcacuccagccugggcgacagagcaagacuccaucucaaaaaacaauaauaauaauaaaaaaaagaauauuaaaccaaucuuauauuccugcagaaaucccacuugauuaugcuauauuaucuuuuuuauauauugcuggcuuucguuugcuaauauuuuccuaaagauuucaucuguggucaucagugacauauucuauaauuuuauuuucuuguaugucuuugucagauuugauugauugauugauuugauuaagaccaagugucacucugucacccaggcugcaguacaguggcaggaucauggcucacugcagccuugaaccugggggcucaagugauccuccuuucugagccuucugaguagcuggggccacaggcaugcaccaccacguacagcuaauuuaaaaaucuuuuuguggccgggcgcgguggcucauggcuauaaucccagccucugggaggcugaggcagguggaucacuuaaggucaggaguucaagaccagccuuaccaauauggugaaacccugucucuacuagaauuacaaaaauuagccguaauuagacuaaauacaaaaguuagucucacucugucgcccggguuggagugcaauggcaugaucucagcucaccacaaccuccgccucccagguucaagcgauucuccugcaucagccucccggguagcugggauuacagggucaugccaccaugcccggcuaauuuuuguauuuuuacuagagacggguuuuuaccauguuggccaggcuggucucaaacuccugaccucaggugauccacccgccucgaccucccaaagcgcugggauuacaggcgugagccaccacgcccagccacuagacaucaaauuauguaaugcgugcaguuucgaucagugguauacuaauagaaauugcaugauaaugcaauccaagagaaaauuuuguuuuuuguuuuuuguuuuguuuuuugagacggagucuugcucuaucaccaggcuggagugcaguggcaccaucucggcucacugcaaccuccgccucccagguucaagcaauucuccuaccucagccuccgaaguagcugggaccacaggcgugugccaccacgcccagcuaauuuuuuuuuuuucuuuauuuuuaguagagaugagguuucaccauguuggccaggauggucucgaucucuugaccucgugauccgcccaccucggucucccgaagugcugggauuacaggcgugagccaccacgcccggccgagaaaaguuuuaacuaaaaucacaaagaaugaaauuuuugauuuuaauuuauagauacauuuuuguuucagagacuuaugauaggacauuugagcauaaaaaagucacauuaggauaaaacuuuauagagaaaguaaaauguagguggaacuucaaagauagcagggaacaaugcaaacucuuaaaaaagagauaguugguguauuuuuaaauggcuuuggagggagacagagaagcaggggucugggagccacugggaugucuuugacccagauccuucccaucgucaucaccucauggccaggcucacagcuaagcagagccccuaucuggaccucaguggcaggugugguuuuguccccagcaacaccaggcaggguuacuggaguucaaggccaaggcugagugggcucuugaugucugcauugcccaccagccccaugccagaggaacaggcuuguuuucaguguggcacuugcccccugggcuguucucagaguccuccugguuuacccccagucaaggagggauccugggcuuaaccccacccucagucacuuugcaugugugguccuagucuccaguuccuucugcuucuugucaccgcccuuucccccucuccccuucuucccucuaccugccccccuuccagggugccuaggucucagcagccucccugcuggcucaguuaccucucagccaucugcucccgccucaaggcuugcauugauucccuccccuuccgccuagucgcauacccucccaacccccccacccccacccugaugcuucucuuuguucuuguggcuucugcugucuuuccuuccaggacugcuauuuuauugggucuugaggagggagcagaggugcagagguauaggcuuaaccuguggaauccugggggccaagguggcuuguuugauuuuuuugaaaaaaguuuuaauuaucuguuuuggucaggcacaguggugcacaccgguaaucccagcacuuugggaggccaagacaggccgauugcuugagcucaggaguucaagaccagccugggcaacaugacaaaaucucaucuguauuuaaaaaaaaaaaaaaaggccgggcgcgguggcucacaccuguaaucccagcacuuugggaggccgaggcagguggaucaugaggucagaaguuugagaccagccuggccaacauggugaaaccccaucucuacuaaaaguacaaaaauuagcagggcaugguggcgugcgccuguagucccagcuacuugggaggcugaggugggaggacuguuugaucgcugggauuccaggccacaguaagccaugauccugcuacuguacuucagucugggugacagagugaaacccugucucaaaacaaaaacaaaaaacaagacuuccuuacucuauuucagcugcugacagaaaugcuggaauuugugagauuauagugucagagggucucucuuggcuuuuuaauuguuaucauaggcugggcacagugacucacaccuguaaucccagcacuuugggaggccgaggcggguggaucacaaggucaggagaucgagaccauccuggcuaacacggugaaaccccgucucuacuaaaaauacaaaaauuagcugggcaugguggcgggcgccuguagucccagcuacucaggaggcugaggcaggagaacggugugaaccugggaggcggagcuugcagugagccaagaucgagccacugcacuccagccugggcgacacagugagacuccgacucuaaaacaaacaaaaaaauuguuaucauacacuaugcugcaggauuaaggagcccagcaaggccuuucccaccuggacgggugaaccugacauaaaugcccagaagcagaaugacugacuccagggugugcaaggauuuacacuuacaccagcaaaugggugagaagguccauuuccucacagucgagccaccugggggcuguuucuguuuucauuuuucuacuuugaacuaauuuuagacccacagaagaguuacaauaaaaguacagagaguucccacauaccuuucacccagagucuccggaugauaacauuuuacauaaccacaaugcaaugaggcgacccaggaaaugaacacugguauaaagccugcaggccucauuccuaucucagcaguguuuccacugguguccuuuucugccuguuccaggaucuucuccagaaaugcacguucauuuaggugucauuucuuuuauuuauuuauauuuuuuuugagacugagucucgcugugucucccaggcugggcaguggcgcgaucucagcucacugcaaccucugccucccagguucaagagcuucuccugccucagccuccugaguagcugagauuacaggcgugcgccaucacacccagcuaaucuuuuuuuuuuuaguagagacaggguuucaucauguuggccagacuggucuugaacuccugaccucaugauccaccugcuuuggccucccaaagugcugggauuucaggugugagccaccgcccccggccuaucauguuucuuaauaagggaauuucuuuuuccuuuuucuuuucuuuuuuuuuuuuuuuuuuuugagauggagucucacuguaucacccaagcuggagugcagcaccaucucagcucacugcagccucugccuccuggauucaagcgauucuccugccucagccucccaaguaacugggauuacaggugugcaucaccacucccggcuaauuuuuuauuuuuaguagagaugggguuuugccauguuggccaggcuggucuugaacuccugacuucaagugauccagugccucggccucuuaagugcugggauuauuauaggcgugagccauaaugccuggcccuaauaagagaauuucuaaacauuccucauuuggaaauuuuuuucucaucuuuuauuauuucuuccccaucuuucauuuuuuuauuuuuauuuuauuuuauuauuuauuuauuuauuuuugagacggagugucgcucuguugcccaggcuggagugcacugacuggcauggucucggcucacugcagccucugccucccggguucaagcgauugucuugccucagccucccggguagcugggauuacagaugccugccaccacgcccagcuaauuuuuguauuuuuaguagagacgggguuucaccauauuggucaggcugguugcaaauuccugaccucaggugaucugcccgccucggccucccaaagugcugggaucuuccccaucuuuuauuaucagccaacuuccuuguaugaaagauaaggauuugauguuuuuccuuucccucucccauauuaaauaaccucucccuccucccuaguauacaguuccgguuaccgguuccacgggauuuagccucucaguagccagcauguucgucauggccgucuugccaucgugggcucuagcagucacuacuguguccuuaugacgacccuucaccaucgaguaguggacccuaugaggaauaccuucccuucauuuuacaaggaagcagccaucguaugcaggcguguucccaauaguggggaagaggugcuuuguccuuuuuuucuuucuuucuuuuuugagauggaguuuugcucuuguugcccaggcuggagugcaauggcaugaucucggcucaccguaaccuccaccucccagguucaagcgauucuccugccccagccucccgaguagcugggauuacaggcaugcgccaccaugccuggcuaauuuuguauuuuuaguagagacaggguuucuccauguuggucaggcuggucuugaacucccgaccucaggugauccacccaccucggccucccaaagugcugggauuacaggcgugagccaccgcgcccggccuguccuauuugugcauaagcucccgagccccggucccccaccacggagggagcuguuuggucuuagcagcacauuuccugaggaaaggguugcauuccagccaccugcaguuucaugcucagaaaaaucuugaacaauaguuaacuguggccaaguacgucacuuuacuugccucaguggguuaagauaucccuccuuucccggggaaaucucucugggcuuggucagccacuguguugugaccuagagugucugaagugccuguggccuggagcuccggggcugagagagaucugagcauaggaguuuggguccugaaguucugaguggccccuggaaguagaugugacagucgagugagaaaagggcuuaggaaauggugcccugagaaaugacagccacugaggccgaggaaagggucuauaucagagacagauguguagagggggccuggagccaauccaggaaauccaggaggaggggcaaugcacagugccacauucucgaggggacagauaacaccaaaagcaucaggagagagagaagggagaugggggagccagagacaggagccauacccauuguccauggucaccuccugggcaccuccacagaucagcuuuuucauuaagugccugcucugugccuaucuggggcuggggacagugcagugaccgaguuagccucagguccugccugcaucggccucacaguccaguuggagagacagacuugucaccaugcagugaggacccagagcagucagagcucagauagaggaucccaggggucuggaggucagggaaggcuuccuggaggaggggacaucugaguugggauucuccgguauggaagacagaugaaagggagugagucuggagggagagaguucagggaggagacggaaaacgauucuauguaacccaagaguagauucacaccaguggguaggauguacuuccaggaauaaaauuccugacagaagucaggaagaggauauuagguuaacauuuacaaacugagcauuuucucccuuacucugucauugccauucucccaauccugucaguugaguauuuugacccccaguuuugauaaggaaacaccaaggcucagcuugcgaauccagaaagugacagaaccaggauuugaguccaggucugugcgacuccaaaggucuugcugccauuuauuaaggccggccucguguuaagcccagggagcuuugagaaccuugagaaugugucugacccagccuaugguucagggagggcuuccuggaggaagggacaguccagcugagaucuaaaagaagaauugggaaaagacaggaagagagaaauggagggggccaggugcgguggcucacaccuguaaucccagcacuuugggaggcugaggcggguggaucacgugaggucaggaguucgagaccagccuggucaacauggugaaacccugucucuaccaaaauauacaaaaauuagccagguguggugguaugugccuguagucccagcuacaugggaggcugaggugagagaaucacuugaacccgggaagcggagguugcagugagccgagauugugccacuacaguccaccugggacagcauggcgagacuccaucucaaaaaaaaaaaaaaaaaaaaaagaaagaaaaagagggaaagaagagagagaagagaaagaaagaaaagaaaagaaagaaagaaagaccauuguccauauucuuuuaaguaauagagaaaguaggaauacugacuuacucauuuuaugaguccaauagaauacugauaucaaagccugauaaagucauuacagaaaaggaaaauuauagguuaagaucucucaugaaguuggaguuaggccagacacgguggcucacaccuguagucccaguacuuugggaggccaaggugaauggaucacuugaggucaggaguuugagaccagccuggccaacauggugaaaucccgucucuacuaaaaauacaaaaauuagucggacaugguggugggcgccuguaaucccagcuacuugggaggcucaggcaggagaaucacucgaacccgggaggcagagguugcagugagccaagaucaagccacugcacuccagccugggcaacaagagcaagacucuguaucaaaaaaaaaagcaccaaagucucaugaagcagcacucagagggucuccucucugccuuagucacaccacacuggagaguguuuccauggccacugcauugcagagcggagaucaugccacugcacuccagccuuggggacaaagcgagacuccgucuaaaaaaaauaaaaaaaaaaaacagcagaacauagaauaauaaaaacugcauacaaauccccuguagaaaugggggagcggagaaagggcaggccgcaugggggcagagugcucaccuuucauaguggggcuggauuaugaguagguaacgauggcguagaucugaacaaaccuccaguugaagagcucagaaaugagugagguaugcuuacuaugggcuguccaggagauggcgcuaggggaaaacaggcuggcgaccgcaguaguugaggguuccucugaggaggggacuuuggcuuuacauuuuauaguuugaguacuuuguuuucuugccauguguuacuuuuauuugcggcaggaguuggggguggggcgacggggaaugguagguuuguucuuuucuuuucuuuuuuugagacagucuugcucuuguugcccaggcuggagugcaguggcguggucuuggcucacggcaaccuccaccuccuggguucaagcgauucuccugucucagccucccgaguaggugggauuacaggggccucccaccacgccccgcuaauuuuuuguauuuuuacuggagauggguuucaccauguuggccaggcuggucuugaacuccuuaccucaugaucugccugucucagccucccaaagcgcugggauuaaaggccugagcuaccgcgcccagccaguuuguucuuuucuucucaccaauuccuucugauugcugcgugggggacaauugcagaggggugaggcuggggccggcaggugggaaggaggcuggaggcgggacucacuuauguguuaagcuuagaucuaaugagcaucaugcgugugccuggccuggcacugggcagugcuggggacacagcagugacugugacagcccugggccccacccuugugaggcuuacaggacaguggggagacugauugcagacagguaacuggauagccacuauuccugguugugauaggcacucagaaggggauagacaggcuguauuccuccuauucaggaggucagggaggagaacguuggucagagcugggauggauccuggaccaggacagcagaagggaauccacugggagagauguucaagaugcagaauggacccgacacgcagcugagaggcugugggagaaggggaacagcugggcugaggcccccgucucuagccaggggacagguguggggccaggugcuggguucagguuuggaugugcugagugugagaggucuaggagacaucuggagcguguugacccccgcaagucuggugaguccuccagcuuagccugucccggccccucacagcugucccuucuagaaucacagcccugugauucauccccaccugggccuuguuuccugaaccccacaucugaccgcuggcccgagggagaaugccgucggccccugcucugaaagcccugaaagcccaugccugcgugcacacacgcgugcacacacacacacacccucuugauuugauuuccuguggccuggguaugugcccacucccauuggcacaccuagacccaccugcuggcccagauccccaugcuuggucugcacugagacacuugcauuuccacgcugggaaccucacccaggaaggcuagaggaucuggaacccucaccccucaccacucucuggccacugugcuaggugucccugacaugaaggaggcagugacaguuacgggcccagcucugggccaccaccaggucuggcgagugucauugucaggaugaugcuguccuuccuguguuacagaggggccuuggggcaggcugucauugcucaggcagcagguggcggagccccggggggaccccagaucagccugacccuaagaccucagugugggaggggucuccacagccuggaccccaggaacccacaagcccagggccuaagucacagcuguaacaguaacugcagcagcugacagugacagugacagugacuucucgggcccuaagcuugcaccucaggucuucccuccagcuccagcagagcuccccaagccuuccugccaccccaccccuuugaagaugaaaaauguguaguggcugggcucaguggcugucuccugucgucccaguacuuugggaggcugaggcaggaugauugcuugagcccaggaguucaagaccugcuuuggcaacauagcaagacccagucucuaccaaaaaacaauuuaaaaacagccaggcaugguggggcaucuauaguucuagcggcuccagaggcugaggcaggagaauugcuugagucuagguguucgagguugcagugaacugugauggagccgcugccuuccauccuggaccacagagugagagcccaucuguuaaauaaauaaauaaauaagauggaauauggcaagaccccaucucuacccaaaaaaaauaaaauuagccaggcaugguggcaugcaccuguuguccuagcuacucaggaggcugaggugggaagaugacucgagccugggaggcagagguugcagugagcugagauuguuccacagcacuccagccugggcaacagaacgagauccugucucagaaaaagaaaaaauaaauugugugcccucuagugcauuuucaaguugacaaguaaaacuuuucuucauuaaccuuaaguaguugugaaggauggaauuucugguucugguguguuaugauacugacauguucaaacagcuggugcauccuucccuucauauuuauugcaguucgcauacaauaaugauuugaugccuaccaaugucugguuuaaagauauauauauauaggccaggcauaguggcucacgauugcaaucccagcacuuugggaggccgaggcagccagaucacuugagcccaggaguucaagaccagccuaggcaacauacugauaaaccccaucucuauuuuaaaaaaaauacaaaaaugacuaggcacgguggcucacgccuguaaucccaacacuuugggaggccgagguggguggaucacgaggucaggagaucgagaccauccuggcuaacacggugaaaccccaucucuacuaaaaauauaaaaaaauuagcugggcgugguagcgggcgccuguagucccagcuacucaggaggcugaggcaggacaauggugugaacccggguggcggagcuugcagugagccgagaucgcgccacugcacuccagccugggcgacagagugugacuccaucucaaaaaaaaaaaaaauauuagccaggcauaccuguagucccaguuacucaagggacugaggugggaggaucauuugagccuggaaggucgaggcugcagugagccaugauugcgccacuacacuccagccggggcgacaaagcaagaccccgucucgaaaauaauacaaauaaaaacaagcucuucuuuuucagucagaaauuucacaugguuucuuuuuguucauguacuuuuguauuuacaguccacauacccacagaauuccaucuagugauuuauaugucggcaaccaaaauacauacagaaauuuacauguuaauuuccugugaccauaagguucuaaaugcuaaguuauuuucuucuggauugaguuaauuuugaaauuauuagugcgcaguuacuuuaaaauguucaucuuuuggauggacaugguggcucauggcuguaaucccagcaguuugagaggccaacgcagguggaucacgaggucagaugaucgagaccagccuggccaacguggugaaaccccuucucuacuaaaaauacgaaaaauuagacgggcaugguggcgcgugccuguagucccagcuacucaggagacugaggcaggggaauugcuugaaccugggaggaggagguugcagugagccaagacugugccacugcacuccagccuggcaacagagugagacuccgucucuaaaacaacaacaacaaaaaguucaucuuuuauacauuuucaugaauaauuacuaaaccuuaaaaguaaaaggagauguugcaaaugagucugcaaaggcaccacacaaggguucccucugugguuucaugugcccuuggaugaauauuaauuguugcaggagugagucaggaugcagcaucaauucugcauugguuuuaaagacucaagugcugagaaccuuccuucauaaagaagcagcuaggcaaggaaggaguuuuuguuccagcagcaccacucaccucuugagcucccaccaagguaugugcccaaaaccucacugugaagagcucgcagcucuuagcugcaccuucagggcugaugaaauucuaggauuggagccaucagacuugcaaaaaugauugauuauuacaaguguaucuaaguguucagaggcacuuagcaucgacugccaccuuaagcugcccuuuggagccaggagccccccucucccccaucuguagccccaacuuugcauuuugggaaaauaaggcaagaaaggagguuggucuuucuccugggaaguggguggggcgacagugccagggcaggacagccaggauggcaguggcuuaagggaggaacacagggaacuaagcaucuggcaacuggaccuuuacaccguccaugaacuuggcgcuguggaagcuccuggugucccucuuggggcgcggccccucaaguccgaggaccucccuucuggggcaguguuucuuauuccuggcugcucgcuagaaucaucuggucuuuuaaaagaccccuggguuacccaggcuaggugacugcauucccugggugagagggguggggcuugcagggggcucccagagcgcagccugaccccucucuucccccgcaguguaucacuggguggagaugcggaccaagaugcgcaucaugggcuuccggggcacggucaucaagccgcugaacgaggaggcggcagcugagcugggcgcagagcugcugggcgaagccaccaucuucaucgugggcggcggcugccuagugcuggaguacuggcgccaccaggcgcagcagcgccacaaggaggaggagcagcgugcugccuggaacgcgcugcgggacgaggugggccaccuggcgcuggcgcuggaagcgcugcaggcgcaggugcaggcggcgccgccacagggcgcccuggaggaacugcgcacagagcugcaagaggugcgcgcccagcucugcaaucccggccgguccgcuucccacgcagugccugcguccaagaaauaggagcuugcuggauggaaccugaauuuggacauggccuauguaccuaacguggccuucuucccgcaccacccuugccugcgcuggcccaguggaaaccaccaggaucuugaugcaacuuggcauuugguuaccccugcugauaagagcagccguuaccugccacugggaccagcaggugaagcguugcaacauagcccccuccaucauccuucaccuccuaucccccacuccaaaccaggacgaccugcaaggucccagccagcaggacaccgugggcacucuggcaaaugaaaaaauggaaccuggucuugagcugaaucaauguguuauuguuacccccacccccgguuuaccugaucaguguuaaccuuuacugggacacucaucuguuacacuggaacaccuucuucuuuuugucaaucggcacagaccacuguaaggaaaugcaguguguugcaguggccuuuucucccccucaccuucuaaggucagcucuagcugagcaucagugcucucuuaaggaggaaaaaaacggugcggcugggagcgguggcucacgccuguaauccuagcaccuugggaggccgaggcgggcggaucacuugaggucaggaguuccagaccagccuggccaacauggugaaacuccgucucuacuaaaaauacaaaaauuagccgggugugguggggugcgcuuguaaucccagcuacucgggaggcugaggcaggagaauugcuugaacccaugagguggagguugcggugagccaagauggcaccauugcacccuagccugggcaacagagcaagacaccgucuuaaaaccaaaaguuaaccgggcgugguggugggugccuguaauccuagcuacuugggaggcugaggcaggagaauugcuugaacuugggagguggaggccaagauuguaccacuguauuccagcccgggugacagagcaagacugugucucaaaaaaaaaaaaaaaauccuggcugggcacgguggcucacaccugcaaucccagcacuuuggaaggucgaggugggcgggucauuugaagucgggaggucgggagaucgggagcucgagaccagccugaccaauaugaugaaaccccgucucuacuaaaaauacauaaauuagcugggcaugguggcaugcaccuguaaucccagcuacuugggaggcugagacaggagaauugcuugaacccgggaggcagagguugcagugagccgagauugcgcaauugcaugccagccuggguaacgagcaaaacuccaucuuaaaaaaacccacaaaagguccuggccugcagucaaucccuggaaucauuguaccuucccuugagacccgaaguggacuauuccaacagaacccccucauccuugagucuauggcacaacccacuggaauggcacuacaggaucuuuucugugaauguccuccaaccccccuuuccguggugggaaauuugauccuaacuagggcuaauccagccuguccuucagccucagcccccuauuuuccuguccucagagucccuggagcuuguacuguguggcauguccuuucuugccuuccccaccuugcucaguagcauuucucagggacccagucgaauccaagcccauggauucaauugucacauccuucaucuuccauccgugucuccuaaucugugugcucuugcuuucuuuccucggagcucuggacugacccgacagccugucuucauguagcaguacccuccugccuccauagcccccggucccacccccauccuaccaauuaggccagcaguuggccuuaacugcuugauuaauuuccuuggacugccauaacagaucaccauuggguggugaacuugauggcuuaaguccaacaggaauuuaauucacacaguucuggaguccagaagucugaaaccaaggugcugacagggacacgcucccucuuccagcuccuggugauuccaggccuuccuuggcucugccugcagcuucacauggccuuuucccucuucuauuuugucucuuacaagaacaccugucauugcauuuagggcccaucuuaaguucaggaugaucccaccucaagacccuuaauuacaucugaaaaaacacuuuuuccaaauaaacugucauaagcacagguccuggggguuaguauguggacuugucuguugggggcacaccauucaagccauucagcccacuauuccuccucaccccaagaguacgcuggcguccaggugcaguggcucacaccuguaaucccagcacuuugggagaccagggcaggagggaucucuuugagcccaggagcugaagaccagccugggcaacauagugagaccccaucucuacaaaaguaaaauaaaaaauuagccaggugcggugaugcaugccuguagucccagcuacuugggaggcugaggcaggaggaucaccugagcccuggaggucgaggcugcagcgagccgugaucgcgccacuacacuccagccuggaugacagagugagacccuuucucagaaaaaaaguacccugggacuccugccaaccccgcgggccauuuggccuuccugcuagcugagaggaacagucuaggaaccacccuuuucuacuggguuucucuuccaggaucugccacugaagcgggagggggugggucccaguagccugcagucuguccuuccgacuguagcucucucauuagaggagcugcaaggugaugaaggcauccugaggcuguaccugaaccaccauguggaucuccacaauggguacagagcuuauuaaaaucaggagggaaacugggaggguucugauggggagaggcccaagagucacccuaugagcuggggaaacuaaggccagggguaagcaaagggacuugccagagaugccacagccagugaggggcugacugcccaggguggugaaguaguaggggcagagugagaggcuuggauuaccccagcugcagagugaggagggagaggcgauggcugagcagaggcugggagggugacgaucucuacacagaggcccagaccaucccagagguggcguugauagugggagacccucucuauccccucucagagcagccccagaucacaccagagaucauagcauuguguaaacugggugaccauuccaccugggcccgcuuuugggaagcugcaggugaaagugggagggccgggcuuuccccgacuuccauccucaccucccuucucuaaagagguaaaacuggccuggaccaagaucugcccagauagaaagccaagaaacagguucugaaacuuuucuuuucuucuuuucucuucuuuuuucuuuucuuuucuuucggagacagucuagcuccgucacccugacggagugcaguggugcaaucucggcucacugcaacuucuaccucccaggcucaaccaaugauccugccucagcuuccgaaguagcugggauuacaugugcccaccacccacgccuggcuaauuuuuguauuuuaguggagacgggguuucuccaaguugcccaggcugaucuugaacuccugaccucagguaauccgcccgccucggccucccaaagugcugggauuacaggcgugagccaccgcgccuggccugaaacagcauuucaguuccuucuggaagagggggagaagcuggagcagagggaacugaccgaguggguccugagugggcuguguuuaaaacugggagugacccaggccagcucacgccugucaucccagcacuuugagaggccaagguggacugaucacaugauguuaggagaucgagaccagccuggccaacauggcaaaaccccgucucuacuaaaaauacaaaaauuagccgggcauguuggcacauuccugaaucccagcuacucgggaggcugaggcacgagaauugcuugaacccaggagguggagguugcagugagcugagaucgcgccacugcacuccagccugggugacagagugagacucaacucaaaaaaaaaaaacagaggugggagugugaacacaggcaggagcuccaauuccugaccccagcgcuguccugacccagauggagugcugcucucacaucucagagacuucgcacucagcccugcccugcccugcccugacaggcagccagucaucgugggcagcagggccaucuacuucccccacugcggcgucagggguggccagaguguguggaaguggaaagaacguccucucaaaaugcaagaggccagaggaugguucacugcucguguguucugcuagcuagaauucuguguaccuuguaauuuggggagagggguuagaauaaauuuguaaaugaagcugauuaucuucaaguugaugcauucuuuuuucauauuuaaaaaguccuugggacugggcgcaguggcucacaccuguaauccuagcacuuugggaggccaggguggguggaucaccugaggucaggaguucaagaccaaccugaucaacauggugaaaccucgucucuacuaaaaauacaaaaauuagcugggcauggugguugugcaccuguaaucccaccuacucgggaggcugaggcaggagaaucucuuggacccgggaggcggagguugcagugagccgagaucaugccauuauacuccagccugggugacagagcgagacuucaucucuaaauaaauaaauaaauaaauaaauaaauaagguccaugucaaccuuaggaaaaauauccuuuauuuauucuuucacucaaaaaacucacugagguggucccgcaccgggacauggacccaguguccuugguagggcgucucccgcaaaaaaaaaaaaaauaaaaaaaauaaaacacaaaacucacugaguuacccacucucugccccacccuaugcuggggucacaguggugacagagacagccccagcccugccgucaccgggucuuacagaugcucacacguacauuucuuuuccaguguucccugccccaccccauaguuguuuaggaagcaggggcugggcugaauccggaauccucccucuggagugacucaggacuauaaacccauucaucccagcucacaaaacccugggaggugcccugagggcugugccccucccaucuccuggcaggcccugcugucccucuuguugguuucucuguagggcaggccauugccuggagggaggcaaaauggcugagagccaccccaggagaaaaugggcuuuacauaagccccaaccugaucuauuggcucacggagcuacuccugggcuggucgcuguguugcugaguggcaggcuugggucccccaguggcaauggcuuguagcuggagucgguguggacagagagaggagaagcauggcaacucugaguguacugaggaucaacugcaccaggcuccauucuaguagcugggagccaguugggagcaagcagaggcccucacuggagcugacauucuagugccagagaccggcaauaaagaaggaaagaguggccaggcgugguggcucacaccuguaaucucagcacuuugggaggccgaggcgggccaauccccugaggucgggaguucgagaccagccugaccgacauggagaaaccccaucucuacuaaaaauacaaaauuagcagggcaugguggugcaugccuguaaucccagccacucaggaggcuguggcaggagaaucgcuugaacccgggaggcggagguugcggugagccaauauugcaccauugcacuccagccugggcaacaagaacgagacuccaucucaaaaaaaaaaggaaaaagcuaauccagcauagggugaugaggacugagaggaauggaggcaggguaggaguuccggacuuacgggcaccgcugaucuagacaggugggcagggaggaggcagcgcuucagauggagggagauaggaagagggcugugaguaucugugaaaguccuaggacagauguggccuuggccuguuccuggaacagcaagaguuucuggcugucagaauagagcagaggcucgcugaccaaggccuuugggccaaaucaaggggacccuugcuuccugucuuuguaaauaaagacuuauuggaacccaggcgcucauucguuugcauauuuuccacaguugcuuuugcaguacagugacagagcugaguauuugcacagagauccuagggcucucguacucucuggcccuuuacagaaaaaguuuaccauccccuggaauagaguaagcgaggggagaaguuaggugagggggccaggcaagcaaaggcugccccuugccuugauuggcacaacuguggaggucaucccagcucuggagccccaacaggaucacucaggccucugcuuccaccacaucuggcuucagcuucccccucuguggaguccucccucccucccuccuuccccauaggaaaugaccccagugcucagcaguaacccccacugcgcgcagaucucagaaccuccaccucaaucuacagccacgugccacaauaagaagcagaguuuuaggccaggcgcgguggcucacgccuguaaucucaguacuuuggaagaccaaggugggaggaucacuugaagucaggaguucgagaccagccugcccaacauggugaagccccgucucuaauaaaaagaauacaaaaauuagccgggugugguggugcacaucuguaaucccagcuacaugagaggcugacauaggagaauugcuugagcccaggagguggacguugcagugagccaagauugcacuacugcauuccagccuaggugccagagugagacuuggucucaaaacaaaacaaaacaaaaaauuagccaggcaugguggcacacaccuguagucccagcuacuuggggggcugaggcaggaggaucgcuugaacccggguguuuaaggcugcagugaacugagaucaggccacagcaccucaaccugggagacaaagugagacccugucucaaaaaaaaaaaaaagcagaguuuauguaauccaucgugugcauauuuauacaauaauuuacaauucuauguauuuuaaaaguguauaauucauauauuaugugacacaauauauaauggaauauaaaauauauauuuuaugucauguguaacauaacaucaucuauuauauguaguguaugugcuuauguacauaucauuggaaugaaaguuucauuaaauaauuacccuuaauauuugcagcccgguuuaauauuuccuauuuuauuguauuccauuucaugaagaauaacuacagauauauaugcauucuauauacuuaauauauauuauaaacauaugaaacccauuaaguguguuccauaacacauuggaugauauguuaauaucauacauuauguauuauaugucuuguuagaacaaguuucucugaauaauaauuguucuuaugugugaugggcaacuucguuacuuuuuauucuccguuauuuuauuucuuaaagaaaagcauggccugucacaccuguaaucccagcauuuagggaggccgaggugggaggauugcuuaaucucaggaguucaagaccagccugggcaacauggugaaacccugucucuacuaaaaauacaaaaaauuagcugggcgugguggcacacaccaguagucccagcuacuugggaggcugaggcagaagaauuacuugaacccaggagacggagguugcagugagccaagaucacaccacugcacuccagccugggcaacagagugagacuccaucucaaaaaaaaaaaaaaaaaaaagaaaagcauguacauaugauguauguauuauacaaaccuguauaaugugggcugccuugggccagcaugaagacuaacuuuuacucugggaagagauuuuuaagcugggauuacaggugugagccacugugcucagccucugguuguuguuguuguuuuuuccauuuguuuguuucauuuuggacagggucuugcucugucacccaggcuggagugcgguggugcaaucacggcucacugcagccucagccucccaggcucaagcaauccucccaugucagccuccagaguagcugggaauagaggugugccaccacuacacucagcuaauuucuuaauuuuuuguagagaugggggucucuuuauguugcccaggcuggucaggaacuccugggcucaugccauccacucgccucagcucccaaagugcuaggauuacaggugugagccaccacauccagccccuuuuuucucuguuuugaaguagaggccuauccugccuugucuugauuuccuauuuuuuguuuuuuuguuuuuuuuuuuuuugagacggugucuugcucugucgcccaggcuggagugcaguggcgccauuucggcucccuacaaccucugccucccggguucaagugauucuccugccucagccuccugaguagcugggauuccaggcaccugccaccaugccuggcuaauuuuuguuuuuuguuuuuguuuuuguuuuuuugagacggaauuuuccucuuguugcccaggcuggagugcaaugacacgaucucggcucaccacaaccuccgccuccuggcuucaagcgauucuccugccucagccucccaaguagcugggauuacaggcaugggccaccaugcccgguuaauuuccuauuuauuuauuuauuuauuuauuuauuuauuuugagacggaguuuugcucuuguugcccaggcuggagugcaauggcaugaucucggcucacugcaaccuccaccucccggguucaagugauucuccugccucagccuccugaguagcugggaucacaggugugugccaccacgcccggcuaauuuuguguuuuugguggagacaagguuucuccauguuggucaggcuggucucgaacucccgaccucaggugauccaccugccucggccucccaaagugcugggauuacaggcgugagccacugugcccagccgaauuuuguauuuuuaguagagacgggguuucaucguguuggccaggcuggucucgaacucccgaccucaggugaucugccugccuugccgucccaaagugcugggauuacaggcgugagccaccgugccccgcccccaucaucccuuuuuauggcugaauaauaguccauugugaggcuagaccacaauuuguuuauucauacaucuguugaacguugggguuguuuccuccgcgugguggcuaugaauagggcugcuaugaacgugcauguagcuugcagucuuuuuaggcuuagaucauuugucucgagagcagugaagcaucaugggaagggcaugggcucagaucccaaaaugccuggaaucaaucccuagcucugccucauaccaguuggaugagcuugggcaagucacuggguaucuugugccugauaacagaacuuccuuuguaaguuuauuaugaaagugaaucaauuaauacaugcaaaacacuuaggaaguugcuuagcacagagugaacgguugcaaaaugacucugcauugccagcaacaggaaccuuccugggcuaacugaagcagaaaaagaacuuacuggaaggauaucagguagcucacuggaggcuaagaaaaccagcaggaaccuugagagguuuacaguuagagaugccgaugcuguaacagagaccccauauguguaaugauauugagugaacgaguuuacuucuugcuccuaaaauaguaacguuggccaguugcaguguucacaccuguaaucccagcacuuugggaggcugaggcgggaggauugcuugagcucaggaguuagagaacagccugggcaacauagcaagacuccucuucuacaaauaaaaauaaauuauaaaaauuaaaauacagcugggcgcaguggcucacgccuguaaucccaguacuuugggaggccaaggugggcagaucacuugaggucaggaguucgagacuagccugaccaacguggugaaacuccaucucuacuaaaaaugcaaaaauuaggcgugguggcgugugccuguaaucucagguacuccgggggcugaggcaggagaaucacuuaaacccaggaguuggaggcuacagugagccgagaucacgucacugcacuccagccugggcaacagagcgagacucugucucaaaaaaaaaaaaauuaaaaauaaaaauaggccaguugugguggcucaugccuguaaucccagcacuuagggaggccaaagcuggaggaucacgugagcccaggaguuugagaccagccccugggcaauauacagagacgcuauuucuucaaaaauacaaaaguuagucaggcauggugucaugcuccuguagucccagcuacgagggaggcugagguggguggguugcuugagcuggagaguuggagguugcagugagccgagaucaugccacugcacuccagccugggcgacagagugagacccugucucaaaaauaaauaaauaaauaaauaaacaaacaaaauaagacaaaacagugaagucacgcgcugggcaugauagcucacaccuguaaucccagcacuuugagaaaccaaggugggcagauugcgaggucaggagaucgagaccauccuggccaccauggugaaaccugucucuacuaaaaguacuaaaauuagccaggcgugguggcaggugccuguagucccagcuacucuggaggcugaggcaggagaaucacuugaaccagggaguuggaggcugcagugagccaggaucgcaccacugccugcccucuagccuggcgacagagcgagacuccgucucaaaaaaaaaaaaaaaaaaaaaaacaaaaaaacagugaaguacuguaccacauaaugagguuucuguccacaacaaaccgcauauacaacaguggucucauaaaaugauaccaccguauuuuuacuguaccguuucuauguuuggaugugucuagacacgcaaguacuuaccauuguguuacaacuccugcaauuuucaguacagucacaugcuguuuagguuuauagccuaggagcagaaagcucuaccacauagccuagguguguagcaggccacacuaucuagguucguguaagcccacucugugauguuugcacaaugacaaaaucaccaaacaaugcauuucucagaaugugucccugucauuaagcagugcacggcuguacuagccgggaacagguuggcagggcagcccuccuccacacagucauucagggacucaggcuguugcagcucugccaucuucaguguguuuauuucaaggucacccugggguggucuucaugaggaccacagcauggcucauauggaccagggcuggaaguagccggcuucacuuggcuggcuuauuuuuccuagaacucggugcccugaccacaccuaacugcaccuaacuauagucccuggcugggcagccacuucccagcaaggagccugucuguuggguugcagcgagcaugaagcacucagggacuccaaggucagagggcugucagcaccauggguaccacccccuaccacugccguggaccuacuccacacccuaacauggauccuaggggucucuucguauccuugaagccuuccccaagauuucagguucaggcugggugugguggcucacaccuguaauaucagcacuuugggaggccaaggugggaggaucgcuugagcccaggaguucaagaccagccugggaaacauagugagacccuguuucuauaaaauguuuuaaaaugcgccaggugugguggugugugccuauagucccagcuacucaggaggcugaggcaggagguuugcuugagcccaggaggucgaggcugcaaugagccaucauugcaccacugcacuccagccuggcuaacagacugagacucuuucuccaaaaaaaaauuucucuuauuuauuuuguuuuauuuuuuaguagagaccaggucucccuguguugcccaggcuagucucaaacuucuggacuuagaugauccuccugccucagccucccaaagugcugggauuacaagccugagccgcuacaccaggccccaauuaaaugaggggugacucuguauccagucaagaacaauggaccucccagaccccccuauaguacaggauggcuauguggcaugggggcucuguaaaaucuaguggcuuuuccauaaaaagugacagauuagacacacacuuccucugacacccccugcccucaccuccuguguagaaggaggcugugaugccgaggggcagcaggcaucuuuugggcauguggcuaaaagccccauaaugaggaggguagggauugaacgagaaggagccuggguucccagugacauuguauggcagccuucugguugugggagaacaguccccauauggggaagccauggguuucuccaguuucuguugcaggcuguuccugacucagacuaacagcaauggcgcuuccccaaugcaacagagggguuuagaugcuggaaaaucaaaaaccucagaaguacagacauucauuccugagguccugaguuuggugggauccacuugggcccagcauagagacugugaacccccacccauccugccuaugauucaugacagcauuugccaauuccagugagagagguccuggaccccgguguucuggcuuuuuugcuuguuuuuuuuuugagacggagucucucucucucacccaggcuggagugcaguggugccaucuuggcucacugcauucuccgccucccagguucaagugauucuccugccucagccucccaaguagcugggauugcaggcgccugucaccacgcccaccugacuucaggugauccgcccgccucagccucccaaagugcugggauuaguaugagccaccgugccuggcccccuuuuuuuuuuuuuuuuucuuucugagacagggucuuacucagucacccaggcugcagugcaguggugcagucacagcucacugcagccucaaccucccaggcucaagcgaucuucccacuucaaccccccaaguagcuggggcuacagguaugagccaccguguccuggccugguuuguuuguuuaaacagcaaggcauaaucuacacaccaugaaacucacccuuuguuuuauuuuauuuuuuauuuuuuauuuuuuauuuuuuuugagacagagucucgcucuggcacccaggcuggagcacaguggugcgaucuugacucacugcaauuucugccuccuggguucaagcgauucuccugccucagccucccgaguagcugggacuacaggugcacgccaccacacccggcuaauuuuuguauuuuuaguagagacgggguuucaccauguuggccacgaugcucucaaucuccugagcucgugauccaccugccucggccucccaaagugcugggauuacaggcaugagccacugcgccuggccgaaacucacccauuuuaagaguacgauuugaugauuuucaguaaacugacaugguuaugcaaccaucuccacauuccaauuucagaacauuuccaucaucuccaaaagaucccucacauucauuugcagugacucuccauucuccuuccuucagccccuaaaaaucacugaucuacuuucugccuuaauagauugcauuauuugggacauuuaauguaaauggagucauacaaugcaugguccauuuuauugcaugaauaucucauuccuuuuuuuuuuuuuugagacaaggucuggcucugucgcccaggcuggagugcagugacgcgcugucugcucacugcaaccucagccccacccccgcccaguagcugggauuacagacaugcaccgccacgcccggcuaauuuuuguguuuuuuggcuggguguaguguucaugccuguaaucccagcacuuugggagacagaaguggguggauagcuugaggucaggaguuugagaccagccugggcaauauagugagaccucaucucuacaaaacauacagaaauuagccgagcguggcagaaaaaauaaaaauauuaaaacuuuuuugugauguuuuuguagagaagggguuucgccauguugcccagguuggucuugaacuccuggguucaagcgaugaguagccucccagagugcugggaauacagguguguaagccacugcaccuggccuauguuuaacuuuuuaagaaacugccaaacuacuuuccaaaguggcugcaccauuuuacauuuccgccagugacaugcgagaguuuuguuacccuacaacugauauaguuuggcucugugucccaacccaaaucucaucucgaguugucauccucauguguugagggagggaagugaucaugggggugguuucccuuaugcuguucuccugauaaugagugaauucucaugagaucuaaugaauuuuaaaauggcaguuuuuccugcccuuucacuucucccuccugcugccuugugaggaggugccugcuuccccuuugccuucugccaugauuguaaguuuccugaggccuccccagccauucagaacuguaagucaacuaaaccucuuuccuuuauaauuacccauucucaggaauuucuuuauagcugugugaaaacugacuaauacagaaacuuuggaagcauuagugguuguucacuguuuugacuauagccauuccaguggcugggaaauggcaucucauugugaauuugacuuguauugcucuacuaacuaauguguugagcaucuuuucuuuuuuuuuuuuuugagacggagucucacuuuuuugcccaggcuggagugcaauggcacaauuuuggcucacugcaaccuccgccucccagguucaaggaauucucuugccucagccucccaaguaacuggaauuacaggcacacgccaccacaccuggcuaauuuuuguauuuucaguagagacagguaguuucaccauguuggccagccuggucucgaacuucugaccucaagugaucugcccaccucggccucccacaaaugcugggauuacaaguguaagacaccgugccuggccucacuugcuuuuuucuugagauagggacucacucuuuugcccaggauguagugcaguagugcaaucacagcucacugcaguuuugaucuuccaggcucaagcaauccuccccccucagccuccugaugagcugggaccacaggcauacaccaccacacccagcuauuuugugugcgugugugaagaugggguuucacuauguugcccucaaauuccuggucucaagcaauccuccuaccuugaucucccaaagugcugggauuacaggugugagacuccauagcuagcuagaaucuuuuuuuuuuuuuuuucagguggcauuuuuuuuuuuuuuuuugauauggagccuagcucuguccuccaggcuggagugcagugguaccaucucagcucacugcaaccugcaaccugcaccuccugaauucaggcaguccucccgccucagccuccugaguagcugggacuacaggcacacaccaccacacccagcuaauuuuuauugaaaacauauauauuaugaaauauugcagacauacagaaaacaauauaaugaauaaccuuguacccaccacuuagaauuaauagaaaugaacauuuuguccucuuugcuuugguuuuuaaagagagaaagcugaagcuacaguuuagucucgucauucucccucccugcucuggcacucgggaggcugaggcaggagaaucgcuugaaaccggagggcagagguugcagugagccgagaucgcaccacugcacuccagccugggcaacaagagcgaaacuccaucucaaaaaaagaaaauaaaagaaaagaaaaagauaccauccucuuuugugagucaaguccuucuccacuagguucucuacccuuccccuuuugauuggcaggagguaucuguauguccuaaauuugaguuauuugucagauugauguauugcaaauggcuucuuccagucuaugauuugccuuuucccucucuugcuggugucuuuugaagaaugaaaguucuuuucuuguuuuuuuuuuuuuuuuuuuuuuuuuugagacagagucuugcucugucauccaggcuggagugcaguggcaccaucacaacucauuacagccuucaacucucgggcuuaagugauccuccucgcucagccugcugaguagcugggaggcggagguugcagugagcugagguugcgccauugcacuccagccugggcgacagagcgagacuccauuucaaaaaacaaacaaacaaaaaacaaguucgagacaagccugaccaacauggcgaaaccccaucucuacuaaaaaguuuuuuaaaaauuagccuggcaugguggcaggugcaccagcauaccgggcuaauuuuuuauuuuuuguagagaugggguuucaccauguugcccaguauggucuugaaccccuucucugaagcaauccucccaccuuggccuuccaaagcacaguuuauaggcaugagccaguacacccagccuccuacuuuuuuuuucuaaaaguguuauuuuugugucuaucauauuuugaucuacaaucccuguggaauuaauuuuuguguauuaugugagguagauguuaagguuuauuuuuuucucugugaauauucaagugauccaacgugucuuaaaaaguccauucuuuucccacugcacuacagugucacuuucgucacaagucauaugacugugcaugugugaauauuucuggauucucuacgcuuuaccacuggccugucuauucauguggaaaugccacccuguuuugaugauuauagcuuuaugauagcuuuauaucugguaguguaaggucuccaguuuuucucuucaguauuacuauucuuggcccuuuguguuuccauacacuuuuuuuuuuuuuuuugagacagaguuucacucuugucgccaagaguggagugcaguggcacgaucuugacuuacugcaaccucugccuccaaaguucaagcaauuauccugccucagccucccuaguagcugggauuauaggcacccgucaccaugccuggcuaauuuuuuguuguauuuuuaguagagacgggguuuugccauguuggccaggcuggucucaaacuccugaccucaugugauccgccugccucagccucccagagugcugggauuacaggcaugagccaccgugcccggcccacauuuuuuuuuuuaauuuuuuuuuuuuuuuuugagauagagucuugcugugucauccagcuggagugcaguggugugaucucggcucacugcaaccuccaccuccuggguucaugcaauucuccuuccuaagccuccugaguagcugagauuacaggugcaugccaccacaccuggcuaauuuuuuaauuuuuucaguagagacaggguuucaccauguuggccaggcuggucucgaacuccugaccucaggugauccgccuaccuuggccucucaacguacugggguugcaggcaugagccaucacacccggcaagaaaaccaguuucuagcaggguguggcagcaggcaccuuuagucccagcuacucaggaggcugaggugagagaaucucuugagcucaggagaucaaggcuauagugagcuauaauugugcuauugcacuccagccugggugacagggugagaccucaacucuuaaaaaaaaaaaaaaaaaagaaaagaaaaaaacaguuauuauguucaaacaauuaaaguguauauguacaauuaaaauaauuuauaaacaaauuauaugacuaagaagaauaagaacuaauuaggcugggcauggcgguucaugccuguaaucccagcacuuugggaggucaaggcaguuggaucgcuugagcccaggaguucgagaccagccugaacaacauggcgaaacccugucuuuacagaaaauuacaaaaauuagccaggcaugguguugugucccugcagucccagcuacucaggaggcugaaguagguggaucacuugaggcugcaguaagcuaugauugcaccacugcacuccagccugggugacagaaugagaccuuaucucaaaaaaaaaaaaaaaaaaaaguaauaauuuaucaagaucacugcauauaagguacggaaaucaguuuauuccuaucaucaguaccagcaacaaacaaauagaaaaugaaauuugaaauguugccaucaaaauaguaucaaaauaucuaauacauaggaauaaacugaauuuacaugcaagauaucuauucuguaaacuacaaaacauuauugagauaaauuucuuaaagaccuaaaugaagagaauaccauguucauggauugcauugacaggaaaaucuuuuccucuaccaaucuagaucccuguuguugggaaccugcaaauuaauuaacaauagacagaucaacacguggaaagaaaaacuuuauuuacacauuaggcaagggaacucuguaaugaguaacucauugaauagcuggaaguaaagguuuauuuaccaacuuaagaaaaaggaguucaggcuggaugcagugacucacaccuguaaucccagcauuuuggaaggccgaggcugggggaucacgaggucaggaguucaagaccagccugaccaacauagugaaaccccgucucuacuaaaaauacaaaaauuagccgggcaugguggcgcgugccuguagucccagcuacucgggaggcugaggcaggagaaucgcuugaaccugggaggcggagguuguggugagcugagaucacgccacugcacuccagccugggcaacagagcaagauuccaucucaaaaaaaagaaaaagaaaaagggguucaguggaaaaguauggauaguucuauuguuuucuuuacuugacuuuuuuuuuuuuuuuuuuuuugggacagaguuuugcucuugucaccaggcuggagugugauggcaugaucuuggcucacuacaaccuccacuucccagguucaagcaauucuccugcuucagccucgaaaguacugggauuacaggcacccaccaccaugccuggcuaaguuuuguauuuuuaguggagaugggguuuaauuagguuggccaggcuggucuggaacuccugaccucaggucauccacccaccucagccucccaaagugcugggauuacaggcaugagccacagcgccuggccucuauugcuuuccugugugauuuuuaacacuaaaagagauggacagucugucuccuuccuggaauucgcagaaaacucccuuggaggggguuaauggcaguuguauuuucaggaggcucuccuuuaguccaauaagaggaguguagauaacauuacaaguguuuucacuguaaaauaaucuuugugccaaagcuguggauuccuucaauuggaagguucaauauuguaaagauaucaucuuauaaacugauuuauagauucaagucaaucccaauucuaugccaaaagguguguguuuguauauuugugcaugugcaugugugugcaaacugacaaacugauacuagaauucacauggacugaacugacuugucuccaggccagagucagaggcaacaaccugcccacugcuuaaugguggcuauggugccuucuuucggggagaagcauggagccugcccaggacggagccgcuuguucaaccuugugaaaccaaucccuggguuuucaccuugacccugcccauccagggccaccaagagggccccucccauaggagacugaagugaauucacacaccucaccaugcuuugcauucaaccaacagaagcuuggccuggccuggccuggccugcccuggaguacggacuuacuggugaacugaccucuccuggauuaggauccggcugauguuuaaguaccggccucaaagguauaggguaaaaggaaacaacguacaucuguagcacaaggugucuccugauuauuuaaaaauuagcuacauucagcugggcgcgguggcucacgcauguaaucccagcacucugggaggccaaggcgggcagaucaugaggucaggaaaucgagaccauucuggcuaacuuggugaaaccccaucucuacuaaaaauacaaaauauuagccgggcauaguggcaaaugccuguagucccagcuacucgggaggcugaggcaggagaauggcuugaacccaggaggcggagcuugcagugagcagagaugcgccacugcacuccagccugggcgucagagugagacuccgccuuaaaaaaaaaagaaaaaucauccuggccagaugcaguagcucaugccuguaaucucagcacuuugggaggccaaggcagguggaucauuugagguugggaguucgagaccagccugaccaacauggugaaaccccaucucuacuaaaaauacaaaaauauccgggcaugguggugcaugccuguaaucccagcuacucgggaggcugaggcaggagaaucgcuugagccugggaggcagagguugcagugagccgagauggugucaucgcacuccagccugggggagaagagcaaaacuccaucucaaaaaaaauuuaaaaaauaaaaaucauccuagggcugggcacaguggcucaugccugcaaucagcacuuuacgaggcugaggugggaggauugcuugaggcugggaguuugagacaaggcuggacaacauagugagaccccaucucuauuaaaaaauaaaauaaaauaaaauaauuuuaaagccgaauggacacuaaacuucccuguauguuuggauauuuuauaaucaaauuuuaaauaaagacugaaaauuagggggaaaaaauaaguucugaaagucaacaaaaccucccagugguguaacaaaaaggagcaauggaaaaaaacaggaagggaaagugaggagaucagugcaggguggcguuccagacugggaagggguaggagaaggguaggagaaaauggagaggaggcaacagauaagacacacauuuagggggucaccaagaccacccucacuucugucauugacugcaagcucaggagucucuaagaucaccaucaguuucaguaauuugcuagaaagacucacagaacucacuaggaucaguuauucucaugguuguggcucauuacagugaaaagaaucagauuaaaagcagcccagggaagagguccauggguccaggagaguuccaagugccaauuuaauaccugguacaguuguggacagcacuaacuucucccagcaaugauaagugacaugaugucacccaccagggaagccuaccugagccuugguguccaggguuuuuaauagggaucagcauguggauaaggcugaccacuuguguggcuccccuuagauucuagccccuccagagguuaagcugauaucacauggcccaaagcccccaccauaaaucaccacuguuagcacaaaccauaugguguggcccaaggccccauguaaacucaggcuggacauuccaagaacuaaaaaauuaccucccaggaguaaaaggcaaaggucagaccucuauuuggaugaaguuaauccuuuacugagcagacaagaaaaauucgaagggcuaaagagagaaacgggauuuggauagaagauagaagaguuuaaggggaauaagaaaaacauucaucuuggugcaaugucagugccacagggaugacaacaagccccucugccuuuacacaucguggaaccaggccaccaaacugcugaggaauaggauuucgaacuagucauucuggggcuagaauuuaucaucucaucuaaugugaagguggaaaaagauauuucagauauucaaggauucaaaacacugagauaccaagcacccuuucugcaaaagguaucuagggauauacuccaggaaaacuagaaugaaauucaacaaagaggaugcaaguuccucaaaagaggaggagcaguaugaaggaggacaguccugcagcagcccagagaacagcuaguguguccacaacuguuuauuuaauaaacagaauaggagcaaacaucuggaugaucuuggucccaugguaaauuuuugugggucacauaguuaguuugagaaucaucauucuaggaaaaacuaaaaccuucauacaguaacgucaaaguugaaauaaaagaaaaugaaaauguggcacgauacgaagcagugaguccagcuggcauuuaaugauaaugcuucacaugccacugguuuagugaaauaaaaauacaucuucauuauggaucuacaggauuaauauuuccauaaccuccauauuuuacauggucuauauuuucaauuucaggcagcacaaagcauugcacaaagcaauuacauagguuaccaauaaacaguaaaaaaaaauaggcugggugugguagcucaugccuguaaucccagcacuuugggaggcugaggcggguggaucacuugaggccaggaguucgagaccagccugaccaacguagugaaacccugucucuacuaaaaugcaaaaaaaaaaaaaaaaaaaaaaaaaaaaaaaaaaaguaggugacaugguggcacacgccauugaaccaagcuacuugggaggcuaagccaccagaauggcuugaaucugggaggcagaggcugcagcgagccaagaucacaccacugcacuccagccugggggacagaccgagacucugucucgaaaauaaauaaauaaauaaaggcugggcaugguggcucaugcuuguaauccuagcacuuugggaggcugaagcaggcggaucacuugaggucaggaguuugagaccagccuggccaagauggugaaaacccgucucuaguaaaaauacaaaaauuaguuggaaaucacuugaaccugggagguggagguugcagugagcugagauagugucacugcacuacagccugggcaacagagcaagaccccgucucaauaaaaaaaaaccauacauacauaaauaaaaauaaacaguaaaaaaauaaaaaccacuuguaaaaauugggaggggagagggaaggagauagaauaugugaugaauuccauauaguucaugggguugagggggagugcagugaaaaaucaaguuacaauuuuauuuuuuuuuugagauggagucucgcucugucucccaggcuggaguacaguggcaugaucucggcucacugcagccucugccucccuguuucaagcgauucuccugcuucaacuuccagaguagcugguauuagaggcacgcgcuaucacgcccggcuaauuuuuguauuuuuaguagagacgggguuucaccgucuuggccaggcuggucucaaacuccugaucucaacugagccacccaccucggccucucaaagugcugggauuacaggcaugagccaccgcgcccagcgaaguaugaauuauugauggaauuaagaguuagccucagggccgcgcuccguggcucacaccugcagucccagcacuuugggaggcuuuggcaggagggucgcuugagcccaggaguucgagaccagccugggcaacgcaaggagcccccauuucuacaaaaaauuaaaaaauuagccaggcaugauggcgcgcacacguugucccagcuacucuggaggcugaggcgggaggaggaucgcuugagcccaggaguucgaggcugcaguaagcugugauuucggcacugcacuccagccuggacgauagagcgaaacccuggcucaaaaaaagaaaaauuaaagaaaaaaaaagagcaucagcaucuucuguguuuauaacgaugcaaaagcugacacuccaccuucacaugaguaagucauuaguuaaggaaguuuucccuagaggauucugggugugaggccugcacuugucuucguuaaggcguccccgccagcacgcguccgauuguggugaccacauccccauugcuacaacggggacaucgaagcacagagggucggggcuuauaggaggcugcccugcaaaagaccccugacuccugucuuuuccugcaguguaccacuggcuggagaugcggaccaaaaugcgcaucauggguuucaaugccgcugccaucaagccgcugaacgagggugcagccgccgagcugggcgcggagcugcugggcgagggcaucaucuucaucaccgccugcagcugccugaugcuggaguauuggcgccaccaguugcagcagcgccgcaaggaaaaggagcgacguguugccagggaggcgcugcggggcgaggugggccacuuggggcuggcgcucgaggaguugcaggcgcaggugcaggcgacgucgacgcagcucgcccuggaggagcugcgcgcucagcugcaggaggugcgagcccaccucugccuccgagacccgccgccugcacccccaguugcgccggcguccgagaaauaggaggucucggggcccuggucuuggaggugacugcugucuggacugcgaagucucugucuuggccuauucuccgcacugucccauccuggaccggcccagcugacaccacccaguccuucgggggcgccggagagauccugggcuggagcugaucgaaccucccuacuaaccugcccagugguaccuuccacugggacucuccgccuccugcagguggaacguuccaagaaggaccccgcccuaucccaccccgccccugccagcgcauuuguugagcacuuuggaaagacagcgucuuuuaucagaccccaccucccuaccgcuagguaggccagcaggacguccaccucuuuuggcaaaacaaaauucugcacccggauuuagccaccucucauucugucacccgcacccucacucaccugaguggacccuuccccuaggacgcucauccuuugcaccgaacaccaccuaccuccuccucauugguacagaccauuguaaagaugcacaaaguuccuacggacuucccgacccgcccccuuccaucuaccucagucuuagggggaaaggugggggugaauccuggacugcguuagcuccaaugagucaccacccugcggcuccugaccuuaauccaucuuaguaccugucauugacauccuccccucccugaguggaucgauccaacauaaccccccucuucuuccaccuauggcgcaccccacuggcauggcuaugcugggucuuccagggaaacgccucccagcccggcauucuguggucuguuccagcaggacguggccuuuugggaggaaaaaccggucuugaccagggcuaguccauucuggcuuucaggcucagucacuuggucaccaguccccaguccuggaccuacugcuacuguccuuuuauccgguccucccucgcuguccucuucaguugccuuugcuagggaccggccugucccuuuacuaccuaagucaucgucaguucgcccaacuucccuccaaaucugccccucacgguacgcagggaucgcccuuccuuccugccuuuggacugguccagguccuccuccgcccuccuucacgcaaaggccuccuccagggggacuaccugucccucagcccagaggucccccuguccaagcgggguauuccaccaggccauaugaccuacccacccgacaacugaagggggcguggaugagcucugugacucugaaugcuacuuuauaaaucgacugucagcguuuucuaauuaaaggagcucugggguaaagaucuuaa

SEQ ID NO: 191726 - RNA, 38006 nt, Homo sapiens
agugcugaguuuaaguuaaacacccauaugaauuuauuaaauccagacuguguuaaagggcggcggucuaggagggggagugugguagggggacgagggacaagaugaugaacggccgugggcaucccguaggggggcccggccccacccccgcccaacccacccccucggcaacgcugcaucagcuucaccaugauucccaguggugcugggcuggcagggcgagauggcuggaaacacagagggacagagggacagacagcgccuccacaaacaaacccuggccugccccggccccuacaucacacgcugggcccugaccugaggcgggccucccaccgccccggccugaucuguccagggaaagggcgacagggaggggaggcgagggggccgggacgcagggguaguggucgccaggagccggagcaggugaggaccagucucgacuaauccuuuuucuuguccucugcuggcuuuggaggggcuuccuggggcucgcuggcagagcuggcccccugggugggcuuggugggcagggacguggaggccuccucccugguggcgguggucguggugggugcaggugugggcgugagggccccugcugcugugggaaccucggccacgggggcggcagcuguggggucuucuccacucaugccaaacucguugacucggguggggucgacgcgguagauccaccguugguagagguagaugaagaaaaccacaucuggagaggggugggaggcagugugaggucgggcuggcccguccacagccaggugggccuggguggagagggcgugaugcaagggcggggccgagcccccucagacugagcaccccaucuggggccguggcacccccucaggccugggcccuaaagacugccucagggcccuguuccggugggagcucccaccugcccaccgggccucaccgucccgcaggcagccgauccgguacauaacgggcaucuugaugacaaaggcgaacaggucgucgaugaauguguugagggccuuguaggugagcaugcgccagggaaggugggccacagacuugagcuuguaguugaugaagagcuggggcgucauggugaugaagccugcagugagagcacccaugagcagagggauggccucucccaccucuccccugugcacucugcacuggccauaccagcccccucaccacuuccuacaccugggcacacucuaccacuuccuauaccugggcacacucuaccagcggccucugcacugguggggccuucugucacauccgcacagcucucucccuggauaucugaggccucuguuuaaauguccuguccucagaggggcccccggaccccuauuaaugugcauccucccaccacucugcccuucacaguacucacuauuggcugugauucacccggucuuuuguuuuuugagacagggucucacucugucacccaggcuggagugcaguggcguaaucauggcucacugcagcuucaaccuccuggacucaagggauccucccaccucagccucccagguagcugggacuacaggcacgcaccaccacuccccaauaauuucuguguuuuuuuguagagaucgggucuugccaaguugcccaggcuggucacgaauuccugggcucaagugauccuccugccucagccucccaaagcauugggauaacaggugugagccacugcaccuggcccuacuuguuuacuuguucccaagacacaaaggcccccugagaaugaggacugaagcguacuguucauguccucccugaaguccucucugaccccagauggggccaugugugcccucgggccucccuauaucccagcucugcccacccuagguugucccugucuggggaugggucugucuccuacacuggggcugugagcccugcgcagcauggggccugcucucuccuggggcggccggaccgcucaccgaaggucagcaggaagccguagagcaugcugagcacccaggaguaccagcccuugugcuccagguacagaagacuguagacggcauagcagcccaggagcgggaagaggauccaggacagguaccggaaugccaucuguggggccacaggguggggcugucagccagcuccucagcccugccuggcagcccugcuccccgcccucacccaccacaccuggucuggcaggccgggcagggggaauuuccagguagcccuggggacuccggacucgcccagggaagcaguuauggcagaugggggacacagaggauguggcacaggcuguaaagcauggguccggcagacagauggccggccccgggugccucagggauacgugguaccuggagaccacccccaggggcccacugugcaggacacucacaucaucauacacuuuggucgaggacucgauauacguggacuuguccuugaaggauaggcgggggaagauuccugccacccugugcucucgguccagcuguggaugaggugggugccauggucaguugcuacgcuggcucccaccccacaagccagaaccagccccugcccuuccccaccguucccaguuccccugccccaugugugacccaaaaaauccccuggugagaaaauccccucaguccugggagugaggcacuugcugggaaucccccgggggccagcuccaggguccagcugggccacacuacccccucccaaccccugcagcucccgagacagcauggcgccccagccuuacccggacguccaugaccuuggugaucuuccagaggucgaugaggaccccaaugaagacgcugaccuggaccacgaaguuggucucguuguccaggauguagaggaggaccacgaaugacuggaaaacgccgaagaagacggagcgcacggacaggcccuccagggacugccggcuguuccagaacuggauaucugugcgcaggggguaggggggaaccaggaggcugaggaggugcugagacccuacugcagcucccucaggcccccuuggccugcauccucacacccugggguggggcuggguccucaggaggggugcugaacgagaccccucucucccaggaaggcucucauauucauugggugacccccagagcaccagacaggcggcaccccuggagcccucccauaggacgucagcacccagcaccccaaggugcagucccuugacugauggugacggugacuggugccauggacagggcucaccacgugccaggugcuaaggacuggucagggaagcugcuucccugaggccaaacagccuggcauggcagaaucugaagggacgcggggucugugccacaccauggugccagcucgcccucccugggaaggaagaucuguggcaugcacuucaagaccaccuccuccaggccccugcccugacaccgggaaggaacuggcucacagccaugcucaggaaacugaaaagggcccugggcuccagucuggagcuccuuccagugcuccgccuagaugcugccaaggauccaugucagcaugcuccucucugagcccuggucucaccacggacaccccucucuugaccccgcccggcugagcaucuaaccgcagccacaggaggcugagccaccacgucuguagcacagugguggagccaggucugcaguccugcagagucagggccagcucugcacucagggagugagggcugugaauucugguccaugugcacccuaccccaucccagagcucccccacaucccagagcucccccacaucccagagcucuggcacacuccauagccucaccccacccaccccugcccaucagaaugaccccugucccaacugagaagaaugggucuggagacaggguucugguggguucucgugggagcaguugggcccaagccucuccuuagaccagggaggccacacagcacuggugccaagugaggccugcgcccccugcugcaugacacuggggaggacagccuucuugugccucauuucucacuggaccccagccaagccagcuccuaggcagaagggucccgucucccagcgacagcugguagauggcuggcuggggucggcaccagcuccugugcccguaugacacugcauucuuccagaugguaguucucaauaauggcaagagcguccuuuuuuuuggaacagggugucacucuguugccuaggauggaguucaguggugugaucauggcucacggcagccuugaccuuucaggcccaagccucccgaguagcugagaccauaggcacacgcugccaugcccagcuaauucuuaaaaaaaauuguguagaaacgaaucucgcuuuguugcccaggcuggucucaaacuccggggcuuaggugauccucccaccuuggccucccaaagugcugggauuacaggcgagagccaccaccaggccggcaauagcaucuuaauaccaggaauacuacuacucauuccucuugccgccugcgggagcuacagggccgcaggccacuccuucagacuggggugcucugggcaaggaagaaguggccugcagggccuagaagaugagaguuggggcuggaaccaucugccccuuaggaaccgugugacugggcaagugacaucccugagccucuggcucccacagggcucaaggagcuacuggggaggguacccaggacagugccuggcauguggcugcuucuccucaaacgcuggccaucaguauggucagccuuagaaccuagggaccuuugggggacagugcuccuccuucccacuugggcaggccccguccacucagcccuaagcggccucccgcagcaggcagccugccgggcaggguggcgggagcagcuccggggcuucccugcucuuggcucuggaguuccccagcccugcuuccuggcaguauuggccuggccucugccccaccagcgggccagccccucccucagcuccacacccggugggugggaauuucuggguugggaguuuuggggccacugccccuccccagcucacuaggccucuggagaguggggcugagagaccccaggcagggggaggacauguggggagggaggggaggaggaagggggcagguccugucccccacccugcacagccucucacuagcccugggguccuguuccuaccauucuugaaggccaggaacucgaagacacugugaacgauagacacgaugauggugagcgccagcagguagggguuggucuccagcagggccaccugcaggggacacaugugagcacagccuguccccacccaggagcaccuucacuagcuuuugucccgagggcugccccuggggccgccuguagagggaggcugaaggugggccagccaggaggagacugggucagagaugggcagauggggagagagaggagggugacucacaaagacagaagagacggggagauggcacuaggggaagaggcagaggccaagggagugcugcggggagugggugaagggacacugggagccaggagcagagacccaacagugacgacagcccaggaggcaaagccgagccucacgccacagacacaggcugacauuucaggacccagugagauggcagagacacagaguuggagccagggccagggacacaaggucugggacagaaggaggaagggacaggucuggacccaaaggguccaacagaacagccuggggagaggacccccagucaucuagggcuggagggcugggugcccacuuccuuucacuguggagaagggaccugggagguugugaaacugugggcagaggagcaccaggcgggaggucccacagcccaggccuggcacacuuccucuuggccucuugcgcccaggaaggcaccgggaagucccgcccacaccggccgcacucaccuucaccgaguccugcuccucaucugacugcucguacaacucaucacccaggaaguuccagggcgacuuggugcucugggcagcauagagcugccagcgccaaagcgagagugggcagaaggagacgcggagcggcaggcuggccaggcucucguugaugggguaguaguccuucugcagguuccaguagucauugaaguagaugaugggauaguagucaccgcucacggcgucgaacuucacaucugcagcacguggggcaggggcaccauuuggcccgggcaggaggccaggguacccgcaggccucagaugucuggagagacccaacagggccccucuacagagacuggaggacaggggacauuucuaggccacaccaugaggagcuaaagggugccuugaccucagcagaggggacugaggcaaagggcaggcagguccccacugaagggggcagcuguggcucagcuccagcccacggcugcccugugggugaccauguaacccaguuuuauaaaauaagccagaaauuguggcuuuuaagugauacugccucaauuucaaaagcuggcaagugauaagacauuuuuugaaaacaguuugugggcuggauggcacuugauugcggaccgaugcuggcguguagaagucaguccugggguccccaggggugguggugugggagagggagaggacaugggaaggggauaggacagggugggagcuugggaggguggagcccuggaaagcucucucagggggacagggccaggagaagacaaggagauggaccccgagcacccucucaaaggcucugcaggcagcuggcagggcuggggagcuuacauugauccaggggagggggcacacugcccuucacccacggcguguggucguccacgauguugauggugauguuggggugccaaugggagaucaccuccacaggcccauaguccucagcccucugaggcaacauggggggaaggaccucagaggcagguggaagugcucggggacuaucacucucuguacacuuccuccccaggguucccgagaaaaucuuaaucuuugcuuucuuuuuuuucugagauggggucucacuaugcugcccaagcuggucucgaauucugggcucaagcacgauccucccaccucggccucccaaagugcugggauuagaggcgugagccaccauggacagcuucuuuucuuucuuucuuuuuucucuuuuuuggaagagauggggucucacuaugcugccugggcugaucuugaacuuccgggcucaagugauccuucugcuucggccucccaaaaugcugggaaaacaggcaugagccaucuccccugacaacccuggcagcagaauaucagccaccacagcaacugcuggcagaaggcucuccucccuaggcuuagagauuccgccacccaggacccuuccggccaccgacaggauccucccaccccacauguagaaaaccgagguagagguagaggcagggcuggcauccuaggccaggcugcgaagcccagccucaugacagcaggcuccacacacucuugcacgguggccucagcuccaugagcagggaccacccccccaacacaggaccacccgcagagagaggaagucucuuagugcccacugcagguuaaccacagauuaacugcccggcuccccagcccacugggagugacagcaacuaugaauccugcaguuccuacuaaagccauauucucgugugugugcuuggagccaggcugagcuugggcucuggggccuggcugugugggugagagucccuggccugccacuuccggcugagacugagcaaguguccucaugugacaaugggacugugauguagaccccucccaggcuggcaagaggcucagguaaccuugucugggauccuccucacucccugagagacagcugccuccugaccccauuucccagaggaggagcccagugcucagggaggggagguggcaugaccgagccggcauggugguucagugguggugacagaugacagccccaguggucugggaugagcugugaauggccuggcuuggucccuauaggcccugacaacccugcccauuuaccuugaucauuucuggguccgcuucugucucuccugucagcagguucuugguuuucugaaaucgucugcgcuuguauuuguugaucacugugguugggaggugggaaaggaggggacgugagaccugcuggcaccugcagccuccagagcccggaccccugcccaccagcaacggcucacggucuccuggcauccaccuugcacucaccugcugagaucaaugugaccuggaaugccagaacugccuccccaaaucucaacgaaucccaguuccucaugaucauggggacgccaccaucaccaaaugccccaggcagaaaccccagcucaguagggcacuguaaucccagcacuuugggaggcuggggcgggcagauccccugaggucaggaguuagagaccagccuggccagcauggugaaaccccccgucucuaauaaaaauacaaaaaucagccggaugugguggcgggugccuguaaucccagcuacucggaaggcugaggcaggagaaucgcuugaacuagggagguggagguuacaggaagcugagaucgcacuguugcacuccagccugggcaacaagagcgaaacuccguuucaaaaagaaaaagaaaacaaacaaacaaauaaauaaaaacaagugacugaucauggccaucccgcagcuuuggaaccccagacacucaccguagccccggugaccucucaacccucaccaccuuccacuucucaaacaugccaacccggggccuucaggcgugcugccccgugucccaggaacccaugcccugacacaaucuucguggccuggcuccuccguggcauucaagucccuggcagaauguccuucuuccacagggcuucccuggccaccccacugaaugagccuaugcagucauucuccugccagcuuguuuccuucacaacauuucaccacuauccaaaaccacuuagccagugguuuaccugccugcugucugucccugcaaccagucugcaaacucugugcggaaaugcggguaggggcagggccuguuugaauacacauggggcgccugcacaggcucggugaugaccaguugaauacaugacuauaaagaggcagcagacgguuccaaaaaaggccugaagccaccaacaugagaaaccaagaugagaaacacuuugaggcugugaauccccagccaggaguuggccucacuuccucucgcagaggcccaguuggccacaggcccccugccauguugucccaaaugcugccggggaggaaggggcuugugcgugcccacgcuccaucucccaaccucugcccuggccuggggacguuucuguuuuuuuucuggagacagagucucgcucugucacccaggcuggagugcaguggcacaaucucggcucacugcaaccuccgccuccuggguucaagcaauucuccugccucagccucucaaguagcugggauuacaggcgugugccaccaggcucugcuaauuuuuuguauuuuuaguaaagacaggguuucacuguguuagccaggauugucucaaucuccugaucucgugaucugcccaccuuggccucccaaagugcugggauuacaggugugagcugccgcaccuggcccgaaaagaagcuaaguauuuuucuuuuuucuuuucuuuuuuuuuuuuuuuuuuuuuuuuuuuugagacagagucucgcucugucauccaagcugcagugcaguggugugaucuuggcucacugcaaccuccgacucccagguuccagcuauucucccaccucagccuccuggguagcugggacuacaggcguguaccaccacgcccggcuaauuuuguauuuuuaguagagacagggugucaccauguugcccaggcuggucucaaucuccuggccucgugaucugcccaccucagucucccaaagugcugggaugacaggcgugagccacugagcccggggacuuuucagcucuuccuuaugcuaugaaggaaaacucagucugcccucccucaagucucuauccuguccccuggggccagggagagacagggaaaggggaaagagaccuggccaacagcgggggcucugggggcaaucuuggcucugaauccuacaagcuaagggaugcuggugagugaugucacuucccuaaagaaggaagaaaagccucaccacuucuuggcccagggccuacugcuuauuagcagaaacgucauccucauuuuuuuuuuuuuuuugagauggagucucacucuguugcccaggcuagagagcaguggcaugacuucagcucacuguaaccucugccuccuagguucaagcaauucuccugccucagccucccgaguagccgggauuacaggcauccaccaccaugaccagcaauuuuuguauuuuuaguagagacggaguuuaaccauguuggccaggcuggucucaaauucuaaccucaagugauccaccugccucggccucucaaauugcugggacuacaggcuugagccaccuggccaauccucaucauuucuaugauuauuaaaucauuggggaucuuccuccuguguccagggggagaaaccaacacucaaggguugacuuggagaaaauuccagggggacaugccccaaucguguccacaccugacagagacuguccagggaagggagagccccagagggcagcgcuggcugguggagggggaggcacaggggagagaggcuuuggcucaggcaaagaacacauucugcagcuuggaggcauccagaccagauggaccuggcuccuguggggaggaaaaagccccccuuucuuggaggaaaaucuucuagagcugcaccauccaguaucaggguugcuggccacaugcagcuacugggcacugcaaauauggcugguccaaaccaagaagugcuaugauauaaaacacacgcuagacccuuuuuuuuuuuuuugacauagucucgcucugucgcccagacuagagugcaguggcacgauuucagcucacugcaaccucugccuucuggguucaagugauucuccugccucagccucccgaguagacggaauuacaagcguuagccaccaugcccgccuaauuuuuguauuuuuaguauagcugggguuucauuauguuggccaggcuggucucaaacuccuggccucaagugauccaccugccucaaccucccaaagugcugggauuacagaugugagccaccgugcccagucacacacacuagauucugaaaacugacacaaggggaaacaaaaauguaaaauaucucacuuuuuauacugaucauauguugaaacgagaauauguugagcucaauuaaacuauuauugauauuaaucucaugguuuuucuuuaccuuuuuauuuauuuauuugugagacagggucuccuuuuguuauccaggcuagagugcaguggugugaucacugcagccucaaccuccugggcuugggugauccuccuaccucaggcucccgaguagcugggauuacaggcaugugccaccaugccuggcuaauuuuuguauuuuuauuaggggggguuuugccauguugcccaggcuggucucgaacuccuaggcucaagcaauccucuagccuuggccucccaaagugcugggauuacaggugugagccaucacggcccuggccuuaccuuuuuauuauuuuauuuauauuucuuuuugagacagggucucgcuuuguugcucaggcugaagugcaguggccugaucacaguucacugcagccuugaccuccuggacucaaaugauccuucuaccugagccuccugagucggaggacacuacagguugcgcaccaccauaucuggcuaauuuaaaaaaauuuuuuggcucacgccuguaaucccaacacuuugggaggccaaggcagguggguccccugaggucgggaguucgagaccagccugaccaacauggagaaacccuaucucuacuauaaauacaaaauuagcugggcguggugacacaugacuguaaucccagcuacuugggaggcugaggcagaauugcuugaaccugggagguggaggcuguggcgagccaagaucaugccacuguacuccagccugggcaacaagagugaaacucugucucaaaaaaaaauaaaauaaaauaggccaggcgcgcuggcucaugccuguaaucccagugcuuugggaggccaaggcggguggaucacgaggucaggagaucaagaccauccuggcuaacacggugaaaccuggucucuacuaaaaauacaaaaaaaccauuagccgggcgugguggcgggcgccuguagucccagcuacucaggaggcugaggcaggagaauggcgugaacccgggaggcagagcuugcagugagccgagacugcaccacugcacuccagccugggcaacagagcaagacuucaucucaaaaaaaaauaauaauaaauaaauaaaaugaaauaaaauaaauaaaauaaaauaaaauuuuuuuuuguagagaugaggucucccuauguugccagggcuggccucaaacuccugggcucaagcgauccucugacuuuggccucccaaagugcugggacuacaggcaugagccaccgugccuggccucucuuuaccuuuuuacucuuuaguauuuuucuauuggaaaaauuuuaaugccuucucuggcucacauccuaucuccaugggacggagcugcucuagaauacugauuauuggccucuuggggauaaaaggggcuuuucuuuucuuuuuuuuuuuuuuuuuuugagauggagucuugcucugucgcccaggcuagaguacaguggcacgaucucggcucacugcaaucuccgccuccgggguccaaaagauucucccaccucagcuucccgaguaacugggauuacaggcaugugccaccaugcccagcuaaguuuuguauuuuuaguagagacaggguuucaccauguuggccaggcuggucucgaaguccugaccucaagugaucugcuugccuuggcuucccaaagugcuggguuuccaggcaugagccaccacaaccagccaaaagggggcuuuucugaacucacacucuccuucacccuggaguuuguggguggcucacuccaaguccuucuaugucccugcuuugagggucccagcuccaaggcuggggagggaggccuggaugauccuaguaugcuuuucagguucacugucugcagguucuauuuuacagaccagacugacugugaauaaaccucaccacacagugacauggaucacacucaccaaagacaaaacugcagaaaauacuggcaucgauuugggucaacgggaugauuaggugaucgucaaacgggguacaagaauagggugaagagccacccaccugggucaccuucagagcgaccucugaaacaucgggcauuuuagcccagaccccugacguaucccccugcagggaaacaucugugagaccaacccuguaggucacacccccucaagccacuucugccugguucuccaaagaucucaccacauggacgucagccgggugggacauaccaacgcagcacauucuucagacacacucacucagaaaggggcucaaguaacuccagaagaccuuuccaagucauuucuagggacccacauagagucaacuuuucauuucauccaguauaggugauaaaaaaaaauuaccauccuuuaggauauuuuuguacuaaaagaaguagguaagaccuaacucauacaaauagaauucugucuguugcugcgccacccaaaaccagccagauggaucuuaaccaaauccacagggaaugucuggaauaguccucaauaaagugaaagcuagguggaguacacagaacucccguuagaagaauggggggcuuucugaggaagccauucuccagcuccgcucaaacagguacagcaagagauuucuacggcugcccaucaggagacagaggacucagggaaaaagcucacagagaaccaagcaaggcuggguguggcagcucacaccuguaaucccagcacuuugggaggccgaggcagacgaucacuugaggucaggaguuugagaccagccuggccaacauggcgaaaccccgucucuacuaaaaauacaaaaacuagccgggcguaguggcgugugccuguagucccagcuauuuuggaggcuaaggugggagaaucgcuugaacuugggagguggaaauuguggugagcugagauaguccacugcacuccagccugggcgacauagugagacccugucucaaaaaaaaaaaaaaaaagagccaggcaagcagaaagaugacaacaauuauuaacuucucgaaaacaagaggacggacaaugcuaugguuugaauguuuguccuggccaaaacucaugcugauucucccaccucagccucccaaguagcugggacuacugauguacucuaguacuccccacucccagugaaacuuaauccccaaugugccaguacugagagaugaggcuuuuaagaggugacugggucaugaggacccuccccucaggaacugauuaacccauucauggauuagugguuuaauggauuaaugaguuaucaugggaguagaagugguagucuuauuuuuuauuacuauuguuuuuucagagacguggacuugcucugucgcccaggcuggaaagcuguagugcaaucacagcucacugcauccuugaccucccagguucaagcgauccucccaccucagccucccauguagcuggaaccacaggugcucaccaccauaccuggcuauuaauuuuuguagcaacgaagucucauuauguugcccacacuguucuuugaauuuuaucuauuuuuuuuuuuuuugagacggagacggagucuugcugugucaccaggcuggagugcaauggcgugaucucagcucaaugcaaccuccgccuccuggauucaagcgauucuccugccucagccucccaaguagcugggacuacaggagcaugcuacuacacccagcuaauuuuuguauuuuuaguagagacgggguuucaccguguuggccaggauggucucuaucucuugaccuugugauucacccgccucggccucccaaaguccugggauuacaggcgugagccacugugcccggccucuaucuaucuuuuugagacagguucucggucugucacccaggcuggagugcaguggugugauucuggcucacugcaaccuccaccuccugggcucaagcgauccucccaccucagccuccugagcagcugggacuacaggcacacgcccagcuaguuuuugugucuuuuuugguagagacaggguuuugucauguuucccaggcuggucucaaacuccugggcucaagcaaucugcccaccuugucucccaaagugcuaggauuacaggcaugaaccacugcacccagcccacaaauuauuuuugagugucuacuucuaucaggccccuacugugcaaaagucaacccuggcccuucccccuuggugaaggacgucuccuccucuccaagagucccugucuccagcugcuuuuucuggccaauuucucucuggucccugagccuccgugggucucccuuccuccguggguaucccugcuuaguguccacagggcucuuucaggcuggguggggcuugagccugcccugccaaucccacccucuuugagcacaggcuuccugccugcccuccuggacuugggauuuguccgccacauuagccugggggcucccaggaugcuggccuccuggacaguggguccuggcugcaggggagcgacuuacuccgggacauguggacuguggcaagccggcgguacagggccuucugccgggggucuggguggaagccacucuuggugaaguaaacguggauguagauggagccguucugcuggacgcucugcaaaagacggaaggucaggugggcaggcugggcaacuggggugagggaaacguuaaagcccugccuggcacccaucugcagcaguuuccucccccucaacucucuggccauuuacugaguacucaggguggggcauguagcuggguggcagagagguaaaugcuggagucagacagacucagacgcccgcucuaccugccauggccgugugagcucagcuucucucugagccucagggccccaccuagaggaugcgaaguucccacagcacugacccgagggcaccacugcagggacuaccuggagcacuggcacacagcucagucaacgagcucucguuaagcucacucaacaggaagaagcagcugaccgacauggagcuccuacuaugggccagacccugcccugggcacuucagacaacagcuuccuaaucuaacgaguuaacacacauauaacaugucaaccuuaugcaaugggucauguuaccaccccauuuugcagaugaggcaaacggggcucaugccaaggggucacauaguguguggcaaguacgcagauggaaacccagucugugggcuccugggugcuacucccugcuaccuccagcuggccccucucugcccaagucuuccucauuaucucaucaagucuccuugccucccagggaagggggacuauucucacuugauccagaugaggaaacugaggcuucaagaagggaggcaaguuguccaggggcacuggguggagacaaaggcgagcacugaaccucucugauccuugugcagagcucgaauucaguuggccacauuguguucuccucacucucccuaucuuuuuuagagauggggucuuccuguguugcccaggcuggagugcacuggcuauuugcaguugcgaucauggcacacuacagucuuaaacuccugggcucuggccauucucccaccucagccuccugaguagcugugccuacaggcacaugccacugugcccagcucuccugccuuuuaaguccacuuggaccccacccugaagcuucgacuuagauccaagcccuuggaagcagaucccccugcugggccugccaggcccugguccuuccuuggaucucguggcaaggccugggggcugggcuugaggucucugugggagucaccucucagugcaggucagaaaguccagccagguggggugguucaugccuguaauuccagcacuuugagaggcugaggugagaggaucgcuugagcagaggaguuugagaccagccugggaaacauguugagaccccaucucuacaaaaaauuagcugggcaugguggugcaugccuguugucccagcuacuugggaggcugaggugaaaagauugcuugagcccaggagguugaggcugcagugagcuguaauugcaccacugcacuucagccuaggcaacagagcaagaccccaucucaaaaagaaaagaaugauggcuggacgcggugucucacgccuguaaucccagcacuuugggagaccaagguagguggaucacuugaggucaggaguucaaggccaaccuggccaacauagugaaaccuugucucuacuaaaaaauaaaaaaauuagcugggugugaucaugugugccuuagucccagcuacucaggaggcuggcacaugagaaucgcuugaaccugggaggugaaguugcagugagccaagguugcgccacugcccuccagacugggugacagagcgagacgcugucucaaaaaaaaacaaaaaacaaaaaaaaaaaccagaaugacuguguccacauucugcuucuagcuacccagacagaaauagaacagaaaugugcccuccaccccaaagcugagaaggccugcuggggagaaaggaaugagggcagcugucuuggacucagccgaagaaggccccaaagagagaugucccuuuuacuuguucaauacuugcugauucugcacccagccccacguugggcagugcuggggacauggaagugaucuaggcagccccagccuuauuaucacaaggcucacagucccauacaggagucccaaugaggccccagaaugggcugggauggggaagcccagcaggugugagaacccagagagggugcuuaaccaagccugagugcucugugagucagggagggcuuccuggaggagguuggauuugagccuagggcugcgagaguccacagccguagagccugagucugaaucucucaugcgauguggccuuggguaaaucacuuuccuucucucucaguuuccucacauguuaaaugagaauaauaacaguuccugcuucacaggguugccgggaaauuuccaugagucagccuagcuuaguacccugcacuuagcucaaucaacauuaacuaauauuauuuugaaacggggcugccugauaaacuggugauaggcaaacauccccaaggacaauuacuaaucuuucaccaguuuaaaguggaggacugcacaaccuuagagguagcugggagggucccaggccaauuccaccccuaucuaccuuuuucagguaggggaaagugaagcccagagaucucagggacuggcuuguggucacagaccaugugagcccagggaagggccaagccuggagcccaaacuccacaugcucucagcaaggagcggacuggaggaaaagguccuucagugccagucaagcagccauggggccagaaaccgagagcugcccccaccugugggauaucgagcucagcaaagugcucguagcagccgucugaguucucgccgcuaguccagucgccauacacaagaucgugcuguucccagaagagugccgacguggcguugaagucuguaaagugcucgugcucugagauguacacaugcagguucuguugggacaggaagggaacagagcucaggccugcucuucagagccucugcaggcuggcuaaagagcuauggcagcggucagcacacucaggggaacaguaauuauggaggacaggggagaggagagaggaagagcagcagagaggacauauuuucucuuuucucauaccaccauguuuguccuggucugagccugugaagucaacgaacaaagaacacuuggagacuggccagccugccaauuagaauuuagggguaggaaggggcaggagcucccugaaugaucuccugcccucauggcugcugggccuuccuggucagagcucugcaggcuuauggacgaagcaguccagagcuacaaaagcacugugagccaccgggcacgguggcucaugccugugaucccagcacguugggaggccaaggcggguagaccacuugaggucaggaguucgagaccagcguaccaaaaagguaaaaccccaucucuacuaaaaauacaaaaaauuagcuggacgugguggcacaugccuguaaucccagcuagucgugaggcugaggcaggaggaucacuggagcccgggaggcagagguugcagugagcuaagauuaugccacugcacucuagccugggcgacagagugagacuccaucucaaaaaaaaaaaaaaaaaaaacccacugugacccaacaagaacuuccuccuuucucaagccccaauggccauguuugcucagaaaagccuagacugacagaucuaaaugcuuuugcucuggaggcuccugaagcccugcccugccugugcccaagcccacuguggaagugcaggucuccucuccuuccgggcccaccuccugucagccucugcuggcucccugcccuccccaccucucacacucucucccuugcacaucucccucugcaacccugaaaggcugaacauacuuuugaaauauaacauccaaagacccugauuuaaccuauuuuaaccaaaugaauuugcuuuuucuuuugggugacacagguuuuaugugcuggggauggacccaggugacagaggucucacguguuggggaugggcccagaguuccucaacccuggaccuguuuuccuagaccugccagugagcaaggaccuggucugucccgacugcugacaucacuccuccacauuccaccccuccacaccccaucaccucccaagucugcccuaccacccggcaguuaccauuaaagugucuuuggggaacagguugcggcuggcgacgcguggagcuccuccggggcccgccugguccugaggggccggcccucggcggaaccaacugcugauggcccagaugaugaagauccugaggagagaagcagcaagguggugaguccccaagccuuggcucuccgccauagacccgccugacuuccuucugacuuagcacaugcuggcgccugaccuggggcuagugaccaagucagggaggcccugagaagguagucacagggcuggcaaggagauaagaugucccuaaagaccacaucuggggagggagcccagaugccaccguuugccaguguguggggguagcuggcacugcccuggucugcaugcagacccuugacucuaaauccugcaggagcuccuggugaccacagggcugcaggggcugacucuugacucagacugggaaaccugccauccagcccccugggaucccccgagaggagacuaagaaucuggaaccccuucagugugcagauggaugaauuaaaagaaaaaagaaauaaagaaaaaauaauaaacauaaaauuuuuaaaagaaagaaucuggaauccuagcgcuucaaaagcacagaaccggggaugguuaauggcuacaaaaaauagaaugaacgaggacgggcgcggcggcucaugccuguaaucccagcacuuugggaggccaaggcgggcggaucacgaggucaggagauugagaccauccuggcuaacauggugaaacccugucucuacuaaaaaauacaaaaaaauuagcugggcaugguggcgggcgccuguagucccagcuacuccggaggcugaggcaggagaauggugugaacccaggaggcagagguugcagugagccaagaucgcgccacugcacuccagccugggcaacagagcgagacuccaucucaaaaaaaaaaagaaugaaugagaucuaguauuugguagcaaaacacggcaacucuagucaauaguaauuuaauuacacauuuuaaaauaacuuaagaaguauagaggccaggcacaguggcucaugccuguaacuuugggaggcugaagugggcaaaucacgaggucaagaaaucgagaucaucguggccaacauggugaaacccugucucuacuaaaaauacaaaaauuaacugggccugguggugcgugccucuagucccaucuacuugggaggcugaggcaggagaaucacuugaacccgggaggcguagguugcagugagccgagauugcgccacugcccuccagccuugcaacagagugagacuccaucucaaaaaaaaaaaaaaaaaaaaaaguauaauugggucagguguagcagcucaugcuuguaaucccagcacuuugggaagcugaggcaggcggauugcuugagcucaaaaguuugagaccagccugggcaacaugaugaaaucccgucucuacaaaaaauauaaaaauuagcugggcaugguggcccaugccuguagucccagcuacuugggggacugaggugagagagucacuugagcccugacggucaaggcugcagugagacgugauugcgccacugcacuccagccugggagauagagagcuugucccaaaaaaauuaaucaauuaauuaauuaaauuuuuuaaaaaagaaaaggaaaagaaccgaaggcacagaagcuuagaaagagcaacauuucugaacuuuuggagaauuuuuggagaagcagauaguaagugauacguuaguuccaauuuuaguaacagugggcuuaauuauucagaccaacccucucacuggaaaaaauuggaaaagcuugauaaaauuaauacacuaagaaaauaucaauauauuuuauauuuguaauuauacauauugauagaaugagaauauaugcugcucacguauucucguauuuguucucaugcauguaauuuuuaucaaguuuacauaugaauauauauaaauagacagcucugaagaauggacacgacuguagguuaccaaaccuucaggcaaaaacugaagggaaagugggaauccuaaaguaguaaaggaucggccgggcgcgguggcucaagccuguaaucccagcacuuugggaggccgagguggguggaucaccugaggucaggaguucaagaccagccuggccaacauggugaaaccccaucucuacuaaaaauacaaaaauuagccaggagugguggugcaugccuguaaucccagcuauucgggaagcuggggcaggagaaucgcuugaacccaggagaaggagguugcagugaaccgagaucgugccauggcacuccagccugggcaacaagagcaaaaaguccaucucaaggaaaaaaaaaaaaagaaguaaaggaucuuggauuugcaggucuaggggaaaaaaaaaaaaagaauaaguaaaggagcccuauaagcuucuucauguguccgaggacaucugcuagguguuuuggugggugacaaaaaugcuggccuaggcugggcgcgguggcucacaccuguaaccccagcacgcugggaggcugagguagguggauugcuugagcccaggaguuugagaccagccugggcaacacacaguuucuacaaaaaauacaaaaauuagccaggcauggcagcacgcaccaugccuauauucccagcuacucaggaggcugaggugggagaaucaccugagcccaggaggucgaggcugcagugaaccacgaucaugccacugcacuccagccugggcaacagagugagacccugucucaaaaaaaaaaaaaaaaaugcuagcccagggcacauacaacauaugagguaaccagagaccuacccuauaggaaacuaagaccccacaaggugcaagccuccaccccugagaaggaaggaaccagguggccuacccauucccaggaguugcacaacagguaugcagggcgaaguaugcaaggccacucgugggauaaggagucacgaagggcagcucaagcccugaaccuggugcaaggaaaccuaggacuugguaaugcccccaggcagaagcaaaggcaauccucucuguaggaaaauaugcucauccuagcccugaaauuccuacaaauaacuuuucaaguauaaugacuaggacacagacagagauaagccaggcacaaaaggaaacgacauuaugagcgagaaucagcagcaacaacagauaccaaaaccaaaacgaggcugggcgugguggcuuacaccuauaaucccagcacuuugggaagccaacacuugaggucaggaguucgagaccaaccuggccaacauggugaaaccccaucucuacuaaaaauacaaaaauuagccgggcgugguggcgggcgccuguaaucccagcuacuugguaggcggaggcaaaagaaucgcuugaaccugggagguggaggucgcagugagccgagaucaugccacuggacuccagucugggugacagaguaagacuccaucucaaaaaaaaaaaaaaaaaaguguccuuaaagagaagaaauauuccuucuugauuuauucuucucuccuguugccuggaguguggaugugauggcugaaucuucagcagcugucuugggcuaugaggauaaagggaaaaaccuagcaauggcacaacaaacagcaaggagucugggucacugaagacugcagaauccuagucugccuccauccagacugguauaucagagagaaaugaaccuguacuguguuaauggagguuucucagcugcaugcagccaugugauuaaaugauucaaguacuuauuaauuauagguaugauaaccauacagcagaagagguuaugagcccagccucuaaacuacaguaucuucaucugaagcccagcucugcuacuuacugugaccucaguggucaacuucaaugguugaaauggggauaauaacagugccuacucucauaggguaguuuauaagcauuaaacacauuaaauuauauauauguuuauauagcguguauauacaucugacacacgcacacguaccucagaauggagccuggugcauacccaguaagugacugagaaguguuagcuauuacuguuauuuuaaucauaggaaaaaggcauacaaaaaacuuuggagcagaaaaacacuaugaguaaauucuaguguggguggggugccucccugcugagcccugaucaggggcaggaucaggcacaggaacuugccucugccuguagaagccacaaggcccugggguccagggucuuaggggccacgguccagcugagccaucgcuaccuccccaugaagucccugauaugcacgucuggggaaggucuggaccuggcaaucucuggggauaccgaugccuccagcagaggcucucauuuuaguaaacacaccaggggagaguguagaagcagugaugcccccaggcagcucugccccuggcuuaguguguggcuguggggguccuaaccccucugggcuucuagauccccauguauaaaacaaggccaggccuuuuuggauuccagauccccaguccccugaagaacguccuguguguauccacacgcccacaguucuguggacccucucagagggcucauggccauggccccucauccaugcacccaggccugcaggagacuggaccuuucuaaugcuuccugauguacuugaguaagcaaagaaaacagacauuaaauccuuucucccacccaaauagguauucuacagucacagguucagaacauuuuuaaauauaugaaaagacguauaaucaaaacucucccucccaccccauuccuuuauauacccaguuccugcuccaccucccacuccagguaaccacaugugcucaaaaacacagacgccacccgcuaucuagaaaggcuauucccacauaaucagcuucaagcuacaaggaguucaugggccccugaaaacaaacccuggaucccauuuuaagaacugcagccaagauggucuccgagcacccacccgaacugauguuugaugcugccuaguucuaagaaaggaaauuagccuacagugugacuuguauuaaaaaugucucucugaaggaagcucccuaugcacugacguggaaagauuucaaagauauauuguuaaugaaaaaaaucaaggagcagaacaguguguaaaacaggcuaccucuuauguaaaaaugaagggaaagauaaaaauaauuuucaugcagagcugcuugcagcaugaaaaaaaagaaggugauauauaagaaaaucugaagucuuuacguggccauggggaggggaggugaaguggagacgguaagggacaggggcgcaugacugagaagcguagggcacauggcaggaauuuuugaggcacacaugucaguuuugcaacuuaacagaguggggagguuucuuuccugcaguuucucaguguccugugugacacucuuggaggacaccaggcaggcaguucugcucuagucuagaaugugaucagugacuacaucagggaucaugaguuguuuuuuuuuuuuuuugggacagaguuucacucuuguugcccaggcuggaguaaaauggcaugaucucggcucacugcaaccuccgccucccggguucaagcgauucuccugccucagccuccugaauagcugggauuacaggcauaagccgccaugcccggcuaauuuuguauuuuuugcagagauggguuucuccauguuggucaggcuggucuggaacucccgaccucaggugauucaccuaccuuggucucccaaagugcugggauuacaggcgugagccacugcacccggccucaugaacuuuuuuuuuucacuguuucacuauauauuuccuaagguuuuuguuuguuugagauacagucucacucuguugccuaggcuggagugcaguaguaucaucacggcccauugcagccuugaccuccugggcucaagcgauccucccucuucggccucccuaauagcuggcacuacaggugugcgccaucacacccagcuaauuuuuuaguuuuuuacagagauggggucaggauaggcgcgguggcucacgccuguaaucccagcacuuugggagcccgaggugcguggauagcgaggucaggagaucgagacuauccuggcuaacacgaugaaacccugucucuacuaaaaauacaaaaaauuagccgggcgcuguggcgggcgccuguagucccagcuacucgggaggcugaggcaggagaauggcgugaaccuaggaggcggagcuugcagugagccgagaucgcgccacugcacuccagccugggcgacggagcgagauucugucucccaaaaaaaagagagagagagagagagaugggggucuuacuguguugcucaggcuuuuuuuuuuuccacguugaacaacaaaaggaaucauggccaacauugucugugugcgugccagcuccugcaccccucaguugacaugaauucucuuggaauccuucugaugcacccugagcuaauugucaagauucccugucugugagguggaaaaugaggcucaagaagggugauaaccugaccaggccacagagcucagagguggcagggcugagaugucagcagggcugugcucuuacacgcuaucugacacuaccugccccccgccuccuaacuuuucucuauuuuaaacaacucuaucugugagcaucuauauauaaucccauuuagggccaauuacaaaaaugugugccuaugggauggccaccaacacauuacacuuuuuuauuuuugagacugugucucgcucugucacccaggcuggagugcaguggcggcaucuuggcacacugcaagcuccgccuccuagguucacgccauccuccugccucagccucccgaguagcugggacuauaggcgccugccaccaugcccggcuaauuuuuuauauuuuuaguagagaugcaguuucacuguguuagccaggauggucucgaucuccuaaccucgugauccacccaccucggccucccaaagugcugggauuacaggcgugagccaccgcgcccggcccacauuacacuuuuucauuagcuuuuucuuuucacucuucguauuguuugaacuacuuaauuuuguaaaauaaacacucauaauuuauaagcuaagggaaaccaguaauaagauuuuauggaagagauaaguagcugccccccauaaccacucuccucuucuuccucaguaauaggagcccugcuuuccagcagggugcucaguuucccagauuaaagaccacauuucccagccucccgugcagcuggccauggccaugugaagacauucuagccaaaggaaugauuguuuuauuuuuuuauuuuuguuuuauuuuuugagacggagucucgcugucgccuaggcuggagugcaguggcaccaccugggcucacuguaagcuccgccuccuggguucacaccauucucuugccucagccuccugaguagcugggacuacaggcgcccgccaccacaccuggcuaauuuuuuuguauuuucaguagagacggcguuucacuguguuagccaggauggucucgaucuccugaccucgugaucugcuugccuuggccucccaaagugcugggauuacaggcgugagccaccgcgcccagccaugauuguuuuauuuuuauuuucucuuuuuuuuuugagacucagucuugcucugucgccaggcuugagugcaguggcacgaucuuggcucacugcaaccucuaccucccagguucaagugauucuccugccucagccucccgaguagcugggacuacaggcuugugccaccacacccagcuaauuuuuguauuuuuaguagagaugggguuucaccauauuggccaggauggucucgaucucuugaccucaugaucugccugccucggucucccaaagugcugggauugcaggcgugagccaccgcaccuggcgggaugauuguuguaaacaucucugcugugcaauuccuucuaucucauaaguagggaagcugauugccuaacugcaugguguggucucuuauuuugcuaaaauacaucuccaaaaagcaaaaaaaaaauaaaaggaauaucuauuuugcagaggaguaaacaaaggcucagagcaaagaaggugacugucacuaggucuaggcaggaaggauagaacccagugccaagcauauucccccgccaccacccagcaucuccccagggccucaaacagaagcugggcuuugaaaaaacaggcccuggggucccacugcccaggaauagcaugugaacccacagguaaaagggucaccaccaggcagucacagaaggacaaaugcugucugauuccacauacaggagcuaacuagaguagugaaagagagacaggaaauagaaaaguggcugccagguguugcaaggaggaagaaaugggaagcuugugucugauggguauggaauuucaguuugggaagaguaaauucucgggauggauaauggugaugggggcacaacaguggagauguacuuaaugccacaggacuacauacuuaaaaaugguuaaaaugggccaagcgugguggcucacgccuauaaucccaggacuuuaggaggcugaggcggguggaucaccugaggucaggaguuagagaccagccuggccaacacggcaaaaccccaucuccacuaaaaauacaaaaauuagccaggcgugguggcaggugccuguagucccagcuacucagguggcugaggcaggagaaucgcuugaacccaggaggcagagacugcagugagccgagauugcacuacugcacuccagccugggugacaaagugagacgcugucucaaaaaaaaaaaaaaaaaaaaaaaaaaaaaagguuaaaaugaaaacauagguuaaaaugguaaauuugauguuaugugcagaugugggcugaaucaugucucccaaaauucauauguuaaagucucaaccuucaguaccaccgugacuagauuuagagacaggguccccccaacuuuuuuuugcgauaaggucucacucugaugcccagacuggaguacaguggugugaucucggcucacugcagcuucaacuucugagggucaggcagggcccaguggcucacgccuguaaucccagcacuuugggaggcugaggcggguggaucaugaggucaggaguucgagaccagccuggucaacauagugaaaccccaucucuaauaaaaaaaaaaaaaagcaaaaauuagcuaggcacugggugcaguggcucacgccuguaaucccaacacuuugggaggccaaggcgggcagauugccugagguugggaguucgagaccagccugaccaacauggagaaaccccaucucuacuaaaaauacaaaauuagcugggcaugguggcacauaccuuaauuccagcugcucaggaggcugaggcaggagaaucgcuugaacccaggagguggagguugcagugagcugagaucgcgccacuguacuccagccugggaaacagagcgagacuccauuacaaaaauaaaaauaggcugggugcgguggcucacaccuguaaucgcagcacuuugggaggccaaggcaggcggaucaugaggucaggagauagagaccauccuggcuaacacggugaaaccccaucucuacugaaaauacaaaaaauuagccaggugugguggcgggugccuguagucccagcuacucgggaggcugaggcaggagaauggcgugaacccgggaggcggagcuugcagugagccaagauugugccacugcacuccagccugggcgacagagcgagacuccgucucaaaaaaaaaaaaaaauacauaaaauaaaaauaaaaaaauuuccaaggcucaagugauccuccuaccucagccucuugaauagcugagacuacagguacgugucaccauaccuggcuuuuuuuuuuuuuuuuuuuuugagauggagucucacucuguccccaggcuggaaugcaguggcacgaucucagcucaccgcaaccucugccuccuggguucaaacgauucuccugcccucagccuccugaguagcugggacuacaggcacgugccaccacacccagcuaauuuuuguauuuuuuuuguauuuuuuauuuuuuuugagacggagucuuucucuguugcccaggcuggagugcaguagcgcgaucucagcucucugcaagcuccgccucccggguucacgccauucuccugucucagccuccggaauuuuuuuauuuuuaguagagaugggguaucacuauguuggccaggauggucucgaucucuugaccucgugauccacccgccucggccucccaaagugcugggauuguagguguaagccaccgugcccagccagauuuuuuuauuuuuaguagagacagggucuuacuauguugcccaggcuggucucaaacuccugggcucaagcaguccuuccaaccuggccucccaaaaugcugggauuaugagggugagucauugugccuggcccagauagggucuguaaaaaaguaagguucagugaggucauuaugguggguacuaagccaguaugacuaguguccccauaagaggagcuuaggacacagacacacacagaggaaagaccacaugaagacacagggagaagacggccuucugcaagcccaggagagaagccacagaagaaacugccccugcccacagcuggauccuggacuuccagccuucagaacuguaagacaaugaauuuccuauuucaguuguuuaagcuacuccgucuauauuacuugauacaagggcccuagcaaacuacuucaguauuuuuuguguuuuuauuuuuucacaaaucagguagccccccaaaaaccagaacagguucagggagacucccuacuucaguauguuuuaccagaguaaaaaaaagguuuagaaaacauuccaucauacaaaaaaaaaaagaaaaaaagcaacucuaccauacaguaaugaucaccauccucagcugaucagcugacuuuuccuuucuuccuuauuuuuauuugaauguuuucggugaacaaacccaagucccgucugcucaccuaaacagcacaccuuugaugaccugccaggcauugggugccggcugggccgguggguucugaggcugggucuccgcuggcgggucccucccgaugcugccauugcuggucaccugugggggacagaggccaggguaaggagggagaauggacacgggggcugucuuagacaccaucaugcaugaaggccaggcacaggcugggcaaagagugggugcuuaucaauaacuggagaaugaaucagugaaaacaccugggaaggugcgguccucuucuuuuaggaggaaaacacucgcagagcaccucugugaccuagggacaguggugaccuagagagucuuuugcuguccuccugggguuuaacagcccggugggggagaaagauucaucucuagacagugacuguccagaacggggcaggaaugcaggagcccugagaggcaccugguccagucuaggguucggggcaacuuccuggagaagggggcauugaagcugagaccuaaaacauagcaaguugguggcacaaaggaggaagugagagaagcagcaggugcagaaacagaagauuagaggcacagucugauucugaugacuguccacuguucccuggggcuggagccaggaugcaaggagguggcuauuggggacaacaacagaaggagucuuauggcaggugccagauucuucaaggcuggggcuuagcugaaagagccuucccugggcaaaccauuccugaggcccccucuguggccaacccugcccuccaagggccccugguccagcaggugggacagacacagaaaaacacaaccagacuaucagcugcuaccauaagccacggccacaagacaugucugugacagcacacagcacacuaauccugaggccaaaacuaugaccagcuccauccggcugcugagcaaagggaggcucagagaggugaagccacuugucuggucacucaggaaggaccgcagaagcagaaugacagaagggaaggggggcaggcaagggagccaggcacggcuucccagaggaggacucuucacucagacacagaaggucacaaucagagacucucugaaugccagguuuggaaggggauguucugcucacccuucacgcacccugcuagcuccccaguccuguucucauucaccccuccucccagcuguccccucagccaucagccuucaagaggcaggaccagggcuaucacagucacaguuagcucaagagcaccaguggcacagagcaaggcugugauaaacaccuguguggccaccgcugccugaaggacucaccccggacgcucaggucacccaaacccacuucccucugaggcuccagugucuggcccucuccuccacagccccuaguccacuccucugcaauguuuucuccauucaccuuacccaccagauagcaaaugucccaggagcaugguuagaggggcuacauguguuaaaugugucacuugucaccuccuguccccuucaccagcaagagcucuuuccuguaaucucccaaagcacaggacaccauuggaggggcuccagggucaaacagaccucagcuauaguccuggucccaccguucuuggcugugacaccuugggcacaucacuucaccucucugaccuguggaccagguugugaaaauacuggaacauuuuagacagaaaucugggcccugcuuacccagagcuggggaucuagaaggaaacacacuagaacgguaaacaggauaauuaaaaaugguacauggaaaacaagcagggggaagugacagcaacugaguugggaacagggauccacuuuggaguggguggucagagaggccucccugaggagcucccuuugacgucugggucgucugggugagacccuuaggcugagacagagaaagccacauucugaugaggagaucuauggggcgggggucggcuggggaagggaaaucagacaggcacaaggcccccuccucaaggccagccuagcuauugggaaauuuagggguccaaguauggguuucaaugggucugagcugauuuggggucaggaaaggacacuugaugccaggucaggauuugaagcugcaucugacugacucccaggucucuucgcuuacccguuagugaugggcaaucuggcugggaaccuucccacggaaaggcaaguuaaaaccacaaugaggugucacuucacaccuauuaggauggcuaucagcagaaagacaaucacaagugcuggcagggauguggaaaaacaggaacccucguaugcugcuaggggggaaaguaaaaguacagcuacuucggaaaauauggcaguuauugaacaagucauaugugcaccuacuacacaauccagcaaacccauccugaauggcuacccaggaggcagaaaacaugaagccagaccaggcgcaguggcucacgccuauaaucccagaacuucaggaggccaaggcaggaagacugcuugagcccaggaguucaagaccagccugggcaacacagcaagaccucaucucuauaaaaauacaaaaauuagccaggugugguagugcaugccuguggucccagcuacucaggaggcugagacgggaggaucaauugagccuuggagaaugaggcuacagugaaccaggaucacaccacugcacuccagccuaggcgacagagcaugacucugucucaaaaacaaacaguggccaggugugguggcucaugccuauaauccuagcacuuugggaggccaaggcaggaggauccauugagcccaggaguucgagaccagccugagcaacacagggagacccugucucucuuacuuagaaaaaaaaaaaaagaaacaaaauacagccacagaaaagccuguacaugaauguucauagcagcauuauuggcaacagacaaaaacuaaaaacaauccaaauauccuucaaggacugaaagaauaaacugugucaugucugcagacuaccacugagcagugaaaaggaacaacugugagcacguacuuuaggauuuccccaaaggccaaauuucccugauccuagguuguaaaaaauaaaauaaaaaugaacaacugcagaucuauguaacaacaugaaccucaaacccauuaugcccaaugaaagaagcuggacacaaaagacuggauguuguuuagauccuuguuuaagacauuuuuagaaaauuacagagauagcaccucuguggcugccuaggauugggagcagcagagacuguaaaagggaacuuuuugaggggacagaagcuuucucagaccagacuguggugauggcugcaccacacaacugcauaaauggaccaggagccaauggacucuauccuaagaacaggugaacguuauaccaucuaaauuauaccacaaggcuggacgugguggcucacgccugaaaucccagcacuuugggaggccgaggugggcagaucaccugaggucaggaguucaagaccagccuggccaaccuggugaaacccugucucuacuaaaaauacaaaaauuagcugggugugguggcaggugcuuguaaucccagcuacuugagaggcugagguagaagaauugccugaacccaggagacggagguugcagugagccgagauuguggugagaaagcgagacuccgucucagaaaaaagaaaaaaaaaaaaagagucacucuuuucagcuccuauuucccucagaguaaaggccaaguccuccccauggccuccaaagcuuggcauaaucugcaucuguccccagccaccccucuccccucacccgcuccagccuccucgcccuuccuucaucacaccaggcaccucccacuuuagggccuucgcacuggcugcuccuuugccugaaaagcuuuucccucguguaucuuugggacucccucucucacuuccuucaggucuuuguucaagcgucaccuccucagagaggccuucuagacuacccuauuuaauugcaacucuucuacccaccccucacuuccuauccccaucccagcuuuauuucuguccauggcacgcagagccaucugaacugcuguuuuucuuauuuaucuuguucacugugugucccugucugugcuuccccuauaaauucagcuccaacuagaacauaaguguaagggccuucaagagggcagcaccuauuuuauucacagcuguaucuccagcaucagcaaaggccuagcauggaguagacucaauucgcauucgcugaaggaaggaauggcaaagcuguggguucuguguccgaguuccuggcuacaggagcaggcuagcuaaagcagcagacugugcagagggugugccugcugugcacuaggcccugggcaugggagaaggguggcaguggcuguggacacaucagugacuaagacacaguuccugcucucggaucugcacguccacgcacacacacaauccccagcaacaucugcuaaaggguccaagaaguagcugagaccaccagggcuaggcaagagcaggaggaagcuagguuuugcggcaugucuucacugauuaccuggauccaccacggcaucagggaauuccaccucagcccagccucuguuucaagauccgcucauuccacaaacacugagcaccuccucugugccuggcgcugagcugaguggugcuaaggaagcaguggugaucaaggcaguccuggcucugcccuccugggguucccaguccccagacagugaaacccaguagggcagggcugggacagcggagcccagacagucaaagagggcuuucugcaggaagggacaucugaaaucuguaggacuaauacacaucaacuagcuaaagaggggagagaccugugcauagacuaugaggaaagagacugagaggcaauaaaagagguuuagaaauaaaauagguucagagcagcggauccccuuuagcgcaguuguucucacgcagggauggcuuugccccccugcucuuggaacauuuggcaaugucuggagacauauaugguugucacaacuggggaggggcguggauccuacugacaucuagugcguagaggccacggaugcugcuaaacauccuaaaaugcacagggcagccccccaaacaaagcauuauccaauucaaaauguugauagugccgagcucgagaaauccuagucuagucugaagaaaagugucggaucgugcaagacugugauuuauuaaagaauuuguacuuuguccuaaaggcaaagggguaacucuugauuguuuuuaagcagaguugguacaagagaagaucagagugccaucuggaagcucagggcaaugagaacaaccugggcccuggucucucaagccaccaucaacccaauaaucaacagaaacccagaggggaaacgaccuccuuucagcaagacugggaaacccuugaagacaggaacugagccuucauuccagcacuaacucaacaaacauuuccuaagcugucccugaagccaggcccuggcugagaaugcugaaaagauucagagcagauacagugggcucuaucacacaaauuucauccauguguccuacccaagugauaccacuugcucuuucucugggcucccccagucccugacacagacuuuugucaccaaccuaaucauucaggauuacaacuguuuacaugucagucuccucucuucguccccugacagcagggauauggcuggcccuccuguccaaccucugcauuuaacacgggagagauaaaggccuaaagagggaaaggaacuugcccaaggucacacagagagucagcuucauucuccccucucaacccgcacuccuuuccccugagcugccucccacaugucagugacaucccagugggugggucgacagcaccuucaugucucuccaucuauuccccaaaugccugaacgguagcugccugaaaugguaugcucugcaguguguuaagacagcaguggggcagaagucauccgcaccaggacuaauuaacccauagaacuauuuuacauuaaaaccacaaccauaccagucccugugucagcagugucuuguaacuucuacauaaaguuacaaaccuaaccaggaugaccuucuagaagcgccuuagucucacuguuccuugaauucccgucuguaaaaugggucugucggccgugcccugcuaauacugacuuccccacagcuagaaaacucccaauuaaucacugcgcacaccucaaacacuacaacgagaccugaacgccagaccacucuaggaacggccucagagcauggaaucgcggaguugagaacccagcgcgccaagguacaagccugcgccccuccgagccacugucuccccggaucgagcaaugagccugguggccgcccggcucgagcgugcaggggaaccgacccgcaacagggcccuguucccggcaccguccggccucccgggcgguccggcccugccugggccggguauucaaggucccucuggccaaggagcccccagugcacgggauuccgugacaagagguaggacacgccccgugggaggccccccggcuggggaagaacccccucaguccccucucggccuccguaccugaccggagcugccucccccggccgccaccacggcgcugcgggccccguccgccuccugcgccgccgccaucuucccgcuccggguccccgcccccgccgccagccccgccccguccccgacuuc

SEQ ID NO: 191727 - RNA, 38006 nt, Homo sapiens
gaagucggggacggggcggggcuggcggcgggggcggggacccggagcgggaagauggcggcggcgcaggaggcggacggggcccgcagcgccgugguggcggccgggggaggcagcuccggucagguacggaggccgagaggggacugaggggguucuuccccagccggggggccucccacggggcguguccuaccucuugucacggaaucccgugcacugggggcuccuuggccagagggaccuugaauacccggcccaggcagggccggaccgcccgggaggccggacggugccgggaacagggcccuguugcgggucgguuccccugcacgcucgagccgggcggccaccaggcucauugcucgauccggggagacaguggcucggaggggcgcaggcuuguaccuuggcgcgcuggguucucaacuccgcgauuccaugcucugaggccguuccuagaguggucuggcguucaggucucguuguaguguuugaggugugcgcagugauuaauugggaguuuucuagcuguggggaagucaguauuagcagggcacggccgacagacccauuuuacagacgggaauucaaggaacagugagacuaaggcgcuucuagaaggucauccugguuagguuuguaacuuuauguagaaguuacaagacacugcugacacagggacugguaugguugugguuuuaauguaaaauaguucuauggguuaauuaguccuggugcggaugacuucugccccacugcugucuuaacacacugcagagcauaccauuucaggcagcuaccguucaggcauuuggggaauagauggagagacaugaaggugcugucgacccacccacugggaugucacugacaugugggaggcagcucaggggaaaggagugcggguugagaggggagaaugaagcugacucucugugugaccuugggcaaguuccuuucccucuuuaggccuuuaucucucccguguuaaaugcagagguuggacaggagggccagccauaucccugcugucaggggacgaagagaggagacugacauguaaacaguuguaauccugaaugauuagguuggugacaaaagucugugucagggacugggggagcccagagaaagagcaagugguaucacuuggguaggacacauggaugaaauuugugugauagagcccacuguaucugcucugaaucuuuucagcauucucagccagggccuggcuucagggacagcuuaggaaauguuuguugaguuagugcuggaaugaaggcucaguuccugucuucaaggguuucccagucuugcugaaaggaggucguuuccccucuggguuucuguugauuauuggguugaugguggcuugagagaccagggcccagguuguucucauugcccugagcuuccagauggcacucugaucuucucuuguaccaacucugcuuaaaaacaaucaagaguuaccccuuugccuuuaggacaaaguacaaauucuuuaauaaaucacagucuugcacgauccgacacuuuucuucagacuagacuaggauuucucgagcucggcacuaucaacauuuugaauuggauaaugcuuuguuuggggggcugcccugugcauuuuaggauguuuagcagcauccguggccucuacgcacuagaugucaguaggauccacgccccuccccaguugugacaaccauauaugucuccagacauugccaaauguuccaagagcaggggggcaaagccaucccugcgugagaacaacugcgcuaaaggggauccgcugcucugaaccuauuuuauuucuaaaccucuuuuauugccucucagucucuuuccucauagucuaugcacaggucucuccccucuuuagcuaguugauguguauuaguccuacagauuucagaugucccuuccugcagaaagcccucuuugacugucugggcuccgcugucccagcccugcccuacuggguuucacugucuggggacugggaaccccaggagggcagagccaggacugccuugaucaccacugcuuccuuagcaccacucagcucagcgccaggcacagaggaggugcucaguguuuguggaaugagcggaucuugaaacagaggcugggcugagguggaauucccugaugccgugguggauccagguaaucagugaagacaugccgcaaaaccuagcuuccuccugcucuugccuagcccugguggucucagcuacuucuuggacccuuuagcagauguugcuggggauugugugugugcguggacgugcagauccgagagcaggaacugugucuuagucacugauguguccacagccacugccacccuucucccaugcccagggccuagugcacagcaggcacacccucugcacagucugcugcuuuagcuagccugcuccuguagccaggaacucggacacagaacccacagcuuugccauuccuuccuucagcgaaugcgaauugagucuacuccaugcuaggccuuugcugaugcuggagauacagcugugaauaaaauaggugcugcccucuugaaggcccuuacacuuauguucuaguuggagcugaauuuauaggggaagcacagacagggacacacagugaacaagauaaauaagaaaaacagcaguucagauggcucugcgugccauggacagaaauaaagcugggauggggauaggaagugagggguggguagaagaguugcaauuaaauaggguagucuagaaggccucucugaggaggugacgcuugaacaaagaccugaaggaagugagagagggagucccaaagauacacgagggaaaagcuuuucaggcaaaggagcagccagugcgaaggcccuaaagugggaggugccuggugugaugaaggaagggcgaggaggcuggagcgggugaggggagagggguggcuggggacagaugcagauuaugccaagcuuuggaggccauggggaggacuuggccuuuacucugagggaaauaggagcugaaaagagugacucuuuuuuuuuuuuucuuuuuucugagacggagucucgcuuucucaccacaaucucggcucacugcaaccuccgucuccuggguucaggcaauucuucuaccucagccucucaaguagcugggauuacaagcaccugccaccacacccagcuaauuuuuguauuuuuaguagagacaggguuucaccagguuggccaggcuggucuugaacuccugaccucaggugaucugcccaccucggccucccaaagugcugggauuucaggcgugagccaccacguccagccuugugguauaauuuagaugguauaacguucaccuguucuuaggauagaguccauuggcuccugguccauuuaugcaguuguguggugcagccaucaccacagucuggucugagaaagcuucuguccccucaaaaaguucccuuuuacagucucugcugcucccaauccuaggcagccacagaggugcuaucucuguaauuuucuaaaaaugucuuaaacaaggaucuaaacaacauccagucuuuuguguccagcuucuuucauugggcauaauggguuugagguucauguuguuacauagaucugcaguuguucauuuuuauuuuauuuuuuacaaccuaggaucagggaaauuuggccuuuggggaaauccuaaaguacgugcucacaguuguuccuuuucacugcucagugguagucugcagacaugacacaguuuauucuuucaguccuugaaggauauuuggauuguuuuuaguuuuugucuguugccaauaaugcugcuaugaacauucauguacaggcuuuucuguggcuguauuuuguuucuuuuuuuuuuuuucuaaguaagagagacagggucucccuguguugcucaggcuggucucgaacuccugggcucaauggauccuccugccuuggccucccaaagugcuaggauuauaggcaugagccaccacaccuggccacuguuuguuuuugagacagagucaugcucugucgccuaggcuggagugcaguggugugauccugguucacuguagccucauucuccaaggcucaauugauccucccgucucagccuccugaguagcugggaccacaggcaugcacuaccacaccuggcuaauuuuuguauuuuuauagagaugaggucuugcuguguugcccaggcuggucuugaacuccugggcucaagcagucuuccugccuuggccuccugaaguucugggauuauaggcgugagccacugcgccuggucuggcuucauguuuucugccuccuggguagccauucaggauggguuugcuggauuguguaguaggugcacauaugacuuguucaauaacugccauauuuuccgaaguagcuguacuuuuacuuuccccccuagcagcauacgaggguuccuguuuuuccacaucccugccagcacuugugauugucuuucugcugauagccauccuaauaggugugaagugacaccucauugugguuuuaacuugccuuuccgugggaagguucccagccagauugcccaucacuaacggguaagcgaagagaccugggagucagucagaugcagcuucaaauccugaccuggcaucaaguguccuuuccugaccccaaaucagcucagacccauugaaacccauacuuggaccccuaaauuucccaauagcuaggcuggccuugaggagggggccuugugccugucugauuucccuuccccagccgacccccgccccauagaucuccucaucagaauguggcuuucucugucucagccuaagggucucacccagacgacccagacgucaaagggagcuccucagggaggccucucugaccacccacuccaaaguggaucccuguucccaacucaguugcugucacuucccccugcuuguuuuccauguaccauuuuuaauuauccuguuuaccguucuaguguguuuccuucuagauccccagcucuggguaagcagggcccagauuucugucuaaaauguuccaguauuuucacaaccugguccacaggucagagaggugaagugaugugcccaaggugucacagccaagaacggugggaccaggacuauagcugaggucuguuugacccuggagccccuccaaugguguccugugcuuugggagauuacaggaaagagcucuugcuggugaaggggacaggaggugacaagugacacauuuaacacauguagccccucuaaccaugcuccugggacauuugcuaucugguggguaaggugaauggagaaaacauugcagaggaguggacuaggggcuguggaggagagggccagacacuggagccucagagggaaguggguuugggugaccugagcguccggggugaguccuucaggcagcgguggccacacagguguuuaucacagccuugcucugugccacuggugcucuugagcuaacugugacugugauagcccugguccugccucuugaaggcugauggcugaggggacagcugggaggaggggugaaugagaacaggacuggggagcuagcagggugcgugaagggugagcagaacauccccuuccaaaccuggcauucagagagucucugauugugaccuucugugucugagugaagaguccuccucugggaagccgugccuggcucccuugccugccccccuucccuucugucauucugcuucugcgguccuuccugagugaccagacaaguggcuucaccucucugagccucccuuugcucagcagccggauggagcuggucauaguuuuggccucaggauuagugugcugugugcugucacagacaugucuuguggccguggcuuaugguagcagcugauagucugguuguguuuuucugugucugucccaccugcuggaccaggggcccuuggagggcaggguuggccacagagggggccucaggaaugguuugcccagggaaggcucuuucagcuaagccccagccuugaagaaucuggcaccugccauaagacuccuucuguuguuguccccaauagccaccuccuugcauccuggcuccagccccagggaacaguggacagucaucagaaucagacugugccucuaaucuucuguuucugcaccugcugcuucucucacuuccuccuuugugccaccaacuugcuauguuuuaggucucagcuucaaugcccccuucuccaggaaguugccccgaacccuagacuggaccaggugccucucagggcuccugcauuccugccccguucuggacagucacugucuagagaugaaucuuucucccccaccgggcuguuaaaccccaggaggacagcaaaagacucucuaggucaccacugucccuaggucacagaggugcucugcgaguguuuuccuccuaaaagaagaggaccgcaccuucccagguguuuucacugauucauucuccaguuauugauaagcacccacucuuugcccagccugugccuggccuucaugcaugauggugucuaagacagcccccguguccauucucccuccuuacccuggccucugucccccacaggugaccagcaauggcagcaucgggagggacccgccagcggagacccagccucagaacccaccggcccagccggcacccaaugccuggcaggucaucaaaggugugcuguuuaggugagcagacgggacuuggguuuguucaccgaaaacauucaaauaaaaauaaggaagaaaggaaaagucagcugaucagcugaggauggugaucauuacuguaugguagaguugcuuuuuuucuuuuuuuuuuuguaugauggaauguuuucuaaaccuuuuuuuuacucugguaaaacauacugaaguagggagucucccugaaccuguucugguuuuuggggggcuaccugauuugugaaaaaauaaaaacacaaaaaauacugaaguaguuugcuagggcccuuguaucaaguaauauagacggaguagcuuaaacaacugaaauaggaaauucauugucuuacaguucugaaggcuggaaguccaggauccagcugugggcaggggcaguuucuucuguggcuucucuccugggcuugcagaaggccgucuucucccugugucuucauguggucuuuccucugugugugucuguguccuaagcuccucuuauggggacacuagucauacuggcuuaguacccaccauaaugaccucacugaaccuuacuuuuuuacagacccuaucugggccaggcacaaugacucacccucauaaucccagcauuuugggaggccagguuggaaggacugcuugagcccaggaguuugagaccagccugggcaacauaguaagacccugucucuacuaaaaauaaaaaaaucuggcugggcacgguggcuuacaccuacaaucccagcacuuugggaggccgaggcggguggaucacgaggucaagagaucgagaccauccuggccaacauagugauaccccaucucuacuaaaaauaaaaaaauuccggaggcugagacaggagaauggcgugaacccgggaggcggagcuugcagagagcugagaucgcgcuacugcacuccagccugggcaacagagaaagacuccgucucaaaaaaaauaaaaaauacaaaaaaaauacaaaaauuagcugggugugguggcacgugccuguagucccagcuacucaggaggcugagggcaggagaaucguuugaacccaggaggcagagguugcggugagcugagaucgugccacugcauuccagccuggggacagagugagacuccaucucaaaaaaaaaaaaaaaaaaaaagccagguauggugacacguaccuguagucucagcuauucaagaggcugagguaggaggaucacuugagccuuggaaauuuuuuuauuuuuauuuuauguauuuuuuuuuuuuuuugagacggagucucgcucugucgcccaggcuggagugcaguggcacaaucuuggcucacugcaagcuccgccucccggguucacgccauucuccugccucagccucccgaguagcugggacuacaggcacccgccaccacaccuggcuaauuuuuuguauuuucaguagagaugggguuucaccguguuagccaggauggucucuaucuccugaccucaugauccgccugccuuggccucccaaagugcugcgauuacaggugugagccaccgcacccagccuauuuuuauuuuuguaauggagucucgcucuguuucccaggcuggaguacaguggcgcgaucucagcucacugcaaccuccaccuccuggguucaagcgauucuccugccucagccuccugagcagcuggaauuaagguaugugccaccaugcccagcuaauuuuguauuuuuaguagagaugggguuucuccauguuggucaggcuggucucgaacucccaaccucaggcaaucugcccgccuuggccucccaaaguguugggauuacaggcgugagccacugcacccagugccuagcuaauuuuugcuuuuuuuuuuuuuuauuagagaugggguuucacuauguugaccaggcuggucucgaacuccugaccucaugauccacccgccucagccucccaaagugcugggauuacaggcgugagccacugggcccugccugacccucagaaguugaagcugcagugagccgagaucacaccacuguacuccagucugggcaucagagugagaccuuaucgcaaaaaaaaguuggggggacccugucucuaaaucuagucacggugguacugaagguugagacuuuaacauaugaauuuugggagacaugauucagcccacaucugcacauaacaucaaauuuaccauuuuaaccuauguuuucauuuuaaccuuuuuuuuuuuuuuuuuuuuuuuuuuuuuugagacagcgucucacuuugucacccaggcuggagugcaguagugcaaucucggcucacugcagucucugccuccuggguucaagcgauucuccugccucagccaccugaguagcugggacuacaggcaccugccaccacgccuggcuaauuuuuguauuuuuaguggagaugggguuuugccguguuggccaggcuggucucuaacuccugaccucaggugauccacccgccucagccuccuaaaguccugggauuauaggcgugagccaccacgcuuggcccauuuuaaccauuuuuaaguauguaguccuguggcauuaaguacaucuccacuguugugcccccaucaccauuauccaucccgagaauuuacucuucccaaacugaaauuccauacccaucagacacaagcuucccauuucuuccuccuugcaacaccuggcagccacuuuucuauuuccugucucucuuucacuacucuaguuagcuccuguauguggaaucagacagcauuuguccuucugugacugccugguggugacccuuuuaccuguggguucacaugcuauuccugggcagugggaccccagggccuguuuuuucaaagcccagcuucuguuugaggcccuggggagaugcugggugguggcgggggaauaugcuuggcacuggguucuauccuuccugccuagaccuagugacagucaccuucuuugcucugagccuuuguuuacuccucugcaaaauagauauuccuuuuauuuuuuuuuugcuuuuuggagauguauuuuagcaaaauaagagaccacaccaugcaguuaggcaaucagcuucccuacuuaugagauagaaggaauugcacagcagagauguuuacaacaaucaucccgccaggugcgguggcucacgccugcaaucccagcacuuugggagaccgaggcaggcagaucaugaggucaagagaucgagaccauccuggccaauauggugaaaccccaucucuacuaaaaauacaaaaauuagcugggugugguggcacaagccuguagucccagcuacucgggaggcugaggcaggagaaucacuugaaccugggagguagagguugcagugagccaagaucgugccacugcacucaagccuggcgacagagcaagacugagucucaaaaaaaaaagagaaaauaaaaauaaaacaaucauggcugggcgcgguggcucacgccuguaaucccagcacuuugggaggccaaggcaagcagaucacgaggucaggagaucgagaccauccuggcuaacacagugaaacgccgucucuacugaaaauacaaaaaaauuagccaggugugguggcgggcgccuguagucccagcuacucaggaggcugaggcaagagaauggugugaacccaggaggcggagcuuacagugagcccagguggugccacugcacuccagccuaggcgacagcgagacuccgucucaaaaaauaaaacaaaaauaaaaaaauaaaacaaucauuccuuuggcuagaaugucuucacauggccauggccagcugcacgggaggcugggaaauguggucuuuaaucugggaaacugagcacccugcuggaaagcagggcuccuauuacugaggaagaagaggagagugguuauggggggcagcuacuuaucucuuccauaaaaucuuauuacugguuucccuuagcuuauaaauuaugaguguuuauuuuacaaaauuaaguaguucaaacaauacgaagagugaaaagaaaaagcuaaugaaaaaguguaaugugggccgggcgcgguggcucacgccuguaaucccagcacuuugggaggccgagguggguggaucacgagguuaggagaucgagaccauccuggcuaacacagugaaacugcaucucuacuaaaaauauaaaaaauuagccgggcaugguggcaggcgccuauagucccagcuacucgggaggcugaggcaggaggauggcgugaaccuaggaggcggagcuugcagugugccaagaugccgccacugcacuccagccugggugacagagcgagacacagucucaaaaauaaaaaaguguaauguguugguggccaucccauaggcacacauuuuuguaauuggcccuaaaugggauuauauauagaugcucacagauagaguuguuuaaaauagagaaaaguuaggaggcggggggcagguagugucagauagcguguaagagcacagcccugcugacaucucagcccugccaccucugagcucuguggccuggucagguuaucacccuucuugagccucauuuuccaccucacagacagggaaucuugacaauuagcucagggugcaucagaaggauuccaagagaauucaugucaacugaggggugcaggagcuggcacgcacacagacaauguuggccaugauuccuuuuguuguucaacguggaaaaaaaaaaagccugagcaacacaguaagacccccaucucucucucucucucucuuuuuuuugggagacagaaucucgcuccgucgcccaggcuggagugcaguggcgcgaucucggcucacugcaagcuccgccuccuagguucacgccauucuccugccucagccucccgaguagcugggacuacaggcgcccgccacagcgcccggcuaauuuuuuguauuuuuaguagagacaggguuucaucguguuagccaggauagucucgaucuccugaccucgcuauccacgcaccucgggcucccaaagugcugggauuacaggcgugagccaccgcgccuauccugaccccaucucuguaaaaaacuaaaaaauuagcugggugugauggcgcacaccuguagugccagcuauuagggaggccgaagagggaggaucgcuugagcccaggaggucaaggcugcaaugggccgugaugauacuacugcacuccagccuaggcaacagagugagacuguaucucaaacaaacaaaaaccuuaggaaauauauagugaaacagugaaaaaaaaaaguucaugaggccgggugcaguggcucacgccuguaaucccagcacuuugggagaccaagguaggugaaucaccugaggucgggaguuccagaccagccugaccaacauggagaaacccaucucugcaaaaaauacaaaauuagccgggcauggcggcuuaugccuguaaucccagcuauucaggaggcugaggcaggagaaucgcuugaacccgggaggcggagguugcagugagccgagaucaugccauuuuacuccagccugggcaacaagagugaaacucugucccaaaaaaaaaaaaaaacaacucaugaucccugauguagucacugaucacauucuagacuagagcagaacugccugccugguguccuccaagagugucacacaggacacugagaaacugcaggaaagaaaccuccccacucuguuaaguugcaaaacugacaugugugccucaaaaauuccugccaugugcccuacgcuucucagucaugcgccccugucccuuaccgucuccacuucaccuccccuccccauggccacguaaagacuucagauuuucuuauauaucaccuucuuuuuuuucaugcugcaagcagcucugcaugaaaauuauuuuuaucuuucccuucauuuuuacauaagagguagccuguuuuacacacuguucugcuccuugauuuuuuucauuaacaauauaucuuugaaaucuuuccacgucagugcauagggagcuuccuucagagagacauuuuuaauacaagucacacuguaggcuaauuuccuuucuuagaacuaggcagcaucaaacaucaguucgggugggugcucggagaccaucuuggcugcaguucuuaaaaugggauccaggguuuguuuucaggggcccaugaacuccuuguagcuugaagcugauuaugugggaauagccuuucuagauagcggguggcgucuguguuuuugagcacaugugguuaccuggagugggagguggagcaggaacuggguauauaaaggaauggggugggagggagaguuuugauuauacgucuuuucauauauuuaaaaauguucugaaccugugacuguagaauaccuauuugggugggagaaaggauuuaaugucuguuuucuuugcuuacucaaguacaucaggaagcauuagaaagguccagucuccugcaggccugggugcauggaugaggggccauggccaugagcccucugagaggguccacagaacugugggcguguggauacacacaggacguucuucaggggacuggggaucuggaauccaaaaaggccuggccuuguuuuauacauggggaucuagaagcccagagggguuaggacccccacagccacacacuaagccaggggcagagcugccugggggcaucacugcuucuacacucuccccugguguguuuacuaaaaugagagccucugcuggaggcaucgguauccccagagauugccagguccagaccuuccccagacgugcauaucagggacuucauggggagguagcgauggcucagcuggaccguggccccuaagacccuggaccccagggccuuguggcuucuacaggcagaggcaaguuccugugccugauccugccccugaucagggcucagcagggaggcaccccacccacacuagaauuuacucauaguguuuuucugcuccaaaguuuuuuguaugccuuuuuccuaugauuaaaauaacaguaauagcuaacacuucucagucacuuacuggguaugcaccaggcuccauucugagguacgugugcgugugucagauguauauacacgcuauauaaacauauauauaauuuaauguguuuaaugcuuauaaacuacccuaugagaguaggcacuguuauuauccccauuucaaccauugaaguugaccacugaggucacaguaaguagcagagcugggcuucagaugaagauacuguaguuuagaggcugggcucauaaccucuucugcuguaugguuaucauaccuauaauuaauaaguacuugaaucauuuaaucacauggcugcaugcagcugagaaaccuccauuaacacaguacagguucauuucucucugauauaccagucuggauggaggcagacuaggauucugcagucuucagugacccagacuccuugcuguuuguugugccauugcuagguuuuucccuuuauccucauagcccaagacagcugcugaagauucagccaucacauccacacuccaggcaacaggagagaagaauaaaucaagaaggaauauuucuucucuuuaaggacacuuuuuuuuuuuuuuuuuugagauggagucuuacucugucacccagacuggaguccaguggcaugaucucggcucacugcgaccuccaccucccagguucaagcgauucuuuugccuccgccuaccaaguagcugggauuacaggcgcccgccaccacgcccggcuaauuuuuguauuuuuaguagagaugggguuucaccauguuggccagguuggucucgaacuccugaccucaaguguuggcuucccaaagugcugggauuauagguguaagccaccacgcccagccucguuuugguuuugguaucuguuguugcugcugauucucgcucauaaugucguuuccuuuugugccuggcuuaucucugucuguguccuagucauuauacuugaaaaguuauuuguaggaauuucagggcuaggaugagcauauuuuccuacagagaggauugccuuugcuucugccugggggcauuaccaaguccuagguuuccuugcaccagguucagggcuugagcugcccuucgugacuccuuaucccacgaguggccuugcauacuucgcccugcauaccuguugugcaacuccugggaauggguaggccaccugguuccuuccuucucagggguggaggcuugcaccuuguggggucuuaguuuccuauaggguaggucucugguuaccucauauguuguaugugcccugggcuagcauuuuuuuuuuuuuuuuugagacagggucucacucuguugcccaggcuggagugcaguggcaugaucgugguucacugcagccucgaccuccugggcucaggugauucucccaccucagccuccugaguagcugggaauauaggcauggugcgugcugccaugccuggcuaauuuuuguauuuuuuguagaaacuguguguugcccaggcuggucucaaacuccugggcucaagcaauccaccuaccucagccucccagcgugcugggguuacaggugugagccaccgcgcccagccuaggccagcauuuuugucacccaccaaaacaccuagcagauguccucggacacaugaagaagcuuauagggcuccuuuacuuauucuuuuuuuuuuuuuccccuagaccugcaaauccaagauccuuuacuucuuuuuuuuuuuuuccuugagauggacuuuuugcucuuguugcccaggcuggagugccauggcacgaucucgguucacugcaaccuccuucuccuggguucaagcgauucuccugccccagcuucccgaauagcugggauuacaggcaugcaccaccacuccuggcuaauuuuuguauuuuuaguagagaugggguuucaccauguuggccaggcuggucuugaacuccugaccucaggugauccacccaccucggccucccaaagugcugggauuacaggcuugagccaccgcgcccggccgauccuuuacuacuuuaggauucccacuuucccuucaguuuuugccugaagguuugguaaccuacagucguguccauucuucagagcugucuauuuauauauauucauauguaaacuugauaaaaauuacaugcaugagaacaaauacgagaauacgugagcagcauauauucucauucuaucaauauguauaauuacaaauauaaaauauauugauauuuucuuaguguauuaauuuuaucaagcuuuuccaauuuuuuccagugagaggguuggucugaauaauuaagcccacuguuacuaaaauuggaacuaacguaucacuuacuaucugcuucuccaaaaauucuccaaaaguucagaaauguugcucuuucuaagcuucugugccuucgguucuuuuccuuuucuuuuuuaaaaaauuuaauuaauuaauugauuaauuuuuuugggacaagcucucuaucucccaggcuggagugcaguggcgcaaucacgucucacugcagccuugaccgucagggcucaagugacucucucaccucagucccccaaguagcugggacuacaggcaugggccaccaugcccagcuaauuuuuauauuuuuuguagagacgggauuucaucauguugcccaggcuggucucaaacuuuugagcucaagcaauccgccugccucagcuucccaaagugcugggauuacaagcaugagcugcuacaccugacccaauuauacuuuuuuuuuuuuuuuuuuuuuugagauggagucucacucuguugcaaggcuggagggcaguggcgcaaucucggcucacugcaaccuacgccucccggguucaagugauucuccugccucagccucccaaguagaugggacuagaggcacgcaccaccaggcccaguuaauuuuuguauuuuuaguagagacaggguuucaccauguuggccacgaugaucucgauuucuugaccucgugauuugcccacuucagccucccaaaguuacaggcaugagccacugugccuggccucuauacuucuuaaguuauuuuaaaauguguaauuaaauuacuauugacuagaguugccguguuuugcuaccaaauacuagaucucauucauucuuuuuuuuuuugagauggagucucgcucuguugcccaggcuggagugcaguggcgcgaucuuggcucacugcaaccucugccuccuggguucacaccauucuccugccucagccuccggaguagcugggacuacaggcgcccgccaccaugcccagcuaauuuuuuuguauuuuuuaguagagacaggguuucaccauguuagccaggauggucucaaucuccugaccucgugauccgcccgccuuggccucccaaagugcugggauuacaggcaugagccgccgcgcccguccucguucauucuauuuuuuguagccauuaaccauccccgguucugugcuuuugaagcgcuaggauuccagauucuuucuuuuaaaaauuuuauguuuauuauuuuuucuuuauuucuuuuuucuuuuaauucauccaucugcacacugaagggguuccagauucuuagucuccucucgggggaucccagggggcuggauggcagguuucccagucugagucaagagucagccccugcagcccuguggucaccaggagcuccugcaggauuuagagucaagggucugcaugcagaccagggcagugccagcuacccccacacacuggcaaacgguggcaucugggcucccuccccagauguggucuuuagggacaucuuaucuccuugccagcccugugacuaccuucucagggccucccugacuuggucacuagccccaggucaggcgccagcaugugcuaagucagaaggaagucaggcgggucuauggcggagagccaaggcuuggggacucaccaccuugcugcuucucuccucaggaucuucaucaucugggccaucagcaguugguuccgccgagggccggccccucaggaccaggcgggccccggaggagcuccacgcgucgccagccgcaaccuguuccccaaagacacuuuaaugguaacugccgggugguagggcagacuugggaggugaugggguguggagggguggaauguggaggagugaugucagcagucgggacagaccagguccuugcucacuggcaggucuaggaaaacagguccaggguugaggaacucugggcccauccccaacacgugagaccucugucaccuggguccauccccagcacauaaaaccugugucacccaaaagaaaaagcaaauucauuugguuaaaauagguuaaaucagggucuuuggauguuauauuucaaaaguauguucagccuuucaggguugcagagggagaugugcaagggagagagugugagagguggggagggcagggagccagcagaggcugacaggaggugggcccggaaggagaggagaccugcacuuccacagugggcuugggcacaggcagggcagggcuucaggagccuccagagcaaaagcauuuagaucugucagucuaggcuuuucugagcaaacauggccauuggggcuugagaaaggaggaaguucuuguugggucacaguggguuuuuuuuuuuuuuuuuuuugagauggagucucacucugucgcccaggcuagagugcaguggcauaaucuuagcucacugcaaccucugccucccgggcuccagugauccuccugccucagccucacgacuagcugggauuacaggcaugugccaccacguccagcuaauuuuuuguauuuuuaguagagaugggguuuuaccuuuuugguacgcuggucucgaacuccugaccucaaguggucuacccgccuuggccucccaacgugcugggaucacaggcaugagccaccgugcccgguggcucacagugcuuuuguagcucuggacugcuucguccauaagccugcagagcucugaccaggaaggcccagcagccaugagggcaggagaucauucagggagcuccugccccuuccuaccccuaaauucuaauuggcaggcuggccagucuccaaguguucuuuguucguugacuucacaggcucagaccaggacaaacauggugguaugagaaaagagaaaauauguccucucugcugcucuuccucucuccucuccccuguccuccauaauuacuguuccccugagugugcugaccgcugccauagcucuuuagccagccugcagaggcucugaagagcaggccugagcucuguucccuuccugucccaacagaaccugcauguguacaucucagagcacgagcacuuuacagacuucaacgccacgucggcacucuucugggaacagcacgaucuuguguauggcgacuggacuagcggcgagaacucagacggcugcuacgagcacuuugcugagcucgauaucccacaggugggggcagcucucgguuucuggccccauggcugcuugacuggcacugaaggaccuuuuccuccaguccgcuccuugcugagagcauguggaguuugggcuccaggcuuggcccuucccugggcucacauggucugugaccacaagccagucccugagaucucugggcuucacuuuccccuaccugaaaaagguagauagggguggaauuggccugggacccucccagcuaccucuaagguugugcaguccuccacuuuaaacuggugaaagauuaguaauuguccuuggggauguuugccuaucaccaguuuaucaggcagccccguuucaaaauaauauuaguuaauguugauugagcuaagugcaggguacuaagcuaggcugacucauggaaauuucccggcaacccugugaagcaggaacuguuauuauucucauuuaacaugugaggaaacugagagagaaggaaagugauuuacccaaggccacaucgcaugagagauucagacucaggcucuacggcuguggacucucgcagcccuaggcucaaauccaaccuccuccaggaagcccucccugacucacagagcacucaggcuugguuaagcacccucucuggguucucacaccugcugggcuuccccaucccagcccauucuggggccucauugggacuccuguaugggacugugagccuugugauaauaaggcuggggcugccuagaucacuuccauguccccagcacugcccaacguggggcugggugcagaaucagcaaguauugaacaaguaaaagggacaucucucuuuggggccuucuucggcugaguccaagacagcugcccucauuccuuucuccccagcaggccuucucagcuuugggguggagggcacauuucuguucuauuucugucuggguagcuagaagcagaauguggacacagucauucugguuuuuuuuuuuguuuuuuguuuuuuuuugagacagcgucucgcucugucacccagucuggagggcaguggcgcaaccuuggcucacugcaacuucaccucccagguucaagcgauucucaugugccagccuccugaguagcugggacuaaggcacacaugaucacacccagcuaauuuuuuuauuuuuuaguagagacaagguuucacuauguuggccagguuggccuugaacuccugaccucaagugauccaccuaccuuggucucccaaagugcugggauuacaggcgugagacaccgcguccagccaucauucuuuucuuuuugagauggggucuugcucuguugccuaggcugaagugcaguggugcaauuacagcucacugcagccucaaccuccugggcucaagcaaucuuuucaccucagccucccaaguagcugggacaacaggcaugcaccaccaugcccagcuaauuuuuuguagagauggggucucaacauguuucccaggcuggucucaaacuccucugcucaagcgauccucucaccucagccucucaaagugcuggaauuacaggcaugaaccaccccaccuggcuggacuuucugaccugcacugagaggugacucccacagagaccucaagcccagcccccaggccuugccacgagauccaaggaaggaccagggccuggcaggcccagcagggggaucugcuuccaagggcuuggaucuaagucgaagcuucagggugggguccaaguggacuuaaaaggcaggagagcugggcacaguggcaugugccuguaggcacagcuacucaggaggcugaggugggagaauggccagagcccaggaguuuaagacuguagugugccaugaucgcaacugcaaauagccagugcacuccagccugggcaacacaggaagaccccaucucuaaaaaagauagggagagugaggagaacacaauguggccaacugaauucgagcucugcacaaggaucagagagguucagugcucgccuuugucuccacccagugccccuggacaacuugccucccuucuugaagccucaguuuccucaucuggaucaagugagaauagucccccuucccugggaggcaaggagacuugaugagauaaugaggaagacuugggcagagaggggccagcuggagguagcagggaguagcacccaggagcccacagacuggguuuccaucugcguacuugccacacacuaugugaccccuuggcaugagccccguuugccucaucugcaaaauggggugguaacaugacccauugcauaagguugacauguuauauguguguuaacucguuagauuaggaagcuguugucugaagugcccagggcagggucuggcccauaguaggagcuccaugucggucagcugcuucuuccuguugagugagcuuaacgagagcucguugacugagcugugugccagugcuccagguagucccugcaguggugcccucgggucagugcugugggaacuucgcauccucuagguggggcccugaggcucagagagaagcugagcucacacggccauggcagguagagcgggcgucugagucugucugacuccagcauuuaccucucugccacccagcuacaugccccacccugaguacucaguaaauggccagagaguugagggggaggaaacugcugcagaugggugccaggcagggcuuuaacguuucccucaccccaguugcccagccugcccaccugaccuuccgucuuuugcagagcguccagcagaacggcuccaucuacauccacguuuacuucaccaagaguggcuuccacccagacccccggcagaaggcccuguaccgccggcuugccacaguccacaugucccggaguaagucgcuccccugcagccaggacccacuguccaggaggccagcauccugggagcccccaggcuaauguggcggacaaaucccaaguccaggagggcaggcaggaagccugugcucaaagagggugggauuggcagggcaggcucaagccccacccagccugaaagagcccuguggacacuaagcagggauacccacggaggaagggagacccacggaggcucagggaccagagagaaauuggccagaaaaagcagcuggagacagggacucuuggagaggaggagacguccuucaccaagggggaagggccaggguugacuuuugcacaguaggggccugauagaaguagacacucaaaaauaauuugugggcugggugcagugguucaugccuguaauccuagcacuuugggagacaaggugggcagauugcuugagcccaggaguuugagaccagccugggaaacaugacaaaacccugucucuaccaaaaaagacacaaaaacuagcugggcgugugccuguagucccagcugcucaggaggcugaggugggaggaucgcuugagcccaggagguggagguugcagugagccagaaucacaccacugcacuccagccugggugacagaccgagaaccugucucaaaaagauagauagaggccgggcacaguggcucacgccuguaaucccaggacuuugggaggccgaggcgggugaaucacaaggucaagagauagagaccauccuggccaacacggugaaaccccgucucuacuaaaaauacaaaaauuagcuggguguaguagcaugcuccuguagucccagcuacuugggaggcugaggcaggagaaucgcuugaauccaggaggcggagguugcauugagcugagaucacgccauugcacuccagccuggugacacagcaagacuccgucuccgucucaaaaaaaaaaaaaauagauaaaauucaaagaacagugugggcaacauaaugagacuucguugcuacaaaaauuaauagccagguaugguggugagcaccugugguuccagcuacaugggaggcugaggugggaggaucgcuugaaccugggaggucaaggaugcagugagcugugauugcacuacagcuuuccagccugggcgacagagcaaguccacgucucugaaaaaacaauaguaauaaaaaauaagacuaccacuucuacucccaugauaacucauuaauccauuaaaccacuaauccaugaauggguuaaucaguuccugaggggaggguccucaugacccagucaccucuuaaaagccucaucucucaguacuggcacauuggggauuaaguuucacugggaguggggaguacuagaguacaucaguagucccagcuacuugggaggcugaggugggagaaucagcaugaguuuuggccaggacaaacauucaaaccauagcauuguccguccucuuguuuucgagaaguuaauaauuguugucaucuuucugcuugccuggcucuuuuuuuuuuuuuuuuugagacagggucucacuaugucgcccaggcuggagugcaguggacuaucucagcucaccacaauuuccaccucccaaguucaagcgauucucccaccuuagccuccaaaauagcugggacuacaggcacacgccacuacgcccggcuaguuuuuguauuuuuaguagagacgggguuucgccauguuggccaggcuggucucaaacuccugaccucaagugaucgucugccucggccucccaaagugcugggauuacaggugugagcugccacacccagccuugcuugguucucugugagcuuuuucccugaguccucugucuccugaugggcagccguagaaaucucuugcuguaccuguuugagcggagcuggagaauggcuuccucagaaagccccccauucuucuaacgggaguucuguguacuccaccuagcuuucacuuuauugaggacuauuccagacauucccuguggauuugguuaagauccaucuggcugguuuuggguggcgcagcaacagacagaauucuauuuguaugaguuaggucuuaccuacuucuuuuaguacaaaaauauccuaaaggaugguaauuuuuuuuuaucaccuauacuggaugaaaugaaaaguugacucuaugugggucccuagaaaugacuuggaaaggucuucuggaguuacuugagccccuuucugagugagugugucugaagaaugugcugcguugguaugucccacccggcugacguccauguggugagaucuuuggagaaccaggcagaaguggcuugagggggugugaccuacaggguuggucucacagauguuucccugcagggggauacgucaggggucugggcuaaaaugcccgauguuucagaggucgcucugaaggugacccagguggguggcucuucacccuauucuuguaccccguuugacgaucaccuaaucaucccguugacccaaaucgaugccaguauuuucugcaguuuugucuuuggugagugugauccaugucacuguguggugagguuuauucacagucagucuggucuguaaaauagaaccugcagacagugaaccugaaaagcauacuaggaucauccaggccucccuccccagccuuggagcugggacccucaaagcagggacauagaaggacuuggagugagccacccacaaacuccagggugaaggagagugugaguucagaaaagcccccuuuuggcugguugugguggcucaugccuggaaacccagcacuuugggaagccaaggcaagcagaucacuugaggucaggacuucgagaccagccuggccaacauggugaaacccugucucuacuaaaaauacaaaacuuagcugggcaugguggcacaugccuguaaucccaguuacucgggaagcugaggugggagaaucuuuuggaccccggaggcggagauugcagugagccgagaucgugccacuguacucuagccugggcgacagagcaagacuccaucucaaaaaaaaaaaaaaaaaaagaaaagaaaagccccuuuuauccccaagaggccaauaaucaguauucuagagcagcuccgucccauggagauaggaugugagccagagaaggcauuaaaauuuuuccaauagaaaaauacuaaagaguaaaaagguaaagagaggccaggcacgguggcucaugccuguagucccagcacuuugggaggccaaagucagaggaucgcuugagcccaggaguuugaggccagcccuggcaacauagggagaccucaucucuacaaaaaaaaauuuuauuuuauuuuauuuauuuuauuucauuuuauuuauuuauuauuauuuuuuuuugagaugaagucuugcucuguugcccaggcuggagugcaguggugcagucucggcucacugcaagcucugccucccggguucacgccauucuccugccucagccuccugaguagcugggacuacaggcgcccgccaccacgcccggcuaaugguuuuuuuguauuuuuaguagagaccagguuucaccguguuagccaggauggucuugaucuccugaccucgugauccacccgccuuggccucccaaagcacugggauuacaggcaugagccagcgcgccuggccuauuuuauuuuauuuuuuuuugagacagaguuucacucuuguugcccaggcuggaguacaguggcaugaucuuggcucgccacagccuccaccucccagguucaagcaauucugccucagccucccaaguagcugggauuacagucaugugucaccacgcccagcuaauuuuguauuuauaguagagauaggguuucuccauguuggucaggcuggucucgaacucccgaccucaggggacccaccugccuuggccucccaaaguguugggauuacaggcgugagccaaaaaauuuuuuuaaauuagccagauaugguggugcgcaaccuguaguguccuccgacucaggaggcucagguagaaggaucauuugaguccaggaggucaaggcugcagugaacugugaucaggccacugcacuucagccugagcaacaaagcgagacccugucucaaaaagaaauauaaauaaaauaauaaaaagguaaggccagggccgugauggcucacaccuguaaucccagcacuuugggaggccaaggcuagaggauugcuugagccuaggaguucgagaccagccugggcaacauggcaaaacccccccuaauaaaaauacaaaaauuagccaggcaugguggcacaugccuguaaucccagcuacucgggagccugagguaggaggaucacccaagcccaggagguugaggcugcagugaucacaccacugcacucuagccuggauaacaaaaggagacccugucucacaaauaaauaaauaaaaagguaaagaaaaaccaugagauuaauaucaauaauaguuuaauugagcucaacauauucucguuucaacauaugaucaguauaaaaagugagauauuuuacauuuuuguuuccccuugugucaguuuucagaaucuagugugugugacugggcacgguggcucacaucuguaaucccagcacuuugggagguugaggcagguggaucacuugaggccaggaguuugagaccagccuggccaacauaaugaaaccccagcuauacuaaaaauacaaaaauuaggcgggcaugguggcuaacgcuuguaauuccgucuacucgggaggcugaggcaggagaaucacuugaacccagaaggcagagguugcagugagcugaaaucgugccacugcacucuagucugggcgacagagcgagacuaugucaaaaaaaaaaaaaagggucuagcguguguuuuauaucauagcacuucuugguuuggaccagccauauuugcagugcccaguagcugcauguggccagcaacccugauacuggauggugcagcucuagaagauuuuccuccaagaaaggggggcuuuuuccuccccacaggagccagguccaucuggucuggaugccuccaagcugcagaauguguucuuugccugagccaaagccucucuccccugugccucccccuccaccagccagcgcugcccucuggggcucucccuucccuggacagucucugucagguguggacacgauuggggcaugucccccuggaauuuucuccaagucaacccuugaguguugguuucucccccuggacacaggaggaagauccccaaugauuuaauaaucauagaaaugaugaggauuggccagguggcucaagccuguagucccagcaauuugagaggccgaggcagguggaucacuugagguuagaauuugagaccagccuggccaacaugguuaaacuccgucucuacuaaaaauacaaaaauugcuggucauggugguggaugccuguaaucccggcuacucgggaggcugaggcaggagaauugcuugaaccuaggaggcagagguuacagugagcugaagucaugccacugcucucuagccugggcaacagagugagacuccaucucaaaaaaaaaaaaaaaaugaggaugacguuucugcuaauaagcaguaggcccugggccaagaaguggugaggcuuuucuuccuucuuuagggaagugacaucacucaccagcaucccuuagcuuguaggauucagagccaagauugcccccagagcccccgcuguuggccaggucucuuuccccuuucccugucucucccuggccccaggggacaggauagagacuugagggagggcagacugaguuuuccuucauagcauaaggaagagcugaaaaguccccgggcucaguggcucacgccugucaucccagcacuuugggagacugaggugggcagaucacgaggccaggagauugagaccagccugggcaacauggugacacccugucucuacuaaaaauacaaaauuagccgggcguggugguacacgccuguagucccagcuacccaggaggcugaggugggagaauagcuggaaccugggagucggagguugcagugagccaagaucacaccacugcacugcagcuuggaugacagagcgagacucugucucaaaaaaaaaaaaaaaaaaaaaaaaaaaagaaaagaaaaaagaaaaauacuuagcuucuuuucgggccaggugcggcagcucacaccuguaaucccagcacuuugggaggccaaggugggcagaucacgagaucaggagauugagacaauccuggcuaacacagugaaacccugucuuuacuaaaaauacaaaaaauuagcagagccugguggcacacgccuguaaucccagcuacuugagaggcugaggcaggagaauugcuugaacccaggaggcggagguugcagugagccgagauugugccacugcacuccagccugggugacagagcgagacucugucuccagaaaaaaaacagaaacguccccaggccagggcagagguugggagauggagcgugggcacgcacaagccccuuccuccccggcagcauuugggacaacauggcagggggccuguggccaacugggccucugcgagaggaagugaggccaacuccuggcuggggauucacagccucaaaguguuucucaucuugguuucucauguugguggcuucaggccuuuuuuggaaccgucugcugccucuuuauagucauguauucaacuggucaucaccgagccugugcaggcgccccauguguauucaaacaggcccugccccuacccgcauuuccgcacagaguuugcagacugguugcagggacagacagcaggcagguaaaccacuggcuaagugguuuuggauaguggugaaauguugugaaggaaacaagcuggcaggagaaugacugcauaggcucauucagugggguggccagggaagcccuguggaagaaggacauucugccagggacuugaaugccacggaggagccaggccacgaagauugugucagggcauggguuccugggacacggggcagcacgccugaaggccccggguuggcauguuugagaaguggaagguggugaggguugagaggucaccggggcuacggugagugucugggguuccaaagcugcgggauggccaugaucagucacuuguuuuuauuuauuuguuuguuuguuuucuuuuucuuuuugaaacggaguuucgcucuuguugcccaggcuggagugcaacagugcgaucucagcuuccuguaaccuccaccucccuaguucaagcgauucuccugccucagccuuccgaguagcugggauuacaggcacccgccaccacauccggcugauuuuuguauuuuuauuagagacgggggguuucaccaugcuggccaggcuggucucuaacuccugaccucaggggaucugcccgccccagccucccaaagugcugggauuacagugcccuacugagcugggguuucugccuggggcauuuggugaugguggcguccccaugaucaugaggaacugggauucguugagauuuggggaggcaguucuggcauuccaggucacauugaucucagcaggugagugcaagguggaugccaggagaccgugagccguugcuggugggcagggguccgggcucuggaggcugcaggugccagcaggucucacguccccuccuuucccaccucccaaccacagugaucaacaaauacaagcgcagacgauuucagaaaaccaagaaccugcugacaggagagacagaagcggacccagaaaugaucaagguaaaugggcaggguugucagggccuauagggaccaagccaggccauucacagcucaucccagaccacuggggcugucaucugucaccaccacugaaccaccaugccggcucggucaugccaccuccccucccugagcacugggcuccuccucugggaaauggggucaggaggcagcugucucucagggagugaggaggaucccagacaagguuaccugagccucuugccagccugggaggggucuacaucacagucccauugucacaugaggacacuugcucagucucagccggaaguggcaggccagggacucucacccacacagccaggccccagagcccaagcucagccuggcuccaagcacacacacgagaauauggcuuuaguaggaacugcaggauucauaguugcugucacucccagugggcuggggagccgggcaguuaaucugugguuaaccugcagugggcacuaagagacuuccucucucugcgggugguccuguguuggggggguggucccugcucauggagcugaggccaccgugcaagaguguguggagccugcugucaugaggcugggcuucgcagccuggccuaggaugccagcccugccucuaccucuaccucgguuuucuacauguggggugggaggauccugucgguggccggaaggguccuggguggcggaaucucuaagccuagggaggagagccuucugccagcaguugcugugguggcugauauucugcugccaggguugucaggggagauggcucaugccuguuuucccagcauuuugggaggccgaagcagaaggaucacuugagcccggaaguucaagaucagcccaggcagcauagugagaccccaucucuuccaaaaaagagaaaaaagaaagaaagaaaagaagcuguccaugguggcucacgccucuaaucccagcacuuugggaggccgaggugggaggaucgugcuugagcccagaauucgagaccagcuugggcagcauagugagaccccaucucagaaaaaaaagaaagcaaagauuaagauuuucucgggaacccuggggaggaaguguacagagagugauaguccccgagcacuuccaccugccucugagguccuuccccccauguugccucagagggcugaggacuaugggccuguggaggugaucucccauuggcaccccaacaucaccaucaacaucguggacgaccacacgccgugggugaagggcagugugcccccuccccuggaucaauguaagcuccccagcccugccagcugccugcagagccuuugagagggugcucgggguccaucuccuugucuucuccuggcccugucccccugagagagcuuuccagggcuccacccucccaagcucccacccuguccuauccccuucccauguccucucccucucccacaccaccaccccuggggaccccaggacugacuucuacacgccagcaucgguccgcaaucaagugccauccagcccacaaacuguuuucaaaaaaugucuuaucacuugccagcuuuugaaauugaggcaguaucacuuaaaagccacaauuucuggcuuauuuuauaaaacuggguuacauggucacccacagggcagccgugggcuggagcugagccacagcugcccccuucaguggggaccugccugcccuuugccucaguccccucugcugaggucaaggcacccuuuagcuccucaugguguggccuagaaauguccccuguccuccagucucuguagaggggcccuguugggucucuccagacaucugaggccugcggguacccuggccuccugcccgggccaaauggugccccugccccacgugcugcagaugugaaguucgacgccgugagcggugacuacuaucccaucaucuacuucaaugacuacuggaaccugcagaaggacuacuaccccaucaacgagagccuggccagccugccgcuccgcgucuccuucugcccacucucgcuuuggcgcuggcagcucuaugcugcccagagcaccaagucgcccuggaacuuccugggugaugaguuguacgagcagucagaugaggagcaggacucggugaaggugagugcggccggugugggcgggacuucccggugccuuccugggcgcaagaggccaagaggaagugugccaggccugggcugugggaccucccgccuggugcuccucugcccacaguuucacaaccucccaggucccuucuccacagugaaaggaagugggcacccagcccuccagcccuagaugacuggggguccucuccccaggcuguucuguuggacccuuuggguccagaccugucccuuccuccuucugucccagaccuugugucccuggcccuggcuccaacucugugucucugccaucucacuggguccugaaaugucagccugugucuguggcgugaggcucggcuuugccuccugggcugucgucacuguugggucucugcuccuggcucccagugucccuucacccacuccccgcagcacucccuuggccucugccucuuccccuagugccaucuccccgucucuucugucuuugugagucacccuccucucucuccccaucugcccaucucugacccagucuccuccuggcuggcccaccuucagccucccucuacaggcggccccaggggcagcccucgggacaaaagcuagugaaggugcuccuggguggggacaggcugugcucacauguguccccugcagguggcccugcuggagaccaaccccuaccugcuggcgcucaccaucaucgugucuaucguucacagugucuucgaguuccuggccuucaagaaugguaggaacaggaccccagggcuagugagaggcugugcagggugggggacaggaccugcccccuuccuccuccccucccuccccacauguccucccccugccuggggucucucagccccacucuccagaggccuagugagcuggggaggggcaguggccccaaaacucccaacccagaaauucccacccaccggguguggagcugagggaggggcuggcccgcugguggggcagaggccaggccaauacugccaggaagcagggcuggggaacuccagagccaagagcagggaagccccggagcugcucccgccacccugcccggcaggcugccugcugcgggaggccgcuuagggcugaguggacggggccugcccaagugggaaggaggagcacugucccccaaaggucccuagguucuaaggcugaccauacugauggccagcguuugaggagaagcagccacaugccaggcacuguccuggguacccuccccaguagcuccuugagcccugugggagccagaggcucagggaugucacuugcccagucacacgguuccuaaggggcagaugguuccagccccaacucucaucuucuaggcccugcaggccacuucuuccuugcccagagcaccccagucugaaggaguggccugcggcccuguagcucccgcaggcggcaagaggaaugaguaguaguauuccugguauuaagaugcuauugccggccuggugguggcucucgccuguaaucccagcacuuugggaggccaaggugggaggaucaccuaagccccggaguuugagaccagccugggcaacaaagcgagauucguuucuacacaauuuuuuuuaagaauuagcugggcauggcagcgugugccuauggucucagcuacucgggaggcuugggccugaaaggucaaggcugccgugagccaugaucacaccacugaacuccauccuaggcaacagagugacacccuguuccaaaaaaaaggacgcucuugccauuauugagaacuaccaucuggaagaaugcagugucauacgggcacaggagcuggugccgaccccagccagccaucuaccagcugucgcugggagacgggacccuucugccuaggagcuggcuuggcugggguccagugagaaaugaggcacaagaaggcuguccuccccagugucaugcagcagggggcgcaggccucacuuggcaccagugcuguguggccucccuggucuaaggagaggcuugggcccaacugcucccacgagaacccaccagaacccugucuccagacccauucuucucaguugggacaggggucauucugaugggcagggguggguggggugaggcuauggagugugccagagcucugggaugugggggagcucugggaugugggggagcucugggaugggguagggugcacauggaccagaauucacagcccucacucccugagugcagagcuggcccugacucugcaggacugcagaccuggcuccaccacugugcuacagacgugguggcucagccuccuguggcugcgguuagaugcucagccgggcggggucaagagagggguguccguggugagaccagggcucagagaggagcaugcugacauggauccuuggcagcaucuaggcggagcacuggaaggagcuccagacuggagcccagggcccuuuucaguuuccugagcauggcugugagccaguuccuucccggugucagggcaggggccuggaggagguggucuugaagugcaugccacagaucuuccuucccagggagggcgagcuggcaccaugguguggcacagaccccgcgucccuucagauucugccaugccaggcuguuuggccucagggaagcagcuucccugaccaguccuuagcaccuggcacguggugagcccuguccauggcaccagucaccgucaccaucagucaagggacugcaccuuggggugcugggugcugacguccuaugggagggcuccaggggugccgccugucuggugcucugggggucacccaaugaauaugagagccuuccugggagagaggggucucguucagcaccccuccugaggacccagccccaccccagggugugaggaugcaggccaagggggccugagggagcugcaguagggucucagcaccuccucagccuccugguuccccccuacccccugcgcacagauauccaguucuggaacagccggcagucccuggagggccuguccgugcgcuccgucuucuucggcguuuuccagucauucgugguccuccucuacauccuggacaacgagaccaacuucgugguccaggucagcgucuucauugggguccucaucgaccucuggaagaucaccaaggucauggacguccggguaaggcuggggcgccaugcugucucgggagcugcagggguugggaggggguaguguggcccagcuggacccuggagcuggcccccgggggauucccagcaagugccucacucccaggacugaggggauuuucucaccaggggauuuuuugggucacacauggggcaggggaacugggaacgguggggaagggcaggggcugguucuggcuuguggggugggagccagcguagcaacugaccauggcacccaccucauccacagcuggaccgagagcacaggguggcaggaaucuucccccgccuauccuucaaggacaaguccacguauaucgaguccucgaccaaaguguaugaugaugugaguguccugcacagugggccccuggggguggucuccagguaccacguaucccugaggcacccggggccggccaucugucugccggacccaugcuuuacagccugugccacauccucugugucccccaucugccauaacugcuucccugggcgaguccggaguccccagggcuaccuggaaauucccccugcccggccugccagaccagguguggugggugagggcggggagcagggcugccaggcagggcugaggagcuggcugacagccccacccuguggccccacagauggcauuccgguaccuguccuggauccucuucccgcuccugggcugcuaugccgucuacagucuucuguaccuggagcacaagggcugguacuccugggugcucagcaugcucuacggcuuccugcugaccuucggugagcgguccggccgccccaggagagagcaggccccaugcugcgcagggcucacagccccaguguaggagacagacccauccccagacagggacaaccuagggugggcagagcugggauauagggaggcccgagggcacacauggccccaucuggggucagagaggacuucagggaggacaugaacaguacgcuucaguccucauucucagggggccuuugugucuugggaacaaguaaacaaguagggccaggugcaguggcucacaccuguuaucccaaugcuuugggaggcugaggcaggaggaucacuugagcccaggaauucgugaccagccugggcaacuuggcaagacccgaucucuacaaaaaaacacagaaauuauuggggagugguggugcgugccuguagucccagcuaccugggaggcugaggugggaggaucccuugaguccaggagguugaagcugcagugagccaugauuacgccacugcacuccagccugggugacagagugagacccugucucaaaaaacaaaagaccgggugaaucacagccaauagugaguacugugaagggcagaguggugggaggaugcacauuaauagggguccgggggccccucugaggacaggacauuuaaacagaggccucagauauccagggagagagcugugcggaugugacagaaggccccaccagugcagaggccgcugguagagugugcccagguauaggaagugguagagugugcccagguguaggaaguggugagggggcugguauggccagugcagagugcacaggggagaggugggagaggccaucccucugcucaugggugcucucacugcaggcuucaucaccaugacgccccagcucuucaucaacuacaagcucaagucuguggcccaccuucccuggcgcaugcucaccuacaaggcccucaacacauucaucgacgaccuguucgccuuugucaucaagaugcccguuauguaccggaucggcugccugcgggacggugaggcccggugggcaggugggagcucccaccggaacagggcccugaggcagucuuuagggcccaggccugagggggugccacggccccagauggggugcucagucugagggggcucggccccgcccuugcaucacgcccucuccacccaggcccaccuggcuguggacgggccagcccgaccucacacugccucccaccccucuccagaugugguuuucuucaucuaccucuaccaacgguggaucuaccgcgucgaccccacccgagucaacgaguuuggcaugaguggagaagaccccacagcugccgcccccguggccgagguucccacagcagcaggggcccucacgcccacaccugcacccaccacgaccaccgccaccagggaggaggccuccacgucccugcccaccaagcccacccagggggccagcucugccagcgagccccaggaagccccuccaaagccagcagaggacaagaaaaaggauuagucgagacugguccucaccugcuccggcuccuggcgaccacuaccccugcgucccggcccccucgccuccccucccugucgcccuuucccuggacagaucaggccggggcggugggaggcccgccucaggucagggcccagcgugugauguaggggccggggcaggccaggguuuguuuguggaggcgcugucugucccucugucccucuguguuuccagccaucucgcccugccagcccagcaccacugggaaucauggugaagcugaugcagcguugccgaggggguggguugggcggggguggggccgggccccccuacgggaugcccacggccguucaucaucuugucccucgucccccuaccacacucccccuccuagaccgccgcccuuuaacacagucuggauuuaauaaauucauauggguguuuaacuuaaacucagcacu

SEQ ID NO: 191728 - RNA, 43093 nt, Homo sapiens
agaauucuuuggcaggggcgaccuuagaauccuggggaggagcgagaauggaaucccggggaggaacagggguggaauccggggggcggggucagaacgccaggagggggcggggccggagccagggucggcuugacucgggggagcagcggguggauccugugacgucagcggguucgaaccgccggagcugagcgagaggccgggggugccgagccgggcggggagagcugggccgggagagcagaacagggaggcuagagcgcagcgggaaccggcccggagccggagccggagccccacaggcaccuacuaaaccgcccagccgaucggcccccacagaguggcccgcgggccuccggccgggcccaguccccucccgggcccuccauggcccgggccgcugcccuccugccgucgagaucgccgccgacgccgcugcuguggccgcugcugcugcugcugcuccuggaaaccggugagacgagcggacggcccccugcccucgcgcggacccccuccaaccuuaccuuccgagcuggggaagccgagcaccuuccccgcccacccccggcuccccgagcccccucucgcgugcccccuuccuggcuggccccacagacuccgacccccuacacguccgauucucucgaggagacucugaccccuccuuucugcaucucucucaccaccacccccauccuucuuaauccaauugcccauccuacgccugcuugucugucccccuccccauuucucggauucccgcgccgaaaggguuaaaucccaggaaggccuggugcccccuccccaccccgcgccgaguaguucacccggaucugggucucugucuccucuaccccucucaggaauguggggaauguuccccccaccuaccgcaguaaggucucgaggaagaggcgagaccaccucccuccccuauuuuuccuucuucccggcuugggcgucugaggcccggagagaacugaggacaagcggaccugauucgggucccuuggagggcuaaggauaagaguucuggcgacuuagggggaagggccugagcucggagcuccaaccccgaaccucagggaguuggggguucugacuccguggacuccagaaaaauuaggggccgggggcuccgucuucagggucccugguagaauggaggcuaggcgcuaagucuaacugggaucuagguaaaacugggggcgagagaggaucaaacuuguagcuucuggauuuaauugugggcagggggcuucguuuucaggguucccggcagaaccgggggacaggagacucgaucucgugggcuucagacuuaauuguaggcagaggaacgucuucugagauccaaacagaagugcgagcagcgggccccgucucuugggcuccagauaugaucaagggucgaaggcucugucuugaggcuggagucucagucgccugagucccagauagaacgggaggccccgagucccagaggcugggagacuccucccuuucccuaugaauggucgggggcgacggagacgucgccggggaaguuuuccugguuucacucucgccgagccagggaggggcggggcgggcgcuccuggcuccggguuccggacuccccgguuucgggaccuuaucuauccucugguagcgccuuuguccucagagccauagcaggagguggacgaguggagccgccgcccuuaucccccgucccucccauugcuaugccuuggacccccuggcguccuuccauccaccccacuaggggaggagagcggccccccuggggagggaggggcugggagggaacccuugaaagaggcgcuggccccgccccuugcaggugacccgguuguguauucccagcgacaaacucugggaugcuagaguuucccgaggguuugcgcagaagagagcucagggggaucuugggggaaccccggccaccucucuggccucauuucccccaggauggcucucacuggccucccagcuuugacccagagcugggaacuccgcuuccauccccugccucucccuucaggcagaaauaggcagaugagaucagaacuggcaccucugggugaauucuccgaacccaccagacccugagccuacuguuagcuuggugcaugaucucaccgaaggcuccagcuugcccugggaaacagguccuguuucuguuuccaucuuagagaugaggaaacaggcucagcaaaggcaagcagccuucucaaggucucacagcaggucccggggaagccgggcuccgguucuucagagccccgcaccgggugggcuccaggaagugccucugaguuuccauuuccucccucguaaaaaaacugagauaacaauccuuucccugcggaccauccggaaggcucccaggccccacugauucccugugaaaccucuuagccccuggagaaggagcugucggccccuuucuugaccacccccaccccaauccuucgccucugcuguccacuggcuggccggcuggcaugugcucgcucucccucucucucucucuccccucccccucccuguuuuccuccuucccucacuuucuuucccccucuucaucucucuucguuucucacccuuucucucuccaucccucuccaagcucuuucucucuucuccucuccccaucucucucucuccucuccgucuuucucuguauaccugucuagcuccacugccucccccgcuuggccuccucggggaaugcgggugcaccaccugggcccccagcugggccggcuccccucccccagcuuucuucccugcccauccguguguccauguccgccaggcagccccacguaguggagggggaggggagcagagggacggcagccuggcugucuccucucauuagggaagggggacugggcagaggagaaguugggggguggguauauagagaggcuggagcuacaaggauggguacagaggccaauagagggaagcggucagacacagauuuaggaauggggucagagacacguguaggaauggaaucagaggauagaaggggagugaaaugccggcacagggucgggggagugaaauaccgacacagggaugaggcugaaagacacuggaaugggacggaggagggugggggaagggagcuagacauagauaccagaugaaggcagggacaggaaaaggaaagggguuuggugacaggcagggagccccaaagacuccagcugugggacagcagaggugccgugacccacggaggucaggguacagggggccucaaggccagcgacaugugggggccacagggagugaugaacacagaagggacagggagcugggcacaugggccagcucccccgccccugccugggacgcuguuacauuuuuaaugucccagcagugcugacaaauggagcaggaaggggaggagaagaggggacccagcaagaugggccaggcugugagaaggugugucagaaauauggggagacagggcacuggagacccaggaggcagggagacuccacagucagagacagaaacagagacguagaccagaaggcuugugagaagagaaccccaggaaucaaggcagagagccagguuccagacacagggagacccagacggagaaagagaccggagaugucagacauacagaggaaagaggaagagagugacuaacggggacaggguaucuucucaggcuaaugaaaauguucuauaauugcucgggugauggauggcuaacucugaauauacaaaagccacugaacuguacacuuuaaauggguagauuguaugguaugggaauaaugucucaauaaagcuguuacaaagagacagagaauauaagaggcacagagcagagaccagagacucugggggacacagauaagagugacagaggccaggcacauuggcucauaccaguaauuccagcacuuugggaggcugacgcaggagaaucguuugaaccgaguucaaggcugcagugagcccugauugcacuacugcacuccagccugggccacagagcaagacccugucucaaaagagaaaagaguaacagagaccccaagagagacccugggaauuggagacacagagggacagggacccuaagaacuagacacagagagagauagaagaggccccggaagacacagauaagagacgcuaagagacagcagggauaccauuaaaagacuuucaagaagccaggcauggugacucaugccuauaauccuagcauucugggagguccaggcagguguaucacuugagcucaggaguucgagaccagccugggcaacacggcgaaacccugucucugcaaaaaauuuaaaaauuagccaaaggugguggugugugccuauagucccagcuacuuggaaggcugaagugggaggaucacaugagccaggaagguugaggcugcagugagcugagaucacaccacaguacuccacccugggcaacaaagcaagauccuaucucaaaaaaacaaaacaaaacacacggauuagaggaggccagggggcaggugcagaaauccaggcacagacagacagcccuacauccuggcugcugcagccgcugcucacucccugaaccagcuccuggauuuccgcuguggggguugggcacugugauuaauacaauuaauuaacugacaaggugacugaggcagcagcugaggccaguacucaaagccucuggccuucaagggccuucucuagucccgacgugccuugccaugggaggcugggucgcugugcuuuauagaucugcgggggaagccaggcccuggggagccagccaggcaggaguccaggagcccagcuccuccuccccuagacccagguguccagcuucaggccccgccucccucagacccagaagcccaggccccagccucuccucccucagacccaggaguccaggccccagcccucuucccucagacccaggaguccaggcccccaucccuaaucccucagaccugggaguucaggcccccaucccugcucucucagacccaggaguccaggccaccagugcuuccucccucagacccaggaguccaggcccccauccuuccccucucagacccaggaguccaggcccuuagucccuccucccucagacccagggguccagccucaguccccugcucccucagacccaggagcccaggcccccugcucuuccucccucaaaccugggagucuaggccuccagcuccuccucccucagacccaggaauccaggcccccagcccccuccuuucucagacccaggaguccaagcccccaaccucuccuccaggguuccauaggucacucugcacccuccucgcugccuuggucuacccaucccuggaucucggggucucaagcugugucuguccccauuguucucccaugggcucacacuacacccugggcagccuccacucugccaccacaggaagccugcaggugcaguccacagggagaggaagugugucuggggacccagcucacacuucaugaagcugucaccagucuggcuugcccagugacacugagggaggcugguguucccauggccacaguccccuggcuauggugcuggccauguccuggccaaguucauggcacagccccugccuagcagugugcuggaugaugggggcucacuccaggcugaccaaccuccuggcuguaucucccuugccuccaccugacaugcagagcgucugggcagcggcccucaccccuguccccuuuaccuccgcagcccugucagccuccaagucccaacccucccagcuucucccugucacccccaccgcugguccugcuuucccauuccaaguucugaguguguuuccaaucucgccauccuccguccccacagccccgacccugaucccggcgccuccccccgagaccccugccccacugagggcucuuucuuuuuucuuuuuuuucuuuuuuugagacaagagucucacucuguugcccaagcuggcaauagugucucacucucucacucugucuuccaagcugguacaguggugugaucuuggcucacugcaaccuccgccucccagguucaagcaauucuugugccucagccucccaaguaguggggauuacaggcaggugccaccaugcccagcuaauuuuuguauuuuuaguagagacgggcucucaccguguugcccaggcuggucuccugagcucaggugagccacugcacccagccugugaggguuuuuucuuucucuuuuuguuuuuuuuguuuuuuuuuugagacaugguagccaccaccuguaaucccagcuacucaggaggcugaggcaggagcccgagacagagcaagacuccgucucaaaaaaaaaaaaaaacagaaaagacuugggcuuguuuccugagggcucugugcagaggagggcguguucugcacuuucuagcaggauccuucuagcugugcauaggaacaaaccacaaggacaacugcaguccuccaggugggaaguggcaguggauuagaccagggcagggacuggggaggcgucagagguggucuaacuagauaaaugucaaagaaggaggugacaggguuuccugauagauugcuuaugaggugagagagaaagaggugaaaaugccuuaaaaauggacuguaggcaggacgcgguggcucacgccuguaauccaagcacuuugggaggccaaggcaagaggaucgcuuuaguucaggaguuugagaacagccuaggcaacaaacagugagaccccuucucuacaaaaaaaaauuuuuuuuaauuagucaaguaugguggugcccgccuguagucccaacuacugagaaggcugaggugguaggauugcuugaacccaagagguugaggcugcggcaagcugggauccugcacuccacccugagcaacggagugagauccuaucccagaaaaaaaaaaaaggaauguuaaccccacagggccugaacuauccuauucauucauuuggaauuagaaauucagaauggggaacuuacagcaaugggauuuuuuuuuucagacggagucucccucuguccccccagcuggagugcaguggcgcgaucucagcucacugcaagcucugccucccagauucacgccauucuccugccucagccucccgaguagcugggacuacaggggccugccaccacgcccagcuaauuuuuauauuuuuaauagagacgugguuucaccguguuagccaggauggucucaaucuccugaccucgugaucugccugccuuggccucccaaagugcuggguuuacaggcgugagccaccacagcuggcccuuuuuuuuuuugagauggagucucacucugucccccaggcuggagugcagugcugcaaucucagcucacuacaaccuccgccugcuagguucaagugauucuccugccucagccuccugaauagcugggauuacgggggcccgccaccacgcccggcuaauuuuuguauuuuuaguagagacgggguuucaccauguuggccaggcuggucucaaacuccugaccucgugauccgcccuccucggccucccaaaguguuggaauuacaggcgugagccauugcgcccagggauuuuagaaccucauucauucguuauucagcaaguacugagcaucuacuagguaccaaucucucuugcagauacugaggguacagguugugagcaaaacagacagaagaucccugcccucguggcgcuggcagucaguuuccaggaggaugugauauaucuagugugugagauggugagaagcacuaugcagacagagaacguaacagggcaaaagggcggaagagcagucaaccagggaggggagaggagguggcagcugagguggaguaucucgggguaaaagaaccccccgaggagugugccccacaagaagcuaaaagugguggguuuguuugagaccgaguccucacucugucacccaggcuggagugcaguggcgcaaucucagcucacugcaaccuccaccuccugaguucaagcgacucucccuaaaguagcuggaauuacaggcaugcagcuaauuuuuguauauuuaguagagacaggguuucacugugucggccaggcuggucucgaacuccuggccucaagugauccauccaccuuggucucccaaaguucugggauuacaggcuugagccaccgccccauccuaaagucgguuuuuuuguuuuaauccuccaaauccaguagugcucagaugccauccuaaauggaggauuggaggggagccucccuuagaaggaagaucugggccccuggaagccacaggacugcuccuuaagucaagaacucugaaucuggccaggugcaguggcuuaugccuauaaucccaacacuuugggaggccgaggcggguggaucacuugaggucaggaguccgagacuagccuggcugacauggcgaaaccccaucucuacuaaaauuacaaaaauuagcuggguauggugguacaugccuguaaucccagcuacuugggaggcugagacaggagaaucacuugagcuggggaggcggaggcuguagugagcccagauugcgccacugcacuccagcccgggcaacagagugagacuccaccucaaaaaaaauuuuuuuaaaaagaacucugaguugccgggcgcgguggcucacgccuguaaucccagcacuuugggagucccaggcgggcggaucacgaggucaggagaucgagaccauccugguuaacauggugaaaccccaucucuacuaaaaaaauuagccgggcgucguggcgggcaccuguagucccagcuacucgggaggcugaggcaggagaauggggugaacccgggaggcggagguugcagugagccgagaucgcgcugcugcacuccagccugggugacagagcaagacuccgucucaaaaaaaaaaaaaagaacucugagucagccuggcgcaguggcucacaccuguaaucucagcacuuugggaggccgaggcgggcagaucacgaggucaggagaucgagaccauccuggcuaacacggugaaaccccgucucuacuaaaaauacaaaaaauuagcagagcgugguggcgggcgccuguagucccagcuacucgggaggcugaggcaggagaauggcaugaaccugggaggcggagguugcagugagccgagauaguggcacugcacuccagccugggcgaaagagugagaaucugucucaaaaaaaaaagaaaaaaacucugaaucccagagacccagggacuuggaggaggugaaggguguggggcuccagggaccuggggcucagcuuuucaggucuccuccuccaggaagcucuucuuucguucaucgucccucccuccuucagacaggucaagccucuucagguuccucccauaccaccccuacuccgucuuccaggcauucuuggugauaauuauuugugcaauauuuguacccccugcaaucuggaugucaacccuggaaaacaagcaccugauuuguccuguuacuucugcagcauccacacuuagcaacauucauucacuuggcaguguuuacugagcaccuacuacaugcuaggcccuguuguaggugcuggggauacaguaggggaaaaacacagacaaaccucagggcuggagagggcagacccucuagcacccaggaccuguuuguugaguaacuauuuguuuuuuggauuugaccuauaagaugugaaagaacagccagauucuuccagguucugccuuuuccugaucccucccucucucccuacuaccaaaucccuuccauuuuaaaauuuuaaauccugguggggcacaguggcucacgccuauaaucccagcaguuugggaggcuaagguaggcagaucaccugaggucgggaguucgaggccagccuggccaagauggugaaacccugucucuacucaaaauacaaaaauuagcugaguguggugacauaugccuguaaucccagcuacucgggagguugaggcagaauugcuugaacccagaggcagagguugcagggagccaagauggcgccacuacacucuggccugggugauacagcgagaauguguuucaaaaaaauaaaauccuaagaccuauuagccuccuccccaacacucagucucagucuuaaccucuuguucuuuucauugccaacuuuuugugucauuuugcugucuggucaucuaucucugcucagcccaccaccuuccccucaggccuccuuggaugaaguuaagucauucucuauuugaagaacccgcaacggcucccacuugccacaaagaggaaacuaacuuccucggccccagccuacuuugcugucucugcaguucacacaggcccaaauggcuuuccuugacccucauugaguggccuuccccccuugccuagcuaggaaggggccagagcgcuuaaccacccugaucccaaccuuagugccuuugggggccaggcgggugauaagucccagcaccuggggaaucuggaggagccggaagggagugugccuugugggaggggggugauguccuuccucagccccacccagcuguugcccccaggagccacauauccggacuucugucuggagcuuuagacagcaaucuccaggccuucugugugggcugcuacuucccaacugaaauaacacucugugggccaaagcaaacaugcaccacagucagaucuggccugcagcaggcggcugaccccugcugcucugcucaccugggccacgccccgugaacaucccccaugagcaaguccuucccuggaacuggcacaagggacccuggaggguggcugaaacauccccauuuuacagauggaggaaguugggcuuggagacaaggcugccagcuggaaagggugucagcguuaaauaacaagauucagaaaauaggauuaaguauagaguuuauucaagccuaaagcuugaggauggccaccccggaguguggauucaaguugccccaaauaaacccuuugacuagcugugauuacaaguggacuuuuuuuuuuuuuuuuugagacagggucucacccugucacucagucuggagugcagugugugaucauggcucacugcagcgucaguuucucgggcuccuggccuugagugauucuccugccacagccucccuaguagcugggacuacaggcccuagccaucuugcccagcuauuuuuuuuuuuugagacggagucuugcucuauugcccaggcuggaguguaguggcacaaucucugcucacugcaaccuccaccucccggguucaagcaauccuccugccucagccccccuagcagcuaggauuacaggcaccugccaccaugcccggguaauguuuauuuuuuuaguagagaugggauuucgccaugcuggccaggcuggucucgaacuccugaccucaggugauccaccugcuuuggccucccaaagugcugggauuacaggcgugagccaucgugccggguuuuuguuuuuguuuuuuuuuuuuuaagagaugaagucucacuauauuguccaggcuggucucaaacuccuggccucaagugauccuccacccacuucggccucccauagugcugggauuacaggcaugagccaacgcacccagucugcaaguggauuuuuaaggaacaaagaagagagaguuccuaaauuguuaccaagaauuuacauugaaacagcauaagguaucugcaggucuggcucagaaaaaaagauaacagaagguauugauuggcuaugcacuguuuauuguaucacaaauuccaggaacaagaagcuaauggggagggcagcugugcaggaaccacugccucgggcauggguggaggaggcgugugaccgaaguccccuauucacuguacagucucccugggccugauacauuucgcauagcucagacugaucugagcuauuuuucuuuucucaaguuggguggggguggccccucuggacuggaaaagccucauuuuucccccaagugacacaccugaguuuguuugacuuguuucccccaagugacacaccugaguuugugggacuuguguggagaugauguauuuaugucacacuucagucuucgcugauggcuuuuuuuuuuauauuuauuuacauuuuuucuuuuaagguaggcagggccucauucuaucgcccauguuggagugcaguggcgaggucucuggguucaagugauuccccuuccucagccucccaaguagcugggaauacaggggcccgccaccacgcccagcuaauuuuuguauuuuugguagagacgggguuucaccauauuggccaggcuggucucgaacuccugaccucagggugauccauccgccucggccucccaaagugcugggauuacaggcaugagccgcagcacccagccuuuuuucuuucuuucuuuucuuuuuguuuccccucccgagaccgagucucucucugucacccaggcuggagugcagugguaugaucucagcuuacugcaaccuccaccucccggguucaagcaauucucccaccuuagccuccugaguagcugggauuacaggugccugccaccacacccagauaauuuuucuauuuuuaguagagaugggguuuugccauguuggccagucuggucucaaacuccuggccccaagugagccuccugccucggccucccaaagugcugggauuacaggugugagccaccacaccuggccuuauuuuauuuuuaauuucuguucuuguauugcuauaauuuacugaugauuucuuacccaaagauccucggccuguccccacccaaggggacugccuuccaccggggaccccucauaagaguuacucauuaggaugguguucccugggguuccuguguguaugacgccagggccugugcaccgccuccauggcccaucuccaucagacagagcugggcagugguguuggcccucgaaaugaggcuugugcccuggccuuuccuggccugggggcugagugccaaggccaccuguaauuaaacugagcuuccuauguuuacuuagcaagcacugaccucucauuuccuggggcccuaugcugaguguuccacagcuauucuuuaaucuuuaaacagcccuugggacgcaggcacuauuauuaaccucacaucacagcuggggaaacugaggcacagagagguuaaguggccugcacaaggucgcagagccaggauucaaacccaugaacuaugggccacucagucgccaugcuguacugccgugcacagcagaggaagauuuguucuuguucuuguuuauauuaaaagugagaaaacaugggccacacgccguggcucacgccuguaaucccagcacuuugggaggccaaggcggguggaucaccugaggucaggaguuugaaaccagccugaccaacauggugaacucuggucucuacuaaaaauucaaaaaucagccggaccguaguggcucgcaccuguaaucccagcuacucaggaggcugaggcaggagaaucgcuugaacccaggaggcagagguugcagugaguugagaccgugccacugcacuccaaccugggugacagagcaagacuccgucuccaaaaaaaaaaaaaaaaggugagaaaccacuuaggcuggcugagaacugcaaacaugcguccacauaaaaacuugaacuugcaugaucccagcagcuuuauuuaucagagccaaaaaguugaaacaaccucaaugccuaucagcggcugaauggauaaacaaaaugugguccguccauguaguggaauauuauugagccuuaaagaagagugaagcgccgacacguguuacagauggaugaaccuggaaaacaagaugccaagugaaagaagccagacacaaaggcuacauagucuauuacaugaaauguccagaacaggcacaucaacagagacagaaaguugcaucguggcugggggaaugggaagugacugcuuaauggauaaggggguuacuuagggaauuauaaaaaugcccaggcugggcgcaguggcucaugcccguaauccgaacacuuugggaggccgaggcagguggaucgcuugagcucaggagccuaagcaacaugaugaauccccaucucuacaaaaaauacaaaauuagcuggguuugguggcucgcaccuguagucucagcuacuuggggggcugaggugggaggaucacuucggccccagagacgguuugcagugagcagaaaucgcgccauugcacgccagcauggacagagugagauccugucucaaaaaauaauaccuuaaaacugauuauaguaacagauguaaaacuccaaauauacuuaaagccacugaauuguacuguauuuuuuauuuuacuuuuuuauaaaaaaauuauauauauauauuguuuuuucuuuucuuuucuuuuuucaagacagagucucacuuuaucacccaagcuggagugcagaggcgcgaucucggcucacugcaaccuccgccuccuggguucaagugaacacguccggcuaauuuuuauauuuuuaguagagacaggguauuucaccguguuggccaggcuggucucaaacuccugaccucaaguggcccacccaccucggucucccaaagugcuggaauuacaggugugagccacugcacccagccuuaauuguauacuuuaaaugggugaauuguguagcguaagaauuuauaucucgauaaagcuguuuaaaaaaaaaaaaaacuacguaaaaaaugagcaaaggacccgaagagacauuuuucuaaagaagacauacaggcagccaacaaacaugaaaaaaugcucaacaucauuaaucaucagagaaaugcaaauuuaaaccacaaugaggugccaucucaccucagucagaaugucuguuacuaaaaagucuaaaaaaacagaugcuggcaaggauuuggaguaaagggaccgcuuacccacuguugaugggaauguaaauuaguacagccucuauggcaaacagcauggagauuucucaaagaacuaaaaauagaacuaccauuugguccaguauuccacugaguauccucccaaaggaaaagacaucauuauaucaaaaagacaccugcgcuuguauguuuauugcagcacuauccacaacagcaaagauauggaaucaacuuaaguguccaucgaugaauggaggauuggauaaagaaaauguggucuauaucuacaaagauuucaugacgaaauugccaaaagcagugcagcaaaagcaaacauugacaaaugggaucuaauuaaacuaaaaagcuucugcacagcaaaagaaacuauccucagagugaacagacaaccuacagagugggagaacauuuuugcaaucuauccaucugacaaaggucuaacauccagaaccuacaaggaauuuaaacaaauuuacaagaaaagaaaaaccuaaaaaagugggcaaaggacacgaacagacacuucucaaaauaagacagucaugcagccaacaaacaugaaaaaaaugcucaacaucacugaucguugagaaaugcaaaucaaaacaaugagauaccaucucacaccagucaaaauggccauuaucagaaagucaagaaacaacagaugcaggcaagguuguggagaaauaggaaugcuuuuacacuguuggugggaauguaaauuaguugaacuauuaugaagacaguauggcgauuccucaaagaucuagaaccagaaauaccauuugacccagcaaucccauuacugguauauacccaaaagaauauaaaucauucuauuacaaagauacauguaugcguauguucauugcaggacuauucacaauaccaaagacauggacucaauccaaaugcccaucauggauagacuggauaaagaaaauguacaggccgggcacuguggcugacgccuguaauccuagcacuuugagaggccgaggcggcggaucacgaggucaggagaucgagaccauucuggguaacacggugaaaccccgucucuacuaaaaauacaaaaaaauucacugugugugguggcgggcaccuguagucccagcuacucgggaggcugaggcaggagaauggugugaacccaggaggcagagcuugcagugagccgagauggcaccacugcacucaggccugggcaaaagagugagacuccgucucaaaaaaaaaaaagaaaagaaaaaagaaaccugcacauguauccuggaacaauaaaaaaaaaaaagaaagaaaaugugguauaugucuaccauggaauacuacacagccauaaaaaaggaugggaucaugucuuuugcaccaacacggauggaacuggaggccauuauccugaguaaaauagaaagucaaauaccacauguucucacuuauaaguggaaucuaaacagcagauacacaaagauuggaauaauggacaguggagacuacaaaaggugggagggagggaaacaggugaggguugaaaaauuaacuguuggaggcugggcacaguggcgcacaccuauaaucccagcacuuugggaggccgacacggguggaucacgaggucaggcguucgaggccagccuggccaacauagugaaaacccaucucuauuaaaaauauuaaaaaauuggccgggcgcgguggcucacgccuguaaucccagcacuuugggagcccgaggcggcagaucacgaggucaggagauugagaccauccuggcuaacauggugaaaccccgucucuacuaaaaauacaaaaaaaaaaaaaaaaaaaauuagccgggcaugguagugugcgccuguaaucccagcuacucgggaggcugaggcaggagaauugcuugaaauugggagguggagguugcagugagccgagaucacaccacugcacuccggccugggcaacagugcgagagucugucucaaaaaaaagaaaaauugacuguuggaagccaggugcauuggugcaugccuauaaucccagcacuuugggaggcugaggcgggcugcucacuuugaguucaggaguuugagaccagccugggcaacauggcaaaacccuaucucuacaaaaacaaaaauuagccgggcacugguggcacaugccugcagucccagccacucaaguugcagugagccaagauugugccacugcacuucagccugggagacagagugagacccugucucaaaaaagaaaaagaaaaauuaacuguuggguacgcuguuugcuauucaggugauagauaugcuaaaagcccagacuucaccucuaugcaauauauguauguaagaaacuggcacuugcaccugcuaaaaauauaauaauuuuaaaauuuuuauuuuaauaaaaaaauagaaacuuagggccaaggggggagcugaucauuugaggucaggaguucgagaccagccuggccaacguggugaaagcccaucucuacuaaaaauacaaaaauuagccaggcaugguggcgggcgccuguaaucccagcuacucaggaggcugaggcacaagaaucccuugaaccagggauggagguugcagugaccaagauugcuccacugcaccccagccugggcaacagagcgagacucagucucaaaaaaaaaaaagaaacuugagaaaaaaugcuauguaggaggucuguagguuucauaggaaggugagagaaaguauauuacugaggggggaugaagacaauacucagccuuuaaauguuuuaaaauguauuuuaugaaaguuuuuuuuuauugauuuauuuucagaggauuccccccccccaaaaaaaaaucuuaugaaaauuuuggggugggcuggguacaguggcucacgccuauaaucccagcacuuugagaggcugaggugggaggaucacuugaguccaggaguucaagaccagccugggcaacauagcgagacauugucucuaccaaaacaaacaaacaaaaaauacaaauuagccagguguggugguacaugccuguagucccagcuugaaccugggaggucaaggcugcagugagcuggguggcccacugcacucuagccugggugaaagugaggcccugucugagaaaaaaaauguaguugaaagaaaagaaaacuuuuauuuuuuuauuuucuuuuuuaauuuuaaaggcagggucucacucuguugcccaggcuguucuugaacuccuaggcucaagcauuccucccaccuuggccucccaaagugcugagauugaagucuugagccacuacccuggccaucaugucaacuuuuaaacauacaaauacagguaagaauggccugguggccgggcgcgguggcucacgccuguaaucccagcacuuugggaggcugaggcaagcggaucacgaggucaggagauugagaccauccuggcuaacacagugaaaccccaucucuacuaaaaauacaaaaaagaaaaaaauuagccaggcaugguggcaggcgccuguagucccagguacucaggaggcugaggcaggagaauggcgugaacccaggaggcggagcuugcagugagccgagaucgcgccacugcacuccagccuggucaacagagcaagacuccgucucaaaaaaaaaaagaagaauggccuggagccucccucaccuucuccaccuagacccacuugacaaugggugacauauuuugguuuuugcugaaccauuuaggaguaacuugagaucaugacauugcgacuucauaucuucugggaaaaauagugugugcacagccacaauuuaauuaucacaccucggaacaugaacagcaauuccaaaaucauauguaauaugaacucauaguacacguuauaguuguauaauagaauagucauuuuagucuucccuaaaaugucuuuuccagguggcuuuuuuggaaucaggaugcugcgaagcugccuacguugcaugcggagccugcauuucccguggggcccccuucgugguggcccugccuggaggugucugggucccucccccacccgacuacuucacucucuguccucucugcccaggagcccaggaugugcgaguucaagugcuacccgaggugcgaggccagcucgggggcaccguggagcugccgugccaccugcugccaccuguuccuggacuguacaucucccuggugaccuggcagcgcccagaugcaccugcgaaccaccagaauguggccgccuuccacccuaagaugggucccagcuuccccagcccgaagccuggcagcgagcggcuguccuucgucucugccaagcagagcacugggcaagacacagaggcagagcuccaggacgccacgcuggcccuccacgggcucacgguggaggacgagggcaacuacacuugcgaguuugccaccuuccccaagggguccguccgagggaugaccuggcucagagucauaggugagcaggguaagggcgggaggcaaggaggugggagggccgcggugugggagcauccccuugcgggucaguuucucucuuggcuucagcugugagguucacauucucuguggguuuccauccaucagcaaauguucauuaagcaccuaccgcgugccagaugcuuuucugugugcugaggauguggcaggcaaccaggcauucuugggaaaaacaaaaaaauaaguauuggcugggcgcaguggcccaccccuguaauccuagcacuuuggaaggccgagaugggcagaucgccugaggucaggaguucaagaccagccuggccaacauggugaaacccugucucuacgaaaaauaaaaaauuagcugggugugguggcccgugccuauaaucccagauacucaggaggcugagucaggagaaucgcuugaacccaggaggcagagguugcagugagccgagauugugccaccacugcacucuagucugggugacagagcaagacucggucuaaaaaaaaaaaaaguauugagguugggugugguggcucacgacuauaauccaagcacuuugggaggcugaggcagguagauugcuugagcccaugguggugcgcagauguggucccagcuacuugggaggcugaggugggaggaucgcuugagaccaggaauuugaggcugcggugagcugugaucaugccacuacacucuagccugggugacagagugaggcccuaucucuaauaaauaaauaaaagaguaagucaggcaguuaaaggggccauggaaguuggagagggccaaguugcaauucuagcuaaggaggucuggggauauuuaggcagaaacuaggagaggaggagcccucuggguaucuaagggaagagcguuccaggcagacggaauggcaaguacaaaggcccugagacaggaauaccuggaguauuugagggccaggaaggaagucaggguggcuggagacauaugagugggggaaaguaggaagcaauaaagucaaggagaggauggggacagauuggcaaaagccuuguggacuauaagaagccuuuggcuuuugcccagggaggauaagagcuguaguagguucuuagcagcagacagguuugaucuggcuuggguucucaccagcuccuccuggcuguguugggaggggaaagaaugggagcugagaaaccacaggguaaggcaacuacaaaguccggguggggccgggugcuguggcucacgcccauaaccccagcacucagggaggccgaggugggaggaucccuugagccuaggaauuugagaccauccuaggcaacauaguaagacucuugucucaaugacaaaaaaaauuuuuuuuuuuuuugagacagaguuuugcucuuguuacccaggcuguaguggaguggcgcgaucucggcucacugcaaccuccgccucccagguucaaccaauucuccugccucagccucccaaguagcugggauuacaggcucccaccaccacaccuagcuaaauuuuuuuguauuuuuaguagagacgggguugcaccauguuggccaggcuggucuugaacucccgaccucaggugauccguccaccugggccucucaaagugcugggauuauaggcaugagccacugagccuggccaggaaagaaaaaaaaauuguuuuaauuaaccaggcucagugacuuaccuguaauuucagcuacucgagagacugaggugggaggaucaccugagcccaggagguugaggcugcagugagcugugauugugcuacugcacuccauccuggacaagagagcgagacccugucuuaaaacaaguccaguccgggcaggaaguaaaacggcuuagaaguaggggacauaguggccucauugagauaggaugugcagggaaggcgucuuagucaaguccuggagucugagaaggagcuaccuuugggcauagcagaggggcacgggcacagaaaccugggaggugggcaugagaugggagcugggcgcguuccaggaauggaaagggggcuggugaggauaggcaagggcuugggugacccucagcggggccacauuacacgggcuucacagguggaggcgaggaggcuggacuaugcccucagcaugguuaagagccaugggaggugucaagccacaggagagaucuggacaaacguuugagguugcaaaaaaugaccggcagcaguaugaggagugauuggaggaguggacggagguagaagggagcugggacgagaggggagaagaggcauugcugggaagacggaugaggcaguggggggcagagggaagcgggcggcauauagugguguuuuuagaagauaguaggugcugggcuugcccauggauugagggggaagcaggaucagagaggagucccaggccuggugcgguggcucacgccuguaaucccagcacuuuaggaggccaaggugggcagaucgcuuugaggucaggaguuucagaccacucugggcaacauggugaggccccaucucuacaagaaaaaaaaaaauuagcugggcaugguagcacacaccuguagucccagcuacccaagaggcugaggugggaggaucgcuugggccugggaagcagagauugcaagugagccaagauugcaccacugcacuccagcacgagacccugucucaaaaaaaaaaaaaaaaaaauaggacucccagcgggaaggugacugauacuuggcaaaaauagagaaggcagggaagauuuuuuuugaaggaugcuuuuuuuucuuuuccuuuuucuuuuuuuuuuuuuuucuuuuuuugagacaaagucucacuacauuguccaggcuagacucgaacuccugggcucaggggauccuccuaccuccgccuccugcauagcugggauuacaggcaugagucaccacauccagcuacgaaugcucuuucuuuaaaucuugaggcugggcgugguggcucacuccuguaaucccagcacuuugggaggccgaggcgggcggaucacgaggucaggaaaucgagaccauccuggcuaacacggugaaaccccaucucuacuaaaaauacaagaaauuagccaggcgugguggcgggugccuuagucccagcuacucgggagauugaggcaggagaauggcuugaacccgggaggcggagcuugcagugagccgagaucgcgccacuauacuccagccugggcgacagagugagacucugucuggaaaaaaaaaaaaauauguuggaaguccccugggagcccaccuucccuaggcaacuucccagaagccacgucacucuggaugccuuuucuucccccuucucagcccagagcgucugagaaggucacccugugcuauccuugaguaaacacuucccuuuccaguaacacaugaaaccacagccguuuuccauaauacaaaggacagcucuucuccuccccacccucacaaacgccucucuucuugugcaaucauuuguucucauccagagauaacuucagggcugggcacgguggcucacaccuguaaucccagcacuuugggaggcugagaggcaacaagagcaaaacucugucucaaaauaaauaaauaaauaaugagacucagaaaauaugauuaagggccaggcgcaguggcucacgccuguaaucccagcacuuugggaggccgaggcaggcggaucacgaggucaggagauugagaccauccuggcuaacacggugaaacccugucucuacuaaaaauacaaaaaaauuagccgggcgugguggcgggugccuguagucccagcuacuugggaggcugaggcaggagaauggcaugaacccaggaggcggagcuugcagugagccgagaucgcaucacugcacuccagccugggcgacagagcgagacuccaucucaaaaaaaaaaaaaaaaagaaaagaaaauaugauuaaguguaggguuuaaucaagcccaaagcuugaggaugaccaccugggagcauagauugaaguugcccugaauauacacuucaagcaggggccaaggcaagcagcucuugcaagugagcuuuuguuuguuuguuuguuucuuggagagagggucuccaaaacuacaaauaaaaauuagcuaggaaugguggcgcacaccuguaaucccagcuacucaggaggcuaaggcaggcgaauugcugaaaccagcaagggcagguugcaguaagcugagauugcaccacugcacugcauccugggugacagcaagacucugucucaaauuaauaaaaaaaaaagagagagagagagauaaccucaagagcuuccguauacacacuggugcagaaguaaggaacaaaacagccaaagccucugucuucaugaugcgugagccaccaaggaauaguuggccagagucggcggucaggaaagugcccuugacgaaguggggcuuggaguggggucuggagaaggaggccaaagcaauccaggcacaaaaucaccaaccaaaaccccaaaguggguggaggcagagacugaggagggcguggauggggagcauguggaguggccaggggagguggccauggggaaguggugggcucgggcccugagucacuauucuaacagcuuggagggcggccaggaggauguggggaggcuuguuggaugcuccacgauggucaggggagaaggcggugggaagggagagcugggaagaagaggagagucagaccguguugagaaguucagagguggauacccagguccagaaagcaacagaagaugugagucugggugggggacacacaucauaagcaugagcugcuauucuuccuggaguuuuguuuuugugauuuuuuuccauguuuuccaagagaaugagguggaaaggguauaaaaaaaagaaacggcuuugagauuuucugccuuuaucacacuuccagucauucaaucaucuaauggugauuacaggaaaaggaacagggggccuuuccagcuggaccuuugaaccacaguacucaguuacucgcucggccuugauuugcuuuuuuuuuuuccuuuuuuuuuuuuuucuuuuggagacagagucucacugucacccaggcuggagugcaguggcacgaucucggcucacuacaaccucugccucccagguucaagcaauucucuuaccucagccucccgaguaccugggauuacaggcaccugccaccacgcccagcuaauuuuugcauuuuuaguagagaugggguuucaccacguuggccacgcuagucuagaacuccugaccucaggugaucugcccaccugggccucccaaagugcugggauuacaggcaugagccacugcgcccauccuaauuuuuguauuuucaguagagaugaguuuucaccauguuggccagacuggucucaaauuccuggccucaagugauccacccuccucagccuccuaaagugcugguauugcaggugugaaccaccacgcccgaccagcuuuuuuuuaaaucucagccuccucuaggcuuuuggacccugucucugcaucucuggcagggcgaagagacaguauaccgaaauggccaggccaggcgccuguaaccucagagcuuuggggagccgaggugggaagauggcuugugcucaggaguuugagaucagccugggcaacauagcaagaacucaucucuacaaaaaaauuuaaaaauuagccgggcaugguggugcaugccuaugguccuagcuacucuggaggccaaggcgggaggaucacuugagccuaggaggugcaggcugcagcaagcuaugaucacaccacugcacucgagaccaggugacagagcgggccccugucucuaaaaaauaaauaaaguaaaauaaaaugggcaacacuuggauagggcagugcaggccagacauuacccuaagccauuuaccuaucaauguauuauuuaauucacacagcaauccuagggguggguacuuucauuauccccauuuuacaaaacaagaaacagcuacagaguugcaaaaccacuuaucccaagccaggccgcugauaagcagcagagcugggauuggaaccccggcaguuagggccuaaccacccugcuccucugcugaguguuuguugaaugacugccggugaggagugacgcacccccucuccuccucuccccagccaagcccaagaaccaagcugaggcccagaaggucacguucagccaggacccuacgacaguggcccucugcaucuccaaagagggccgcccaccugcccggaucuccuggcucucaucccuggacugggaagccaaagagacucaggugucagggacccuggccggaacugucacugucaccagccgcuucaccuuggugcccucgggccgagcagauggugucacggucaccugcaaaguggagcaugagagcuucgaggaaccagcccugauaccugugacccucucuguacgcugugaguguaucgggggugaccccucccccaucaaaacugccuacacuggcuucucuaaagcacugucuacauugucucugaauguugucuacguggguucccugaagccaaauucugcacuaccuuccugccauugucuacacuggcucccaugggcaaaucuacauacuucccccucauugucuacauuggcuuuacuggguuccugcaugcugugccuagucugugguaaccugggaugggcuugcaagagccaguuugauacauuucuuuccaauuccacauccaaugaagucuucucgguagcuugaaaucaaccuuggggaauauuuacaccaaggaaauuggcaaacccuagaaaugggggcuucuuuuauuccccagagaguugguuuaccagcaaagagcugcccccaacagugucuuuucuggcucccauggaccccgguugacacugccccuggaccguuagaucaaucaugcugggccauguccacaugucuacaugucuacacugcccaaccuaacaucgucuccacaccuucccauacuucugccuugacuucccuaggugccaucuauacugagucucccagagucucuacaccgaccccugauccuugauauuauuuacauuguauuuauuauuuauuauuuauuauuauauuuuuauauauuauauauuauauaaaauauauaaauuauauauuauauauuaacauauauuuugucauuauuuauuauuguuauuuaauauaauauaauuacauuauauuauauauuacauuacaggcuccaccccccgggcccuguugauccugaccccucccacuggguuuuuugcuagcucuuccagaaacugccuauacucacaccucguaauguuacccagagaggccacccuggcacucuucacacagaaucccucaaauacuggcuuaaccaccucuuccaccacuguccaaaaugaccacauaucccaacucaauguugucuacacuagcuccccaggcaaugccuccacuuacacagauucccuaagccaagucuacaccagcucccccaggcaacaugcaucacgugcgcccauaagugcaacagcuccccugagccucgucugugccacuuuccucccgggaccuacacugguugcccaaacccuguuuugacauccucccuccaugccaaaaacacacacacaggccgggugcgguggcucacaccugcaaucccagcacuuugggaggccaaggcgggcagaucacuugaggucaggaguucgggacuagccugggcaacauggugaaacccugucuguacuaaaaauaccaaaauuagcuggacguggugguacaugccuguaaucccagccauuugggaggcugaggcggagggauggcuugagcccaggacguggaguuugcaguaaaccaggaucaccccacugcucuccauccugggcaacagagcaagauccugucucaaaaacacacacacacacacacacacauuauuuguaguggcucccuuaggcacugccagcacugaacaauaacucccacaaaauuauccacagugguuucccugaacagugucuacacugacaucagcacacaacagccuggacugauuugccccagacaguuuugacugcuguaccuccugccaacccgccccguuucuuuagcauuccugucuaucugcuaacuuguccacccgcucugggauucuccuccuugcugauccaguccccccauuucccccagacccuccugaaguguccaucuccggcuaugaugacaacugguaccucggccguacugaugccacccugagcugugacguccgcagcaacccagagcccacgggcuaugacuggagcacgugagucacguggucucagaacccugggucugagggaggcggggcugggggccuggacuccuggaucuaagggaggaggggcugggggccuggacuccuggaucugagggaggaggggcugggccuaaauuccuaaguccuccaggaugaagggagcuugcauuuuggcaauuuggggucuccgggaguacuuaggucccuggagcuuggcuccugguggguguaucuuuagggaugaggccugugcuccccucucgaccuugguaucccucucaccugaccccacaccccuccaggaccucaggcaccuucccgaccuccgcaguggcccagggcucccagcuggucauccacgcaguggacagucuguucaauaccaccuucgucugcacagucaccaaugccgugggcaugggccgcgcugagcaggucaucuuuguccgaggugagugggucuugggggccguguguggagaccuggguccgcuccccuggaguucugcccuucaggacuuggggcugcacugggggaggcugcgccgccgaccugggagggaugcagaccugccuggcugaggggagaugaggguuggccuuccccucguggccucagacuggggucuggauuuggggugucgggguaggugaaggcagcagaguugggggguugaggacuuugcucgggguuccuagaaaguagaggccuggguaggguccucacgaauagacccgaggaagcugcccugggcuccagcuccugagaaagacgcacaccuagagucaggcaugcaaacuucaaagagacagaaaccaagagcucccacccccagaaacacaauccggccccaaggcacggagccaaagaggaaaagcacaaagccagaccaucacccagugauggaaacugggucaaacucacaacugcagggccacacaccuagagcgcggccgggacuguuaacagagccaugcuuccugggacagagagaccccuggguccuggagauagggccagagaccccuccugucagagccacagcuggcaggauccacagccacagacacucccugugcugagaaauucuguugcagagaugcaucagaauccagacacucaccuggaugguaacccugcacgcucaaacccauugucaccaagacacacacccaggaggacaguggcaccagccaagauagacugaacgaagccagaugacaccuggaaagggacauucuuuuuuuuuuuuuuugagauggagucucgcucugucgcccaggcugaaguguaguggcgcaaucucagcucaccgcaaccuccgccucccggguucaagcaauuauccugccucagccuccugaguagcugggacuauaugcgcucaccaccaaacccggcuaaguuuuguauuuuuaguagagacaggguuucaccauauuggucaggcuggucucgaacugcugaccucaggugauccacccgccucggccucacgaagugcugggauuauaugcaugagccacugcgccuggccagaaaaagacauucuuagaaacacgccagggcgacgguccaugcagcacaccugugcaaacacgcaaugugcaggccccccagaaacaugacugaagguguagggacaaacucccagacaggggcugucccugucaugcagacagacuagccacggagggacagaagcagacccccuuacugagucauaaucuuagaaugcacacacacuugcagggacacccgagggaaaacagacaccucuucaggaauccagauacagccagggagauaggacaccccuacgggaaacacugucacagacagcaaacccagagagacagcugucccgcucugggcucgccuggcgcgugaggaugcacauaaguccccggaggaagacgucacacagacacgcugggggcaaaacuaauccaggacagcaacggcugcacacggaggaaugucaucccucacucacagacccucagacggaaaaucaaagacauccugggaggagcuucuucccaggaacccucccgaaacuccccgaaacuccuccgaaauuauccagaaaguccguuagggagauucucauucaacaaauauguguuuccuguuugcuaggcacucuugcugagguugggaauacaauggugaaugagccacagucccugcccucaguagcacacccaggggagggucagcuccacccgcccagacagacaccgaacuggaaauacaccccuaaccucuaccccagauacaccugacaagcugauccccugcccacacacccagcagguggcuccaaggucagagccugcagaacacagacgcaauagagaaagacucagcgcuguggaaagacacccccaccuacccacgacaguggccacagggccacccccagccaauaacaccauuacaaagacacgugccuucagauaaugccugcagaaacgugcaugcuccaagcacucuagaaaucccgucucaagcagugagugccccgacagccacagccagaggagacacacucaaagcuccuggggucacucucagagggucucugagccacgaacccacauccaggcacacacagagucgucacagagacacaguauggaguccacagcagcacgaacauaggauacgaacgccgcaccacaggacagaucuaucuuuagggagacucagagaacuuuuuauuuuuaauagagacagggucucgcuauguuggccaggcuggucuugaacuccuggccucaaagcauuccuccagcuuuggccucccaaagugcugggauuacagguaugagccagcacacuaagccugauucagagcuuugaacccuagacauaugaacagacucagcuucgaguuccaaaacaccaaugccaccuccagaaacagagacaagccucccaagauaggcucaaccugguccaguuagugaccagcacaggagaaaaaucuguuucacuccucaacccaguguauaguuagagacauauauaccacccuacccccuaccaaaaaagauuuuauccuccuuuuuuuaaugcuauuugugagucacuaagcugauuugacagcccgcugggucaugacccccuguuugaaaacaacagaaacagauguccuuccugggucucagccccuccugugugucgagguguagagguggggucaggugugggugaaccccccacccccgucugucccaguuaugccuugcaugcagggaugggggaaguggauguggguagguucugguuacauugacuucugucccuggcuuggggcccaggagccccaucccucccugcucacacugcccuccucagcacuucauggcuuccucucucucuccgccuccccacuaccucccaucccccauccccaccugcucagccccugcagggagcacuaaggaagucccacugucccggucugugagaaccccauuuuacacacuggggauaaguggccuagagaugaggcagccacggcacuuggaauaaaugcucccagccacucaagagggcagaauuaucaggaaucuguggcccucugcagagagcuuugggaucagacagccucccacugaaacccagcuguccucccccgaggggguguggcccccaagcucauagcuuugugaggaccccacagcacauucagggagggcugcgaagucagauggcaccaggguccuggccagugaccgggcggccagaucuauugcauccaaauagccagcuuccacucggcuacggcgaucgccagacaugggaguuugguguugcuagaucugauuugucccccuaagagaaaccuggauuuuuaagugaaaucgccugauuuuugaaagguuggcuagcaauuuaaauuuugcaaaacacuaacaccuggggaccaccgguuggcaucccccuccuuguacaaaguggugcucaggcuguagcgaagggcggaggggcuucugcuuccccaccccccuccuccuccuccuccauucuucugcccagagucacccccucauucuggucacucccgcucccuccauccccgccuauccugcaucucccccacccccucacuccccagagcgauccucgugaucuugugucucccuuucucucucucucaccccuccuucucucucuccucagaaacccccagggccucgccccgagaugugggcccgcugguguggggggccgugggggggacacugcuggugcugcugcuucuggcugggggguccuuggccuucauccugcugagggugaggaggaggaggaagagcccuggaggagcaggaggaggagccaguggcgacgggggauucuacgauccgaaagcucagguguugggaaauggggaccccgucuucuggacaccaguagucccuggucccauggaaccagauggcaaggaugaggaggaggaggaggaggaagagaaggcagagaaaggccucauguugccuccacccccagcacucgaggaugacauggagucccagcuggacggcucccucaucucacggcgggcaguuuaugugugaccuggacacagacagagacagagccaggcccggcccucccgcccccgaccugaccacgccggccuaggguuccagacugguuggacuuguucgucuggacgacacuggaguggaacacugccucccacuuucuugggacuuggagggagguggaacagcacacuggacuucucccgucucuagggcugcauggggagcccggggagcugaguaguggggauccagagaggacccccgcccccagagacuugguuuuggcuccagccuuccccuggccccgugacacucaggaguuaauaaaugccuuggaggaaaacaucaggggugucuuguaauacaucagacccccuccuugcauguuggggaaagagagggugggacagggacuccuaggucccagggcugggaagagcugauccacgcccccggggaacgagagccuggcagggguuagacuggggaaggcuguggggcucggaccacuuggauccuugaaagacgcauuggauggccgagaaccgcaaggcucgugcaacuaggauucaggucacuggauuggggacucagaggccuggacauuuggacuccugggucccaggacagaggcugccuuucuggaugguguggccagacccaucagaggcaggaguucucuggacuccugggcccucggguggagguggggguggggacagcaggggcucagccagguucccugcguccugagagaaugaggccagagggcugugauccaguggagccucagaccucaacucccccagguugcugggggucucgggaggggagggcugcuccccacucccauucuuaggggcccugagggcauggggcaggcggggggugcuggggaagucccaccucuggccaccccgacuguggcuccccuccuucuccauccuugcccccagggaucaccccaggggacuuuucaguggcucccugggaguggcggcagcucccuccagcuccucucaacuggaaaagcaaagacggggggaggggcggcccuugguccuugaacucccaggcucaguaagggacagguuuuuacccgcgucaccucugcucucccaagccuccaugccuccucuguaacacggggcagguguuuccaucggccucacaaggcugucgugggacccaguaaggacaugcccgugaugcccucaugcagccucauugaccuccacagaccccaccaagcccugugccaggcagugcuggggcugcagcuguggccugcacagacccagugccguccuccggugugcacggccauaaugaccacaagaauagcagcaguauguuuaggaugaagguguguguguggaccgaggggcagucucucucucucacucccccacccucugaagcccuccagaggaugccaggcuguggaacgggagcaguggagauccaacaguccagcguccucuggaagcuuccuccucaucuggagagugaggccgaugcaugcgugacccccacgggcccuuccauacuuguuacuuccucugguuguuuguugucuguacucacccacccaccccacccggacaaccggagggcaggggcggggaauuggguccgccuggcacacaguggauccuucagugccaugcugaguccuccuuacacacccagcaaacaccuacugugugccgaaccucaggcacacagucuaguauggaaauuggcaaguaaacggguaaccacuccaaaaacucuuccauuaggaaagacuugagaaauggaaacgggaggugcuagcaaggaaggagaggcccaggagcaaacaggcuucucgcuucucgaccccuuuuccugucuugccuuuuuuuuuuuuuuuuuuuuuuuuuuuuuugagacggugucuagcucuguuacccaggcuggagugcagugguacgaucucggcucacugcacccuccaccucccaaguucaagcaauucuccugucucagccucuugaguaacgcacccagccuuuuuuuuuuuaagaagugggguggucucccuauauuacccagauugggcucaaacuccugggcucaagcgaucgauccucccacuucagccuccaaaagugcugggaugacaggugugagucacugugccuggccccuggcuaauuuuuuuuuuuuuuuuuuaagacggaguuucacucuuauccaggcuggagugcaauggcgcgaucuuggcucacggcaaccuccgcuucccagguucaagcaauucuccugccucagccuccugaguagcugggauuacaggcgcgcgcuagcaugcccagcuaacauuuuguauuuuuaguagagacaggguuucuccauguuggucaggcuggucucaaacucccaaccucagguaauccaccugccucggccucccaaagugcugggauuacaggcgugagccaacgcgcccggcuagcccccggcuaauuuuuaaaauuuuuucuagagaugaggucuugugcucguugcccuggcuggucuugaacaauccgcccgccucgcccucccaaagcgcugggauuacaggcgucagucacugccccaagcccuaacccccuuccugauaaguggaaggagauucuaguccccagaggugauucuggaucccagaauucuguccccgcauucucugucuucuagccgccccugguccugucuccucuccucucaucuucccacucugccccgccucauucugccccagcuacacagucuacuugcuguucuuuaaaaacaauacaaggcaggccgagcacggcauaaucccagaacguugggaggccgaggcgggaggaucacuugagcccaggaguucaagaccagccugggcaacauggcaaaaccccaucucuacaaaaaaauucaaaaaaaaaaaaaaaaagcugggccuggcggcacaugccuguaguuccagccacuccggagggugaggugggaggaucgcuugagcccaggagauuggggcuacaguugguggugaucaugccacugcacucuagccugggugacaaagcgagaccgucucaaaaaaaaccauagagccccacaagccuccugcagggccgcuggcuguuugcgcugccugcgauacccccagacacucucaugacucauccccggugucucuuucaggcccuugcucaguugucaccuuacaguaagguagaggcccucccacuaccuucggggaccccacuuugcaccuccuaucacuuccgcacuguauauuuuuguaucccccgugacuuacucccaucuggcaugugagcuauuguacugguuugcuuacuguuguucucccugcccaaccagaaucaaaguuccaugaagguagacacuuuguauguuuuguucuccacucaucucccaugcggggcacacauccucgcuccuuccucaugcucagcaguuugaguugaaugaaagaauguccccugcccaugggagaggacauagacaggcaggcgaugauguggggugggauggucgcuuggaauaaggagcuguggcuuccuccuggagacccccucacgcugucccucuccuugcagagacccccaacacagcaggcgcaggggccacaggcggcaucaucgggggcaucaucgccgccaucauugcuacugcuguggcugccacgggcauccuuaucugccggcagcagcggaaggagcagacgcugcagggggcagaggaggacgaagaguaagugaugggcccugagacggggaugggagaggggucgaagaacugaggaguaugggguaggggugagggugggagaaaauucuccauaauggcugugugaaacagacagaccuaaaggaacuggggucuaaauggaguagggagguauggguuucucucugcuauaaaguauggcauugaauuuaaaaauuagcugggggccaggcacaguggcuuacaccugccaucccagcacuuuuggaggcugagguggggagaucgaucguuugagcccaggaauuugagcccagucuggguaacauaggaagacuacccccaucuacaaaaaaaaaaaaaaaaaaaaaaaaauggccacgcaggguggcucugaccgcuccgcucugcaaagacuccucggagcccaggauccuacuacauuuuuuuuuuuuuuuugugacggagucucacucugucaccgaggcuggaauacagugaugcaaucucggcucacugcaagcucugccucccagguuaaagcaauucuccugccucagccuccggaguagcugggaauacaggcgcccaccaccaugcccagcuaauuuuuuggauuuuuaguagagacaggguuucacuguguuagccaggauggucucuaucuccugaccuugggauccccccuccucagacuccaaaagugcugggauuacaggcgugagccaccauggcuggccaguuguuaauaaaagaagaaagggcgguuccuaaauuguuauggagaauuuacauuaaaauaacguaagcuauugauuggcuauccauugcucuuuguaucacaaauuccagaaaccugaagauaaagaguaacacuggucaggcagggugggucaggcaggguggcuccugccucuaaucccagcacuuuguuuuguuuuuguuuuuguuuaagauggagucuuggucugucgcccuggcuggagugccaaggcgccaucucggcucacugcaaccuccgccucccugguucaagcgauucuccagccucagccucucgaguagcugggauuacagaugcgcgccaccacgcccggcuaauuuuuguauuuuuaguagagacggaguuucaccauguuggccaggcuacucuugaacuccugaccucaagugauccacccgccucggccucccaaagugcuaagaucacaagcaugagccacugcgcccagccaaugccagcacuuuggaaggccaaggcucuuguugcuagugguucgagaccagacugaacaucaaagugagacaccaucucuaaaaaaauaaaacaaacaaaauuagccaggcaaaguggugcacaccugugguccagcuccucaggaggcuggggugggaggucacuugagcccaggagcucaagucugcaaugagcuaugaucaugccacugcacucuagcccaggugacagagcaagacccuguaucuuaaaaaauaaaagacugggcacggugccucacaccuguaaucccagcacuuugggaagccaacccaaguagauaacuugagcucaggaguucgagaccagccugggcaacauggcgaaaccugucuacaaaaaaaauacaaaaauuacccagaccugguagcccaugccuguagucccagcuacuugggugggcugaggugggggugggggcauguggaggcugcagugagcuaugaucacaccacuguacuccagucuggccaacagagugagaccuuguaaaaaaaaaaaaagaaaagaaaaauagcucagagcagucugagguaugcgagcuaugcaaaauuuguuuuuuugagacaggaucucacucugucccucaggcuagaguucagugguauaaucugagcucacugcaaccuucgccuccugagcucaaccaaucuuccuaccgcagccucccaaguaaaugggaccacguaccaccacaccuagcuaguuuuuguauuuuuguagagacaggguuuugccauguugcccaggcuggucuugaacuccugaccucaggugauccacccaccucagccucccaaagugcucggauuacaggcgugagccaccaugcccagccuggaaucuguauuuaccacaagcucucuaaguuuuucugaugcacaggaaggucuguuacaccacugucuuaaucaucuaguuaguucaaaccaauaacuugcugcugaucuccucugugugcagcuccaugcugugacccacuguguccgagacggccuggagcucacaauauggaggaggagacaaaacugucuccagauagugaugguguagcaugaccagugaugggauagggcaguugagcaagcucugagaagccagagggggcaucugacccaggcuggauggucagguagggcuuccuggaagaggggacaucugagcugacagaaugcaucguaagcaccugucauuacuguaugcuuuggucuguggguguguagaaugagggacaggaacuuuaaccuaauuugagggacaggaaggcacuucauuuauucauucauucuuuucacaaauauuuacugaacuccucauaguggauucuggagacaccuugcugacgacccagaucuuucuuuuuuuucuuuucuuuucuuuucuuuuuuuuucuuuuugagguggaguuucgcucuuuuuucccaggcuggagugcaauggcgcgaucucggcucaccacaaccuccaccucccggguucaagcaauucuccugccucagccuccugaguagcugggauuacaggcaugcgccaccacgcccggcuaauuuuguauuuuuaguagggacaggguuucuccauguuggucaggcuggucucacacuccugaccucaggugaucugcccaccucggccucccaaagugcugggauuacaggcgugagccaccacgccuggcugaucuuucuuucuuuuuuuuuuuuuuuuuuuuuuaauuugagauggcaucucacucuauugcacaggcuggaguggagugaucucaucucacugcaaccucugccucccgaguucaagcgauucuugugccucagccuccugaguagcugggauuacaggcgugcaccaucaugcccagcuaauuuuuguauuuuuuggggagauggcauuucaccauguuggccaggcuggucucgaacugcugaccucagaugauccgcccgccucagccucccaaagugcugggauuacaggcgugagccacugcccccagcccaacacagaucuuuuuucccucccagagcucacaguggggcaugguaauuauaaauaacauuucaaguacaaauucaguaagugcccugagggggaaguacagcuagguauguccguguaacaggaauuccugauccacuggggaaaccugaaggcuuccgggaaaaagaggaauucauggaaugaauaaaaacucuuacuccaggcaagaaaagggggcaggggaaagggagacccagguagagggaacagcaugugccauaaccccggagucagagggaugccugggucuuaaucuccacuuguccuaccuccuaccccacagccuggagggaccucccuccuacaagccaccaaccccaaaagcgaagcuggaggcacaggagauggugagcacuuucccuggagcccaagcuauccccaccuccacacccaccccagggcugggaggggccuggcagggagaagcuggcuggguggugggggcaguuccugaccuccccgccccucucccacuacagcccucccagcucuucacucugggggccucggagcacagcccacucaagacccccuacuuugaugcuggcgccucaugcacugagcagguaggagcucaugggaagacaaagguggguugggggucuggguugaagggccaggggucaggccuggcaaaagaggucaaagacuaaaggucauaacucaaggucaaggguguguccccgguuggugcuuaaugcauugagauguguucaggauuccaugggggaggucaggggugaaaaggcccaaggucacaagguuagaauuuaaagucacuugggggcugggcacgguggcucacgccuauaaucccagcacuuugggaggccaaggcaggaggaucacuuggggucaggaguucgagaccagccugugcaacauggugaaaccccgucucuacucaaaacacaaaaaauuaguugggugugguggugcgagccuguaaucuuagcuacccggggcgcugaggaggaagaaucgccugaacccaggaggccgagguuacagugagcuaagaucacaccacugcacuccagccugggcaacagagcaagauuccgucucaaaaaaauaaauaaaaccaaauaaauaaaaucaccugggccgggcaugguggcucuggucuauaaucccaguacuuugggaggccaagguagcuggaccccuugagccuaggagcucgagaccagcgugggcaacaugggcuacccagcaacauuuugcgucuacaaaaauacugaauuuaccuggaugugguggcaaaugccuguaggcugaggugggcggauugcuuaagcccaggugguuggggcugugccacuacacuccagccugggcaucagggugagacccuaucucaaaaaaaaaaaaaaagaggaaaagucauuaggucaaugaaaauugauuaucuggucaggcaugguggcucacaccuguaaucccagcacuuugggaggcugagacgggcagaucaccugacgucaggaguuccagaccacccuggcuaacaaggugaaaccccuucucuacuaaaaacaaaaauaagccaggcaugggugacaugcuccuguaaucccagcuauucaggaggcugaagcaggagaaucgcuuggacccaggaggcagaaguugcaaugagcugagaccacgccacugcacuccagccuaggcaacagagcaagacuccgucucaaaaaagaaaaaggccgggugcgguugcucacgccuguaaucccagcacuuugggaggccaaggcagguggaucaccugaggucaggaguuccaagaccagccuggccaacauggugaaacccugucucuacuaaaaauuacaaaaauuagcugggcgugguggcgggcgccuguaaucccagcuacuugggaggcugaggcaggagaaucgcuuggacccgggaggcagagguugcagugagcccagauugcaccauugcacaacagccugggagacaagagcaaaacuccgucucaacaacaaaaaaaaacagaaugaaagaaaauugauuaucuacauuugcuggauacugugccugaagcugggacaagacaaaucaagucacuccccucaguggucuacuggaggucaggggucagacacugagguugcgcucaagguucaaaggacuguuuagagcccaagguuaaguauuugaggucaagacugaggugaaagguucauggggaaagauuugcagagaucgagugucaaaagugagucccaggauuaacagggugaguugcacgagcugggcuuuggguuaaggaagggcugaaugaaugucccagugcaauauggccucaggggacaaggagugagguggcaucuuguuggcauggggagagagcggucaggauuuuggggucaagagcagauugguaaucugugucgugcguaggaagugaucuugaguuccuguccucucucuaccuccaggaaaugccucgauaccaugagcugcccaccuuggaagaacggucaggacccuugcacccuggagccacaagccuggggucccccaucccggugccuccagggccaccugcuguggaagacguuucccuggaucuagaggaugaggagggggaggaggaggaagaguaucuggacaagaucaaccccaucuaugaugcucuguccuauagcagccccucugauuccuaccagggcaaaggcuuugucaugucccgggccauguaugugugagcugccaugcgccuggcgucucacaucucaccuguugaucccuuagcuuucuugccaaggaucuagugcccccugaccucuggccaggccacugucaguuaacacauaugcauuccauuugugaugucuaccuugguggcuccacuaugaccccuaacccaugagcccagagaaauucaccgugauaauggaauccuggcaaccuuaucucaugaggcaggagguggggaaggugcuucugcacaaccucugaucccaaggacuccucucccagacugugaccuuagaccauaccucucaccccccaaugccucgacucccccaaaaucacaaagaagacccuagaccuauaauuugucuucagguaguaaauucccaauaggucugcuggagugggcgcugagggcucccugcugcucagaccugagcccuccaggcagcagggucccacuuacccccuccccacccuguuccccaaaggugggaaagaggggauuccccagcccaaggcaggguuuucccagcacccuccuguaagcagaagucucaggguccagacccuucccugagcccccacccccaccccaauuccugccuaccaagcaagcagccccagccuagggucagacagggugagccucauacagacugugccuugauggccccagccuugggagaagaauuuacuguuaaccuggaagacuacugaaucauuuuacccuugcccaguggaauaggaccuaaacaucccccuuccggggaaagugggucaucugaauuggggguagcaauugauacuguuuuguaaacuacauuuccuacaaaauaugaauuuauacuuugaccagg

SEQ ID NO: 191729 - RNA, 12904 nt, Homo sapiens
uucauuauuuauuuuauuuccugauucuuuccccugccaagugacccucugggaaagcgggaguuuuuguuuugcuuucuaccagggcugcaagagccuagaacugggucuggcauacagcaaaggcucauuuauugcugaaugaaugcauaguuuggggaaggggaggacaagcugaggccacauuugggacgggugcuggggugggguggagaagggagcugcugcccagagggacucaguaagauucagggugggggccaagaccagcagcuggcagcagguucugagaggggcugggccugccugaacagggaagggguccagcagccguggucaccuugcugggacugguguguggggccacaggccugugaggcugggccucucugccaccugaggcccgcaugguggggugucugccuuguccuaaggggagaagacucugagggucacuaguggaguugggguagggcauugaggacagacaguugggagcccagccaacugccugggaggcaggccugaggccaccaucuuguccccagauauccagaucuugggggacuuuggcauggaaaggggccagagccugccuuucacaggcacauggcccaggccagcuugcuugaaggaacagaccgaaggcgggcgugcauucacgggcugcacaaggaccugggccuguuacagucuccugucccccugccaggacaccugccccaugugcugcugagucuuuggcugaguccaccucaucggccccacagcccccaauggccuuguccugcuggucucaggugugaggcucccagaggagggcuggggccuugucuucucccuggcuggccuggcccaggacccaucaggaaguuggcaccagcuggcaguagggggcagggucgggguuuagcagguccugcuuggggggaagagagaacagaauuaugacuggguggagggggagagucuuggggagacagagagggacagaggaugagagacagcgugagauggagagaaacccgcagagagaauggaagagcaagguggaaagagagugagaugcagagacaagagguccuggaagagccaagaaaugagguggacacagugacagagacaaagaggcaggagagacagagaauggagagagagagagacagagaugcagagaaacgaagacauguaaagagaugcaucuuagacaaggcagcaugaacaaacuggaaacagaaagacagauuaaaaaggacacagcaagagaaacugagagagagagagagagagagagagagaguccaagaaaggggaagacagacauacagacauauguaggccacugagagagagagacagaacuacagggacagacagcugacaggaggggauggagagggacugagcucugcggugggguuucacuggggaccugacuggcuguguggccccaggcaauccccugucccucucugggccuuguuccuccugugcaaguucaagguuuuggaucccuuuugcaaagaaggaaauugcagccuugggaggaaaagggacuugccagggucucucagggaggcgguuugggcuucuucgagagcagagaccgugaggcuuggggggacgaggggaggaaagcccccaguuucaguugucuugaccccuccccaccccggcuucggggcuccuggauccgugggauccccaccaccccucccagcucccagcuccauaccugguacuggugguucucuggcuccgccugcaggugugggggugugggcaggggcugcaagggaaggacacgggugagugggcgcucggcaccccccacccucuaaacuuugaccuuuggugcuaggacagucucagauuccaaguccccaucaccccucccagacugugaggccccugggcagaggggauuagcuuccuuacaccucaguguucuccucugacaaaugggcacugggccccagcuucgugugguauccaguggcccgucaaccacuccauuaacucucagucuaccccugucaacaccucugguucuaagcucuuagccuuaguguuuuauguuucucuuauuuuucacuuuuuuagaaaaagacaggaucuugcucugucacccaggccagagugcaguugugcaaucaccacucgcugcagccucaaacuccugggcucaagugauccucccuccucagccucccugguagcugugacuauaggugcacaccaccaugccuagcuaaauuuuuguagagauggggucuagcuauguuccccaggcuggucucaaacucccggccucaagcaauccucccaccuuggccucccaaaguguugggauuuacagguguagagccaucaugcccagcuaaguuucucuuuuuauuuaaucuaaauaacuuuuuuuuuuuuugggauggagucucgcuccugucgugcaggcuggagugcaguggcaugaccucggcuuacugcaaccuccaccuccuggguucaagcgauucuccuuccucagccucccgaguaacugggauuacaggcaugugccaucacaccuggcuaauuuuuguauuuuuaguagagacgggguuucaccauguuggccaggcuggucucaaacuccugaccucaggugauccacccaccuuggcuucccaaagugcuagaauuauaggcgugagccaccacgcccagccuaaaugacucauuuuuauaaaccuuucguuauauauauauaaaaccuccccauuauaaagguaguggcugcucagugcagaaaacacagacaaguauaaaagaaaagaagauaaaacccacccaccagccuccacaccccggagacaaaugcugcuucuguugugcuguuuccuuccagucucuuuuccuuaggauuuuuaaaaacagggaacaauauauagagaguugagauucccaaaccuggugucaagauggcccagaggaccacagccagcucagagaggaggcgccuguuagcauuggcuucaggggagaggcuggggacgggacucacccgggcuggguuuauggaccuugugucacugaugggggacaccaggaggacuggagagggcaucacuucauagauguuguugucaccugaaacagaggccaggggagguaccagcugacacaugggccccacaggccacucugacugccuguugacauucauuuauuuauuuauucaacuaacauuugugcaaacgcuucuucuagccaaacccagugcuggggacacagugcugaccacgacagucccaggccugcccuuccaggacuuacaguccagugggggacgcagaccagucuccagagugacaaccuggaguguuuagggcuggagucgggggacugggggcgggugggagcccaagacggggugccuaaguagccuaggacucagugagggcuuccuggaggagggggcaucugagauaguagagagaagugagugaagcuaaggcaggagagggugagugcagaggucuggugagagagccagcuguguuucagaaacuguguuugaucugucuugugaagggccuugagaaccauguuaaggagacuaaacuuugucccaagggcacaggggagccauggagggccuuugagcagaggaguaacaugaucagaauuuuagaaagaccuuguccugggauggguuggaggggucuggaggcugggagaccagugaggagcuggguguggggggucuaggaggcugguaguggccuguggagguggaugggauccacuugcaugaugggauggggaugcuagccacugagaagaagagaaaaagcagguuuggggugggugccgaugcgcucagauuaugugggugaguucagggggccccagagaggucucggggcaggugcauugggaggucucugagugagggagaauaagcgggcuuguggcuauaggggagaaaggaggagcugagaggagggcuagguagugagaucuggggcucccgccuuaccagcaucaugagcagggcccaauucuggcuucucuguggucgccauccuggggacacauagagggaauugauauuaggauagagagacacucaggcggggggagagagacuuaagagaagcuggaaaucccaccaggucccugaaagccacauggucucuccuucagagugagcuaggaugaggccugaacuaucccagacuuuucuuccauaauccucauccgcaaucccucaguuucccuagccaccaccuuaugccaaugaauaguguuccccagacaucaccauuuacagagaucaccuaaaugauccugcuucauccaccugucuuaugauuuccuuaauauuucucuuuacauagauucauuugaauacccuuauuuauuuuuuauuuuuuaauuuuuugagacagagucucgcucuguugcccaggcuggagugcaauggcgugaucucagcucacugcaaccuccgccuccuggguucaagcgauucuccugccucagccucccaaguagcugggauuacaggugugugccaccaugcucggcuuauuuuauuuuauuuuauuuuaauuuuuuuuuuugagacagagucucgcucugucgcccaggcuggagugcaguggugcaaucucggcucacuaaaagcuccgccucccggguucaugccauucuccugccucagccucccgaguagcugggacuacaggcaccugccaccaugcccggcuaauuuuuuguauuuuuaguagagacgggguuucaccguguuagccaggauggucucgauuuccugaccucgugauccgccagccucggccucccaaagugcugggauuacaggcgugaggcaccaugccuggcccaugcucugcuaauuuuguauuauuaguagagacaggguuucaccauguucaucagguuggucucgaacuccugaccucaagugauccaccugccuuggccucccaaagugcugggauuacaggcaugagccacugcacccguccugaauacccuuaauuuuaaaaguacacuggaaccaagugaaauggcucaugacuauacucccagcacauugggagaccaagguaggagacuuuuuugaggccaggaguuugagaccugccugacucacaaagugagaucccgucucuacaaaaauuacaaaaauuagccaggugugguggugcacaccuggggucccagcuacuugggagacucgggugggaggauaguuugaaccagggaggucgaggcuacggugagcuacgaucgcaccacugcaccccaaccuuggcaacagagugagacuuugacucugaaaacaaaaguacucuugacaccgcuauagcaaguuuguuaguucacuaaauaaguauuuacaagcaccaaccaugugcugggcgucacugaaggcacuggggauacagccgagcacaagauggacagagaucccuggccccucggagcaggcagucuaggguggaaagagaggggaagaaaauuggaauaaagcauugacaguagaauaucagagagcaacauccuucccuaugaaggaaaauggagaggggggaggggguggaaggugugugugcgguuuugaguaaaaaaauaguaauugggcucaguggcucaugccuguaaucccaacacuuugggaggccaaggugggcagaucaccugaguucaggaguuugagaccauccuggccaacauggugaaaccccgucucuacuaaaaauacaaaaauuagccaggcgagguggugggugccuguaauuccagcuacucaggaagcugaggcaggaaaaucgcuugaaccccugaggcggaaguugcagugagccgagaucgcgccacuggauuccagccugggcgacaagagcaaaacaagaagaagaagaaaaaaaagcuuggaaauggugcacuccuguagucccagcuacuuggggggcugagaugggaggauggcuugagcccagcaauucaagacagccagggcaacacagggagaucuuauuuuuacaaaaaguaaaaaauaagcuaggcauggugaugcaugccuguaauucgagcacuuugggaggcugaggcagaaggaccgcuuaaggccaggaguuugaggucagcuugggcaacauagcaagaccccaucucuacaaaaaauaauaauacagauaauuagccaggugugguagcacaggccuguggucccaguuacccaggaggcugaggugggaggaucacuugagcccaggagucugaggcugcaguaaacuaugaucaugccacugcacuccagccugggugauaaagcaagacccugucucuuuaaaaaagaaaaagaaauaggccaggcgcaguggcucaugccuguaauuccagcacuuugggaggccgaggcuggcggauugccugagaucaggaguuugagaccauccagggcaacauggugaaaccccaucucuacuaaaauacaaaaaauuagccgggcguuguggugcacgccuguagucucagcuacuugggaggcugaggcacgagaauugcuugagucccggagguggagguugcagugagccaagauugcgccacuacacugcagcaagacucugucucaaaaaaaaaaaagaagaagaagaaaacagaauccauggcacauaaggaagaguugagaaaggagacaaaauugcugcuuucauauucugggaacuggugaguggcagaaaaauuagacaucuuaucuacaaucaguucagaaucaauuucaagagacaaaguucugaagacgcugaugucauaagaaaggaauuuuucacgaauagacucucccugggggaaacaggacugucucucucuccucucucuccucucucucucucucucucucucuccauacaaguagguagcaucugauagcugugccugcugcugcccacuccccuucuuugacaauagcaaccaguuuuguuuuccuuuggagagccggucuacacucucaauccacuugauuaaacggaguuggaucuagcccagucucuggggcugcacaaauagcccaacuuuggccaaucagagcuuucccuggccaccaaccccuggccacagugauugguucaugaaaagucaugugaucugaguuaagccaaugagagguagacuuggggcucuuguuggaacuaccaggaacaagguggucuccuugcuaggaauggcuaaaccaguggaguaugagccugggcccccugggagugaucuuguggcaacaggggagagccugccugagaaugaagccaccgaagaaaaauacagaguugacgaguauauaaaggagucauuugagaacauugagccccuggaugcagccuaccugaauaaguuauguaguauuaaacaauuccuuguuuuuugggcagggaacaguggcucaugccuguauucucagcacuuugggaggccaaagcuggaggaucacuugagcccaggaguucgagaccagccugggcaaaaccccaucucuacaaaaauaaaaaaaauuagccaggcuugguggugcacaccuguagucucagcuaccugggaggcugaggugaaagacucaccugaguccggggaaguugaggcugcagugagucgugauugugccacugcacuccagccugggugacagagcgagacccugacuaaaauuccuucuuuuugguaagucaguuuaagaauagguuuucugucccuugcaaugcagaauucuguuuaauacaggauagaaagauucuuuucaccccaggaguuccaagauuugaugagauuguguaugagccggaugaugugacuuguggaagaauccauggggcuugagaagacagugggagcagacaggagagggacacuuggggacccuguaccuguggcucuggccccuccaguuccuugucaccaggagauaggcaaugcagcugaugagaagggccccggcagcaagagauccaaugaugguggccgccaggaucccagcguuggugggcagguguguacugggcagcuccuuauucuuuucugaggggugagagaaagaaagagagaggggggacugugcgaugucuccugagggcucccccagucccucaccgacuauaucagugacugcauggagaacugaggugcaguuuccuauuuccagcccagagcuuucuccugcuuuucagaucugaguauccaaccaucuggguggcacauaaaauccaacaugucccagcgggcugggcguggugcucacaccuguaaucccagcaauuugggaggccgaugggggaggaucacuugagcccaggaguucaagaccagccugggcaacauagugagacccuaucucuauuaaaaaaaaaauuucaacaugucccagauggaacuccuuagcuguccuauaucucgauguugcugcuucccuaggauuucauacgauccucagcacauccaaaaucugcuugcugacaugcuccccaacccuaccccaucaaacugauuuuuuuuuuucuuuuuuugaaacagcgucucacucuguugcccaggcuggaaugcaguggcaugaucacgguucacugcagccuccaacuccucggcuuaagccauccucccaccucagucccccaaguagcugggacuacaggcacacacuaccacuccuggcuaauuuuuaaauuuuuuguaaagaaggggugucacuaaauuacuuaggcuggucucaaauuccuggacucaaguaguucuacugccuuggucucccaaaguguugggauuacagacguggccaccgagcccagacccaaucugcuuugcuuuuucucacuucgguugaugauaccugaaucccuucagcagaaggaugagguucugggcuguguuuugcaggagauguaggggacuuggaggauucuuaaacuggacuugcuagaauuaagaccacgccuaccuggcucuuacccucugaccucccagcuuuacucucaagcuggacaucuguucuaucccaacccgucuuggcagcuaagcucauagacuaugggauccuaaugcugcccacuggcgguguggccuugggcaaauuacucaaucucucugugacuugguucgucugugaaaugaggauaauaugaauaccuaguucuuaggguuguuaugaaguuugaaauacacacacacacacacacacacacacacacacacacacacgcuguucucugaaugauccaacaaagaaguaagcucuaugccauuuuacagauaaggaaacugaggcauggaacaguaaauugacuugcuugauggcucacaauaagugcagugcugggaucauacccaggccaccugaacuccuuaaugaccaugcugugcagcuuccaaagggggcaccugugaccugggaaccccggaaauguggggagaagucacuucaggcuccacaagugaaguaaggacuguuaucuccaaccggacuagagugucauuuuaugcagauuuguguaaucaaauuaaugcauauguugaguugacuuuugccuauuucauccauuucuguaaaauuuuuucuauucacuguccaaaacucauuuuaaaauuuaacuaggggccaggggugguggcucacgccuguaaucccagcacuuugggaggccgagguggguggauugccugagcucaggaguuggagaccagccugggcaacauggugaaacccagucucuaccaauaaauaaaaaaaauuagcugggugugauggcaugcgccuacagucccagcuacaugggaagcugaggugggaggaucgcuugagcccaggagguggagguuacagugagcugagacugggcaugguggcuuauucuuguaaucccagcacugggaggccaagguggaaggauugcuugaggccaggaguuugagaccagccugagcaauaucaguaagacccugucuccacaaucuugcuuuuaaauugaaaaaaaaaaaaauaagggcauacaaucuauuuacaagugcuguacccucaugaucuaaucaccucccacaagccccacuuuuuuuuuuuuugagauggagucuugcucuguugcccaggcuggagugcaguggcaugaucucgguucacugcaaccucugccuccuggguucaagugauucuccugccucccaaguggcuggcauuacaggcaucuaccaccaugcccagcuaauuuuuguauuuuuagcagagacgggguuuuaccauguuggccagggugaucucgaacuccugaccucaggugauccacccacuucagccuuccaaagugcugggauuacagguguaagccaccgugccaggcccaagccccaccuuuuaauaccaucaucuuggagguuaggauuucaacauauaaauucuaaggggaucuguguccuguggaaauggcaaggggccacagcaccucccucccucaaucaccuucuucuggucucuccucuaaggucacuucuugagugaggucucccugaugaccuccuuucccaugucacaucauucugguucguauucuuuacucagcaagucauaaccacugcgugccuccauuuuucaaucuguaaaauggagacaauaauggcgcuggccucauggaguuguuuuaagguaaaaaugaguaaauauagaguaaugguucucaaccaggggugauucuuaucccaggguggagacauuugguaauaucugaagacauuuuugguuggcaugacuaggaagcugcuacugguaccuagugaguagaggccggggugcugcugaaaucucugcaaugcacaaacccucuacuaguaagaacuggccaauacaaaacaucaguagugcugaagcugagaaacuaugcuuuagggaaaauguuuaagauggugccuggcucuuaacgaucacccaagaaaugccagcugucauuauugcccaccacccuuucccucacacuuugccccgaguggauucaucaguaaauacucgcuuuauaaacauaaagauugagggaugcauuccucacaaccaggcauacaguaagugcucgauaaaaauuugguuaauguuagugcaugugaaagguaaaugagauggugcauucuccagugucaggcacaaggcgggcauuucauagauauuuuauuaguuaaugcaugugaggguuaaagacuaucucuggggauugguacacaguagaugcucaauaugugucaagugaauaaaugagaggaccaaaugaaaugguguuugcacagcaccuggugcaugguagcugcucagggcucauuagcuuccucaccucauccccagacccuaacacuuaccagcuaccuggaccucagucuuggccuucauaguccauucagaguugaugguaauggcuacuugguaggugccacugucuguaggcugggcgcggcgcagcagcauggaaccauuggggaagcccacgaugucucgcugucccauggcacugccaucccucugaggccguuguaucccagggauguagguaaauagccucgugccuccguacgucuccucccccagguaccaguugaaguccuggaaggugucugggacacccuggacugacaggagaagguccugguucuuuugaggcugcucuggaaucuucuggauguagagagcugccugggagccuuggagcauccagaggaccaggauugaggcugugggaaguuacagggaagggcugagaucagggguguugccagggaccauggcaugcuccucucuagauacagaucuucagcggggagcaaggacucugagugcugcucauuggaaacaaugcugggauugauuagugaugucugcccugggugcaggagugggaacacaggcaugguuaccacagauuugccauccuguugauccagagguuuuucuaccuugagaugcuguguggccugcuucuaaacacauggacucucugaauucauucauucauucauuuauucaaccaauacuuauaggcauauguaauauauaagcuauaauaccaacuauauguaauacaucuaaacuuccuucaauuucuagacacuggagauauagcagggaaccaaacauacauaaauuccugccuucaugguccuaacauuauagaaaauuccauagauaaaauggcaaugaggcugugauucuguugccccucccccaucuuauucuaauuucauccucucagguaaucuuucccuacuucuaagaggaaacuucaaucucugggcugaguccccauuucuccccuuggccuuuagggucuauuuccuccuuaccugagagcaggaggcucuuugagaagcagcccuggguccccaugggaaucuccaucuuggcgucuuguggaaaugccaaggggccacgagcuggacacuaagggggccagaggggugggcccuggcugucugaaguaggccagcucaguggggaucccaggggugccuuagagacaccgcuggggcuggcccagccccagcaugcccuguccaugggcucuggaggcuccaccuauacucccugggaugggagcacagacagagguugaaccaguuuuucagggugacuggggaacuucccaggacuccuccccugacccucuucaaccucuuuuucucacucagcgugacuacaacagcagucacuguagcaauagucauaacagccucuguuugaacaauuccccuggguuuguucaaacacacacugccucauucagcagccaccauaaauaacuguucccauugcacagauguggaaacagaggcccaggaaaagaggcaagucugccaauagacagaggugggauuucac

SEQ ID NO: 191730 - RNA, 32267 nt, Homo sapiens
cucgcgcgcuugcgcacuuuagccagcgcagggcgcaccccgcccccucccacucucccugccccucggaccccauacucuaccucauccuucuggccaggcgaagcccacgacguugacaugccggagauccgccuccgccaugucguguccugcagcagccaggacucggugagggaccugcaugggggagguuggaagacgugagggaauuaaugaggauagcucuuaaaagagcuuuugggguucucuuggaagucuaaggagagucauggggggauuuccaggaggcuaaaagugaauuguggagagauguugaauuagggacguuccggcgucuagggaacuuccggagagaaaaggaggaauagggaagcuuucuuggagagcccauaggugaacuuccacgggaaaguguuguaggggaaacuccaggcagagugucgggggauuaacgggagagcuuaaaucugggggucguagaggccuugggaggacucaaaggaaucaucugagagcuggaggccuagcugucaucucugugcccuaauucuccucucccacuguuguuuccagacucacugugcagaaaaucuucucaaggcagacacuuaccgaaaauggcgggcagccaaggcaggcgagaagaccaucucugugguccuacaggugauccugccaccccaccuccuccucacuaggagucuggaguccgggguuccagauucugcuccugagccaacuggcaguggguuuagucacuuucuuugcugggccucagcuuccuuacucggaaaaugggcagcauaaucccugugccccucagcagagaggaaaggagacccaaggauuaaguccaggaugaccacaggaaucagugugugguccugggcagguggcaucuacuuucuggguuccaguuuccucagcuggaacaaaaugaaucauugccacguacucugccuccugcagccagugggcucagggcuggaagguguccaggaaggucgucuaagccaaucaacuccacuuuaaagaaggggaaacuggccggaugccguggcucaugccuguaaacccagcacuuucagagccugagaugggaggauugcuugagcucaggaguuccagaccagccugggcaacauaucaagacccugucucuauuuuuauuaaaauaaauaauuuuuuuuaaagaauaauagccagguauggugguucacaccuguaaucccaucacuuugggaggccgaagcuggaguauugcaugagcccaggaguuugagaccagccugggcaauacaguaagaugucaucucuaccaaaauuuuauagauuagcugaguaugguggugugcaccugcaaucccagcuacuggcgagucugaggugagagaauugcuugagcccaggagauggaggcugcagugagcugagauugugccacugcacuccagccugggcaccagagugagacccccaaaauauaaaaaauaaaauaauaauaaugagagcuggcauuauucaacguuaccugucagucgcugcucuacacaccucacucacauggauuagcucauugaguccucauaaaaaaccccaagaggcaggcucuguuauccccacuuuuacagaugaggaaacugaggcccaaagaaguuauacaauuugccugacagucaaucuuuuauuuaucuguugagacagagucucacucuguucccaggcuguagugcaguggcaugaucuuggcuuggcucacugcagccucuaccuccugggcucaagcgauccucccaccucagccuccugaguagcugggacugcaggugugcaccaccaugccuggcuaguuuuuuuuguauuuuuuuagagaugggguuuccaccauguugccaggcuggucucaaacuccugggcucaagcguuccuccugcuucagccucccaaagugcucggaugacaggcaugaaccauuguuccuggccugggggcugcuuuaugacuauaaggagcagaacacucuguggauagugcuagggugacggaaaaauuaaccuuuugugaaugggcagucauucagcaaauauccacuccucucccucccacuggagggggaguauauuucccugcuccauugaugaguuugaccauaugauuuacuuaauggaauuucagcacaucuaacuucagcaagggccuuaaaugcacuuggcuuuugugcucccauaauaugccaugagaacauuugccagguuacugcuaaucccagaaaacuguggaaucucauggaagagaccugaauccucccaaacugcagccaaagcagccaucccacaaauucuuauaagaaugcuuguugguauaagucucaguuuucauguugggaggucgaggugggugaaucgcuugaacccaggaguuugagaccagccuggguaacauggggaaacccuaucucuacgaaaaauuauaaaaaauagcugggcuugguggcguaugccuguagucccagcuaccagggaggcugagcggggaggauugauugagcccauaagguugaagcugcagugaacugugaugguuucacugcacuccggccugugagacagagugagacuguaucucaaaaaaaaaaaaaaaaaaaaaaagaaaagaucucaguuuuaggaugauuuguuacacagcauuauuacaguguaaguuaauacaacuugguuguuuuaaaccacugagauuagggacuccuuuguuacuguaacaucaucugguccaccccaauugaugucaguguuuagugccugucaacuaauggccuccacuucccagguucaaaugauucucaugccucagccuucugaguaguuggaauuuacaugccuggcuaauuuuuguauuuauaauagagaccgaguuuugccauguuggcuaggcuggucuugaacuccugaccucaggaguucaaggcaaaugagcaccaaaugcuaauuuaagugauccacccaccuuggccucccaaaauguugggauuacaggcaugagccacugcaccugaccucagucuuuuaaacugugauagauacagauugcugacaguuuuagucuugagaucuagauucaagcccccagcucuuccucuuaaucggugaccucaagaaaauuguuucauuucucuaaccuguuuucucauguguccauugggaauaaugacauccaagcccggaguugugaaaauucggugacauaaugucugcacaagugcucugucaacauguagguguuuguguagagggagggauuuguguuuuuauuacuuagugggugaugauuccacugggcucucuuaugaucaagugacuccagggaaaucacauuucauucuguuaccccaguugcuguggaaacagagugacuggaggcagaagagacagaaccugucucuggccugggagagacugagggaguauugcagcggucaccaacaugguaaaccccagagggagcagcuuggggaggugauguguuucaguugggauguccagguuugaugugacuuugggacauucuagggguggcauccaggaggcaguuggggaucacauguggagcugaagacagaauguggggaaguugucagugcagagaaagaaccuauagacucgggaguagaugauggauuuauuuguucauucacucauuuauuuagucaaguauuuauuaagugccuucuguaggccaagcacuguuuuaauacagcaguacacagcagaagacaaaaaauauucacucucaguggggugcaguaagcucacgccuauaaucccagcacuuugggaggccaaggccuggcaguucgagaccagcuugggcaacacagggaaacuucaucucuacuaaaaauacaaaaaucugccaagcgugguggccuaugccuguggucccagcuacuccagaggcugaggcgggaggaucacuugagccuggaagaucaaggcuguagugagcuaugaucgcaccauugcgcuccagccugggcaacagaaugagaugcugucucuuaaaaacaaaagaaauucagucuuguggagcuuucacguuaguagggaaagacugacaaaugagucagugaaacauauguuggaugaugagugcuauggaggaacuuaaugaaggggaaugagagugccccagcuggagcuggagcaguggcaaggauuuuuauuuaaauaguaggguccgggaaggccucccugaaaaggggacauuugagcaacaugagcuauguauguaucuagggaaaagacucugaagcuggcuugugacagcaaggaggccaguauggcugggguggagucagccagggggagagagguaggagaugagguaacagggugggacugggaaccccuaaaaaaccacuuaaggccuggaaagccauugaaaggacuugagcuuuuacuccaggugugagauaggagccaccggagggcuccgagcagaggagggacaggaucugccuuaggccuucacaggauccugcuggcuccauguugacaaucaacugcaggggccacacacaggagugggagaucagcauugcagcaguuguuuuguuaacuuacuccacgucagagacccuuuggaaugacugauugcaucuggcaaugacuaauuugugggguuacucuggauucaucaaaugcuaauuuugauucuuuugacguaacugauaaaggcagacauuucuggccaccaaggcaguaggcuuaucucuggguuguuauguuauguuuugagacagggucucacucucuugcccagguuggagugcaguugcaaagucauggcucacuguagccucaaccuccugggcucaggcaauccucccaccucagccucccagauagcugggacuacaggcgugugccgccaggcccagcuaauuuuaaaaauuuuucguagagauggggucucacuauguugcccagccuggucucggacuccugagcucaagcaguccuccugucuuggccucccaaagugcuggcauuacaggcaugagccacugcaccuggccacaucuguggguucuucuacuacccugcauuuucuccucuaauuauuguuaugcaaaaucucgaucuuaccacauggggcuuagccaucugcuuaugacagccccacacaccugguuguuugcaguagccacagcaggcucuguugucuguucaucaccugcucccagagggaaaugccaaccucuuugcuaacuacuccugggcuggagggguggcuuggacaagacccagauauaacucuggugugucacuggaggugugucauuuuuagaagaaauguucaucagcaauagggccuauggucauuuuugauuguuauugguuuucuaaucacucaguucgccacuguggugucuuaaauuuguuuuuacuguuuuuugauguguaacauacauagagugaagugaagguguaaguaagaguacagcucagugacucuuugcaaacugcagcccuguguacuccacacccagaugcagcacagaacaugccuagcccccagcaguucccucagguucuuucugucaguaccccugcaaggguaaccacuguccugauuguuaacagcauagauucauuuugccugauuuugaauugcauauaaaauggaaucgugugguauaaacuuuucuuaucuggcuucccuuguuauguuuguucauuucaucuaugucguucaguguagcuguagaugauuuauugugauuuuuuuuuuuucugagacggaguuucgucuuguuguucuggcuggagugcaauggcacaaucucagcucacugcaaccuccgccucccagguucaagugguucucuugccucagccucccaaguagcugggauuacaggcaugcaccaccacgccuggcuaauuuuuuguauuuaguagagacagguuuucaccauguuggucaggcuggucucgaacuccugaccucuagugauccaccugccuuggccucccaaagugcugggauuacaggcaugagccacugugcucgacuccuauugucuuuuuuuuuuuuuuuugagacagggucucacuauguugcccaggcuggagugcaguggcaccaucucagcucacuacaggcucgaccucccgggcucaagcgauccucccaccucagccuccucaguaguugggacuacaggcaugugccaguucaccagucuaauuuuuguauuuuuuuugcagagaugggggucucacuguguugucuaggcuggucuugaacuccuggacucaagcauuccuccugccucagcuucuuaaauccuugggauuacagacaugagccacugcaccuggccuauugucauuucuguauaguauucuguuguauugagauaacuauuaugguuuuauuuauuuauauuugauuuucuuuuuuaaacggagucucacuauguugccaaggcuggucuugaacuguugaucucaggugaucccccaacuuggccuccugaguagcuaggacuauaggugcacaccaccacacccaacuaauuuuuuuuuuuuuuuuuaagcuuuuuggaggcagcuuccugaguagcugggauuacagggauuacagacagagccacaaagaccuggccauugggguuuuauuauauuugcuuucugaauggguauuauaugcauauagugcaaaauucaaaaggugcaaaaggguauacacuaaaaagaaaaucuccccucacccuuuccaucccucccugcucccuccccaacuccugcucccuccccaacuccugcucccucauucuucucuccugaugcaaccaccauuagcaguuuuuuuggguggucuuccugggucauucuguacacauacaagcauauauaccuaccgccuccaucccuuuuuaaaaaauucauaguauauacacuguucccuuguguguuuuuuuucaaguaacaguguauuuuggagaugcacacugcaugaaguucuaccuuauuuauuuauuuauuuauuuacuuacuuacuuacuuacuuacuuugagacagaaucucgcucugucacucaggcuggaguguaguagugcgaucguggcucacugcaaccucccccucccagcuucaagugauucuccugccucaaucucccuaguagcugggauuacgggcacaugccaccaggcuuggcuaauuuuuguauuuuugguagagaugggguuuccccauguuagccaggcuggucuugaauuccugaccucaagugauccuccugccuuggccucccaaaguguugggauuacaggcgucagccacgccgugcgcagccuaccuuauucuuuuaaaugaugcauacaauugcauuucauggccgggcgcgguggcucacgccuguaaucccagcacuuugggaggcugaggcagguggaucacgaggucagguguucaagaccagccuggccaagaugguggaacccugucucuacuaaaaauauaaaaauuagccaggugcaguggugggcaccuguaaucccagcuaccugggaggcugaggcaggagaauuguuugaacccgggaggcggagguugcagagagccgagaucgugccacuguacucuagccugggugacagagcaagacucugucucaaaaaaaaaaaaaaaagaaaagauugcauuucauggaugugaaacaguuuuuuagcaauauaucucaggaacuuugccuuccugugccauguuuguuucaggaacaguucauaucagaacugugucucccugagaaagcugcaugcacacgaacccaggccaucggugauagucaucuugugcucuuauccucacagcugauacauacugagcacucaucucuuauuuugagaaaaauucacauaaaauuuacuguuuuaaccauuuaaagugcacauuucagccagaugcgguagcucacaccuguaaucccagcacuuugggaggccaaggcggguggauugcuugaggucagggauucgagacuaggcuggccaacauggugaaaccccaucucuacugaaaauacaaaaauuagccgggggugguggugcgugccuguagucccagcuauucgggaggcugaggcaagagaaucacuugaacuggaaggcagaguuugcagugagcugagauugcaccacugcacuccagccugggcaacagagugagacuccgucucaacaaaaaacauaaauaaauaaauaaauaaagugcacauuucaggguuuuuuuuuuuuuuuuagcauauugacaauguucuucaaccaucuccauucucuaauucagaauauuuucaucacuccaaaaagaaaccacauaaccauuaaacagucacuucuuauucucuccccaauguugcccuuggcaaccacugaucuacuuucugcuucucuggauuugcguauucuggacuuauaaauguauacguggucuuuuacacuuaaccuuguuacacuuugcauaauguuucugagguucauccauguuguagcauauaucacaacuucaguuuuuuaaauaacuggaugauauuccauaaauauacuguacaauguuuaucuauucaucaacugauggacauuuauuggguuguuaccauguauauauaaaccuuuuuuuuuuuuuuuuuuugagauugagucuugcucuguugcccaggcuggaaugcaguggugcaaucucggcucacugcaaccucugcuucccagguucaagugauucucgugccucagucuccugaguagcugggacuacaggcgcaugccaccaugcccaacuaauuuuucuguuuuuaguagagacgggguuucgccguguugcccagguuggucuugaacuccugggcucaagaaauccaccugccuuggccucccaaaguguugggauuacaggcgugagccaccaccccagccuccauguauaaacauuuuuaucagauucuuaaaaaguauuuauuuacuuuuuuuuuuuuuuuuuuugagacagagucuugcucugccacccaggcuggaaugcaguggcaugaucuuggcucacugcaaccuccgccuccuggguucaagcaauucucugccucagccucccgaguagcugggauuacaggcgccugccaccaugccugguuaauuuuuguauuuuuacuagagacgggguuucacccucuuggccagccuggucuugaacucuccugaccuugugaucugccaaccucugccucccgaagugcuaggauuacaggccugagccaccgugccuggccacuuuuuuuuuuuuuuagauggagucucacucugucacccaggcuggagugcaguggcaugauuucgguucgcugcaacuucugccucccagguucaagugauucucuggccucagccuccuguguagcugggauuacaggugcacgccaccaagucuggcuaauuuuuauauuuuuaguagagacaggguuucaccauauuggucaugcuggucuugaacuccuggccucaagugaucugccugccuuggccucccaaagugcugagauuacaggugugagccacugugcccagccuguuguuuucucucuugagacagagucucacuuuaucacccaggcugggguguaguggcucgucucaacucacugcaaccuccaccucccagguucaaguaauucuugugccuuagccuccugaguagcugggauuauugaggugcgugucaccacacccagcuaacuuuuuuuauuuuugguagagacaggguuuugcuauguuggccaggcuggucucgaacuccuggccucaagugauucucccgccuccaccucccacggugcugggauuacaggcgugagccagugcuccuagccaggacuuuuuuuauauacaaagaagaaaugucagggagugccuguuuaaaguagaaauaguuauauaugcaguaggaauuguucauuuaaaauacaagcaucuccauccuaccacauuuaggagcuaugcugaauauugugggagagguaaagauguugaguuugacucagggauggaaagaaaggaguugagaacaguggugguauuggacagugcuuugcagucaggcaguugcguccgaaguacucugcuaguuauuagcuugugugccauguaagcuauugauuaaaccugucugagccucaguuuccccaucugugaaacuggagucguaacagacccuucuauuuaaagugguuuugaggcuucagugaugcccggcccaugcuuagccaagugugguggacagaacaguggugcucaaaagauguucauguccucauccccagaaccuggaaauauuuuaauggccaaaggagcucuguggguuugauuaaauuaaggaucuugagauggggagagugcccuggauuaucuggugggccucacguaacccccagaggccuuauaagggaaagagggaggcaagagagcuggaaccagagcugugaagaugcaagcagagccuggagugaugccagcgcuuucagcagcuuugaagacgaggaagggacugugagccaaggaaggcagguggccucgagaagccgaagaugcaaggagacacguucuccucuagugcucccggaaggaaggaaugcagcccugccgcaucuagauuuuagcccuguaaggccgaguuucagacuuuugaccuccagaucuguaagauauuaaauuuguguguuuuuuuuuuguuuuuuugagacggaguuucgcucuucuugcccaggcuggagugcaguggugugaucucggcucacugcaaccuccgcccccccgguuuaagcaauucuccugccucagccuccugaguagcugggauuacaggcaugcgccaccacgccuggcuaauuuuguauuuuuaguagagacggaguuucugcauuuuggucaggcuggucucgaacucccuaccucaggugauccgccugccucagucucccaaaguucugggauuacaggcgugagccacugcgccuggccaaauuuguguuuuuagccacaaaguuugugcuaauuuguacaacaguaacaggaaacucauacaccaagcaccuggcacauggugagaauccgaaaauguuagccaugaugauccucuugugacagaugggacacccaggcaagcagcagagaaggggcucaacagggccacuugguaagggaggacagagccagaguuacugcuuaauaacucuugaguaguaacuucugcaaacgguugcugggcgccuguucugcgucugucuguacauccauugggaaugcaguagaggccugcuguguuaaugauauucgcagcugacauuuauguaguguuugcucggugccaggcaguauuccaggcacuugguauguuauuucucauucuugguauggauuugaauguucucaacaacuuuaugagauagacguuguuauuguccccauuucauagguucgaaaacugaggcacaaggggugaaaugaaaccauuugcuccaggaucacacagcaggaaaucagcagagcugggaaggaccagacacuguucuuggccuuggggacacaguagggaacaacucagacgauacuguccuugcucuuguggagcuuaaaagucuggcgggagagacagaugcuagacaaauacaaacaaaaaagauguaacuguguaacaccaggcaguaaucaugaagaaaaguaaagucggguagggagauagagaguggcaccagguagggggcgagguagguuacuuauggucugaagugacaucugagugggcaccugaagcacagaaggcaaacuuuuacccagcuauggauauguuugagggaagaguggucuaggcagggggauuggcaggugcagaggcccugaggugggaaggagccagacuguucuuggcacagaagggaggccguuguggcugguggaaagucaccaagccuggccuggggagcagucagacugggacuucuuguuauuguuguuuuuguuguuguuguuguuuuugagacagagucucacuccaucgcccaagcuggagugcaguggcacaaucucggcucacugcaaccucugccucccggguucaagugauucuccugccucagccuccccaguaucugggauuacaggcgcucaccaccaugcccggcuaauuuuaauuuucauauuuuuaguagagacaggguuucaccauguuggccaggcuagucucaaacuccugaccucaagcgauucaccugucucagccucccaaagugcugguauuacgggugugagccaccacaccuggcccagacugggacaucucaugagcccaggcagcacuguacacugcccagggcccagggcugggaauggcgguggaggcaggggagucagcaggaggucugccggccucagccuuaggcaggcccuuccuccagcaccaucuuccuccucuagcacgucaguggugugauggaggagcacgcguggacuguugccagccugccuggguuccgguccggcuuugccacccaccagcugugaaguuacauaaccacuuccugccuccguuugcucauguguaagauggagauaauuauagcaacugccuggcagagccauugcaggagaguagauacauguauuauuagcaggagucuggcacaccaggagcgcucagugcacucggauguuggccgcaguugugguuauaguuguuaauucugugucaucucaacuuccuucagagggaggguaaguuuuuuuuugaagacaaggucucaucacucugucgcccagaguacagugaugcgaacaugacucacugcagccuugaccuccccaggcucacgcgauccuccuuccucagccuccugaguagcugggaccacagguaugugccaccaugccuugcuaauuuuuguaauuuuuguagagacaaggucuggcuauguugcccaggcuggucuugaacucccagccucaagugauccucccaccccagccucccaaagugcugguuauagagacgugagccacugcgccuggccaaggagggaggguuguuaaugaccaucuucccuuuuugcaugugaggaaacugccucacagagacguugaauacgucacccaagguugugcagguuggaaauggcauugcuguauuugagcccaggccuaccucaccccaaguccaggcucccuccuuccauacagugguguuccuguugauagcagugugcaggugaugucuagaugaucugacagggaggcaacagagcagauuggagcaucugucaucaccaggggugggagagggcaguguaggguggacuagguaccuugguuuuuuuuuuuuuuuuuuuugugacagagucucgcucugucacccaggcuggagugcaguggcaugaucucugcuuacugaaaccucugccuccuagguucaagagauucuugugccucagccucuugaagagcugggacuacaggcaugugucaccaugcccggcuauauuuuauauuuuuaguagagaagggguuuugccauguuggccaggcuggccucaagugguccacugccuuggccucgcagagugcuggauuuacaggcuugagccacugcaccuggcccagguaccuuugagaguuguaauaaugcgucauucuaggauccuaauaaaagagccccaaacuggaaggcaggacacuugccucaaccuaacugccucccgugcccgcauggcccgcacggcuuucugcaucuucaucugucagacaggaauggcagauccuuugagaugagcccuccuauagguagcucuuuucuucuuucaacaaauaguugucuagcacugacuaauaauaccuccugacugacagcagauaauugccuacucuucgccaugcccuguggccauuauuuaugugcaugauccuagauaugguggucauucccauuuuacagaugagaaaacugaggcuccaaaagguuaacugguauggucauacagcuagugugcagcacagcugggauucaaacccaggaaccagcggugagcaagaucggacaaagccccugcccucagggagguuuccuggaguccucugcgauugugggugaggggugacaugugcuguuugucugcaugaugauuugaauaaaguuauaacucuggcaagugcuuaucaaggagagcucuauggcagugugugauaagcugaccugguggagucuggagaggucagggaagcagguaugugugaggugggcgcguaugcauucauucagugacuauuuugugaguuucugcuccaugccauacccugugcugcauggaggggacacauggcaccauucaacccuggugugcccccucacagaauugacauuacagggacauggugauccaaaggagauucauccugaggucccacagugagcccagaggcagagcaggcacugacaguggccucucucucugcccacaguuggagaaggaggagcagauacacaguguggacauugggaaugauggcucagcuuucguggaggugcuggugggcaguucagcuggaggcgcuggggagcaagacuaugagguaagcagggcuaugagauggaucccauacugaccucugccccucaugcucgcaucaccgucucccccaggggcuggggcugggaagacauggggcagaugugagucacaccugauugcugcccucuggaggaucacccaguguacggaggagacagaaggcagacacagggcgguaaacugcacaucagggaagagagcaaguuuggaucauggcuuaaaaugacacaaauguauuauucgacuguucuggaggucagaagucugaaaucacucucacugggcuaaaaucuagguguaggcagagcccuguuccuucuggaggcucuaggggagaauccauuuccuugccuauuucagcuucuagaguccaucugcccuccucagcuugugacccuuccuucaucaaagccagcacuccugucacucuaacgccugcuuccacuuccauuguuacuucuccaacucugacucucuugccuucuuuuuuucuuuuucuuuuuuuuuuuuugagacggagucucgcucugucgcccaggcuggagugagugcacuggcgcgaucucagcuccuugcaaccucugccucccggguucaagcuauucuucugccucagccucccgaguugcugggacuacaggugcccaccaccacgcccggcuaacuuuuuuuuuuuguauuuuuaguagagacgggguuucaccauauuggccaggcuggucucgaacuccugaccucgucaucugcccgccucagccucccaaagugcugggauuacaggcgugagccacugcgccuggccuucuuuuucuuuuguucauuuuuuuuugagacaggguuucauuuccguugcccaggcuggaguacaguggcguguucucagcucacugcaacuucugccucugagguucaagugauucucccaccucagccucccaaguagccagggcuacaggugcacaccaccacuccuggcuagcuuuuguuauuuuuuauagagagaggguuucacuguguugcccaggcuggucucaaacuccugggcucaagugauccacccaccccagccucccaaagugcuaggauuacaggcaugagccaccacacccagcccuccuuucuuauaaagacccuuaugaugacacuuggccuacccggauaauccaggggcaucucccccauuucaacaucuucaaguucaucacaucugcaaagugccuucugccacauuuccagguucagggauuaggauguaaacaucuuugaggagcuguuauucugccugucuccuauguuuucuucuagaagcuuucuauuuuuagauuuuacauuuagaucucuguuucaucucaagugaauuuuuguguauugugugaagcaggggauaagguuuauuuuuucuguaucuuuuuuuuuuuuuuuuuuuuuuuugagauggagucucacucuguugcccaggcuggagugcaguggcgcgaucucggcucacugcaagcuccaccucccggguucacgccauucugccucagccuccggaguagcugggacuacaggcacgugccaccaugcccggcuaauuuuuuguauuuuuaguagagacaggguuucacuguguuagccaggauggucucgaucuccugaccuugugaucugcccaccuuagccucccaaagugcugggauuacaggugugagccaccgcacccggcccuuuucuguaucuuuuuuauauguuuguugacaaugcuuauuuauuuauuuuauuuauuuuaagacagagucucacucuguuggccaggcuggagugcaguggcaugaucuuggcucacugcaaccuccgcuucccagacucaagggauucuccagccucagccuccugaguagcugggacuauaggugugagccgccauacccggcuaauuuuuuaaaaaauuuuuuguagaaaugggguuucacuacauugccuggcuggucuugaacuccugagcuuaaagugauccucccaccuuggccucccaaaguauugggauuacagaccugagccacugcaccuggcugaaaauacuuugaaaaaaaaaaaaagacuugccuuuucucauugaaucauuuugacuccuuguugagaauuaauuaaccauauguauggguuuauuucuguacucucuucucuguuccauugauauguauaguuuucuuuaugccaauaccaaacugucucuuuuuuuaaccauauuauuuauuuauguauauauguauuuauuuauuuauuuauuuauuuauuugagaugggggucucacucuguugcucagguuggaguacaguggcaugaucucagcucacugcaaccucugccuccugggcucaagugauccucccgccucagccccccaaguagcuagugggagccaucaugcccggcuaauuuuuaaauauuuuuuguagaaauaggguuucacuguguugcccaggcuggucuugaacuccugaggucaggugauccaccugcugcggccucccaaagugcuaggauuacacaugugagcugcuguguguaccuggccuacucuuuuuuuuuugaaacgaggucucacuuugucacccaggcuggagugcaguggcacgaucucagcucacugcagccuuguccucccggguucaagugauccuccuuccacagccccucaaguagcugggacuacaggcuugcaccaccaugcccaacuuugcacuagucagugugacaaggugagaaaaagaaaaaagaaaacuaucuuuuuucacagauggcaugauugucuaugcagaaaaucccaagagaucuagacaaacuacaagguuuaguaagugaaggucacaagaugagaagucaauauacaaaauaaacuguauauuacacaucacuucugugguauucuggccaaagugugcaaccuaaauuaaucacaaggaaacaucagauacuuuguacaauaagugauaucugacaaaaaucacugaccucuacucuucaaaaacaucaaaggcacaaacccaaagucacaggagccuuccuuccuuccauucucccuccccuccuucccucccuccuuccuuuuuuuuuuuuuuuuuuuuuuuuuuugagauggaauuuugcuccuguugcccaggcuggagugcaguggugcaaucucgguucacugcaaccuccgccucccagguacaaacgauucuccaucuuagccucccaaguagcucggauuacaggccugugccaccaugcauggcuauuuuuuuuguauuuaguaggacaggguuuucccauguuagucaccagaugauaaaugcagcuucccugucagcuccaaaucaggccuuuuauaaacaaguauagucaaggucaggaagaaaacuucccuucuguauaauugucuuucuuguuuccuuugcauaaucagcugugcacaaagagagcuauaguuauguucuguuuuucucagcaaaaggcuuuauuguccaauuuuauaauuucacagcaugucaguuagaaaagagacuaagucaguaacaaaauauacccaaccaaaaguggcugcauucaucuuuuuuuuuuuuuuuuuuuuuuuugagacggagucucgcucuauugccaggcuggagugcaguggcgcaaucuuggcucacugcaaccuccgccuccuggguucaagugauucuccugccucagccucccgaguagcugggacuacaggcacgcgccaccaugcccagcuaauuuuuuuguauuuuuaguagagaugggguuucacuauguuggccaggauggucucgaucuccugaccucgugauuugccugcuuuggccucccaaagugcugggauuacaggugugagccacugugcccagucuuuuuguuucguuuuuuguuuuuuggcagagucuugcuccgucacccaggcuggaaugcaguggcacaaucucggcucaccaucaccuccaacuccuggguucaagcgauucuugugccucagccucucgaguagcugggauuauaggugccuaccaccauguccagcuaauuuuuguauuuuuaguaaagacgguguuucaccauguuggcuaggcuggucuugaacuccuggccucuuguccaccaggcuuaagugcaauggugcgaucucagcucacugcaaccuccgccuccuggguucaagcaauucucgugccucagccucccgaguagcugggacaacaggcgucugccaccaugccuggcuuaaauuuuguauuuuuaguagagaugggguuuuaccauguuggccaggcugguauugaacuccuaaccucaaaugauccgccugccuuggccucccaaagugcugggauuacaggcgugagccaccgcgccuggccucagcuuggguuuuucaaugcagauugcuaacaugaauugcuacucucaauuccuugagagaacagacuugugaggaguucucccgagaagaauuuucaccucuucuuugguguccccccaagcuaaggccaagacagacaggccucccagggacucuuuccacaggcuuauuuccccuucauguaacuagugugggcguugccuuuggggaguccucaguucuaugcaguguggugaggaucucugagaugccacucucccuugcuuggagccuagguuuucucucuuguucucuuucaccaccacgugcauaacccuuaaagaucaaguucuagcugggugugguggcuuacacuuguacuucuauagcuuugggaggcugaggugagaggaucauuugaggccaggaguucaggaccagccugggcaacauagcaagaccaugccucuacaaaaaauaaaaaauuagccagguguggugucgugcaucucuagacccagcuacucagaggccaaggugggagaaucacuugagacccagaggucgaggcugcagugagcuaugaucgcaccacugugcuccagccugggugacagagaaagacccugucucuuaaaaaaauaauaauaauaaauaaaaucaaguuauuugcuaucugggaucagcaccaugacaaacuaccaacaugagugcugccgggucagucaggguccuugcccggagauuaaaaccacaccaguuauuuuaacagauaauuugauagaaagaaccaguaacuagguguuacuagaagacuaagauaugagggagaagcaaccgcagggaguagcuaccacucccaggguugggggaacaaaagaaaggagcaggaauuauugaaacguagauguuuggaaacugggagguggggcuccaggagcugaaauucagaucguuugaggagggcuuccucccccaccggcugcugagaggggcugaaugaggcuguuucuggagguauugggacacugcaaacuggauucaucugcugcugcaggcaggaaccacugcagcagcagaagcuuaacugggggugaugcucacaggaucugcaaugcacgagaagcugguccuuccucccuccugcagccuugcaaacucucucucuugcccccccuauuggcagagccuggucacgaucagcuagggaagcagaaaggugguuugccaagugcgggcccagaucacagagaugaguuguagaggguagguuugagcugagaaacaaucacuuaauacuuagugcagcucgccugacucucuggauucuguuuucucauuuccagccucuaguaauuccccuugccuuuccgcugacucaccugugcauuuccaaaagguguuugaauauugugccaguuuacugaauauucucugccgggaaaguuccuuaggacauguagcccgcuguauugccagauauggaagacuccaugggagaauuuagauaagggucgcucacaucuggaggauaaagagaucccucuggggccugugucagggcaggacugacucaaggccuagaaacaaagggucuggagacaucuaggcccaagcuacauucuagugacucccaguccccugugugggcccugugcccucuuccccagccccuagaagcucucaucuaagccaaccugcccugguucucaugcacuguggcuucucccacccagguccuucuggucaccucaucuuucauguccccuuccgagagccgcaguggcucaaaccccaaccgcguucgcauguuugggccugacaagcugguccgggcagccgccgagaagcgcugggaccgggucaaaauuguuugcagccagcccuacagcaagguaccuagggugggagccagggugcagaguccuugguccugggcaaggagggaaauaagggccaauauugagucccauagggcugggaggaguagacagcuggugucccaugggauuauggggaggcugggucccugcguucccugaaauggguuugggaucuuuccuguaaugagaaguuucaucucccggaggaaucuaggaagggugaacugcagcaucucagaggggaaucggaggaggggaacugacuuguuagagagguggccuaguagagugggccuaguaguuaacaucaggagaucuggcgucugauuacugaguucacguccuggcuauaccacuuuuuagcugugugaucuugggcaagugacuuacgcucucugggccuccauugccugauccuuacaggguugcuguagguuaagggaugcuaaaagcugugguaacagugagacuggaguaugugaugaugccacacacuaaaggugugcuucuugcccagguaacuguccuggggaguguuuagccugucagcuggcuucuccuuaugaggucgugcagggacccagacuucuccuauuuucuggcucugcauccagcuggcagaggagagagccuggaacacuucuguguucuggaaguggcacgcagcacucccucccauuccacaggcaggaguuugugcauagggcagugaauucgcugggacaccuaguagacucugccaauugcccaaagagcuaaugcgugaaaagggcuuggagccagacucagaguuagggcucagucauaacagcuuaauccuauaauugucaucaccaucgccagggccccuccuucaacauggguguucaugagagggaaggagccaggaagagguuucccugagugaaaagggucuugggcccuggccucuguccuugggccagacucccugacucccaccccuccuuucccaggacucccccuuuggcuugaguuuuguacgguuucauagccccccagacaaagaugaggcagaggccccgucccagguaagcuguaccugucacuccccauggccuucucccugccucuccacccccaccugccagcagcccaccuauaauacugaccuugcgggaccuuagaaggugacagugaccaagcuuggccaguuccgugugaaggaggaggaugagagcgccaacucucugaggccgggggcucucuucuucagccggaucaacaagacauccccaggugagcucggacaacguggguccugagugaguaggguugagaccuagacucgugggucugaggguagagggggcuggggcucagauuccugggucugagggaggaggguaguggaguccuggacuccugggucucaggguggaggaaggugggccuggccucuuguguccugaggguugagaggucuggaggcugggacuccuggaucacugguggguuuuggcaacaauauucugugucccauagauaggagugaaagggucuuggggcucagcccucucauccuggauccacuuucucccuucauagucacagccagcgacccagcaggaccuagcuaugcagcugcuacccuccaggcuucuagugcugccuccucagccucuccagucuccagggccauaggcagcaccuccaaggugaaaucaucagacuuuggugggguggaggaggagagaagcuggaggccucaauccauccccauccccucagccccaggagucucccaaagggaagaggaaguuggauuugaaccaagaagaaaagaagacccccagcaaaccaccagcccagcugucgccaucuguucccaagagaccuaaaugugagcuaacuagaucccuuguuuccacaggggccugugcuccuguguccuaggggaagcggggcuggagccugcuguccugaaucugagggaggaagggcugggggccuggaccccugggucugagggaggaggggcugggggccuggauuccugaauccgagggaggaggggcugagggccuaaaccccugggucugagggaggaggggcugggagccuggaccccugggucugagagaggagggguugggggccuggaucccugggucugagggaggaggggcugggggccuggacuccugggccugagggaggaggggcugggggccuggacuccugggucugagggaggaggggcugggggccuggaccccugggucugaggggggaggggcuggggccuggauugcugggucugagggaggagggucuggggccuggacugcugggucugagggaggaggggcuggggguugacccccaguggugcuaaccuaaucuacucuuugucuucuccagugccagcuccaacucguaccccagccacagccccagucccugcccgagcacagggggcagugacaggcaaaccccgaggagaaggcaccgagcccagacgaccccgagcuggcccagaggagcuggggaagauccuucagggugugguaguggugcugaguggcuuccagaaccccuuccgcuccgagcugcgagauaaggcccuagagcuuggggccaaguaucggccagacuggacccgggacagcacgcaccucauguaggcuugcgccccccucccugcgccgcugcaguuucucccccagcucccugugucuccuccaccuugugcuuucucuguguccacuaugcugcaugcuuucucucucucucacuugcuuucuuucucacugcauucuguagccuuugucuucucucugauuuuugcaucucucccuuggucuccaaccucuuuuuguuucucccaccucaaucucaugaucugucugucugucugucucucucucucucugucugucuccccugucucguuccccuuugccccucagaucacaccuaacuggcaucuucacuucugccccccaccagcugugccuuugccaacacccccaaguacagccagguccuaggccugggaggccgcaucgugcguaaggagugggugcuggacugucaccgcaugcgucggcggcugcccucccagagguaaggccucacacgccaacccugcuccuuauccugugcugggcaaugccaggaaucuggaggggagucagacuggggccugccagcggagaacacagguggucccagcccagagccagcagacuacugagaggagcggggcaggggcugggguacuccagaugagggaaggaggaccugccugggaggucacagagggcucugugaagccugcuuaucagaaaaggcuggaggagcaguuugugcaaaaacucaggggugggagaacaaguguuaggguccauauucauucauucaaagugagucccggugcaguggcucacgccuguaaucccagcacucugggaggcugaggcagguggaucacuugaggucagaaguucgagaccagccuggccaacauggugaaaccccaucucuacuaaaaacacaaaaauuagcugggcuugguggcgcacgccuguaaucccaguuacucggaaggcugaggcaggagaaucgcuugaaccuggaagccaaaaucgugccacugcacucuggccugggugacagagcgagacucccaucucaacaagaaaaaaaaaacccaaaaaccaaaaugagucccagaagccccugcuuggugccaggcuggaaugugcaaggcugaggauccagucauugagcccugcccuugaaggcuucucacuuugaugagggaucagaauuguuguaacagugcaguggaagccccacaggguggcccgcagagagcgaggggucuucaagguccaagagagguuuuucaggcugaacagaggcagagaacaugcugggcagaggagacaaggucaggucagccuguugucugccuggaguuguaggugaggcugagcuuacacaggggcaagaaguggcaggaaaaaugggacuggggcauuaggaaccacagaaggcuuuggacugagcaaaggcuagcucauaucugagguccaugaauuggaggggagacuggauuguacuccauggccugaguguguucagaaguuaguuguaccugguguauuugagaaauuauuugccuugggggauagcgaggcugugaggugggugggcucaggucagaaggggcuuccggagcccaggcuacacacugggcuccaugcagcuucacagaacccucaucuguuauucaggaauccaaacaucucuagaagcugaaaguucuuuucuagguucagcacaaacucauuucgcugcagucauccugaacuaaugugaggcuauuugcggacuuuuuuuuuuuuauccccuuaagugugucauggucuuaacugcagaaauauuaguggguuugaucauggggugcucccccaggcccuccugggaguuuauguaacaaucuguaugccagccauuugccucucuaaaaccugaaagauucaaaauucugaagcccauccagcuccagaggccuccucuugugagcagaggggagucacagaagguuugaugggggcaggggcaggcucuguugggagggaugaagugucaaggggaggcugcagguggggacuccugaguaggcuggggccucaggaacagaagaggggaugggcuggugcuauaucuggggcagaaggaaccagauuuggguuauuaucugccugggagagcuuaaggagggcaugaaagaaagggaaaaagacaaacaguguuggauuugcaacuggucuuaacaaaaagaauucacaaagcauuuuauauuuuuaaaaauucuggcuuguacucauuuauaaacuaaaaaaaaauaacuauaugaugcaggcaacguggugagaccccaucccuacaaaacaugaaaaaaauuauccaggugugguggcacauaccuguagucguagauacuugggaggcugaggugguaggaucacuugagcccaggagguucaggcugcaaugagccaugauugcaccgcugcacuccagucuagguggcaaaucaagaccuuaucucaaaaauaaaaauuuggcugagugcaguggcucacgccuguaaucccagcacuuugggaggccaaggugggcagaucacgugacaucaggaguuugagaccagccuggccaacaugguaaaaccccaucuguaccaaaaaauacaaaaauuagcugggcaugguggcgcacaccuguagccccagcuacucuagaggcugaggcaggagaaucccuugaaccugggaggaagggguugaagugagucgagaucaugccacugcacuccagccuggggacagagcgagacucugucucaaaaaauaaaaauaaaauaaaaauucaacuauagaaggaagaccccaagaggaugacucuccauaccuaauaagcacaaauuuaguuuuuuuuuuaaucuuugaauagagcacuuugaagaaaaaguuaaguaaaccugcuauugacuguuaaugaacuacuacauuuuaaauccucugaaucuccuguaggcaccguuuuaugagugugacuuaccuaaacagcauuucaccagcuugaaaacaaccaaauuaaaugcagaagggucuuaacauguaugucucagaaaaauggagcuaauacauucauuugugucugcauaccuucccuguggcuuagggcagauuaaauaaucucucugugccuuagucuccucaccuguaaaauggggccaaaaauaggaccuaccccaggauucagugacucaguauuugucacgugcuaccuggcauguaggaagucccauguaagugucaaccugcuacuguuguguuuuuuuuuuuuuuuuuuuugaucauucuuggguguuucucacagagggggauuuggcagggucauaggacaauagugaagggaaggucagcagauaaacaagugaacaaaggucucuggcuuuccuaggcagaggacccugcggccuuccgcaguguuugugucccuggguacuugagauuagggaguggugaugacucuuaaugagcaugcugccuucaagcaucuguuuaacaaagcacaucuugcaccgcccuuaauccauuuaacccugaguggacacaacacauguuucagagagcacaggguugaggguaaggucauagauuaacagcaucccaaggcagaagaauuuuucuuaguacagaacaaaaugaagucucccaugucuacuucuuucuacacagacacagcaacaaucugauuucucuaucuuuuccccaccuuucccccuuuucuauuccacaaaaccgccaucgucaucauggcccguucucaaugagcuguuggguacaccucccagacggggugguggccaggcagaggggcuccucacuucccagaaggggcggccgggcagaggcgccccccaccucccggacggggcggcggccgggcggaggcgccccccaccucccuccuggaggggcggcuggccgggcgggggcugacccccccaccucccucccggauggggcggcuggccccccaccucccccccgacggggcggcuggccccccaccucccucccggacgggaaccugcuacuguuguuagagcuaggaaaauccuuuuccuggaauguuaguggcuuaaggaaccaugauuauaguguuguagucuuuaaaauguguuugcuuugagauuuuccccuuaaaugguggguauuuuccuaaugagaaacugccuuugauucuuaaaggagaaaguucugauuuuucauuccuuucugaauugagacauuucuuccccaagagggaggggaauucuggguacugugguucaugccuguaaucccagcacuuugggaggcugagguggguggaucacucgaggucaggaguucgagaccauccuggccaacgugaugaaaccucguauguacuuaaaaaacaaaacaacacaaaaaacacaaaauuagccaggcgugguggcacaugccuguaaucgcaguuacuggggaggcugaggcaggagacucgcucgaacccugggagguggagguugcagugagccaagaucacgccacugcacucuauccugggugacagagugagaucuugucuaaaaaaaaaaaaaagcggccaggagugguggcuaacgccuguaauuccagcacuuucagaggcugacgggggcagagcaugaggucaggagaucgagaccauccuggccaacauggugaaaccgugucucuacuaaaauacaaaaaguuggcggggcaugguggugugcaccuguaaucccagcuacuagggaggcugaggcaggggagucgcucgaaccuggaggcagagauugcagugagccgagaugaggccacugcacuccagccuggcgauggaauggacucugucucaaaaaaaaaaagagggaggggaagaaaggggguacccaggucugcagggcagguggccagacugacuggguucacuggggccuuccugagcugggagagaaugggcugggaacaagaccaugaggcccacuagagugaguauuuuaguaaaugccaauggcuguugccuccugaacgcccuccccacuucccuugggccuguuugucugaggcccgauuuguccccuagguaccucauggcagggccagguuccagcagugaggaggaugaggccucucacagcgguggcagcggagaugaagcccccaagcuuccucagaaggucugaugcccccuguccagugggggaggguguagugggaggaugacaugaguccgcuguggcaccccaaacuucccacucuugccucuugcagguacccccccaacacacccacacuguuccugcccuccucacccacccacucucccuccuuagcaaccccagaccaaaaccaagcccacucaggcagcuggacccagcucaccccagaagcccccaaccccugaagagaccaaagcagccucaccagugcuccaggaagauauagacauugaggggguacagucaggucagacucugagggaggaggggcuggggccugggcuccugagucugagggaggagggccugcggccugggcuccugagucugagggaggaggggcuggggccuggacuccugagucugagggaagagagccuggggaccuggacuccugggucugagggaugaggggcugggggccuggacuccugggucugagggaggaggggcugggggccugggcuucugggucugagggaggaggggcugggggcuggacuccugugucugagggaggaagggcugaguccuggacuccugggucugagggaggaggggcuggggccuggacuccuggaucagagggaggaggggcugggggcccagacgacuggaucuggagggcaguugaggcugggggcaugagaugccugggucugugccauacugggagagcugccagucuucccaggagacaaggcagccuugcauugacugagcuucuacuugcagaaggacaggacaauggggcggaagauucuggggacacagaggaugagcugaggagguagggcuggggcuggggguuggggugucccuggccuuggguguaggggaggcugcucugcaugcucacucucuacuccucuuggcacccccaggguggcagagcagaaggaacacagacugcccccuggccaggaggagaauggggaagacccguaugcaggcuccacggaugagaacacggacagugaggaacaccaggagccuccugaucugccagucccugagcucccaggugggaaauccccccaucccuccugaaguggcauuuucucuucucaguucucagcugggacuugcccuggccagcccuggggucacugcugcccccgugucuugccuccccucuccuuccucaacccacucccugccucagcaccuucagguucugccaggcuuguuccuuuccuuucagcauccucucugugacuugccuuuuucuccccuccagauuucuuguucugaccacuccccucgcagccaugugccaggugugaccuccuuuuuuucacgucaggggugagggccccacccucaugcuagugcuucacuugcucaggugccguucuguuggucuggggugaagccgggcacaccaggugacaggggcacugcucucugucaggcccugggugggugcacaccagugucugcuuuaacaucagccaucacucuggacguggaugcugucugcacacauuguguguuugcauuuccaguguaaaagaauaagaacaaaaggaaauggggaaacucugcagggaguugugggaugaggggcagggaggcagagcuucuucgagaaugaagggagcagaggaaagacagucacgggcugugcagaggugugguucuggggcuuccagaagagccguuuccacccaguuccucgugggugaugggcaggaagaugcuuugauucucccaagccccuaaaguggcaucagcaaauugauggccuagagagucaccuuaaaauggaaagaaggagccaccccaaaggucagaacaagaaaggcacugguuggaaaggagagcaaaggugaagaaguggcagauacugacguuuucagccuggacuaagcucauuaaguggcuccaggcaggccaggcgugguggcucaccccguacuuugagaggccgaggugggaggacugcuugaguccaagaguucaagaccagccugggcaacauagugagaccccccccgacccccgccuuuacaaaacauuuuaaaaauuagccgagcgugguggugugcuacucaguaguccuggcuacucaggaggcugaggugggaggauugcuugagcccaagaguuugagaccagccugagcaacaugucaauaccccgucucucuacaaaaaguuuaaaaauuagucuggcuugguggcaugcaccuguagucccagcuacuggggaggcugagaugggagaaucacuugagcccaggaggcagagguugcagugaggcaagaucacgccacugcacuccagccugggcgacagagugaguccuugucuuaaaaaaaaaaaagagagagagagagguaaguggcuccagccugucggucagaaacaaaucacaauaauaggcauuguaucuucuaccauuaaagcaaaccaaccaaccaaccaaccuaccuccccaggaggcucugaugggccgcugggcaggguccacugccugccaucaaucccugcccacauguggacagcccucuccucagcugcugggucagccucgucacuccuguuuggugccugggaacuccuggggccucaugcuuaccuuagcccccuucucuccugcagauuucuuccagggcaagcacuucuuucuuuacggggaguucccuggggacgagcggcggaaacucauccgauacgucacagccuucaaugggugagucuccagggacugggguggggaaggggugauggauccaagggaacgcucagggaccugcugggaggggugggggugugggaaagaagaccaucaggaggauggagaagggccaugcccagcaggugggcacaggucauggaauccgaaugcuagcuugcccaccaccggcagcccagggugcauugcuugccucaguuuccucuucuguauggcgaggaucccuaccccuaccccugcuucugaaagggacagccugaggauuagccacugugggagcucuggucauuguggcuguggcaagauggauacaugaaagaauggagccuagaggcaaccuagaggcgcauagguggggacaguguggggacagccauugagaguggcuggggaguaggacgucagugcugauucccugaugugccuucuaccucuuuucuucucucccgccagggagcucgaggacaauaugagugaccggguucaguuugugaucacagcacaggaaugggaucccagcuuugaggaggugaguaccaaagaggcagagaaugggagacccgggcacaccuuugcaucuccuccguccuccccucgaugacacauucccguauggacuccaccccacccugcaggcccugauggacaaccccucccuggcauucguucguccccgauggaucuacaguugcaaugagaagcagaaguuacuuccucaccagcucuaugggguggugccgcaagccugaaguaugugcuauacacacacacacacacacacacacacacacacacacacgaugcauuuaauaaagaugaguugguucuc

SEQ ID NO: 191731 - RNA, 27217 nt, Homo sapiens
cuacgugagugccggaccgcugagugguuguuagccaagauggcgguagcgaucgcugcagcgagggucuggcggcuaaaccgugguuugagccaggcugcccuccugcugcugcggcagccuggggcucggggacuggcuagaucugugaguaccugggccccaggcgguuuucccaaaggggauuagggauguaaaggcuaucuucagaguguggggucccugaaggauaugaaggaagggcugucacaaaagggaaaaagagugggagacuccuuggagaagacaccgaagggaagaucugccacuuccuuaggagacgaaaagaacuuccacuucuuuaggagaggaaaaaacccguuugcaacuucuuugugggcccugagggagacgacuugaagagagagauggggguuccuuauuagcugccacugguauucaggggaggcuccuuggaggaacaggggaagaccgcaagaccuucucccucaggguuuggagaaugaaacugacuuuguaagggagggacuuucuucugggcaaagaucccucuucaagaagaagaaagaagagaacaggucccugucacaggcugcauagggccuuguauuucuuugcuccuuugccacaauucugauuuuaaaaugaauuguguaaaaaauuuguuugauuccugugucucuugaucgaauaucaagacagagaauucguguguucuggacacuguacagaggagacgauuaauauuuguugaauuaaugaggggaaaaaaggagggagagagguacagacagggcacuuugcccacauuucuuagaaacacuugagaaggcuuuguuucuugucaaaagggucacaaucccuucagguggaugcugcuaagggcaagauuacacugcaaaaaaccuagguggaagccuaucuuuagacggggagaggcaauggguugcagaagagcuuugaacuacaguugacagauaggagaguagugguuacauggguggaugcauguccuugcucugccgcuuuccacuuguguagccuuggccaacggacugcacuucucuggaucuauggagcuaauuuuccucucuaaaauauuaacaguggccaccucauagggcugugaaaaaucaauauguaaaaugcuaaggacuggaccuggcacauccuaagggcaauaggaauguugauagugaggguggagggaagggacagaaacuaaccuuggagauggggagaagaaaggggugaccuugggaaggccuggauuggugaggcccuggggaaaaaaaucugaaaagauauugugagguugagucugauccucugauccccaauccauaaggaggggaagauggaaucuguagaaagaagcucuggguaggggaacaaacgggaggagggugaagaagaugggccaggaguaggacguaguagguaucuaggaacggagucacuugaaacagguaaauacagaagggcugcaggagcaagguguggguagggcagucucuugccuuugggcuggagaccuuuucacuuuuuuuuuuuuuuuuuuuuuugagcaguucauauccuccacagcugaucucagucccaggggcccauuggcugggcaaguggggcaggaggugggcaggacuggggcaggcuagggaaaggucauuuauggcugauuaaaucuuucucuccugucucaaucucuugauuaccuuuccucuugcuuccccuacuucauuuuugguggggaguggggagggaagaagucccuacuuuuuauuuauauauauuuaaauuuguauuaucuuaagaguuauuguuuuuuccccuuuauuucucccaccuguucuuucucucuucuucuuucuuuccucuccuucuccucuccucuccuccccucuccuuuuucuuuucuuuucuuuuucccuuuccuuuccuuuccuuuucucuucucuuuucucucucucuuucuuucuguaccucucuuuccuuuuucuuuuuuuuucuuuuuugagacagaguuucacucucucgccuaggcuggagugcagcagcaugaucuugacuuacugcaaucucugccugccgaguucaagcaauucuccugccucagccucccuaguagcugggauuacaggcaugcacuaucacgccuggcuaauuuuuguauuuuugguagggacgagguuucaccauguuguccaggcuggucucgaacuucuggccucaaguuccgccugucuuggccuccaaaagcaugagccacugcgccuagccuuuucuuuuuuugagacaaggucucacucugucacccaggcuggagugagugcaguggugugaucauggcucacugcagccucaaccuccugggcucaagcaauccccccaccuccaccuccuaaguagcugggaccacaggcacgugcuacuacgccuggcuaauuuuuaauuuuuuuuuuuuuuuuugagacggagucuugcucugucacccaagcuggagugcaguggcacgaucucggcucacugcaaccuccacuucccagguucaagugauucuccugccucagccucccaaauagcugggacuacuggcgugcgccaccauacccaguuaauuuuuguauuuuuaguagagaugggguuucaccauguugaccaggcuggucuugaacuccugaucuaaggugaucugcccgccucggccucccaaagugcugggauuacaggcauaagccacugugccuggcugcgccuggcuaauuuuuaaaucuuuguagagaugggguuuugccauguuuuccaggcuggucuugaacuccuggacucaagcgaucuuccugccucagccucccaaagugcaggaugacaagcgugagccaccuugccuggccauauuauuaaauuaucaugaguuuaaguuuaaguagccacaagugggcugggugcgguggcucaugccuguaaucccagcauuuugagaggccaaggugggcggguugccugaggccaggaguucaagaccagccuggccaacauggugaaaccccaucucuacuaaaaauacaaaaaaauuagcugggcguaauggcgugugccuguagucccagcuacuugggaggcugaggcagaagaaucgcuugaaccugggaggcggagauugcagugagccgagaucgcaccacuauaccccagccuaggugacagagcagcccucugucucaaaauaagauagccacaagugguugguggcugccacauuagauggugcaggguuuuuguuuuguuuuguuuuuuguuuuuucgagguggaguuuugcucucauugccuaggcuggagugcaauggcaugaucuuggcucaccacaaccuccucuuccuggguucaagcgauucuccugccucagccucccgaguagcugggauuacaggcaugcaccaccaugccuggcuaauuuuguauuuuuaguagagacaggguuucuccauguugaucaggcuggucuugaacucccgaccucaggcgacccacccaccucggccucccagagugcugggauuacaggugugagccaccaugccuggcuaagaugaugcaguuuuauccagguggagaugaagaaauagucagggaaagguugagaggcugcauauuguagacagauuggauuacuggguucacuggggaagauuggauuagaaggaggaguggggcugcuuuacuuguccccgacuucuugccccugcucugcccacuccuucauugaauacccugcugcccugcagauguguuugccugauuuucaccucccuuccugucucuguuaucauagcagacguuuuagugcucagggaaaggaggaggaaggaaacucagauugucaaggaauugugagucaguuucucagccacuaccccaggccugggcuuggcuaagucauuucaccucucugacccuagcuaguggggugaauagagucccuacccuguuggaagucaggaagccccuggagcucgcucugugcuaauuaucggugacuauuucugugacccagcucuucaggggcagccugucuggggguuccagugcccugugcaguaucuccaagugguagguacucaguguauguauuaguccguuuucaggcugcuaauaaaaacacacccaagacuggguaauuuauaaagaaaaagaggcuuaauggacucacaguuccacauggcuggggaagccucacaaacauggcggaaggcaaaugaggagcaaagucacaucuuacaugguggcaggcagacagagugcuugcaggggaacuccccuuuauaaaaccaucagaucucgugagacuuauucaguauaaugagaacagcacgugaaagauccacccccauaauucaauuaccucccacuggcuccuucccacaacaugugggaauuaugggagcuauaauucaagaugagauuugaguggggacagagacaaaccaugucaguguguauugugggaugaauggagauggucauuacagucuucuaaguguauggguccaucucuuacuugcuaguguguuaagaaaccuggccuccuuuuucacaucuugaggcacugaaugguuuacaaauccaacucuaauuuuuuauuauauuuaauacaccaauagugcaaggccuuuauugguaguacucuccuauuacagauggagagacugaggcucagagaggugaggucugaacuuggagcucuggacuccaaaacccaguuucuuuucaugguaccaggcugccaggaggagaaaggauggagcuuagauucaagucuugcaacauucuucuuaguccaguauuggcuuauuuuguuuuauauuuuuuugagacggagucuugcucuguuacccaggcuggagugcaguggcgugauuucugcucacugcaaccucugccuccuggguuaagcgauuguccugccucccccucucgaguagcugggacuacaggugugugccaccguguccggcuaauuuuuauauuuuuaauagagacaggguuuugccauguuggccaggcuggucucgaacuccuggccucaacugauccacccaccucagccucccaaagugcugggguuacaggcgugagccaccauguguggccgggcaggugauuuuucuugucuuucgccucuuuccacuucagucccccuggccaucuuucccuuccuugaaugugccuccucccaccugguggccuuuguagguaugagguccuucagaugauggcugacaugacacuuccucagagaagcguuccagaccccaaacaccaggucucugucugugaaacagggacagugauaccugccuaaucugcacgccuuucccuucucacgagauauucugggaagggggacucaacucuuugcucuguuugagggcagagugccuuugagcucaggagagaguggguuuggguggccuuagcuacccuagauacggaggacuuggaguuaacuggcaccauccacaaagccuugcaugcacuggaccugaacaaguugcuuagcccuugaggcggcgccucagcuaccaccugucuuugauggaguuaugauaacagugccugccccgucuggaugccuuauggguucagugagcacauagguguaaauaaagugcuuugaguggcaccucagcauguaguuauucucugauugaccuauagcagccaugccagucuucagggucccagggcgccaggcuuucuucucuugccuuggagccuugguuuuucccuaggacugaaguguucugaccccuuggcugaacucccccuucuuuaggaagcuuucccuggugugccaucugaugcuggugcuuccuggagggguacuaucugauccuagcuggugaggcauuccugccagagcugcggcaggugcuuuccccgccucuccaccagccugugagguggaugccauccccacgagggcacgcagguucacagagacuggcuccuguccaaggccgcguggcuggaaagagacagaaccagauucaaacaccagcaguuuaacccuagagacccucauccuaccuccuauguggguaaccacuauacauccugccuccucugaaaucucccguuuuuuuuuauuuuaaaauuuuaugugaguauuuacuuauuuauuugcugcuguuguuauuguuuugagacagagucuugcucuguuuucacccaggcuggagugcaguggugcgaucuuggcucacugcaaccucugccuccucggcucaagcgauucucgugccucagucucccgaguagcugggacuacagacaugcaccaccaugccuggcuaauuuuugugucuuuaguagagaugggguuucgccauauuggccaggcuggucuugaacuccuggcuucgagugaacugccugcccuggccucccaaaguauugagauuauaagcauaagccacugugcccggccaaaauuuuauuuauuuauuuauuuuuuugagauguagucuugcucugucacccaggcuggagugcaguggcacaaucucggcucacugcaagcucugccucccagguugacgccauucuccugccucagccucccgaguagcugggacuacaggcgcccgccaccacgcccggcuaauuuuuuguauuuuuaguagagauaggguuucaccuuauuagccaggauggucucgaucucccgaccucaugauccgcccgccucggucucccaaagugcugggauuacaggcgugagccaccacgcccagccuaauuuuauuuauuaauuuauuugagauggagucucacucugucacccaggcuggagugcaguggugcgaucuuggcucacugcaaccuccaccucccagguucaagcgauucuccugccucagccuccugaguagcugggacuauaggugcgugccaccacgccuggcuaauuuuuguauuuuuaguagagaugggguuucaccaucgugaucagccugacaggcuggucaugaacuccugaccuuaagugauucaccugccucagccucccaaaucugcugggauuacaggcaugagccaccgcacccagccauauuauuucuguauuuucauuuggcuuaccugucaacuugacacuuuuuuguuuuuuuaggcuagucaggugaagcaaugugaguaagaucaccugucuugauuauaacuuguguguucaguguuugucauucaucccucccugucucuagccuucaguucagggcaugauuuggagcaaauguucaguaucuguuuaacaagaacaaucaugagaaauacuuacucacuacuuguguuuaugaaacauuaugugccaggcacugggcugagcaauccacacaggucaacucgguuaauccucaugacaaccccugagauaaguacuuauaccacccucgguguacacaggaggaaacugaggcucagggaguuuuucuuuaaaaauuuuuucuuuuuuuuuuccuugagacaggucuuacuuugucacccaggcuggagugcaguggugugaucuuggcucacugcagccucuugggcuccagcgauccucccaccucagccccucaaguaguuggggaguacaggugugcaccaccaugcccagcuaauuuuuuguagggauggggucuugccauguuauccaggcuggucuugaacuccugggcucaagcgauccucccuccuuggccucccaaagugcugguauuacaagugugaaccaccacaccuggccuuaaauuuuauuuauauauuuauuuuuguagagacgaggucucacuauguuucccaggcuggccucgaacuccuggacucaagugauccucuugccucagccuccagaguagcuagaauuacaggcgucugccacugcacuuggcucagggaguuuaagucacauaaucaggcagcggucugcucaguuagaguccaugcgcuuagccauggugccuucaagugacuccaccagggucaccccaguacuuccugggcagaccagaccauccagagcgggcagguugugcuuuccugcauggugggagaggacguggcaugaagcuuuguguaaaucugugcagccucugccauuguaaaucacuggccaccgggacagacucccccacccccuuccaaaaacuagaggaacagauggguggagucgcauccuuccucugcaggcauuuggccacccacucccauuauggagcauuuccucaggaccaggcacagcguggagcccuuugcauagcucacugaauuggggcagcaacccuggggcuggggacuaccauuaucuccaccagcccagcaaagaggggaggaggguacagccgagacccagcugcaguauguggagcacacuggggugccgugaagauagcuguccagccucuagaggcugacaguccugcccugacacagugguuuguucucagacucuggccuccccucuuagugcccgucugaagacuucagccuucgguccucuuccaucagcaugccgucuccccugugccucagucucccucucuggaguaucugcuggggccacaguuugguuuuauuguucuuugagacaggguaucacuuuguugcccaggcuggagugcaauggugcagucauggcucacugcagccuugaccuccugggcucaagccauccucucaccucagccucccgcaacuccaguaucuggacuacauguaaaugccaccauucccagcuaauuuuuuuuuuuuuuuuuagauagagucucacucuugucacccaggcuggagugcaauggugccaucuuggcucacugcaacauccgccucccagguucaagccauucuccugccucagccucccaaguagcugggauuacaggcaccuaccaucaugcacggcuguuuuuuguauuuuuaguagagacaggguuucacuauguuggccaggcuggucuugaacuccugaccucaggugaucugccugccucggacucccaaagugcugggauuacaggcgugagccaccacgcccagccuuccuggcuaauuuaaaaauuuuucagagacgaggguuuugccuaggcuggacucacuauguugccuaggcugaucucgaaccacuggccuuaagugauccucccaccucagccucccaaaguacugggauuacaggcaugagccgcugcacaucgccacaguuugauuuuaguauccacuuuaaggugcaguuaguucuucccagcuccucuuuucccuaucucauacaguguagucacuucccuuucucccacuucucaccuuccuagauuuuguuuuucucucucuuaccaaguuuugaguauguaauacgucccagaucggugcugaaccccuggugugaguuaacuuagcaacuuuucacgugguguucugcagccuucuuacagauaaggaaauucagagaggugaaguguuuuugcagagagccacacaaugagcuaagaaauuagaacccagggcaguugaacuccagagccagggaacuuaacagcccauucaugcauucacucaggaauucccucuugagugccugcugugaaggcaaccuggacgcugucucugccuuccugggauuguggugugugugggagacagacacgaaacaaagcaaucuucuaggucagugucuggcuaugcuggguacucagaagggggaagcacugugcugcaagaggccggcuguuuccuccucacaaggggaggccugcagugacauugccaggccugaaucugcccugccauugggaguguaauuuccucacgacuacaaaugcaaauaaauacacacacugaacaugcuaccccgcuagaacuguggacagcuuguucacugcaguuaaaggaagacggagggacacauuugagcacgcaugugugagauccagcuuguggcaaacccugccauucuuuaacaucugugggaagugaagccaccauuacugaccucggaggaaucccgggaguagugggaagaaaaguugcagauguuugaaaaucaggcugcaggggcaguuggggugaggagcauggaugucuaggagccugaaucucagcguuggaagcccaguucugauguaauuuuuuuuuuuuuuuuuuuuuuugagacagggucucacuuugucccccaggcuggagugcaguggcacagucucagcucacuacagccucauccuuccagguucaagcaguccuccugccucagccucccaaguagcugggaccacaggcaugugucaccaugccuuucuaauguuuguauuuuuuuguggagacaggguuucucacuguugcccaggcuggucucaaacuccugagcucaugugauccuccugccuuggccuuccaaagugcuaggauuacaggcguaagccacugcccagcauccccaccuuuuuuuuuuuuuuuuuaaauuugugguuuggugcagguuauuuuaccuccccaggccucgguuuccucaucuacucaagggcaauggcagauaaucaaccucacaaauuccccgaggaguuaguaggcuugugccugccaggcucagcuggcuuacagcaggugcuucauaagggggagcuauugcaacgccucggcugguucuaggcugccuagcuccagagcuaagagucccaguggguucauaucccuuugagcauuuauaggcuucucacaggucuccugggcuuucucagccauuccucaucugaccugaggaggugugauguccuugcaggacuccuccagccccucugagcuuuuuuuuuuguuugagacagcauguugcucuguugcccaggcuggagugcaguggugugaucauggcuuacugcagccuccaccuccuggggucaagcgauucucccaccucagccuuccaaguagcugggacuauagguguauguuaccaugcuugaguaauuuuuaaaauuuuuuguagagaugugaucucaggcuggucuugaacuccugggcucaccugggcucaaguaauccuugagcccaaaguguugggauuacagauaugagccaccuugccaggcccugagcuccuucugucuuccaugaaggacacacuauuccuugccuuuugucuuuuuuuguguguguggcagggucucuguugcccaggcugggauguguuggugcaaucugggcuuauugcaaccuccgcuucccggauucaagugauucuccugccucagccucuugaguagcugggauuacaggugugcgcaaccacgcccagcuaauuuuuguauuuuugguagacaugggguuucaccauguuggccaggcuggucucagccucccgaaguguugggauuacaggcauaagccacugugccuggccacuuuuugucuuuugcauguucuauacaccuugccgagaaugugcuuucccugccuccugguuaucccucagguuucagcucuaacaucacuuccccagggaagccuuacccucgcuuucuucugcuauaggauaauaugaaccaccaucauuguuacuuguuuagugucugcccucccugcuaggcagcaaggacagauaucuugccugucuuagguccccagaacccagcacagggcuuggaacaugucaggugcucaaauauuuguugaaugagucagucugggcucgcagagggagcugggaccagaguagaguggacacugaagcguauguagcaguuugccaggcgauagggaaagagaccuucuuguaaagcaagcagagaugagagggagaaaugagaauugcuaagauuguuuugagcauuuguuagguggcuuacagaugcuuugcugaacauuuuauucaugugaucuuguuuaagccucucauuuccaugagggguucuccauuuuuauagacaaggaaggggacacguggagaggggaaguuacuuugccauaucacccucuaagggauuuuuuuuuuuuuuuuuuuuuuugagauggagucucacugucaccaggcuagagugcuauggcgcaaucucggcucacugcaacccccaccucccggguucaagugauucucuugccucagccuccugaguagcugggacuacaggcaugugccaccacauccggcuaauuuuucuauuuuuaguggguacaggguuucgccauguuggccacauugaucucgaacuccugaccucaagugagauucgccugccucugccuccuaaaggcaguaagggaauugaaccuaggcagucugacucuuaagagcucaaagacuuaagcucuguccugaguagcuucgcugguguaugguauagggaucagaagagagcuggucuguaugccuagagggcauccugcagugggcaugugugucuguggucacagugggagagagagaggagggggcaucuguggccagaauggggaggccucgaaugccaggaugaagaguuugggccuaugguaaugagaauaguaauagcuaccaguuauugacuugccagccacuugauugagucauuuaaccucacaacaguccuaugggauagguguuaacuguuuucaucccaguuuuucagauggggaaacugagacacagaaguuguagucaguuauccaaagugucgcagugagaaagugcuggaguuggggcucagacccugugagucaggccccagaguucacuggggccacaugcucaaccaccaugccgccugccugccgccggggcugagccagcggaaaccugggugcugcuucugaugcagguggucuccucugcucucuuccccagcacccccccaggcagcagcagcaguuuucaucucuggaugacaagccccaguucccaggggccucggcggaguuuauagauaaguuggaauucauccagcccaacgucaucucuggaauccccaucuaccgcgucauggaccggcaaggccagaucaucaaccccagcgaggacccccacgugagaggcggccucccccacuucccgugccccccacgcccaggccccuugccugucuccucucuggucccaacugccccacgucuaucugugccuccacccgcagcugccgaaggagaaggugcugaagcucuacaagagcaugacacugcuuaacaccauggaccgcauccucuaugagucucagcggcaggugcguggggacaggacuaggggcggggggcuggaauuaccugagguccccuaccuguguuugggccaaaggaauggcucccaaggaggacagauucuuuuuuggggggguuccauagaguucugaggguucucuugggacucuggaggagaagugugagagcaguccugccuuagggcagaaggauggaccugaucacuaaaaaacaccuacugugugccuggcugggggcucgccuguguggggagagggcagggagaaggccugacagcccuuccucuuggaaaugcacaguccugagaaacaggguggguccccagugcuuccuggagugcuccaggggaccgcccuaggcccaugugaaaugggcugugauccccugauaaauccuaguaucagggacaaggauccagucaagccagugucaacaaagagggaaguuauugacuccaaugaccauacauccagaggguccuguuuuggggcacagcuagauccagggggucuuccaggcaggaaguagagggaaggcggaaggccagacauggcacaucccagcuaucccacacccccaccuuuauagagcuuucuggguagucccaccuagugacaucugcauacauuuccugggccacuccuagcugcaggggagacugagaaauguauuaauaauacuuuagucccggcaguugcugccugcgggagauugagaccucuguuaacagaggaggggaauaguauacugggaaggcaaccaggagccucugccaguagccccgaguccugauccucagggggcugguugcaggcucuuacccacgcuaaccuggacaguccugccaggcccucaguacucagcaccgcccacucacuuggcacuggaaugugcauuaacuuuuaauuggcuccccacuuagaagaaagcacacauucaucaguuucccccacagcaacgggaaagccaggccugggaacacauggaggagggcaccgccgagccgcgaggagcucuggccccggggugucccucagggugcuggccaggcugccuuuguuccgcuuuacacauggcccugugugaucucauguccauccguaugccagggcugcccagagccccagccagacugcuugucagagcccugcuuggcuucucgcccuggaugucccacagcaaacuaauccugucugaacuugaccucgacaucuuccucccaggcgugcuccuuugccucaccuaguccguuucucagugaagagcaccaccauccaccugcuugcccacaccagaaaccucaucucaucccugucuccucccucccccuugcuaucccuuucuccccucucauucccucugucuguagauauuucuuuuuuuuuuuuuuuuuuacuuuugagauggaguuuugcucuuguugcccaggcuggagugcaauggcacgaucuuggcucaccgccucccugguucaagcgauucuccugccucagccucccgaguagcugggauuacaggcaugcgccaccacaccuggcuaauuuuguauuuuuaguagagaugggguuucuccauguuggucagucuggucucgaacucccuaccucaggugaucugccugccuuggccucccaaaaugguaggauuauaggugugagccacugcacccagcuguagcuacuucuuuucuuuuauguuauuuuuauuuauuuauuuagagacggaguccaccucugucgcccaggcuggagugcaguggcgcaaucucggcucacugcaaccuccgccucccagguucaagugauucuccugccuuagccccccaaguagcugggauuacaggcgcccaccaccacacucggcuaauuuuuguauuuuuaguagagaugggguuucaccacauuggccaggcuagucuggaacuccugaccucaagugauccgccugccuuggccucccaaaguaccgggauuacaggugugagccaccgugccuagccugucuguagauacaucuuuaggaagugcucagcugcucagcagcacacucugagacccagccccauccuuucucugcuucacuguuguuggugaguugaccuucgugcucugcuuguggccucguguucacagcauggcugcugcauguccaagcuucauggcugucugcaaggcaggaagaaguagggaguggguagggcuggcaccagcagcaguggucucuucuauccagaaagcaaaagcagacuuccaccaaaauaucuggcuaaaacugugucccauggccaccucuggcugcaagggaggccagggaccugagugcgugucuuuuugaggcucagguuaggggauuugggagaagggaacugggcacugguguggccagcugacagggucugcugcccccuagcacagccgacucagcuuccucagacacauccaccugcuccucucccgccucccucugcuaccaagcugggccucugcccccucucuccuggcuugcugcaaucagccuugaugacuccauccauuuaccucacugcagccugagagcaauucuaaaacacaggucugaccacauugcucccuugagaagacugucggcagguuaccacuauucucagaguaaaaucaauguaucguucccuuuguuaucugggugccaucuccucucccuccucaucuuuccccaccccuaccacuguaugucccagcccuucuggccucauggucuaucauucccucugccuggaacccuccacccaccccaucuuugcgcacugguccucaccgaugcccuuccgugguggaacaggugcuuccuuugggcuucuaucacagcaacucgaucccucuggcaguucuaagcagucuggcagcgucuucuuaaaggcaggaaccccagcauggccuggcccaggacuggccuucaggaggacugugaauucauggagguguuggaagcugggcaggauuuggauggcucucugucauugcccagcauaaccaauugugggaccccgguccccucuacacccccagggccggaucuccuucuacaugaccaacuauggugaggagggcacgcacguggggagugccgccgcccuggacaacacggaccugguguuuggccaguaccgggaggcagguacgucuguccgugguuuggcccugugguccccauugaaguguacacuuuaguuuuucugaguguucuuccaggagcagcauagugccaggaaggucuaaggagcuggaagaagagcuuuccaagcaagaaagagacaagccaggguuaggacucuggagggggcagucuucccacucugaaggccagaaaguguaguggcucagggucugugcucuuaacccuuuguuaccaguugucagguuuugggcaagucacuucccuucucugagccucaguuuucuaaucuccagaagagggauuaugacgguaccugcauccaagggucgcugggaggaugcagugaagucaacguucgcuguggguguggccugugcaggagacccugucugccuggugcagugauccccuggccccuccucaggugcuguauccuucggggagcaggagcagguggaagaaccuugacagaccugagugcggugcaagauuagaggggcccggcaagcccagaugagugaaaggaaggaagggucaaagaccaggaaugaagaaaaucauugagcaggaaugagugccugggagcgaaggagugagcccagggagcagugaguggggucuuccagggagcuuguugguguggggcccugcauggggacuacccucagagugucagcgagcacugauagggccaggaaggcauaucuuaacccuuugucuuagaugcuuggggcaaguugcuuaacugcccugugccucuguuuccucauucguaagggggaugguagcccuucccaagacagcuguugagggcagucuuggggcaguuggcaaagugcccucagcacagaguaagcgcucagggccagggguuggugucaugaucggggacucgcccugggacagcccuucagcagggccagaccacguggcuguccagagcccccauggaccagcauggcuugcagccugcuccuggacugucuacugcucacagcuggaccaggcccuuggccccacaugcucuaggagggcaaacgcccugugguguuugucuaaggucuagugucauccgugcggaaaaagauuuccagacaccaggcagcaagcugggcccccgccagcugugcugagcacugcaccuguuuuugcugaaggguucucuugugagggcaccaggcaggaccgagcaagccucaugggaaucaugggagccgcugagcucuccacaugggagagcuggccgccucugcaagaaugacuguccagcacugagggucagcagaagugucugggcagcugcaaaugggacucaugcagaggcagcauggugcaggguaaggaguugagucacauccacucuagacuucacuuggcaggccacucaccuuggugacgcugucugucgucugugaagugagaagagugguguucaucaugauagguagugccucccugggcucuugacaccagagugcuguucuuuuuuucuucuccuuuuuuuuuuuugagauggaaucucgcucuguugcccaggcuggagugcaguggcgcgaucucggcucacugcaagcuccaccuccuggguucacgccauucuccugcuucagccucccgaguagcugggacuacaggcgcccaccaccaugccuggcuaauuuuuuguauuuuuaguagaggcggguuucaccauguuagccaggauggucuugaucuccugaccuugcgauccgcccuccuccaccuccuaaagugcugggauuacaggcgugagccaccaugccuggccuuuuuuuuuuuuuuugagguggagucucacucugucgcccaggcuggaguacgguggcgcagucuuggcucauugcaacuucugccuuccagguucaggugauucuccugccucagacuccggaguagcuggaauuaaaggcaugcaccaccaugccuggcuaauuuuuguauuuuuaguagagaugggguuucaccacguuggucaggcugguuucaaacuccugaccucaagugauucguuugccuuggccucccaaagugcuggggauuacaggcaugagccaccgcgccgggccagccaaggugcuguuauaugugcucuuuagccucggagacugucauuuccccucacugcacugcagagcgagggcacaccgggugagguuagggcaggccccagugguguugccucauugaggcaccucccccauccaugugaggcaggagaggcaagcauuaccaucaacucuaaaagccagguaagaaccugagucaacaaaggugaggucaugggcccaggccacauucuccuaaggaguggagccgagucuuuuuauggcagucugacccagagacagcucucgcuguuucccacccuuggcugucuucccagggcuauauguggaguaucagugguggcacuggcagggaguggcgcccggugaaaaggaguguuaagaggaagcacgugccaggugugguggcucacgccuguaaucccagcacuucgggaggcugaggcgggaggauugcuugagcccaggaguuugauaccagccugggcaacauggcgagacccccaucucuaaaaaauuaaaaaauuagccaggcgugguggugcacaccuguagucccagcuacucaggaagcugagugggaggauugcuugagcccagagguucaagacugcagugagcuaugauuccaccaccgaacuccaguuugggugacagaguaagauccugucucugagaccaacaagaaaagagguagcaugugucaagcaagagcagcaguucccacuggaccuggaguuuccuggugcaaaucagccugugagucuguauuuucuuuuuucuucaagacggggucuuacucugucacccagguugaagugcaguggcaugaucucggcucacugcaaccucugccucuuaggaucaagugauccucccaccucagcccccugaauagcugggaccacaggugcacgccaccacaccuggcuaauuuuuuuuuugauuuuugguagagacgggguuucgcuguguugcccaggcuggucucaaacuccugagcucaagcaguccaccugccucacccuuccaaagugcugggauuacaggcacgagccacugagccugacaaguuuguacuuuuagcacguuccccugccccugcccaguccuucucacauggguggaccuaguaccacauucugagaaagccugauuccaagguccuguaucagucccuuggaccuucuuugacccucuacaagaccuuucuuucccuccuuaaccagagcaacuccuguuucuaucuguuacauaugcagcacagccacaucuuguguggauuuguauuauguccauucaaaagcaugugucagaaaauaccaguaaaccuguauuaaaguuggauguugaaguagugcuaaccacccucaacucuaacuaaaauaucaacaagugggcugggcgugguggcucacaccuguaauugcagcacuuugggaggcugagguggguggaucaccugaggucgggaguuugagaccagccugaccaacauggagaaaccccgucucuccugaaaaugcaaaaauuagcuggaugugguggcacaugccuguaaucccagcuacucaggaggcugaggcaggagaaucgcuugaacccaggaggcagagguugcagugagccaagauugcgccauugcauucugggcaacaagagcaaaacuccgucucaaaaaaaaaaaaagaaagaaaauuagguagaucuaguggugcacaccuggaaucccagcuaucugggaggcugaggcauaagaauugcuugaaccuggaagguggagguugcagugagcucagauugcgccacugcacuccagccuggguggccaagccagacucugucucaaaaaaaaaaaaaaaaaaaaaaaaagguaacugcuguguguaaugugaucuccauuaaauuuguaucuaaagagcggguucugcgguaaagaaaggauuuggaaagcacuguacuagagagcucccucugaauaauguucccggucugagugcuugcagcauugauccacagcgcugccccuaaaguguuggugugaagguugucccacucuucaggcggggcaaagagcuugucugagggcaaucacaaacccccuucugucuucuaacuucggaggaagggcccccuuaaccuggagcgguucccuuugauggggagguggguguucaccagagguuuuguuugaagaaaagguuuuacugccauacauggguuagaguacuucuguaguccagaaguuguaaauuaguggucuaugcuguuauuugguucauaaugaugauuuuuuuuuuuuuucgagacagggucuugcuuuguagcccagauuggagugcaguggcacgaucucagcugccugcagccuugaacuucugggcugaagcaauccucugccucagccucccaaguagcuggaaccacaggcacacaucaccaugccuggcuaauguuuugauuuuuuuuuuuuuuuguagaagcgaggccucaccauguugcucaggcuggucuccaacuccugggcucaagcgauccuccaacgucagccucucaaagugcugggauuacaggcaugaaccaccaugccuggccauaguaaugauuuaugguuagaauauuucuuaaagguaauugaauuaguugaaagcacuuaaauaccagacaauaucucacuaagagaaagaaagaaaaaggcuagauuucugcuuucuuuugaaaaaucagauuggccuugcugggcagagucagucagucugaacaucagucuuccucuuaaaacaagccugagcuuuccugucugccugccagcaugcugcaggucacccacagggcugaacugucccccuguacugcccacucggcuaaccauugccuccuccccuccuaggugugcugauguaucgggacuacccccuggaacuauucauggcccagugcuauggcaacaucagugacuugggcaaggggcgccagaugccuguccacuacggcugcaaggaacgccacuucgucacuaucuccucuccacuggccacgcagaucccucagggugaggaugcaugcccuguaccuugcacaugugcagaccaaugucacaccccuguccaggccucagcucuuuugccugccuucuggguggaauucuggguuggugacaccacuagagcccuggucugugcuccagacuucuucuucuuauuuuuuucuuuuuugagacggagucuugcacuguugcccaggcuagagugcaguggugcuaucgcagcucacugcagccuccuucucccagcuucaagcaauucuccugccucagccucccgauuagcugagacuacaggugugcaccaccacgcccagcuaauuuuuguauuuuuaauagagacaggguuucaccguguuggccaggcuggucucaaacucccggccucaggugauccacccgccucagccucucaaagugcugggauuacaggcguuuaagccauugugcccagcccacuuuuuuuuuuuuuuuuuuuuuuuuuuuuuuuuuggucugagacgggguuucacucucgucagccagguuggagugcaauggugcaaucucggcucacuguaaccuccaccucccaggcucaagugauucuccugccuuagccuccugaguagcugggauuaugggcauaugccauugugcuuggcuaaauuuuuguauuuuuuguagagauaagguuucaccauuuuggccaggcuggucuugaaccugaguucaagugaucugcccaccuuggccucucaaagugcugggauuacagaugugagccacugcaccuggccuguguuccagacuuugaaugcaccucuugucugggacccuucagaagagggcucuguugcuguccccaccccauucaggggccugaagccugugugaccacacucuggauuucccaaccacaugccuacugcauuugucugcucacaaacauagccaacgugugcaccagguuccacugugccaaugcuucacguucaucaucuaauaaggacccucauuguggccauggggacagagguuauuauuugcucuuguuccuguuuucaagagcaggaugcccguguuuugugugugugugagagacagcaagugaaugggaaaaaaaaaagugcaggagccuggccaacauggcaaagcccugucccuacuaaacauacaaaaauuagcuuggcaugguggugcacaccuguaauccuagcuacucaggaggcugaagcaggaggauugcuugaaccugggaggcagaguuugcagugagcugagaucgugccauugcacucuagccaaagugagauccugucucaaaaaaaaaaaaaaggaaauugaagucaaagagggaagucacucgcuaacggucauguggcacagagggagaggagcagggacucaagucauugacuguguaccuccagagccuggguucuuggcccugaccuuugucugccucaguccucagagucaaguaagcuuccccaaagcuuaccguaggugcccugaagucccuucccuuauaagagcuuuuuugggaagcaaacccacugggugccaggccugcacccucauaguguggagaacaaggaaucggagccccuuccuguccuccggggccuguagccugaucuaggguuggucugggcccuggcuucuuugcccuagggcagcugagaugcaugaguuugugucucuccaggccucagcacugugcccagcacagcaggaggcuccacaccccuuagcucauaguguucuuuuguugaggaacaagaagcaguuugagccucuuaggugggaggugggcagggaagcuuucucagaggagggggcauuuagggggcauuugagcuaaagguaauaggguuuccacaaggcuggggcguggcccuaaccuucccucugggucccugcuaagucacuucaaauacacgaaguuccugccaugugccggugccacuccaagugcagggaacaaaagcaacgcaaaccucagcccuccuggugcugccauuguggugggggagacggacaguaacagagauggagagggaacuccuggaguauaugaggguggggguccuguagggagcagccaagccagccggguguggugcacuguagggguggcugggguccgucacuggagugacacugaaguauggaccagaggaugugaggggggagcuguguggugucuugaggcaggugugagccuggcguguuugaggagcugggaggagcccagaggggcagguguggagugagcagguguggagugagcggguguagggugagcagguguggggugguuggagguaaaguccaggagguggugggugggggugcagauggugcagguuggguggggccucaaggccuuugccuguugcagggaugucgacuuuuacucaaagugggacaggagccguggguggggaggagucugcucuuccuuggccuggcucaccucuucauggaauccgcgggcugcccuguggauaagggauugggcagugugugaagggcuaguaaggaggcugcucaguaacuugggcuugaccaggguggugcagaggaggagguaagagggguuagguucugaagguggaguagauguggagaauggcgggaaguuuggcuuggagaugauacuggacucuucagccugagcaguuggaaggguggaguugcuuucagcugagcaagaggagaccugggugggcagaugcuggggggcaucaggagcugagguguuuccuuuccccuugaagccuggugacugcuggccugagccacgcuugagccgugggucaugugagugugaaugagugugagugcaugugagucuccgccccugcucaccacccucucauccccugcagcggugggggcggcguacgcagccaagcgggccaaugccaacagggucgucaucuguuacuucggcgagggggcagccagugagggggacgcccaugccggcuucaacuucgcugccacacuugagugccccaucaucuucuucugccggaacaauggcuacgccaucuccacgcccaccucugagcaguaucgcggcgauggcauugguaugggcucugcuggcugcuccccaccccgcugggaucaucuccuucccuccccaauccugccaccuuccugccaccccuacccuccuuccugguucucguccuguguccuguggcgucuggcacuuggucagccacaggaguugagguccugagcacucagccuugcucucuguccucucccugcucguccccuuggccucgugcauguuccuuaucucagcccuggccugaccugccuucucuguguccccacagcagcacgaggccccggguauggcaucaugucaauccgcguggaugguaaugauguguuugccguauacaacgccacaaaggaggcccgacggcgggcuguggcagagaaccagcccuuccucaucgaggccaugaccuacaggugccugccgcuccccccgucagcacccccacagcacugacagccaccguagcaucuuccucauaucgaucacugucuccaaaacauggccuuaucaccugauguugcaucucccccuugccuuuauuccguuuccacuccuccuucccuaguucaucccccauccucccuccugacccccacuccagggagcccacacugaccuggggccccuugccccugugcaggaucgggcaccacagcaccagugacgacaguucagcguaccgcucgguggaugaggucaauuacugggauaaacaggaccaccccaucucccggcugcggcacuaucugcugagccaaggcuggugggaugaggagcaggagaaggccuggaggaagcagucccgcaggaaggugagggugccccgcccgggagggugugcugggggcugcugcggccugcagagcuugggaaggauuuguggaacaccgaacugggaggcucagggauaaccccagugaugucucagauguggccuguggagccaggcugcuggggccauguguguccuggcucuguguccuuggcauguugcccuccacuuccuugucuuugaaaggggaugcugguggugcccauuucagaaacugguuugagacugggcaugguggcucacaccuguaaucccagcacuuugggaggccgagguggcagaucacuugaggucaggagcuugagaacagccuggccaaacauggucaagcccugucucuacuaaaaauacaaaaauuagggcugggcgcaguggcucacgccuguaaucccagcacuuugggaggccaaggcggacagaucaccugaggucgggaguuugagaccagccuggccaacauggugaaaccucgucucuaauaaaaauacaaaaauuagccgggcauggugccgggugccuguaaucccagcuacuugggaggccgaggcaggagaauugcuugaaccugggagguagagguugcagugagcugagaucguaccauugcacuccagccugggcaacgagagcaagacuccaucucaaaaaaaaaaauuagccaggcgugguggugcgugccuguagucccagcuacucaggaaggugaggcagaagaaucgcuugaacccgggagguggaacuugcagugauuggagauggcgccacugcacuccagccugggcaacagagcaagacuaucucuuaaaaaaaaaaaaaagcugguuugaggauuagguggcaaaccgugguggaguguacaugcccugcccagagucagugugccacccucccuggcccggucauuaggacccagggcccgugcagcccaguggugagggcagcacccggcauagggcagcaccguguguccugucccugcccuucucugugccucaguuuccucauugcuuagcugucuaccucuuagggcugcugaaagccuuaaaugauuccacacacuuggauagcaccugaucccugcugggauuugaggguuuucauuacacuucugcuaggauaaucauuuccauugucgaggugggaacacaaaggcuuggagugguuaauuccuugccaaggccccgcaggaggaagcaggguccugcaugggaggccggcuagccugcccacugccccauguccccacaggugauggaggccuuugagcaggccgagcggaagcccaaacccaaccccaaccuacucuucucagacguguaucaggagaugcccgcccagcuccgcaagcagcaggagucucuggcccgccaccugcagaccuacggggagcacuacccacuggaucacuucgauaagugagaccugcucagcccacccccacccauccucagcuaccccgagagguagccccacucuaaggggagcagggggaccugacagcacaccacugucuuccccagucagcucccucuaaaauacucagcggccagggcggcugccacucuucaccccugcuccucccggcuguuacauugucaggggacagcaucugcagcaguugcugaggcuccgucagcccccucuucaccuguuguuacagugccuucucccaggggcugggugagggcacauucaggacuagaagccccucugggcaugggguggacauggcaggucagccuguggaacuugcgcaggugcgaguggccagcagaggucacgaauaaacugcaucucugcgccuggcucucuacca

SEQ ID NO: 191732 - RNA, 10981 nt, Homo sapiens
cagccgcacgugggcucggcgcgauggaggaggagacgcauacugacgccaaaauccgugcugaaaauggaacaggguccagcccucgggguccuggcugcagccuccggcacuuugccugcgaacagaaccugcugucgcggccagauggcucugcuuccuuccugcaagguaagaacuucacccaggucuuucuuuuggagagggacuaccguguacugugcaaccgagugcccaccuccucacgauaccagcugguaaaugucacuccugcguugaugcaugauuucuuguccgauugaauacuacuaaauacgcagggauacacacaucucucccucacgacuagaaaggagaagauaguuccaucuuuguaacuaucucugagaaugagaggaggggcagacuguccgcccaagaauugauauuucagaauagggaaaaucaccucgccaggguaaauaucccccuuaacucgauuccuccuccacccucccacccccaccccccacacacacacccucuagguccuugcaucccggacugaagcaaaccugucuauuugcauacuguggacuguggcggaucuuucacccacguaaauacuccucaaauugaagauaaugucauugcgcuggguugagaaauacauccccaccgcuaccucacugcaucucuccacacaaguaaauaucccuaagauuagggcaagucaaaaaaaaaaaaaaaaaaaagauuagggcaagucuuaccuauagagcaaauauccccuuuuccuagcuaaauaacucucagaaguagauuaacuccaagaauauuucucuuuaacguuugagacgggaggccgggggcgguggcucacgccuguaauccccacacuuugggaggccaagaccuguggcucaccugaggucaggaguucgagaccagccuggccaacauggcgaaacccugucucuacuaaaaauacaaaaacuagccaggcaugguggcgggcgccuguaaucccagcuacucgggaggcugaggcaggacaaucacuugaaccugggaggcagaaguugcagugggccgagaucgugccauuguacuccagcgugagcgacaaagcaagacucugucucaaaaaaaaaaaaaauugagacagcgucucacgaugucacccagguuggucuugaacuccugggcucaagcaauccuccucccaaagugcucauacagguaugagccaccacgcccagccccaauacauuuuaacaaaauuuggcugcuguguugauuguggggaguaugggggaaaacagggaggugaugguggcuccagccagagcaggaguaguggaggugaugagauucuggauguaguuugaaaguaauacggacaaaacuuacguauaguuugguuugagugcgaggaaaaagauucaggcauaacuaagguuucugcccagaucuguacaagucuggaaaucagaagagagacccaagcuggacauaggcaauuuggaacucucuggcuauauagaugguauuucaggcuauugccugaacgaagugaguguagauggaaaagagaagaggucccaggaccaagcccuaggccuuccaacuugagcagucagagacaugugacaagcuagcaaaggagacucagaaggaacgcccagagaguuagggggaaaccaggagaugguggugaccuggggccaagaaaagagcaugucugagaugugagggcugaccagcuguuucagccuuacugacagccgggucaugggaggguugaucauuuggaggucaguggugacgauguugagcugccgcaauggagugguggggucacagaaaaggaagaagaggcagcuguucaggaguucugcuguaagaggaucagauaaguggggcaggaguuguagauuguuguggggucaacaggggagagaauugcuggagccacgucuucaagaaggugagaggggagagacucuugugcucgggcaaaacacaggcaguucaucuggagccagaggcaaguucuguuuugguaacuucuccaguccucagggcaguuucuccuggaacuaagcauaccuuccguguaagggcaaauugggcuucccaggaaauacggccuuaaccaaggaccuucccaggcccucccucaggcuuagcgcuuaugcugaauugagauaccuaaaguuucuucgaacguaagaauuaagaagaggccgggugcaguugcucacagcgguaaucccagcacuuugggaggccucugaggucaggaguucuuuuuuuuuuuuucuuuuuuuuuuuuugagauggagucucgcccugucgcccaggcuggagugcagugaagugaucguggcucacugcacccuccaccucccggguucaagcaauucuucugccucagccuccugaguagcugggaccacaggugcgugccaccgcgcccggcuaauuuuugugguuuuuaguagagacgggguuucaccauguuggccaggcugaucuugaacuccugacccugugauccaccugccucagccucccacagugcugggauuacaggcgugagccaccucgcuugguugaggucaggaguucugagaccagauuggccaacauggugaaaacccaucucuacuaaaaauacaaaaauuagucggaugugguagcacgcaccuguaaucucagcuacucuggagguugagguacaagaaucacuugagccugggaggcggagguugcagugaacugagauugcgccacugcacuccagccuccugggugacagagggaaacucugucccaaaaaagaaaauagagacaggagucuuccuaugcugcucaggcuggucucaaacuccuggccucaagcaguccucccaccugggccuccauagugcugggauuacaggugugagccaccaugccuggccuaaaauguauuuuuuuuuuuuuauugagacuaagccuugcuguuauuguccaggcuggagugcaauggugugaucucggcucacugcaaccuccgccuccccgguuccagcaauucuccugcgucggccucccaaguagcugagauuacaggcacccaccacuaugcccagcuaauuuuuguaucuuuaguagagauaggguuucaccauguugacuaggauggucucaaacuccugaccucaggugauccacccaccucagccucccaaagugcugggauuacagcagacaguacuagaagccaggcuguuuauuucuuagguuuuaccuccuguaccccguucauagcuucuggggaaauaaggaaucaggauucauuccagauauuaucccuuucucagguguccagacugaugcaaaauuugggggccagugccuaagggaagagcugggcuggggaagcuuuggaaagagaaguugagagcagcugcaguaagagggaggaugguuagcuuucaggaagaacuuccuguuaaaaguuacuaauaccagccgggcacaguggcucacgccuguaaucccagcgcuuugggaggcgggcagaucaugaggucaggaaguucgagaccagccugaccaacauggugaaacccagucucuacuaaaaauaaaaaaauuagccaggugugguggcgcgcgccuguaaucccagcuacucaguaggcugaggcaggagaacugcuugaacccgggaggcagagguugcggugagccgagauuacgccacugcacuccagccugggcgacagagcaagacuccaucucauuaaaaaaaaaaaaauuacuaauaucagggccaggcgugguagcucacgccuguaauccuagcaccuugggauuacaguugcccaggaguucgaaacccgccugagcaacauggcaaaauccccucucuacuaaaaauauaaaaauuagucaggcaugguggcacaugccuguaguuccagcuacuugggaggcugaggcgggaggaucacuugagcccagaaggucaaggcugcaaugagccgugauggcaccacugcacuccagccugggcaaugagagugagacccugccugaaugccugaauggacgaauguuacuaauacagcuaaagucuguugcacauucagcgugagccccgcaguguucuaaguguuuucugugaauuguguccuuugauccucacaagacgcuagcggggagggacugcuauuuuccccauuuuacaaaugagagaaaugaagugagugcucaaagaaucaguaccaacaaauggcgggggugacguggggagcccuggccgucaggcucagugccacaaauggggccccaggagcagggaagcugugagugaggcccucccugcugucuccucaggugacaccucuguccuggcggguguguacgggccggccgaggugaaggucagcaaagagauuuucaacaaggccacacucgaagugauccugaggccgaagauugggcugccugguaauugggcccugcugaaccucugaguggugcccaguuugucaaaaucacccccccagcuccucccuaccagcugccccgagucuccacuccccgcuugggucuccacucagcuguuucugucuuuaacucuccgccucuaauuaauaacucaucuucuguugcuucucucucugccucuaauuucucccucccucuuuucucccucucucugccuccacucucauucauuccauuaaccuguuuuucuuuuauuuauuuuuauuuauuuauuuuuuuuuuggagacagugucucgcucugucaccccggcuggagugcaguggcacgaucucagcucacugcaaccucugccucccagauucaagcaauuccccuggcucagccucccgagucgcugggauuacaggcacgugccaccaugcccacuaauuuuuuguauuuuuuuaguagagaugggguuucaccauguuggccaggauggucuugaucuccugaccucaagugauccgcccgccucagccccccaaaguguugggauuacaggcgcgagccacugugccuggaccauuaaccuguuuuuccacccuuuuacccucauaucccucaguccccacugacuggaccugcuagggugggagugggcguggguagcagcacagacauggaacucccaggucuucuucccuuggaugguucccuugguggaugcuggagguagcaggggucaguggauggcagucaggccuugccuucuucccacuggaaucuuccaucaucccugcagguaacugcaccaucccaggcugagaccgugagcccuuucugggaauuugggugaggcguauggaggaaggugagucaaaugaaggggaagacccugaaccucucuucaauuuccccagguguugcagagaagagccgggagcggcugaucaggaacacgugcgaggcgguggugcugggcacguugcacccccgcaccuccaucaccguggugcugcagguugucagcgaugccggcucuguauccuuucugccaggccuccuccuccaggaagucuccugauugcuucccuccuggcggauacauauacccucacugcuagccagaaagccuucaaacacuugacagguaccagcucacugaagaaggagagcaaacagccugggugcuuacuuaugugccaggcacuguucugugugccuuaugcacauuaacucauguaauauagcacaugcccuuaugauccccguggaaguggcagagccaagacuuagacccagaccgucuaguucuagagcccacggacccuggcagaugaguguucuuauguucgcauguuucaggugacaaaacugaggcccagagaggggaaggggcuugcccaaggucacacagcuggaaggcagcacaggcaggacucaagcccaggccagucugacuccagagccugugccaaucacuucuuuuguuuuuuggguuuuuuuguuuguuuuugagacaggcucucacucugucacccaggcuggaugcaguggugcaaugucagcuuacugcaaccucuaccucccgggcucaagcgauucccaugcuuuagccuccugaauuacagguggaauuacaggugccugccaccacgccaggcuaauuuuuguauuuuuaguagagacgggguuuugcuguguuggccaggcuggucucgaacuccugaccucgagugaucaguccaccuuggccucccaaagugcugggguuacaggcaugagcuacugugcccggcuggcaaucacuucuacucggcaccucaguggauuucaggcccucagugcugggggcgcccugagcagacagcagcugagucaggagcguggccuuguaagaucuccaugucugaggugcgagagguugagguugaggacuagaauuagacacuguagaaggcuuuacuggaacguggcccugaacuggacagacauuuuauggaugggcagagagagaagguauugugaccccauuuuacagaaguggaaagugaagcccagaggaaggcguggaggaucagcagcagagcuggaaccgguugacuaaagcuguggucuuugucuggcugcuaggccuggagaagaaacacauuaggaaacugaggcagagccagcugacucccaaccugugcucucuuuccacugugagcuuccugcaggcagcagcgagguggcucuuccuccauugcccugccagcucugucaccggggaguggcugcuacccaaguuucgggccuggcuuugccagugccucccccucgugucuuuggaagguuucuuccccucucugacccuauuugccaacaaaugugugguacguacuucaguacauaccuauugaauauuauuauauuccccaucuaacagaugaggagauugagacucaaggaguaagucacuuguucaaggucacacagcugagcaaaacuaggucuggaacccagggcuacuugauccccggaccacuuuuaaccacucugccauacugcccuucugugaccgauuagugaugucugccauaggcaucagccugguggagggaggcauggaucugcucugcuggccaggccuacaguagaaacuucuuaggcugggcgugguggcucaugccuguaaucccagcacuuugggaggccgaggcagguggaucaccugaggucaggaguuuucagaccagccuggccaacauagugaaaccccaucucuacuaaaaauacaaagauuagccgggugugguggugggugccuguaaucccagcuacucaggaggcugaggcaggagaauugcuugaacccaggagguggagguugcagugagccgagaucacaccauugcacuccagccugggcaacaagagcgaaacuccaucuccaaaaaaaaaaaaaagaaacuuaaccauuuccuguggugcucagcuccuggccuguugucugaaugccgccugcauggcauugguggaugcaggugugcccaugcgggcucucuucuguggggucgccugcgcccuggacucugaugggacccucgugcuggauccuacauccaagcaagaaaagguaggugugaagaccaggguggcugaagggcagaggccagacagcugcccgucccuuccuccaggccucgcuucucuacagacagucggcucaugccaccucaaucccacuuagcaagggcugcucuaaucaucaugguucauuuagcagcaagugcuggaaacccagcucagacuugcuuaauuaggaaggaaauguggggccgggagcgguggcucacgccuguaaucccagcacuuugggaggcugagguggguggaucaccugaggucgggaguucgagaucagucugaccaacauggagaaaccccaucucuacuaaaaauacaaaauuagccaggugugguggcgcacgccuguaaucccagcuacucaggaggcugaggcaggagaaucgcuugaacccaggacgcggagguuguggugagccgagaucgcgccauugcacuccagccugggcaauaagagugaaacuccaucucaaaaaauauaaauaaauaaacuagaaaggaaauguauggccaggugugguggcucacaccuguaaugccagcacuuugggagucugaggcaggcagaucaccugaggcugggaguugaagaccagccuggccaacauugcaaaacccugucucuacuaaaaauacaaagguuagcuaggcaugguggcacacaucuguaaucucagcuacucaggaggcugaggcaggagaaucacuuaaaccuggaggguggagguuacagugagcugagaucgcaccacuucacuccagccuggaugaaagagugaaacucucaaaaauaaaauaaaauaaaaccaggacuuuaaacaccaucaggauguccuugcuucacuucucgucccugccuuucucugcacaucagcuucauucuuucuggccagcaccuuuccugaggcugggacugaccccuuaagcuccauuuccauccuaggaggcucaaaagcaaacgagaagagaguuuuccucaucggcucaggugcaguguccuaagcucaaguuauucugaguuuucugcccagugcuauaaugguccccucuagucaagaagacggaaaccacuuggaggguuucagauggagggaguuaaaugcagggacuuuguaacaacaguguugaggaacuagaggaggaaaaaggaagcaggagugacacccagagaugagaaaccccucccagaccuggacugaaccugcgagccaccuccuguucugucguguuggagacaucaucucaauugguucuggaugcacauagcauguccugcuucugcccuggccacugagguccagaacccaccccaccuccauggcugucacacagccacagccaucagcaccugccauuguccaugaggaccagggugcugcuuuucuuccauucucccaccucauuacugauggaaacuagcugguaagggagucugggaaauacagcuugcuggcuuccagccccugugggacagagcauggaagggggacugggaggccgagagguaccagauaagugaguggcacuauggcuagccccuuggggcaggaauacugagcuuggaagccccugucagaaccacgugguuggaauaaggggcauggaguacaguucuacaaaggaaaggcagagggcuauacccagggaaguagggaagggguagcguagacaaaaaauggcugcgcuugaugcuugauaggugagcgccuggcuauggaaagggagaggccuggaggccaaggguccggaguccccucagugggacuggcugcaaguguguggugggaaggggagcguugagacagggucucacugucgcccaugcuggaguguaguacgaucacagcucacugcagcuucaaacuccugggcucaagcaguccucccaccucugccuccugaguagcugggaacucagacaugcacccccacacccagcuaccuuuuuuuuuuuuuuuuuucugagauggggucucccucuguugcccagauuggucuugaguuucuggccucaagcagugcccugccuuggccucccaaaguggugagauuauggucaugagccacugugccuggccaaaggacuggcugagauuuuaucugaggggaagguccuaggucccccaccgccuucuaccccuugucccuaggaggcccgggcaguccugaccuuugcccuggacagcguggaacggaagcugcugauguccagcaccaaggggcucuacucagacacugagguaccagcauggggaugaggggaaaagccagaaccuuccuucccacugacauacggucuugucccaacucugcccuggauucugagaggcuucaggagagccucuuaaauuucuucuuguaaaaagggaguuuucaaacuuuguggacccagaaaccuuugcggaaauguuuaagggaagcccaauuuauaacacaggcaaaaagaggaugagcucaguuugaagucagaagagggcaugugauggucccccagcucccagcucagaguggugagccaugggaauuccaggucucaggcuaaggggcagagccuggaaacucuuggacaugacugucugcaaaagcauguccaaccuggaccucaugaaucuaggaauacauggcagugaagacugggagucucuugauuccauggcucuuagauuauuugggcugaaggggacuguggcuguaaaaucccaagaccacuccaauucugugcacucuccaguuccauagcucugcacagcuggggccuccuccaaggugugaggaugccugauaggucugaguccuguugcugucagaaucugauccugaaguccuucucccucuuuuuauuucuccugaucucuaagaaacaguucaugaaaugggaaauaaucccuuaccacuugccucacuugggggcaggggagugaugggagguuaagggagucagguggggucagcagaaccuccugggucagccaagucgugugugcaugaagggcucggcccccagcaccgaccagucucucccccgcagcuccagcagugccuggcugcggcccaggccgcuucgcaacacgucuuccguuucuaccgggaaucgcugcagaggcguuacuccaagagcugaggcaagcuggggcaaggggccgcucccauugccuccacccacucacccccuacagccugaagcaaaccagcagcccagccuugccucucugacccaugggcuccuugagccugcagcucuguaaccacagggcuccuguggggaggccuuggccugugacagcccccaggccugggggcacagauccccccagcaaggauaacauucaaaggagcucacauuuauggaauggaugaaucaauaaauuaauucacuuuaacaa

SEQ ID NO: 191733 - RNA, 23020 nt, Homo sapiens
ccccgccgccgccgcccuucgcgcccugggccaucucccucccaccucccuccgcggagcagccagacagcgagggccccggccgggggcaggggggacgccccguccggggcacccccccggcucugagccgcccgcggggccggccucggcccggagcggaggaaggagucgccgaggagcagccugaggccccagagucugagacgagccgccgccgcccccgccacugcggggaggagggggaggaggagcgggaggagggacgagcuggucgggagaagaggaaaaaaacuuuugagacuuuuccguugccgcugggagccggaggcgcggggaccucuuggcgcgacgcugccccgcgaggaggcaggacuuggggaccccagaccgccucccuuugccgccggggacgcuugcucccucccugcccccuacacggcgucccucaggcgcccccauuccggaccagcccucgggagucgccgacccggccucccgcaaagacuuuuccccagaccucgggcgcacccccugcacgccgccuucauccccggccugucuccugagcccccgcgcauccuagacccuuucuccuccaggagacggaucucucuccgaccugccacagauccccuauucaagaccacccaccuucugguaccagaucgcgcccaucuagguuauuuccgugggauacugagacacccccgguccaagccuccccuccaccacugcgcccuucucccugaggaccucagcuuucccucgaggcccuccuaccuuuugccgggagacccccagccccugcaggggcggggccuccccaccacaccagcccuguucgcgcucucggcagugccggggggcgccgccucccccaugccgcccuccgggcugcggcugcugccgcugcugcuaccgcugcuguggcuacuggugcugacgccuggccggccggccgcgggacuauccaccugcaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacggugagcucggaggggcaggggagccgggaggggggcccccagggggcgccggagugccggggccacggguaggaagugacuggcagaagaaacuggcuggaggaagaggacaccccggggcaaagggaacgugugauggugggagggggguguccgaaagaggauggcacugagcccccuaccacccaggugucuggucuuggagaggaggagauagcgaaguggaccgcuucuagagugcgacagaaacaugcggggucgugggggcaguccccuagagggagacaagcaauagggggaggguagaaggcucccucuuccaggacgcguugaaugggggggggggucguggggugccaggugcagagaagggagccuggugugggagaagcgaagaccccagcauuugggaaaggagaggcgcuggagaaaguugacccagagcuuggggguccugagguggaaagauucaagaaggacagaaaagcuagaugaaggcaaccccagagggugccaggaaagugagagcggacccacuuccagaggcugccaggaacacgcgggaugcgggggugggggagagucguagaaagagaaacagaggugcgugugauaaauguggggagaaagggacgggagguuauuggaaggaggaggcaagcgggagaggagcggagacucgggagggcgcccgggaugcagagguguccucgguguuucacacagggacgugagggacagaguggggagcccagcggaggaaucgagcuuccagaagaccuagaguccugggucaugggaagggcuuuaccgagaggggagacaggcgugggaaagguggugugagcggggaggaggagagauacccagcgccauccacgcugcauuccccgcaggaugcaggggaaugggcugagcggaguccagccgcaggggaagugcuggguggggggugacucuacaagaccgaggugagaaaaccaagcugggaggagugagaaagccccacgugggugccacgcgcggggggaggagccugcgcuuccaccaaggggcaggaggaccccgcugcgcuaaacgcuggcagucuggaccccaaagucccaguuccucucaggguggcuggggaaaccccagcguccggcggccucaucccccucccuucccuuuccuucccaugcccccggcggaggcggggaucgcucgcggagcccggggcgagacggggcaggucugguccccgcccuccuggcugcggcgccucccgcccuccucaccccagcuacgggcggggcucccacucagccggccccgucggcauccaugcgaggacccaggcgucccgcgugguucagagccuuggggaagaucccucagguuucacugacucuugggcggugugggcuugcggguucccugcccauuucugcgccaguuuacagcuccagcccaaugacgcgcacuccgcacccaagucucagccuuaccuuaucuuccguggcuucaccuucguuguagagguuccuuuaacacugacaccuccaauccucuucuccccaacaaaugcacaugugucucgucucgcacgugucuccccaucugccucuuucuuuucgucuccguuagucuuucuguccacgcaugggucuccugguuuuugucucuccgacuauuuucucucccuuucuauuuuucuccuccacgguccuguugccucgucuccgucucugacaucuccccgccucucccucucugcaucacccuccaacccuuccucucccuccucucugucuuccucccuaucugucuuccccagccaaggcucugccuuuccuuugggguuugcugaguaaccuccgggccaagaauagggcuuacuggggcuggguggggagggagacuggggaggaggaggaggaucgaagggggccguaggggagggguuuccucugccuuucucaccagucucuuuucacacccccacuaugggaggcuggaagcaguugccccaguugauccagcaguucauggccuguucccucauccccauccccaaacuuuuccuaaacuagaaaauaccuuggcugggcgcgguggcucacgccuguaaucccagcacuuugggaggccaagguggguggaccaccugaggucaggaguuggagaccagccuggccaacauggugaaacccggucucuacuaaaaauacaaaaauuagcugggcgggguggcgggcggcgccuguaaucccagcuacuugggaggcugaggcaggagaaucgcuugaaccugggaggcagagguugcuaugagccaagaucgcgccacugcacuccagccugggcgacagaaacuccaucucaaaaaaaaaaaaaaaaaaagaaaagaaaacaccuuaauuccuuuucuccccacuacagccauuccuacccagaaugaacuucacuuucccuaaccagcuggggaagggaguuaaggguggaaaacuaauaauaaaaauaaguagaagaaucacuuagggguuaagagcacagucucuagcugggugggugugguggcucaugccugugaucucaacauauugggaggcugaggcgugaggaucccuugagcccaggaguuccagccugccgugagccaugguugugcuacugcacuuccgucugggggacagagugagacccugucucuugggggaagaaaaaaaaaaagcacagucucuggaaugagacagcuugaguuugaaucccagucugcagcuaugugaccuuggggcaaauuacuuaaucucggugccucaguuucucaucuauuaaacggguauaauaauaguauaagguugugagguuuaaaugucuucaucuuuguaaagugcuuuagauagcaucugguaaauagcgcuguuuugugguuuuuuguuguuguuguuuuugagacagagucuuacucugucacccaggcuggagugcaguggcgcaaucucggcacacuauaaccucugccucucagguucaagcgauucucaugccucaaccucccaaguagcugggauuagagccguccggcaccaugccuggccaauuuuuguauuuuuaguagaaacgggguuucaccauguuggccaggcuggucucgaacucccgaccucaaguaaucaauccaccucggccucccaaagugcugggauuacaggcgugagccacugcgcccagccagcacucuuagacguauacaugauugagugaccaguguaugcagaauuggugccacauggcuugaccugggucaucuaauuucccacuauaauacuggaauggguucuagagucacucugucuugucuuacaccuggcucagagagaggaauucacuugcccaagguuacacagcgcuuaaauuaggagagucugugugggaaugcagggagcuuaauguuauugcuguuuuucaaagaauaacaggaaacugacauucagaaagaggguguuaacugcccauggucacacagccaagaggcagcagaggcacuaucugaguccaaagccugugccuuugauccuuacucugcauuuuaggggcucuugcauuuggggcaaggaaggccagagcaaacagagugguuccccuuggugccagccuuagucgacuugagagaugaugcuacaugagagaggaaugugguuaggaccuauuuuacagaggaggaaacaaaccuagggggagaaaccacuuccucaaggucacacagcuaaaaaguaucacagucagggcugggcgugguggcucacaccuguaaucccagcacuuugggaggccgaggcggguggaucacgaggucaggagaucgagaccauccuggccaacauggugaaaccccaucucuacuaaaaauacaaaaauuagcugggcaugguggcaugagccuuuagucccagcugcucgggaggcugaggcaggagaauugcuugaacccuggaggcggagguugcagugagcagagauugcgccacugcacuccaagccugggugacagagcgagucuccgucucaaaaaaaaaaaaaaauucauuuaaauaaauaaauaaauaaauaaauaaauaaauaaauaaauaaaagguaucagagacugacuccaccccagagcugucagcuccaaaacuccuagaguugggagcaccagcuccccucaccucugccaaaccccugaucgccucccuucauuucucccugcuagaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccaggugaggacaugagccagaaggaaggucagggcaugggcuggagagggugagcugugaccaaggggguggcugugggucggcugguuacaagguccaccuagauggucccugaaggauagaagaacacaaaccauacaauccuagaacgcuuuuuuuuuuuuuuugagacagugucucacucuguugccaagcuggagugcagugguaugaccucagcucacugcaaucuccgccuccuggguuccagugauucuccugccucagccucccaaguagcugggauuacaggugugcgccaccacgcccagcuaauuuuuguauuuuugguagagaugggguuuuaccauguuggccaggauggucucgaucuccugaccucgugauccaccugccucggucucccaaagugcucagauuacaggcgugagccacugcgccuggccucuuuuuuuuuuuuuuuuuuuuuugagauggagucuugcucugucgcccaggcuggaguacaauggggugaucucggcucacugcaaccuccgccuccuggguucaagugauucuccugccucagccacccgaguagcugggauuacaggcaugugccaacacgcugggcuaauuuuuguauuuuuaguagagacagaguuuuaucauguuggccaggcuugucucaaacuccugcccucaagugauucuccuaccugagccucccagagugcugggauuacaggugugagccacugcacccggaaccuagagcacuuuuaaauguucagacucuuugcauccuaggauguuaaacacuuagaaggcuggaaucuuaggaguuggacucuuuaaggacacaggauucuugaaaguuggaaucucugaaaagguugggggcucuagaaucauucuguccaauaugacagccacuagucacauuuagcuugauuaaaauuuaaauuguuuaaaauuaaauuaaaaauuuagggccaggcauaguggcucacaccucuaaucccagaacuuugggaagccgaggcaggcagauugcuugagcccaggaguccgagaccagucugggcaacauguugaaacuucgucucuacaaaaaauacuaaaauuagccuguuauggugaugcgugccucuagucccagcuacucaguagucugaggugggaggauugauugagcccaggaggucgaggcuguagugaacugugauugcaccacugcauuccagccugggugauggagcgagaccgucucaaaaauauauauauauaggccaggcgugguggcucaugccugcaaucccagcacuuugggaggccaggguggguggaucacuugaggucaggaguucaagaccagccuggccaacaugacgaaacuccaucucuacuaaaaauacaaaaauuagccaggugugguggcaggcaccuguaaucccagcuacuugggaggcugaggugggagaaucgcuugaccccaggagguggagacugcagugagcggagaucauaccacugcacuccagccugggcaacagagcgagacucugucucaaaaaaauaaaaaugaaaaagaaauccucauucucacuggccauauuucuaguacucuauagucacaugugguuagcagcuacuauuuuggauguugcagauaaagcacauuuccagaaaguucuuuaggacagcacugcucuagaagauagggagcuuccaagaggacuggggcaucuggaagggcuggaggcucuagcaguuucuaugagcuagaauccauaucagagggaauguuaacucauaggaugguagauuucagacuuucacagugagagaacuuuguccuauguuagcuuggcuucuuggagucuggggaauucagcuuuauucugcagucccuggaguggacuauccagccccagaaaauucuucuuuuuuuugugugugugugugauggaguuuugcuccuguugcccaggcuggagugcaauggcaccaucuuggcucaccacaaccuuugcuuccuggguucaagcgauucuccugccucagccacccgagcagcugggauuacaggcaugcaccaccacaccuagcuaauuuuguauuuuuaguagagacgguguuucuccauauuggucaggcuggucucgaacuucugaccucuggugauccacccuccucggccucccaaagugcugggauuacaagcgugagcgacugugccuggcccagaaaauuauucuacacagauguuggguaccugcagcaucuaggugcggcauggcagacucuuggguuuauagaacauuagucuucuaaagcuucucaggcucuagaaguggaaaucuugggauauuaucaaacauuugaaucacaaaaugacuuuuuuuuuuuuugagacagagucucacucugucacccuggcuagagugcaguggugcaaucucggcucacugcaaccucugugucuuggguucaagugauucuccugccucagccuccugaguagcugggauuacaggcgugugccaccacgccuggcuaauuuuuguauuuuuaguagagacgagguuucacuuuguuggccaggcuggucuugaacuccugaccucaggagauccacccgccuuggccucccaaagugcugggauaacaggcgugagccaccgugcccagccggaaucauuagaaaugacuucuaaguuacugagaauucagggugucaaauuugcagaaccguaugcucaguaaaccccagaauguuugcagcagaauuuuauuuuauuuauuauuauuauuuugagacgaagucucguccugucgcccaggcuggagugcaguggcgugaucuuggcucacugcagucugugucucccgggcucaagcaauucuccugccucagccucccaaauaguggcgacuacaggcgugugccaccaugccuggcuaauuuuuguauuuuuaguagagaugggguuucacuauguuggccaggcuggucuugaacuccugaccucaagugauccacccaccuugggcucccaaagugcugggauuacaggcgugagccacugcgcccggcccagaauguuagcagcagaauuuuagcauugugggcuguccacgcugaguggggcuuagcauuucaccaaugaggaaacaggccucgagaaggcaagaaaacaccuucggcugagcugugugaaggugacuugaccgcagccugagcuuuuucuccaccccuccucucauggguacuguuggggaggaugggugccacaggaccacacagguggcugucugagaggguagugccugggaacuuucuggaagccuguuuggggaagcagauggggugaaggauucaguuaguguauguggggucgugacaccaucuacccacugucucucuccugccuucaucauccucuagaaauacagcaacaauuccuggcgauaccucagcaaccggcugcuggcacccagcgacucgccagagugguuaucuuuugaugucaccggaguugugcggcagugguugagccguggaggugaggauuacuugugugucccaccccuguuucucccugggguccaccccauuguuuguccuggggucacuuugccuaggaccccucuccgccccauacuggugugaaagugcugagaccuggcuccccucuguggcauggaaaccugagugauuggcuaaucuguuuccugagcaccucucugcccugcccugugaugggugaugccaaggacacagcaaugaccaaaacagccccauccuugcccucacagagcucauauaguccauuggcuagguagcuggggaacagaccuguaaggcagugaugacccagagugggugggacugggauggggagcccaaaggagguaccugacccagcccagaaucagggagggcuuccuggaggaggggcaccauagcugauguugaagggaugaguagaauggucaggaaaaggagagguguaagaguauucuggggcugggcaugguggcuuaugccuauaaucccagcacuuuugaaggccaaggaggauggaucacuggagcucaggaguuuugagagcagccugggcaacauggcgaaacccggucucuacacaaaaauacaaaaauuagccaugcaugcuguuacgugccuguaguuccagcugcuugggagacugaggugggagaaucaccugagccugggaggucgaggcugcagugagucauaaucacacuacugcaauccagccuacaugaaagagugagaucccaucucaaaaaaaaaaaaaaaaaaaagauuccaggcaaagggaacagccugugcaaaggccuggaggccagggagagccuaacuaacucauuugaucuguccaggagaugauugucucugucugguuucuggcagggcccauggugccccuaucucucucccucaccucccucucauuuaugcuuuuauucaauaauugcccacagguuccugcugugugccuggccaugugcuggguggugugggggacauagugauaaccaagacagcccucaguucugcccucauggggcccacagucacuucuggacaccuaagagaucuugucaaggccccaccaggcaggaaugaccuagaaugaucaagaaugggauggggaggcaccagcagggaggacaaggcugggacagggaggcaugcaggaugggggaacgcccuaagugcuguugggagcccagagaaggcaccuggacccaucuggggagucuaggagggcuugcugggugagggugauuguguggagacucacaggauaaauaguaguuuggccacaugaaaaaaaagggauuagggggccuggcaugguggcucacgccuguaaucccagcacuuugagaggccgagguggguggaucaccugagaucgggaguucgagaccagccugaccaacauggagaaaccccgucucuacuaaaaauacauaauuagcucggcguggugaugcaugccuguaaucccagcuacucgggaggcugaggcaggagaauugcuugaacccaggagguggagguuucagugagccaagaucgugccauugcacuccagccugggcaacaacagugaaacuccgucucaaaaaaaaaaaagaaaagaaaaagaaaaaauagggauuagggagcaggugggcacugggaggaguguccugggcuguucgacaaaggccuagaaggagcucaucugucuuggucaaugcugagucccaagcacacagcacaggcuucggcacauuguaggagccuagaaaacaucauucacucauucauucaagagauugaugcuggcugggugcaguggcucaugccuguaaucccagcacuucgggaggccagggcaggaggauugcuugagcccagccugggcaacauagugagaccucugucucuacagagaauuuaaaaaguagccguguaggccggaugcaguggcucaagccuguaaucccagcacuuugggaugccaaggcaggcggaucaccugaggucaggaguuugagaccagccuggccagcauggugaaaccccaucucuacuaaaaauacaaaaaauuagccgggugugguggcgcaugccuguuaucccagcuacuugggaggcugaggcaggagaaucguuugaaccugggagguggagguugcagugagcugauaucacgccacugaacuccagccugggcaacagagccagacuccaucucaaaaaaaaaaaaaaaauuagccaugcgugguagcacgcgccuguggucccagcuacucgggaggcugagaugggaggauugcuugggccuuggagauugaggcugcgagaccuugucucaaaaaaaaaaaaaaaaaaaaaaagagagagcugcagugagagggcagaguggggugggugggggaggcaggaaggaagccccugggguuugcuccuuccuuccucuuccuccaggggcugggugagcugcacucucagacuggcuucccucucgccacuccuacaggggaaauugagggcuuucgccuuagcgcccacugcuccugugacagcagggauaacacacugcaaguggacaucaacggugaggccugcuuccccggccaugcccaguugugacgugugugcguguguguguucccaucugccccacgccccacuuaucuaucccucugagaguguguguguauguccccuauccccugacucccacaccaaagcaggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucaggugagccuuguagccuggauggaggccuuccaggcugggggcaugacugccaucugcugaccaggugcuccagguuggacaccuggcugcugcugugcuugggcugagcaucugucuccuuuagcuuggagggcucaggggaugaggucuggguguaagaaccaggagucuugugccaggugcgguggcucacgccuguaaucccaacacuuugggaggcugaggcagguggaucaccugaagugaggaguuugagaccugucuggccaacauggugaaacccgucucuacuaaaaauccaaaaauuagccaggcguggugggcgccuauaaucccagccacaaaaaacaaaaaaagaacugggagucuuguaauguugggaucagguuccuuuuuuuuuuuuuuuuuuuuuuuuugagacagagucucgcucugucaccugggcuggagugcaguggcgcuaucuugauucacugcaagcuccaccucccggguucacacgauucuccugucucagccucccgaguagcuaggacuacaggcacgugccaccacgcccagcuaauuuuuuuguauuuuuaguagagaugggguuucacuguguuagccaggauggucuccaucuccugaccucgugauacacccaccucagccucccaaagugcugggauuacaggcgugagccaacgcgcccggccuaauuuuuuguaucuuuaguagagacuggguuucaccauguuagccaggauggucuugaucuccugaccucgugauccgccugccucagccucccgaagugcugggauuacaggugugagccaccacgcccagccuugcuuucuugcuggaguguuggaaucacagaauguuagaaaguugaacccugugauuguuggaauucaaaguuggaaggucaccaucuugaaucccuaaauuguuggcagguugagguucuagaaugcugggauucuagaaugcuagaauuugguguuaauuacugaaauggaaaaugucggacucaaggaaagcugaaacauuggaauccuagaauuuggggauucaaaaugggaagauggcccauguggaauuccugcaccacuggccaauuguggauaccaguguuggcagauuggaguccuugaauauugggcucacagugguagaauucuguuuugaaauauucacauccacaaauguuggaguuggagaaagcagaauauugguaucucagcauguuggaacucaguguuggaauguuagaauauuagaaugcugggauuuuauuaauagaaaguggcagcaggcugggcgcgguggcucacgccuauaauuccagcacuuugggaggcugaggugggcggaucccugaggucuggaguucaagaccagccuggccaacauggugaaaccccaucucuauuaaaaauacaaaaauuagccaggugugguggcuggcaccuguaaucccagcuacucggcugggauuacggcuauccagguacccaggcuggggcaggagaaucacuggaaccucggggguggagguugcagugaaccgagaucgcgccacugcacuccggccugggcaaugaugcgagacuccaucuaaaaaaaaaaaaaaaaaaaaaaaagaaagaaagugucaguuugaaccucuugagugauggcucagaacuuuggaauguugggaugcaauacuggcauacuggaauucaggaaugccaagauccucaaagguuggaaagggggaauccuagagaguugaagaugcugucagaauguuagaaucauaagaugcuggaaugcuaauacugcaaucuaagaaagcugaaauguuggauuccuagaaaguugaaauggagaguuagaauguuguaaauuuagagugaucaucugaccuuauuccucccuugcuuaaaauauuuugguccugucucugggcuuuguuaccggcuguuucccugccagaaaaucagcccugcucccaggcuccuucaccaccagaucuuagcgccaucagcccagcaacgcugucaaugaacaaauugaggucuuuuuugagacagagucucgcucuguugcccaggcuggagugcaguggcgugaucucggcucacugcaaccuccgccucccagguucaagugauucuccugccucagccuccugaguagcugggauuacaggcgugugccaccacacccggcuaauuuuugguuuuuuuaguagacacuggguuucaccauguuggucaggcuggucucgaacuccugaccucgugauccacccgccucggccucccaaagugcugggauuacaggcaugaaccacugcgcccggccacaaauugaggucuugagugccaacagcuccugacauuacaaagggagauagccagccaugucagccuccguagggagggacccaauguugccuaggaagucuuggcaaaaaaucaaaccugaaggccaggugcgguggcucaugccuguaaucccagcacuuugggaggccaaggcaggcagaucgcuugagcuuaggaguucaagaccagcuugugcaacauguuaaaacccugccucuguacaagaaauacaaaaaaacuagcuggcuggguggugugugccuguagucccagcuacuugggaggcugaggcaggagugcuugagccuaggagguuguggcugcagucagccaggaucacgccacugcauuucaggacagagcaggaccuugucucaggaaaaaaaaaaaaaaaucaaaccugaaucugaucaggacuguagauccuaacaguuuucuagaaagacaggaacagaggaaauggucagcaaaacucagacugcaagaaaccucacccaguuucuucaucaaauacaaugcaaagaaggggaaagcacacacacacacacacguaccccccaugcaaccaaaaauucacauacaaguuuugacuccccaaaaacuuaacuauuaauagccuacuguggacuggaauucugcuuuauccacaacauaaacaguugauuaauacuuuuuuuuuuuuuuggagacagagucucugucauucaggcuggagugcaguggugcggucucggcucacugcagcuucugccucccggguucaagugauucucuugcuucagccucccgaguagcugggaccacaggugcccaccgccacgcccagcuaauuuuuuguauuuuaguagagaugggguuucaccguauugcccaggcuggucuugaacuccugaggucaggcaauccgcccaccucagccucccaaagugcuaggauuacaggcaugagccacugcucccggccgaauaauacauauuuugcauguuuuauguauuauguccuauauccccuuuuuuuuuuuuugagacggaguuucgcuguugucacucaggcuggaguguaauggcacaaucucagcucacggcaaccuccaccucccggggguucaagcaauucuccugcuucagccuccugaguaguugggauuauaggcaccugccaccaugcccggcuaacuuuuguauuuuuaguagaggugggguuucaccauguuggccaggcuggucuugaacuccugaccucaagugaucuacccgccucagccucccaaagugcugggauugcaggggugagccacgcacccggccguauucuuuguuuuuuuuuuugagacagagucuagcugugucacccaggcuggagugcagugaagugaucucagcucacugcaaccuccgccucccagguucaagcaauucuccugccucagucucccaaauagcugugauuucaggcauccgccaucgcacccggguaauuuuuguauuuuuaguagagacgggguuucaccauguuggccaggcuggucuugaacuccugaccucaggugauccaucagccucggccucccaaagugcuggccuuacaggcuugaaccacugcucccggccuaugccugcauuuuaaaaauaagauagagaaaagaaaauguccuuaagaaaaucauaaggaagaggaaguauauuuuccauucauugaguggaaguggcuuaucauaaaggucuucauguugaguaggcugaggaggaggaagaaaagguguuggucuugcugucucagggcagagguggaagaaaaauucaccuguaaguggugaauuuuguaagaggacccauguaguucaaacccauguccaagggucagucuauauauaguugacccugaauauauauacagagagagagagagaugauuuuguagauuuugaaaaaaguccuaagagaggccagguaugguagcucacacccguaaucccagcacuuugggaggcugaggcagguggaucacuugaggucaggaguuggagaccagccuggccaacauggugaaacccugucuguacuaaaaauacaaaaaucaggccagcugucguggcucacaccuguaaucccagcacuuugggaggccaagguggguggaccaccugaggucaggaguucgagaccagucuggccaacguggugaaaccuccucucuacuaaaaauucaaaaaugagccaggcgugguggcgggcccuguaaucccagcuacucuugaggcugaggcaggagaacugcuugaacccaggaaguggagguugcagugagccgaggucgcgccauugcacuccagccugggcaacaagagugagacucccgucucaaaaaaauaaauaaauaauuaaaaauacaaaaauuagcaggguaugguggcaggcgccuguagucuuagcuacuugggagacugaggcaggagaaucacuugaaccugggaggcacagguugcagugacccgagauugcaccacuucacugcauccugggugacagagugagacuccaucucaaaaauuaaaaaaaaaaaaaaauccuaagagacauaucaaccaauugcaauguguagaccuuacuugaauccuuauuuacacaggcuuaaaaaaaaaagauauuuaugagacaguuggguaaaugugaacucugucuagauauuccucuagauaucaaggaauuguuaauuuucuuacaugguauugugacuguguuuuaaaguagucuuaauuagagauacauuugaaauauuuauggaugaagcaacacgguggauugcaugugcuuugagauaaaccauugucggcuggcugcaguggcucacagcuauaaucccaccacuuugggaggccaaggcaggaggauugcuugagccuaagaguuggagaccagccugggcaauauggugaaaccccaucucccaaaaaaaaaaauaugaaaaguagcugggccuggugguguguaccuuuugucccagcuacucaggaggcugaggugggagguuggcuugagccccaggagcuggaggccacagugagcugugauugcaccacugcacuccagccugggugacagagugagauccugucucaaaaaaaaaaaaaaaagagauaguggauagggguagagaugcaauggaaauuggccaugaguuggucauuguugaagcugcuuuuguguacaucugaaacuuuccagcuggacgcgguggcucacaccuguaaucccagcacuuuggaaggcugaggcggguggaucacaugaggucaggaguucgagaccagccuguccaacauggugaaacccugucucuacuaaaaauacagaaaaauuagcuggguaugguggugugugccuguaaucccagcuacuugggaggcugagccaggagaauugcuugaacuugggacauggagguugcagugagccaagauugcaccacugcacuccagccuggggcaacagagcaagacuccaucucaaaaaaaaaaaaaaaaaacuuucauaggaaaauuuguucuuaaggcagcucgaacacuaccuccuuccuaaccccuuucuccaacauccaagauggaugugaggccucugggcuccccuggggcccuaaguagaucuuugacucaacaaacagucucuguugggucuuuuauuuauaaaaaguuuuguagcgacagggucucacuaugcuccccaggcuggucuuaaacuccuugggcucaagcgauucaccggucuuggcuucccaaagugcugagauuacaggcgugagucacugcaccuggccuaggucuugagagacuggacggaagaggcuuggcaagggcaagggcuguggguaucccaaggcccggugcaggguaggccccgaaugugugcugaaaaaaugagucagaggaucaccuagacggcuuguucaacacggacuguuguucccaguccugcacacaauuucugauuucaguggccuggggugccaccugagaaucugcauuucccauaguucccaggugaugcugccgcugguccugggagcucacguggagagcugcugacuuggauaacaguaucacagauuguucaaauccuaggaucucagaaccccagcuaggguugaacugcauauuaaagaugauucugagccgggugcgguggcucaugccuguaaucccagcacuuugggaggccgaggugggugggucaccugaggucaggaguuugagaccagccugaccaacauggugaaacccagccucuacuaaaaauacaaaaaauuagccaggcaugguggcacaugccuguaaucccagguacuugagaggcugaggcaggagaauugcuugaacccgggagacggagguugcagugagcugagaucacaccaucgcacuccagccugggcaacaggagggaaacuccaucucaaaaaaaaaaaaagauuccggacacuaguucuuccccuuuugugaguucagaacuuccugugagaaagugaaagccaggacucuuuuucccagaaauacaugcauacauacacacaugugcauaugaucucaggcacucauggcccucccuaagccugcccaugauggccccuuggcccucagcuuaacaccuuauuuuaucuaguagcuccuaccucugaacagaugaggaaacugagguccaaccaaauugggugguacgggcugaguucacagggaucucaguuucuugacuuccuucucaggcuucuguggcucuuggaaaggcuuuaucuugccucuagguuauccggugccacuugaaguuggguucaagcgauucuccugccucagacuccccaguagcugggauuacaggugcccgccaccagguccagcuaauuuuugaauuuuuaguaaagacaggguccucaagucugccugcccuagccucccaaagugccgggaugacaggcgugagccaccgugccuggcuggccccaccaaucuaugagcagagguugcagugagccaagauugcaccacugcacuccagccugggugacggagcaagacucugucucaaaaaaaaaaaaaaaaaaaaaaggcauugucaacuuuuucuuuucuuuucuuucuuuuuucuuuucuuuucaagacagagucucacccuguugcccuggguggagugcaguggcacgaucuuggcucacugcaaccucugcuucuuggguucaagcagauucuugugccucagccuccugaguagcugggauuacagacaagcaccgccacacccagcuaauuuuuguauuuuuaguagagacgggguuucgccauguuggucaggcuggucucaaucuccugaucucaggugauccacccgccuuggccucccaaagugcugggauuacaggcgugagccacugcacccggccucuuugacaguucuaagaaguaaaauaaaccagaagaaggcaggcagagaguaauagauauugggaacuguuauuuuuccuauucugauuuaaauuccuuuauuauggaaaauuucaaauguauacaaaagcaaugaagauaaugaaugcccguaaacucucauccagcgucaucgguaauuaagauuuugccccauuucaaaugcagacauuuuuauauuuucuugcauaacugcaauaccguauugcacuaaauggaacuaacagucacuuggauauuuuggaaaggauggcucagaaagguaucucugaggaggugauguucagucauguaacugauauuuacuaguaccuacugcauuccagacacugcuuuaggaguuaagggucccugagugaaggacauuugagcuaagguuuaaaugaagugaaggggccaggugugguggcucaugccaguaaucccaaugcuuugggaggccgaggcgugcggaucguuugagcccaaguucgacaccagccucagcaacauagugagaccgugucucuaaaaagaauaacaaauuaaaaagaauaaauaggccagaugcaguggcucaggucuguaauaccagcacuuugggaggcugaggugggcggaucacaaggucaggaguucgagaccagccuggccaacauggugaaacccugucucuacuaaaaagacaaaaaaauuagccgggcaugguggcacacgccuguaaucccagcuacucggaaggcugaggcaggagaaucgcuugaaccugggaggcggagguugcagugagccgagaucaugccacugcacuccagccuggcagacagagugagacucugucucaaaaaaaaaaaaaaaaaaaaauagaaaaaaaaagaagaaaugaagugaaggaacaagcuggaguggguaucugugggacuagcaaggcaggcagagggaacagcagaugcaggagccccgaaauaagacugucugaggaacagacaggacgccaguguggcuggaguggaguaggcgugagagagggaguugagaucagccagauuugauagcaccuuguggcucacggugaggacuugggcauuugccgugagauggagccagguucagagcagaggagugacaagacaauuuauagcaugcccauggagggcagagauuucugucucuuuuuuaaaaaaauugaaaaaaaauuuuguagagacagggucuugcacuuuguuguccaggcuggcaugcagugguguuaucauaguucacugcaaccucgaacuccucgacuccagcgauccucccacuucauccucccaaagugcugggauuaaaggugugagccaccaugccuagccuauuucuaucuguuucauuuguccucaguccacaguagaucccagcccagcacacaguaguaguucaauaaacauuuguugcacaaauagagcagaucaguuuacauggagcuguguuauuuuguauguuccaggguguggcaugccaugauuuauuuagcccccccguggauggucaucuggcuucuuacaggcuugucuuaagcauugcgugaaauuaauuauuacauugcucuuagcacuggaggaagugcuuaaucuguguuagugauuaucaugacuauuuguguuguuauuaacacagugggugcaagggagacccagauggagauagggcugggggggcaaccuagggugacacacgcaccuggggaggaggggcauguggcuucuauggugguagccccucccugccccugacgcgucucuccugccugcagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguacgucuggcccaccgggcuacgagaugcgcuuggggggagccaggacggaggaagaggagagagaaagagaaguaaagucagagaggugaguuggcaggauggggagaaagagagggaugggguggggaggggaaugaauaaagagauggggagagaggcaggaagcuagagaggggcucugagcaggggccagagggagaugagcuaugaagacccacagagugaaguaacagagggaugggggugaaggggagaagagagacagggagauggaaggaaaaacgcagaaauggagagacaaaaugagagagacagauacagacacagaguuaggccaaggagagacaaagacagauacacaacaaggcaagaggcgaagaugaggagggacagagacugagaaagaaaaucaggcgggcgcggcggcucacgaugguaauaccaacacuuugggacgcugaagcaggaggaucgcuugagcccaggaguucgagaguagcccaggcagcagacugagaucccaucucuaccaaaaaaaaaaaaaaaaaaaaaaaaaaagcuaggagugguggcgcuugccugugguuggagcuacuccggaggcugaggcgggaggauggcuugcgcucaggagguugaggcugcagcgagccaugaucgugccacuauacuccagccuggguggcagagcgagacccagucucaaaacaaaaagaaaaucagacagguggggagagacagaauaagauaggauguuagaagauaagagagaccgaauuggagaugggaagaggggaugcggggagagacgaagugagagaggcuggcgcgguagcgggugggggauggggcaguggagggccguuuuccucccuccacgagcccugagcccugaccccgcccgccgcccgcagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggucccgccccgccccgccccgccccggcaggcccggccccaccccgccccgcccccgcugccuugcccaugggggcuguauuuaaggacacccgugccccaagcccaccuggggccccauuaaagauggagagaggacugcgga

SEQ ID NO: 191734 - RNA, 19601 nt, Homo sapiens
uggcuacuuccagauuauuuuauucacauggcuuggugggguacaggcacuccugccagagagacaggagcaggccucccugccagcccuggucagucacccaccucccggcccucuuaggguuagugcuaguuaucacacacacaacagcgaggggguagagaaaggaaggcaagaagggauccccaucugacuaggggcuucagacagccgcagccugagcccccuccauccuggccgggccuggagccccugucucugaaaaccccacgcugggcagccgcacccgcaauccacccucuuccugguccccacucccacuccgggccuuggggcuuagggacacccuggggaagcggaacuugggugacuucucucugacgggggacuugggggcugcaucgcccuccugcccccgagaggcuuuagaaggggccgccaggccuacacguggcaagcggacccggacccggccccggcgacccgaggccccuuccccacugcccucuuccuccuccuccuccuccuccucggggcugggggacccuuccccagugaccaucucacuuuggcugaagcccacucggggcagccugaguuuggggcucuuggccuucucacccuccucggcccccuccuuggcccgcaccaggccaaaccggggcagccguaccuugagcuuguguccggccucucccucccccucugccaccugguacucggcaugguugcccccggauggcgagagcuccacgucgggcagugagaggcagaagguacgcucggccccugggggcugcuccucagcacccucgccccccacccuagcucuggcccccagugugggcaacuucagccucagcccacccucgccuguggccgccucgcccgccugugccucucggcuuagccccacguccagcucaagcuggggcacugucacggugggcaucuuaaagacacccucacccaccagcagcucaccaccugcaaccugggcuccaggcagagacagggucaccuggggcaccugaacccuguagccugcugugcccucugcugaagggacuguacucugagccugcugcccugggguaccugccuccccaaagccggucagcuccaccuguggcagggagaugcccagcggaggcauccucagccccgcgucauggcccucagugaccaccugcccggcuguggacaccuucaggccugacagcugcauuccacugacggccacagcccccucugcccucccuuccuccugggcgcccagcgugaccagcuccaccucggggaucuuaagcugcacagcgguggacucagccuuuucccccgggcuggcacgaucaccuugaacuucugcuuccuucccucgagccagcccaaaggaaggcaucuucagcuugggcaucuucacccucccaucccagccccagcccuugcccuccaacucagccaccccuggcacuaguucugcugccucagugucccggccucugaccccaaacuuggggagagcaaaccugggccccuugaacuugaggucggccccugccaccucuaccuugccugagggcaggugggcauccaggcugagcugugggauggacagaucgagggcaggcagcaggccugccuccccagccccuuuggccucagccucagcccccacccgagccuuggggagugagauggcaaauuuggauaccuucagcuugguagcucgcccagcccccucagccucugccuuagccaccuuuggccccgagaguccaaacuuagguaaggagaacuuggaagagggcuugacuuuugucucuaucaucuccagccgcccuuccucaauuuccacggcgggcagcuguggggugacaauuucaacagagggcacucggaagcccacuucccugaccccugcugccaccucagggcccuccacccgcucucccuugcccauuuuagcggcugggaccugccccugcaggccaagugcuccuggcaggucuagcuccacugaaggcagagugagagaggggacacccacaugagccucaccauccaccucuggcugcagacagggaaguguuaccagcuucccugagaccucagcacccgccucgccuggcuugccacgugauggggacucugcccucccuagcuugggcauggucaucuugggcaucuugaagccaaauuccaucccuucugccuguucugccuugguggccuuuagcugcaccuccggagcccugggcagcuucaccucuggugccuucggaagaugcacgucgggaaccuucggcacuugcauuuccggcagccgaaucucugacacuuucggcagcugcaccucggggaggugcacaucgggcacagccaucucaggcaccuuggggaguuuuaucucugggagcuucaugucagggacuuucauuucacagacuuugggcagcugcaccucugggaggugcacaucgggcacggccauuucaggcaccuuggggaguuucaucucugagacuuuuggcagcugcaccucggggagucgaaccucuggcacagccaucucaggcauuuuagggaguuucaucucugggacuuucgggagcugcacuuccgggaggugcacaucgggcacagccaucucgggcaccuucgggaguuucaccucagggaguuucaucucagggagcuucaucucugggacuuuuggaagcugcacuucugggaggugcacaucgggcacggccaucucgggcaccuucgggaguugcacuucagggaguuucaucucaggaaguuucaucucaggcaccuuuggaagcuucaucucagggacuuucaucucuggcacuuucggcagcugcaccucuggaagccgcaccucuggcacagccaccucugacaccucugggaguuucaucucugacacuuucggcagcuguaccucuggaagccgcaccuccggcacagccaucucuggcaccuuugggaguuucaucuccgacacuuucagcagcuguaccucuggaagccgcaccuccggcacagccaucucuggcaccuuugggaguuucaucucugacacuuugggcagcucuaccucuggaagccgcaccuccggcacagccaucucuggcaccuuugggaguuucaucucugacaccuuggggagcuccaccucugggagucgaaccucuggaagggcugccucgggcacuuuuggaagcuugaccucaggagccuuggggagcuucacuucaggucccuugggcaccuugaccucgggcccugacacuccgaugccaagggagggcaucuugauggugggcagcuucagcuugcucucuacaacuucaggagcagcgggccggggcuccaagagggaaagcccaaaggugggcauucgaagucugggaccuuucacccuggccucagggcugaccuuggcuaccuuggccucagcaacuuccuuugcucgagccccaaaucggggaaaacuaaggcggggcaucuucagggccaccucaggugccucuccccgggccuccaccucugcacccggcaaggccagguccacccccacagucggugcugccacauccagggugggcaccacuaccgacacagccccuucccgggucucuaggcagggaagugugggcagagugggcagugagggcaaggcaggcagcuccaccugggggaccuggauucccacggcuggggccuccacagcaggcggagccggggcuccgagcccaaggguuggcagguggagggcaaagccaccagcugccucugcugagggggcagccuugggggcugagaccugggggacacccaccuccgccccuggcagccgcggcccaaccagcuccaccugaggggcugugaaacgagcuccugcagccaccucagccuccaccuuggcuuuccuggggggaggagcggcggcggccagccgggcugccugagccucuucggccacuucucguacacgcagccgaggcagcuggaggcgccggcgggcaggggcagccgggacaggacccuugacagccucggcuuugaggccccgacgcaggcgggagaacuugggaaaggagaacucgacgucaacaggggccaggucagcggggacccccagagccccaggcaccaucuucuucuucuucacaggggacagacucuggauguucuggggagagaggagagaggcaggaggcggugggacagugggaggcugggaguggacaggaagagccccaccugguauuggaccaggcgggggaugugcugggucaaguaucuuguuccccaaacaucauccccacuucuugccugucauuucaccaugagugcccaggaaagcaggcagccaucuaggaucuccaaaugagucaacaggaguguagggacggggacccaagacuucuagauccugauccgggauuuuccccaacauccucauucuagagauggggaaacugaggcccagggagagaaacaacuuuguccagggccacucagcaguaauugggccagcacucaggcuggaaucuggcuuuccugguucgaaguagccugguucaggaccccuagcaagccuggauccgaugguggggacgccucuccgaggugggugagggcccugggcuggggugggucugucccccuucccggggaagaguuuggggcagagaggaaggggcagaggguggaauuagcuuggguuagugacaagacagagggcaaggcuggcccacgauggcggggaauggggcucacggcgcagagaccggaucgcuggggcaguccagggccggggccgggcuaagcacgcguaccagcuuggccaccuuggcccgcgggcccuugaucucguagccagacacggucccgggccgcagagccagguccccggugggcacagugcgcuucaggcagaaggagacuuuguaaggcucggcgcauugcagcaggcguagugcguccucguacuugaaguucucgaagaacacucgggcacucagcagcugguccccugcgggcgagguggaggugcgcagcacgugggcaucucccggcuccgcccgggccuaguucugcccacuugcacggagcccucgcggugaggacccgccccaaauuuuaguuucuccaauccccagcgcaggauuaagucgcaguuacgcuaguccccgccccaugaccuuauccccgcccccugcaaugaacaaagccgcgcccacucaggccacgcccgcaccuugucgcuccccuacccauccuuacguuucagauacugacuuugcuucuuuuaccgagagaacagaaucagaagggaacuuccagaaucucccacacuguguguucacccccuuucuccugcggcgacuuacuccauucgccuuccuguuccuggggaugaacuaaccccacuccuagcucagggcaaucucuccaccgccuucucagggacauccuccagcaauucucuccucuucccacgucaucaguuguccuucucgucuacauuauucccaucagcauacaaacauauuauuauuucucgcauaagaaagguugucauggccucacucccccggagcuccugccccauuuaucuguucaccuuaauaggcaaaagguauugaguucuccaguggcauuguuaccaguucuccagucacaccucugacccugcuuuccaacacgcacaucugaacugcuccucucaagguuccaggcagugaccucuguauaguaaguccaagggucaagucccaggccucaucugcuuaaaccacucagcaucugaucuaaccucacucucugucauauccuugcuucccuuggcuuccaaggugcuacacccucuggagcgucucugggaguuccuugucagucuccauagauguuugcuuucccucucccugauuucuuucuuucuuuucuaaacagucucacuauguugcccaguccaaucucaaauuccuaggcucaacugauccucccaccccagccucccaaaaugcugauauuacaggcgugagccacuacacccagcuuucuuuccuuucuuucuuucuuucuuucuuucuuucuuucuuucuuucuuucuuucuuucuuuuucuuucuuucuuucuuucacccagcuuucuuuccuuucuuucucuuucuuucuuucugucugucugucuuucuuuucuuuucuuuucuuuuuuagauggaguuuugcucuuguugcccaggcuggagugcaauggcgcgaucuuggcucacugcaaccucugccucccggguucaagcgacccuccugccucagccuccugaguagcugggaccacaggcaugcaccaccacacccagcuaauuuuguauuuuuaguagagacgggguuucuccauguuggucaggcuggucucgaacucccgacgucaggugaucugcccgccuuggccuccuaaagugcuggcauuacaggcgugagccaccgugcccagccccuccucuuuuuuuuuuaagacaagaucucgccaggugcgguggcucaugccuguaaucccagcacuuugggaggccgaggcagguggaucaccugaggucgggaguucgagaccagccugaccaauauggagaaacccugucucuacuaaaaauacaaaauuggccaggcauguuggcacaugucuguaaucccagcuacuagggaggccgaggcaggagaaucacuugaacccgggaggcggagguugcggugagcugagaucgugccauugcacuccagccugggcaacaagagcgaaauuccaucucaaaaaaaaaaaaaaaaaaaaaaaaaagacaagaucucacucuucacccaggcugugguacacuggugcaaugacaaaucacugcagccuugaacuuccaggcuccagcgauccuccugcaaaugcaggcccgugccaccacacccagccucucuggccucuuaaagacacacuaccccagaccucaggacuuggaccuccucucugucuacaugcucaagucaccccuugggaauucuugggaaguucauccagauugagaaguuaaaagaccauaaaucugcuaacaauucccaaguauaucucuccaguccagcacucuccccuccacccuagacucacauccaacaucuccaucauaucuccaccugggugucccacaccacaccucuccuuuaacagauccaaacuguacuccuggucuuucuuaguacuagccucagugugcuccuuuugagggaccagcaacuccauccucaggucaaaaauccccagauccauccuggacaacccucuuuccaucauacccaauauccaguccucaaagcuccuccuucaaaauauauucagaauccaaauauauauauaccuccaaaacccuuugguccugagcauccucaucucuuaccuggauaaucacaguagccaguuuguugaucucccugcuccuaaaccugccuucauauauucuacuguuuguuguuguuggccuuguuuuugaaacagaaucuugcucuguugcccaagcuggagugcaguggugugaucauggcucauugcagcuucagucuccugggcucaagcgauccucccgccuuggcuuccccgagugcugggauuacaggugugagccacccaaugcuuggccauacucuacuguuaaugcagcaguucagcacagucaauucacguuucucccugcucacagcccucacagaauaaaagccaaagucuuauaaagcccucuaaaaaguguccuccccuuaccucucuggccuucucucuuacucuccucuucacuaacucaauugcguagacacuggcuuccucacuguuucuaccacaagcuaggcauggucccaccuuggggcauuuuugcugucuguucccucuuccagauggccucauagcuuguucccuuaccuccuuuagccuuuucacccuuuccagcccaccccuuuuuuuuuuuuuuuuuaggcggaguuuugcucuuucgcccaggcuggagugaaguggcgcgaacucggcuuacugcaaccuuaagcaauucuccugccucagucuccugaguagcugggauuauaggcgccuaccaccacacccggcuaauuuuugaauuuuuaguagagacagaguuucgccauauuggccaggcuggccucgaacuccugaccucaggugaucagcccaccucagccucccaaagugcuaggauuaugcacccagccaagcccacccccauuuaaaaaugcagcuguaggccggccucgguggcucacgccuguaaucccagcacuuugggaggccgaggagggcggaucacgaggucagaagauggagaccauccuggcuaacacggugaaaccccgucucuacuaaaaauacaaaaaaaauuagccgggcaugguggcgggugccuguagucccaguuacuagggaggcugaggcaggagaauggcgugaacacgggaggcggagcuugcagugagccgagaucgugccacugcacuccagccugggagacagagcaagacuccgucucaaaauaaauaaauaaauaaaauaaaauaaaauaauaaaaaugcagcuguagcacauuguccuccuggcaacuguagcacuuacugcuuucuaauuuacuagguauuuuacuuaauuugcuuaaauaugucucucccggcugggcgcgguggcucacaccuguaaucccagcacuuugggaggccgaggcgggcagaucacgaggucaggagaucgagaccauccuggcuaacacggugaaaccucgucucuacuaaaaauacaaaaaauuagccgggcgugguugugggcgccuguagucccucccagcuacuagggaggcugaggcaggagaauggugugaacccgggaggcggagcuugcagugagccgagauugcgccacugcacuccagccugggcaacagagcgagacuccgucucaaaaaaaaaaaaaaaucucuccccacuggaauguaagcuccauaagugcagggacuguuguucaguuuuguucacggcugaagcccaagcagcuaagauaaugucugacauaggguggggcacgguggcucacgccuguaaucccagcacuuugggagacugaggcggauggaucaccugaggucgggaguucgauaccagccuggccaacauagugaaaccccgucucuacuaaaaauacaaaaauuagccgggcgugguggaggggaccuguaaucccagcuacucaggaggcugaggcaggagaaucgcuugaaccagggaggcggagguggcagugagccgagaucgugccauugcacuccagccugggcaacaagagagaaacuccguaucaaaauacauaaauaaauaaagucugaaauagaaggcacuaauaaauaguuguugcaugaauaaaucacgucagcuucauccauauccuaaaacauccuuuacucuucccaaccccucuaaguggcucacuccacccuuuucuccugccccaacaacaaaaacauuuacuagcacucacauaguuaagcacuaugugccacuuagcuaugugcuaaguguuuucacauacugacucguuaaauccucaauacauaauaaccccauacuagaauaagucccauuucagagaugagaaaacugaggcacagaaagaucacaagcuaguaaacgggggaugugaaauucgcacccagacagugaaccuccggaauuugcugugaacagucagcaaagccccgccccaagcccuuaaccccuccuggucgccggucacgcccccaucccccggucaguuucagccucucuuuggacccaaggcagauuccuaaccccgcccccgcaguucgaccccgccccacaccccgggcccgcccaccuuccugcaggcugaggcuccuggcggcgggugaguccucgcgcagcucccgaacgaagauucccucuuugccgccgcccgcuacguugaugccgcugaccccggucugcgccuccgucuccacgauaauuuccaccaacuccgcccgccucagcuccugcagagggcggcgaggugucgcguuggggcucuagggccggaccucgcccagagcccgccauugcgcucaacaguggcucauauacauauauauguuuauauauauuuagagacgggggugggggacggucucgccacacugcccaggcuggucucgaacuccuccugggcccaagggauccucccgccucggccucccaaagugcugggauuacaggcgugagccaccgcgcccggccaaaagcggcuguucagcgggccuucagggcacacgccccucggcgcugcccucgcaggacgucggggcacacccacuccggcgucuccccuuuaagcaagccugagggcagcuggcuuucuaggacccgcggaacgguuaaacagcuccgcgggccggcuggccucuccgaggcccuggagcggcagccgaaagggguuaggggaggagacgggguuguaaggggagggacugcgucggagugggcuggagauaacuugaguugugauugagaggcgggaccaggaucgugggggcguggucaggucgggagggcggggcugggggggguuggugcggguaggagggguaagacaacacaggccugagaggaagagccaaaugggguauagaagggugcaaaagauaggagaggaauguggccagaguuuaugggagguuauuuggagcuggggcggagacccuuauuauuuuuuuguugggggagacagggucucucacucuguccccaggcuugagugcaguggugugaucauggcucacugcagccuccaccuccuuaaacucaagcagaccuuccgcuccggucucccaaguaguugggaacauaggcacgcgccaccacgcccagcuaauuuuuaauuuuuuuuuuaagagacagggguaucacuguguugcccaggcuggucucaaacuccuggccucaagagauccuccugucucagccucccaaagcacugggauuacaggcaugagccacugcaucuggcccggagacccauauucuacaaacugaauuuaacuaugggggaggggcuuuaauuacagcagaacaagagaauaguugaggaugggauucugaggaaggggcuggcuggaccuucaagcccucugggauuggggggacagggagugggauuugccucccugcaggcuugaaugugugugagaaugugcucuauuguaaauucaaugacccgaagaccugugaaacgcccacaggagagggaauccagugaagggggucugcguggguaaugaaugggacugggagacauggcauucccgguauuuacuguaaaugaugcagauuggaccuggcccagaagccacuaugggauucacaauagggcuucccagaagaggcagugacaaaccuggauccugucuaggaauccaaucugcugugugucuuaggaagaaucuugcccucucuggacccacuucccugcugcaaaauaggguaacauaggcauacuggaaggagguugcaguagggaucugagaggacacugucauggccaacgcacuggggccagcacggacuggaauugagcccaggacuuggagggagagcaggucuaggccagaugccccacagcaguggccccaagggacuagggggcugagcagggcagucuggguaaggagaguuguggcugggacuguagggaacagcaugaccaccaguaccgcccuuuggcucagcaggcccugggcucagcauuuuaugugcagaaucucuuuuuuuuuuuuuuuuuuuuuuuuuuuuuugaggcggagucucgcucugucacccaggcugggagugcaguggcacaaucuuggcucacugcaaccuccaccucccgggucaagcgauucuccugccucagccucccgaguagcugggauuacaggugcacgccaccacgcccagcuaauuuuuguauucuuaguagagauagaguuucaccauguuggccaggauggucucgaucucuugacuucaugauccacccgccucagcuucccagagugcugagaugacaggcaugagccaccgcgcccggccucuuuuuuuuuuuuaagagucggagucaggccaggcgcgguagcucacaccuauaaucccagcacuuugggaggccaaggcgggaggaucaccugaggucaggaguucaagaccagccuggccaacauggcgaaacuccaucucuacuaaaaguccuaaaauuagccaggcgugguggugggcgccuguaaucccagcuacucgggagacugaggcaggagaauugcuugaaccugggaggcggagguugcagugagcugagaucgcaccacugcacuccagccugggugacaagaccaagaauccgucucaaaaaaaaaaaaaaaaagagucggagucuuguuuugcccaggcuggucuccagcuccugggcucaagggauccucuggccucagccucccagaguguugggauuacaggugugagccaucgaaugcagucugcaggaucucauuucauccucucccuauagccuugggcagucacagaggaggacacuaaggcccagagagguaaagugacuugccuaaugcccuguagcaaguuaagcggcugggccucaaccuuaggucugugaccccagaacucauaggccauccugugggcagagaacuccuggcgcuguacccacugccucucgcccccaguagcagcuuggccccuguaacaguagacccgcucugugccugguauacaguaagacauggucaaugccaauccaccaucucaguaacagugacagcagcugucauucaaagaggcuuccucagcaccagacucugugcaaauggcucaagcgggaguucucagagguggagaucauuaccuccauuucuuuuuuuuuuuuuuuuuuuugagacagagucucacugugacccucaggcuggcaugcaauggugugaucucggcucacugccaccuccgcuuccuggguucaagcaauucuucugccucagccucccgaguagcugggacuacaggugugcaccaucaugcccggcuaauuuuuguauuuuuagcagagaugggguuucaccguauuggccaggcuggucccgaacuccuaaccucaagugauccgcccgccuuggccucccgaagugcugggauuauaggugugagccacugcgcccagccccauuaccuccauuucagugggaaacugaggcugaaagaggugagaucaucugcccagggccacacagcugaagugguaggguugggauuugagccauggguccaagcccauguccuuaacuccuacauuauaugcccuuguguguguguguguguguguguguguguguguguguguguuuagacagggucuuuuuuuuuuuuucuuuguuuuucucauuuauucuuuccacacaggagacuuaaugagacaggaucuugcucuuucacccaggcuggcgugcagugguucaaucauaucucacugcaaccucaaccuccuggguucaggugauccucccaccucagccuccugaguagcugggacuacaggaaugcaccaccaaacccggcucauuuuuuuuuccgguagagacagggucuuccuauguugcccaggcuugucucaaacuccuaggcuuuagcgauccuccugccucggccucccaaagugcuggaauuccaggccugcgccacugcaccuggcauaugcugccucuucugaugaaggguuucugccggauuuucuucagcuccuuauuaauuuagcuccuuugugcgccagugauuucacugccuugagucuuagccugugccagaugcugcacuaaggacauuacauauguuaauuuucuucuccucacagugacccauaaaauagacccuguuauuauuuccauuucacagauggagagaaugaggcacagagaggccagaaagugucuccuugcugcccuagucugugccuccccauugcccucaagugcgccuugcaggacacgugggcacucaccucggcacuccggcuccuggccuccauggcguugcugggaggcaccugcaccccaggcuccuguguccucuccccuuucugcugcagaaccagcuucaguucugcauggagcagcugccucugagccugugggaggacagcaguggaggcuugaggccaguaggggacgagagguggaggccaugcuuacagggagaaagcaggguggguauuagaaggggagaagggcccccaccccagcuguccucucaccgcugccugggugcaggcacuuccuccuaacaggagcccagcccgaggugccgcacagcugucugcagggcucacgcccuuccgugggguucuugcugccugccagggaaaggccaggaugugaagcuccaggcaggcgaggaagggguggggaggggcauauggcaccagccugcgcucaccugagggucaccuccagcuccuugggccuccuggguccggcgcucuaagaagaauaaugugagcaguguuauuggcuaacagccaccgaugacuuccugagugccugacccugcugcguucugcugauacccuauccccgucgugcaggugggaaacugagccucagaagaccuuuacccaggaugacucagcuggacaacacacgguaaagccaaaacugacuccgaggccugucuggcagcagagcccccgugccaaagaucuuggccaacugagggggccaaauucacuaaaaaauaauugcuauuugagacagggucuagcucuauugcccaggcuggagugcaguggugcaaucacggcacacugcugccucggucucugggcucaggcgauccucccaccuuggccucccgaguagcugggaccacaggugcaugccacaacacccggcuacguuuuuguuguuguugguggugugugugugugugugugugugugugugugagagagagaguuuugcucugucaccuaggcuggagugcaauggcgcgaucuuggcucacugcagccuccaacuccuggguucaagugauucucccgccucagccucccgaguaguugggacuacaggcacgcaccuugggacuacagguacgcaccgccauacccggcuauuucuuguauuuuuaguagagacggaguuucaccaugcuggccaggcuggucuugaacuccugacugcaagugaucagcccaccuuggccucccaaagugcuggaauuacaggcaugagccuccacaccuggcaacaccagguuaauuuuuuaaauuaauuuguagagauggagucucccuagguugcccaaacugagcuccaacuccugggcucaugcuauccuccugccucagccucuugaugcuauaaaauaauuauagccacucccauguacucccagugagcaaaucacagcuccucucugugcuucaguuauguugucuauaaaauguggagaauaagagcuuuuaccucgcagggcuguuccgaggcucaaaugaguuaauaaguguaaagugccaggcaccuggcaggugcuuuauaaauacuugcuauuauuauuauuauuauuauuauuauuauuauuauuuugagacagagucucgcucuguuguccaagcuggagugaaguggugcgaauucggcuuacuacaaccucugccuccuggguucaagugauucuccugccucagccucccaaguagcugggauuacaggugcccaccaccacgccuggcuacuuuuuguauuuuuaguagagaugggguuucaccauguuggcaggcuggucuggaacuccugaccucaggugauccaccugccucagccucccaaagugcugggauuacaggcaugagccacugcaccugucaggccauuauuauuacuaagaacuuccuauggcccugaccuugugucgagcgccccacaugcuccacugcacauggcccucagcacagccuugugcaaucagcuacuacugagcccauuacagaggagacaccugaggcugggggaagggaugucacuagcccaggucacaaauggucgagccaggacuugaauuugucugaaggcuccagcccuuuaucuggguaguaauaauaccugauggguacugagugauuaguauuugcuggcccccgugcuaagaccuucaccuucuacuucaccucggaaaaccccauuuccugagaggccaaaagaacuugcucaaggccucauagcacagccagaaggaggcaaagcugaaauucacaugcagccacccgccaggcccaucuggggaaauggagaugaauacucucucccccaacccccgacucugggcuuguccucacagcccccaccuggcaugccaacccgccaaccccuauugcacagggaaaggucaggccucacgcggcacauucccucacacaauggcccgucugcugugcucaguugcauuccgccccugcccacccacccuggccacacaauggccuuucauagcccaucaguggccaggagagaggacauggggaccccuuaacacucccacagcacccacgccccccacaguguaagagggcuucucucugcaucuccuaggggguccuggucucuguggccuucccugggauccccugugagcccccuacaccuuccaggcugugccaggacuugaacuugucuaaaaacuccagcacgggcugggcgcguggcuuaggccuguaaucccaacacuuuaggaggccgagguggguggaucacgaggucagggguucgagaccagucuggccaauauggugaaaccccguuucuacuaaaaauacuaaaauuagccaggcguggcagcgcgcgccuguaaucccagcuacucgggaggcugaggcaggagaaucgcuucagccugggaagcggagguuguggugagcugagaaugcaccacugcacuccagccugugcgauagagcgagacuccaucucaaaaaaauaaaaauaaaaauaaaaaaagcuccagcgcuuuagcuggacaaucauaauaacaacugauggguauugagugguuaguauuaauauuagcuggucccugcacuaagaccuugucugccaugucuggggcauuuccucugaauugggcccugugcuagcacccacaggccucaaaaucacccuagauguuguggcuguuaugggguggaaacugaggcucacagaggggucacccagccagaaaggggcagagcuaggacccgugccugcccuucaccccugcuucaccuuaauuugcauugguggcucugcgcacuggggcaggagcuggguugggcaggagggggccaacggugcuagaaacacacccaggccaggugccgggccuggaccgggcaggcgcuuuacauacuugaccuugugggaccccauuuaacugaugagucaaugagaguuaagagaccggugaucacagugacagagucgagacuugagcccaggugugaaagcgaacucaguucccuuacccaggacugauacacagcacagaguccugagcuggggacacgagaagccugaaccuuguaggugguaguagagggggucuccugggucaucagcucucugucccaggcccguggcugugagggucaugcccggagccuggcacaggaaguucaggcggggcagggacaagagagagugcccuccuucuucgucccugccuggacaggcacccagcccagguuauauuuagcccaacugugcucuuccugagccacguacccagccccugggguaaggugggggcagcuucggaaggaaacccacagagaggacucuguguucccagcucugccuaucccacuaggcaggggaaagagggguggggaggcuccuggggagggucccugccuuguguuagaggcagauccacugggaccaggcagacacuccagaugccagcagccuauuucuuggguaguuacuguggcaugacccuggcauaugccagaacuuucagaauccccaggguccccauuucuugagcaccuacugugugcuaagauccuuccugucuuggcuccuuaaaucuuuguaacaucucccuggaguggguacaacugagauauccauuucagaugcgacuuaugcccuucagagcagcugggagcgagggguugucauucggaggcugcugagggaucggcugagggcauugcccuucuggcccucuuucccuggugacugccaccaacuucacuugggaacccugccugcucagagccucagcuuucccccgccaccagcgugaucucucauagcaaugggggucagggguugggcugacucauccagaccucuaaacauuaucugaggccaccuagggggucagggggaguuaaggcaguggccucuggcugccucgguuagucccugcuccagcacuucccaggugugaggacuugggcaagauccuucaucucuggggccucaguuucuccaucuguaaaauggagccaauaagaaaggcuuugaagauuugugagagaacagcaggugcuuagaauaucccuccuguauaguaaaugcuugauuaauauaaacucgucucugacagcaacagggagaguauggagggagggagcugugcuucucacaguguugcacauccaaccuuugcuccucaguggcccccacuuucucugcuaccaaaggggagcuuuggcugagagacaaaacccagcucaggcaccagccucccaacaggauccaugcugccucccuagcacccuacuccagggacccaccccaggccuccugccccagcucugguguuuguuaguuuguuuuuuggagacagggucucccucugucacugagacuggagugcagaggugugaucacggcucacugcagccccaaccuccugggcccaacccaaucucccaucucagccuccagaguagcuggaaccacaggcaugcaccaccaugcccagcuaauuaaaaaaaauuuuuuuuuguuuuguagagaugggggccucucuauguggcccaggcuggucucgaacuccugggcuuaagcaguccugccgccucagccucccaaagugcugggauuauaggcaugagccaccaugccuggcugcccuagcucuuuaaaagcagcaacucauuuacucggcaccagcccugugagguggccuccagacaucagcccauuuuagagauggggaaacagaggcacaaaggaugaaguaucuugcccaaggcugcacagccagaaaggagaggaaaggggauuugaaccaccagcuccaaagucuauaccuuuaacaccuacaccacacggcuuccugagcccccaggcccccucccagcaccucccgggacccugaaccucauucccacagugucucagccuggccagggaagggaccggccggcugaucucuuaccgcugagccuccagacaccucgagagc

SEQ ID NO: 191735 - RNA, 27949 nt, Homo sapiens
gggguugacgaccuagcuggguaaggucuucacguccuaggaagaaaucgguggcugcgggaggucuucguggacugggacucgaaccugaccgacccggcagugcgggugggcgagagcgaggcgcucagaggaggaacccggggcgcagacggaaucugccagauccuuaggcgugcgugugcgcgggcaucaaaggauggggauugcgcgaucuugagugacggaggggacugugugagugugugcgugaggcccugugcacaggaccgggacggcguguggacgcagugcguuuugcuggggcugugugagugucacugugccggugguacuaggcuccugcugcuuccuccgucuuuccccuucaaagcugcagaggcugcagcagaggaaugaaaauguccccaguagggagguuagauauugaaccgagaaugaagcuuugcacaagaaggcgcagaucuggacucggggugggaauaugagagcuggaagugccucuugagggucccccaggagggcagcuacauguugagaacccagcgucccucagagaucuguccccaggaaccagcuucgaacucagaccgauuccuccuccuuuuauuuccuucucauuucguacgaagugagggaaguuguggccauggagggugcuuucaaacuuagucugcgcuccaagaaaagccuggagucucacgcuugccguauccuucuccagucguauuauuauccaaaagaaggaccgagaggaggaugagagcguuauuguugcacacuuaagucaagggugaguuugugcuuuguauuuguucaagaaaugcguuuuugauuuuagaauauagagguuccuguaaauuuuuagugaauuucaggagaauaugcaaauugauucuugcccccucccauugugccgccucccagcgagccguuccccaccccgcccgcuccccaccuugccauuuaauauucacagagccauuuggcaaaucguucacaccuuccuguacgcucucuucuucuaagcugguauaaaaauaguccuccagagguuuauauuaaagcuuuauuuuagacucugcuuugaaaagaagauuaguuuguggaaucacacgccagguuucugacucuuuacaggccuccuuuuccaaguagggaagaauggagaugguugggugauuuccauucgucugugaggcuuucaggaaucggaaagugauugcacagaaauugguaucaaccagagucaggauuuuucgggagaguccaugagaugauaauuguaauacuugccagaucucugugagauucggcaguuccgguugcauuuugggcuauuugugugaacugugagaggcaguacgcuguugcgguuaagaauaggggaguggauccagaguaucuggguuggaauguuuguucuguccguuucuggucuucucaggcuuguaaugaacauuagaaugaauuaauacucuaaaaccucuuagagcagugcuaggcauauaauaauaaauguuuaauguuuuagcuuuuguuuucguguggucauuuuaggucauuucccuugacuuucuauaggacaggagcauugggaauaugugauucauugugauugcugcuugcauaguaagaaaaugagugaguugcucaaaugaucuaggacagaaguucuuuuuaaauugacagauaaaauuguauguauuuaucgugugcaacaugauguuuuauaguauauguacauuguggaaugacuaaaucuagcuaauuagcaaugcauuaccucacauaguuaucauuuuuguggugagaacacuuaauauccacucucuuagcacuacagaauaguuauuaauaguaguuauuaauaguagauacguuguuguguaauagauuucuugagcuuauuucucuuaucuuccugaaauuuuauauccuuugaccaacauuuccccagccaacaccaucuucccucccucacccacauuacccccgaccuguaaacaccauucucuucucuaauucuaugauaucaaguguuuucuuuuuuugagagagagugucuuacucuguugcccaggcuggagugcaguggcgugaucucgguucacugcaaccucugccucccggguucaaguaauucuccugccccagccuuccgaguagcugggacuacaggugcaugccaccacacccagcuuauuuuuguauuuuuaguagagacaggguuuugccauguuggccaggguggucucgaacucuggaccuuaggugauccgccugccucggccuucgccuccgcuuucgaaagugcugggauuacaagugugagccaccgcaccuggccuauaugaacauuuuucagauuccacugaugagugagaucaucugccuuucugugcuuggcuuacuuaauaugaauuucuccagguucauccauguuguugcgaaugacagcauuucccuuuuuuuauggcuaguuuuccauuguguauauauaccugcauauauaccacauuuucuuuauccauucauugauagacaguuagauugauuccauaucuuggcuauugugaauagugcugcaauaaacaugggugugcaggugucucuuugguauacagauuucauuuccuuuggauaaauauccaguaguagauugcuggaucauauggugguucuauuucuaauuuuuugaggaaccuccaugcuguuuuccauaaugucugugucacuuuacauucucaccaacagugugcaaugguucacauuucucuacauucucaccaacauuuguuaacuuaugucuuuucaauagccaccccaacacauaugaggugauaucuuauuguagguuuaauuuucauuucccugaugauuaguaauguugaguauuuuuucauauacuguagccauuuauaugucgucuuuugagauguguuuaucagguccuuugcccauuuuuuaauuggguuguuuucuugcuguugaguuccucacacguuuuggauauuaaccccuuauuagauacaugacugcaaauauuuucucucauucuguagguagucucuucacuuugcugugcagaagcuuuuuuagcuugauguaauuucauuugucuauguuugcuuuuauugccugugcuuuugaagucauuucuagaaaaaaaaauuauugcccagaucaaugucaugaagcuuuccccguacguuuuuuucuauuuguuucauaguuugggaucuuacauuuaaaucuuuaauccauuuagaguugauuuuuguauaaugguuugagaaaagggucuaauuucauucuucuguguaugacuccccaguuuucacaacaguauguauugaagagacugucuuuuccuuauuguauguucuuggcaccugucucaaaaaucaguugguuguaaacauauggauuuauucuggggcucucuauucuguuccguuugucuaggugucuguuuuuaugucaguaucaugcuguuuugguuacuauagcuuuguaguauauauugaagucagguaguuugaugccuccaacuuuguucuuuuugcuccagacugcuuuggcuauuugggucuuuugugguucuaugcacauuuuaggauuuuuuuuuuucuauuuuugucaagaauguaggacugaaauucuuaaucugaguucuuguaacuccacguauggucuuggggaccacaaagcucuugaaauaauguauugaaguacuauggaaauuuaucaauguggguuuuagagggagaaauaguauaucauuucauaagacuaucaaaacuguaugugacccaugagguuuggauccauugaucuagauagaacauugauucucagcgggggugauguuuaaaaacuuuugguugucacaccaugggggaggugcuacuuagaucuaguggauagaggucagggauacugcugaacauuguaccgugcacaggauaacccucccuauagccccaacaaaggauuauacagcacaauaugucauuagugccuagggugaaaaaccuuagucuagaaucaaaagauugugauaccuggaaugacacuguaaaugaucuuauauaaaucaaguguccuguaauauggaaaucacuaagcaaauuauacuagacucaagugauaaaguauuaugcagcuaauaaaaugaugucuauaaagaauuaugaaaagaaaaauauuugauauaccauuaagcaguauucaugcuaugaacaaugauacucaagaaaauguuacauguauaugaaucccauauacuaagauaggguuuuuguaaggcauucuguaggaauuguauccaaaaugauauuuuaaugaguuauuuggugaagaagggaaccaagcauggugauguacauuccacagauuuucucauguaguuuccagaugccacuuaucugcauuguguucauucagagaagagucuugauaaugaaaaugucuaauuauauuggugagauacagcuaaaggaugucagaacuagcugauguuauuuguuauagucacauuaaucuuuuugauccucaugacaggcacaguuuuuuguuuuuuaugauuaaaaguacucacucucuguuaacucuguuuuauuuuuauuuuugaauucggauguagaaauaugaccaucauuaaugcauacaagaaauuaguugaagacuuguagacaauuuuuuuuagaaauuguacuaacauacauagaaaaacauagacaucuuaguguuggucaagaauugggaaauaauggaaacaaauuuauuacauaaaaacaagagcucaguagaguuuccuuuuuuuguccccacguugaaaggaaaaugucuaaauaaaagaugucuuucaucuaauuuggagaacaauuuccucgcaagaaaaaaaauguguauguacauuuaaauauguacauauauagauacauacacauguguauauguguguauauaugugugugugugugugugugugaauauaauuauauauucuaaguuaaaugccugggcauagucacaauuaugacauacucuuuagcaaaaagaagaaaauuggggcuacaauacagagauaagcacuguuagcaugcauauaccugucuaaauuuuuguauugaugucuauuagucuuuugcuuaauauuucuauauacauauauuuuacaaauguaaucguauuguuuauccugcuuuguaaccugauuuuucuguuaaucauaugucuggaacaauuaaugauuacuuuguauucuauuacauggcuauucugaacuguacuuaccccagcuggcuuuuggugaacucagaaugcugaacacugcccaugcaauucugucuauauccuuuccaguucucaugccuugccccacugcacccaauccugaguucacaaagagguucuggauuggaugaugcaagcccuucucagcucugaaagguggacuaggggaggaggauugcuuacagcaggaucagaggcccaguccuaggccaagauugguaucccaagaguggaggacuggcuggaagccacaacuucaaggcagaaaugccugugcucggcauucaugcuuccgccgcagguucccugggauguaggcgagagcuugguuucauccacacuccaccuguucacugccaguuuauuugugagaguguguguagggaaaaagggagugacgggagaaggguggaagugugcgugugagcaggaguaguugagaaauaggaauggaggauaaaauauuuauucguucuagugcuuucggacacagcuugacuuagggccuuuuuguuguuguuguuuuccaggggagaagcccgaggaagauugaccaauuuuguaauucuagaaacaugguccauguaaguugguguuucugucuucuugaaauauggugacuuucagguuagguuaggugacuguuauuauuaaaccugaaccuucuuacguaaggauccacgauuuuuuuuuuuuuuuuuuuuuuuuuuugagacggagucuugcucugucacccaggcuggaaugcaguggugcgaucuuggcucauugcaacuuccgccucccagguucaagcaauucuccugccucagacucccgaguagcugggacuacaggcacccaccagcacgccuggcuaauuuuuuguauuuuugguagagaugggauuucaccauauuagccaggauggucucgaucuccugaccucaugaucccccugccuuggccucccacagugcugggauuacaggcgugagccacugugccuggccaggauccacaaucuuacaccccacuuugucccauuacagugaaguuuggugaccaaaaaauaaaagucagugcucuuccuauucguaccucuguuuucccacuggcuuugauguuuucuuugagcagguuauucagucugugcuuaacucaguccuuggucagaaagaauguuggaacaguggaggaguugguccccacagggaaacauggucuuguggguuugauaaguuacagaugauugucgcauuugaccacacucgggaacaccuugaaacuccuccacagacuggagcuuucuagguagcugagguagaauuccauagugaguggccucagucugcaagcgugacaagguguucugcuuuaugaggcuuuuaggaaagugaucagugaggacagugggcaguaacagagauuauucagggcaugagugguaggugauuacagauucucugaauuugggaaaaccuuagagacucugaccaucuuaaauguauaaauagaaaaauaugacuaaaucuaauaugucaguuauuuugaauuuuacgcagcuuauaaaaaucauuugucaugacaagaaaaaauacuuuugcuaucaucugauaccacaguaagcuugaggauuaacggcauuccucaauuguaugcugccaccuuuuuuuuuuuuuuuuuuuuuuuuuugagauagggucucacucuguagcccaggcuggagugcaguagugccaucacacuucgcugcagcauugaacucccaggcucaagcaauacucccaccucagcuucccaaguagcugggacuauaggcacaugccaccacgacaguucuuucuuucuuucuuuuuuuuuuuuuuccagggagugcaucucguuauguugcccaggcuguuugccaacuccugggcucaagcaguccuuccaccuuggucucccaaagugcugguauaacaggcaugagccaccacaccaggccagcagcaggauucuugaagaauguguaggcacucugcgauuuuccauauugcuccuuuauugcaguuuaauccuucacuuccucuccuuucgucuugaaacaacuuucuucaauuucaccauaauccauguguuugugguuucagggaucagugacauucagggauguggccauugacuucucucaggaggagugggagugccugcagccugaucagaggaccuuguacagggaugugauguuggagaacuacagccaccugauaucacuggguaaggucauuggucccaguuauuuuuguaucuguucucuggaauaucagcuuucuucaucaugaguuucagggcugucuuuuaagagguaguuggauuccuucuucuuauucccgaaggaauggauugagauuuguuggguugaaaacaggcaccuccuuggagccucugcaucuugccuacugcaccagggccuccuccauuaugcuggucaucucuguaauccccucucucucuucaugaccauggggcugaauuugaaaucuuguauauucguugaaugauauuguucaagaaccagguuucauauuauguuugaucucagaauuacuguagauuuucuuuguuuguuuuuguuuuucuggcccaccuguaaggagaagaguguguugaguuuuucuauuaaaagagccucuaugauugcuugaaccugggaggucaaggcugcagagagccguggucaugccacuguacuucagccugggcaacagagcaagacacugucucaaaaaaacaaaacaaaacagagccucaaugauuuacauauacugauuggguugacagaacuuauuuagcacuaagucaguauauuccauuuccuucgacagaccuuccguuacuuguuuuguaguugaaaguuucaggccaugaaguguaugcuuuucuguugggugaaaauucuuaaaaugagcuguaaaugucuaaggaugcaaaauaaauaaugacaauaaacauaauaauuuuuaacuuugugcuacuacguaugagugagaguuagaaguauuuuacauauauuaccuuauuuaauauuaguaucaauccuauaaaacaggcauuauuauauuucuguuuuagaguugggaaaacugaaggacagagaguucaagugacuuacuuaaugucaaaguacuaguggguggcagagacaggauuucaaccagguaaucuggcuugaaguuuccugcuguuaaccacuaaauuauaccuccucuugagggauaaguuucuauuaugaguuuaaaugaaagugcuuuuuuuuuuuuuaaacauaguugaucccuuacucaauccucucuuaucuggagucucuucucaauauuguuuuggcuuguaauuuauuauaaguuuaacuaggucucaggguuuaaaaaaaauuuuuauauuaaaaaaauucuacauguguuauuucuuuuaagcaggaaguuccauuucuaagccagaugugauuacauuacuagagcaagagaaagagcccuggauuguuguaaguaaagaaacaagcagaugguauccagguaagugagaguaaagcaggcagggggaagccaucauugucccggacagcccaugugcucagagaggagucacaccccugagaugugguuuggaaaacuuucuucaauaacccaaggucccccacuggacaaaaaugcccaagaccugggaaggaaauaagaucacuguaggagcuguccccaaggaacuucaucauuuacuaaucaccuaauuucuguuauuuucuuccucuuuuaaugaagugagcuuccucuuucuuucccaguguaaacuuuaaacaguuuuuaaaauuauuuuuuaagaggcagcaucuugcuauguugccccagcugaucuugaacucuuggccucaaguagucuuccugccucaaccuccuaaguagcugaaauuacaggcaugagccaaugcuucuggcccccaguguaaacuuuuaacacguauuuuggauccagcuacuuuccaacucugcuuuugcauuuagauuucuacauguguuuucacuaagaaauguauucauguucaguaaauauguauagagugcgcauuccuagaaggcauaugcuuggcucuggucaauacuguaauguacagguaaugaacaagacugagaaagucacugcugucauggacuuuaccagcaguuggugagacaugccucaaacaaguaagcaaaugaauagauaaggaauaccaaauaaucaugcuauagagacaaggaaauaggagugauggggugagaauggcagcacuugggugcuuaggguaccugucuggaagugggcuugcuugcauagagaugugaaguaaguguucaaguacucuagucagacugagcaggaaacacaaagguggaguaaguaauggaacagcgggaagaaaggucugagaguuacgucggagucguaucauacaggguuuugacugucguugugaggaaugugggaaguucuucaagaguuauuuauucauuuuuaauugauacccaauauuuguacauauuuaugggauacauguuauguuuuguuccaugcauagaagguguaaugaacaagugucaggguauuugagguauccaucagauccaccagaggaggguuuaucauuucuuucugauaggaacauuucaagucuucuagcuauuuugaaauauacaauacauuguuguuaauuagagucacucuacucugcuuaugaacauuagaagucauuccucauauuuaacuguauguuuguaacauuaaccaacuccucuucaucccccaccccucacccacacacccuucccagccucugguuucuaucauucuauucuuuaccucugugagaucuuuuuuuagccuccagauaugaaugagaacauaugauauuugucuuucuuuuuuuugaguuggagucucauucuugucgcccaggcuggagugcaguggugcgaucuuggcccacugcaaccuccaccuccuggguucaagcaauucuccugccucagccucuagaguaacugggauuacaggugccugccaccacgccuggcuaauuuuuguauuuuuaauagagacaggguuucaccacauuggccaggcuggucucaaauuccugaccucaggugauucacccaccucggcuucccaaagugcugggauuacaggugugagccacugcgcccagucugauauuugucuuucugaccuccgauucccuccauguugcugcaaaugacaugauuucauuuuuuaaaugccugaauaguauuccauguguauauaucacauuuucuuuaucuguuugucuguugggggacacuuagguugauuccauaccuuugguauuuugaauaaugcuacaguaaucauacaagugcagguaucauuuugauauacugauuuuaucuuccuuuggauuaauacccaguagugggauuguuggaucauaugguaguucuauuuucagguuuuugagaaaucugcaugcuguuuuccauagugauuguacuaauuuauaucccaccaacaguauauaagaguucccuuuuucccucauccucucagguauguuuaaacccaauguuucuuuguuaauuuucucucuagaugaucuaauucugagaguggcacagugacguccccagugauuauuauacuguaguaucucucucccuuuugcucuaauaauauuugccuuauauaucuggguguucugguguugguguuauauguuuagaauuguuauauucucuugcugaauugaucccuuuaucauuauaugaugaccuucuuugucucuuuuugcuguuuuuuacuuaaaaucuguuuuuuucugauauaaacguagcuauuucuacucacuuuugguuuccauuuguauggaauaucuuuuccuguucuuuuacuuucaauccauaugugucuuuaccagugagaagaguuucuuguaggcagcuuauaguuggaucauguuuuuucauccauucagcccgucuguaucuuuuaaaugaaguuuaauccauugacguucagugugauuacugauaugugagggcugauucuuaucauuuuauuaauugauuucuaguuguuuuguuuauccuuuguuccuuucucuuuuauuuuuuaucauugugguuugguuguuuucuuuagggguaacauuugaguccuuuguccuuauuuguauguuugcugugucaguagguuuuauacuuuuguguguuuucacaaugguagauauuguccuuucacuucuagguguaggacucuugaacauaucuuguaggguugguccaguggugaugaauucugucaccuuuugcugucugggaaagacuauuucuuuuucauuuuuguagaauacuuugcugaggauaguguccuugacuggugauuuuuuucuuucaacacugaauguauaaucacauucucucucauuucucucuguugagaaaucugcuguuaggcugaugagaguuuccuuguaagugacuagaugcuuuucucuugcuguuuuuaguauucucuuuugucuuugacuuuuauauuuugaccauaauaugccauggagaagaccuuuuuguauuguaucuauuuggguaucucugagcuuccuguaucaagaugucugcaucucuuacuagaguuggaaaguuuccugcuauuauuucauuaaauagauuuucuauccuuuauguuuucucuuugucucuaggaccucaaaaauucaaauauuuuguuguuuuaugaugucccauauguuacgguggcuuuauucauucauucagauguucugaggaaaacauuuauccuaaggcuuaaaagaugaguuagagggguggaaccaagauggccgaauaggaacagcuccgguguacagcucccagcaugagcgaugcagaagaugggugauuucugcauuuccaucugagguaccggguucaucucacuagggagugccagacagugcaugcaggacagugggugcagcgcacugugugcaagccaaagcagggcgaggcauugccucacucgggaagugcaaggggucagggaguucccuuuccuagucaaagaaaggggugacagauggcaccuggaaaaucgggucacucccacucuaauauugugcuuuuccaaugggcuuaaaaaacggcacaccaggagauuauaucccgcacauggcucggaggguccuaugcccacagagucucacugauugcuagcacaacugucuugagaucaaacugcaagguggcagcaaggcuggaggaggggcgccugccauugcccaggauuagguaaacaaagcagccggggagcucaaacuggguggagcccaccacagcucaaggaggacugccugccucuguaggcuccaccucugggggcagggcaaaaagacagcaguaaccucugcagacuuaaaugucccugucugacagcuuugaagagaggagugguucucccagcacgcagcuggagaucugagaacaggcagacugccuccucaaguguuucccugacccccgagcagccuaacugggaggcaacccccaguaggggcagacugacaccucacacggccggguacuccucugagacaaaacuuccagaggaacgaucaggcagcagcauuugcgggucaccaauauccacuguucuacagccaccacuguucugcagccacugcugcugauacccaggcaaacagggucuggaguggaccucuagcaaacuccaacagaccugcagcugaggguccugucuguuagaaggaaaacuaacaaacagaaaggacauccacaccaaaaacccaucuguacgucaccaucaucaaagaccaaaaguagauaaaaccacaaagauggggaaaaaacagagcagaaaaacuggaaacucuaaaaagcagagugccucuccuccuccaaaggaaugcagcuccucaccagcaauggaacaaagcuggacagagaaugacuuugacaaguugagagaagaagucuucagacaaucaaacuacuccgagcuacaggaggaaauucaaaccaauggcaaaaaaguuaaaaacuaugaaaaaaaauuagacgaauggauaacuagaauaaccaaugcagagaaguccuuaaaggagcugauggagcugaaagccaaggcucgagaacuacaugaagaaugcagaagccucaggagcugaugcgaucaacuggaagaaaggguaucagugauggaagacaaaaugaaugaaaugaagugagaagagaaguuuagagaaaaaagaauaaaaagaaaugaacaaagccuccaagaaauaugggacuaugugaaaagaccaaaucuacgucucauugguguaccugaaagugacggagagaauggaaccaaguuggaaaacacucugcaggauauuauccaggagaacuuccccaauccagcaaggcaggccaacauucagauucaggaaauacagagaaugccacaaagauacuccucgagaagagcaacuccaagacacauaauugucagauucaccaaaguugaaaugaaggaaaaaacguuaagggcagccagagaguaaggucggguuacccacaaagggaagcccaucaaacuaacagcggaucucuuggcagaaacucuacaagccagaagagagugggggccaauauucaacauucuugaaagaauuuucaacccagaauuucauuccagccaaacuaaguuucauaagugaaggagaaauaaaauccuuuauagacaagcaaauguugagggauuuugucaccaccaggccugcccuaaaagagcuccugaaggaagcacuaaacauggaaaggaacaaccggugccagccacugcaaaaacaugccaaaauguaaagaccaucaaggcuaggaagaaacugcaucaaguaaugagcaaaauaaccagcuaacaucauaauuacaggaccaaauucacacauaacaauauuaacuuuaaauguaaaugggcuaaauucuccaauuaaaagacacagacuggcaaauuggauaaagagucaagacccaucagugugcuguauucaggaaacccaccucacaugcagagacacacauaggcucaaaauaaagggauggaggaagaucuaccaagaaaauggaaaacaaaaaaaggcagggguugcaauccuagucucugauaaaacagacuuuaaaccaacaaagaucaaaagagacaaagaaggccauuacauaaugguaaagggaucaauucaacaagaagcgcuaacuauccuaaauauauaugcacccaauacaggagcacccagauucauaaagcaaguccugagugaccuacaaagagacuuagacugccacacaauaauaaugggagacuuuaacaccccacugucaacaucagacagaucaacgagacagaaaguuaacaaggauacccagaaauugaacucagcucugcaccaagcagaccuaauagauaucuacagaacucuccaccccaaaucaacagaauauacauucuuuucagcaccacaccacaccuauuccaaaauugaccacauaguuggaaguaaagcacuccucagcaaauguaaaagaacagaaauuauaacaaacugucucucagaccacagggcaaucaaaccagaacucaggauuaagaaacucacucaaaaccacucaacuacauggaaacugaacaaccugcuccugagugacuacuggguacauaacgaaaugaaggcagaaauaaagauguucuuugaaaccaacaagaacaaagacacaacauaccagaaucucugggacacauucaaagcaguauguagagggaaauuuaugguacuaaaugcucacaagagaaagcaggaaagauccaaaauugacacccuaacaucacaauuaacuagaaaagcaagagcaagcacauucaaaagcuagcagaaggcaagaaauaacuaaaaucagagcagaacugaaggaaauagagacacaaaaaacccuucaaaaaauuaaugaauccaggagcuggucuuuugaaaagaucaacaaaauugaaagaccauuagcaagacuaauaaagaagaaaagagagaagaaucaaauagaugcaauaaaaaaugauaaaggggauaucaccaccaaucccacagaaauacaaacuaccaucagagaauacuacaaacaccucuacacaaauaaacuagaaaaucuagaagaaauggauaaauuccucgacacauacacccucccaagacuaaaccaggaagaaguugaaucucugaauagaccaauaacaggcucugaaauuguggcaauaaucaauagcuuaccaaccaaaaaagauccaggaccagauggauucacagccgaauucuaccagagguaaaaggaggagcugguaccauuccuucugaaacuauuccaaucaauagaaaaagagggaauccucccuaacucauuuuuugaggccagcaucauccugauaccaaagcugggcagagacacaacgaaaaaagagaauuuuagacgaauauccuucaugaacauugaugcaaaaauccucaauaaaauacuggcaaaccgaauccagcagcacaucaaaaagcuuuuccaccaugaucaagugggcuucaucccugggaugcaaggcugguucaacauaugcaaaucaauaaauguaauccagcauauaaacagaaccaaagacaaaaaccacaugauuaucucaauagaugcagaaaaggccuuugacaaaauucaacaaaauucaugcuaaaaacucucaauaaaugagguauugaugggauguaucucaaaauaauaagagcuaucuaugacaaacccacagccaauaucauacugaaugggcaaaaacuggaagcauucccuuugaaaacuggcacaagacagggaugcccucucucaccacuccuguucaacauaguguuggaaguucuggccagggcaauuaggcaggagaaggaaauaaaggguauucaauuaggaaaagaggaagucaaauugucccuguuugcagaugacaugauuguauaucuagaaaaccccauugucucagcccaaaaucuccuuaagcugauaagcaacuucagcaaaguuucaggauacaaaaucaauguacaaaaaucacaagcauucuuauacaccaauaacagaccaacagagagccaaauuaugagugaacucccauucacaauugcuucagagaauaaaauaccugggaauccaacuuacaagggaugugaaggaccucuucaaggagaacuacaaaccacugcucaaggaaauaaaagaggauacaaacaaauggaagaacauuccaugcucauggguaggaagaaucaauaucaugaaaauggccauacugcccaagguaauuuauagauucaaugccauccccaucaagcuaccaaugacuuucuucacagaauuggaaaaaacuacuuuaaaguucauauggaaccaaaaaagagcccgcaucaccaagucaauccuaagccaaaagaacaaagccggaggcaucacacuaccugacuucaaacuauacuacaaggcuacaguaaccaaaacagcaugguacuguuaccaaaacagagauauagaucaauggaacagagcagagcccucagaaauaaugcugccuaucuacaacuaucugaucuuugacaaaccugacaaaaacaagcaauggggaaaggauucccuauuuaauaaauggugcugggaaaacuggcuagccauauguagaaagcugaaacuggaucccuuccuuacaccuuauacaaaaauuaauucaagauggauuaaagacuuacauguuagaccuaaaaccauaaaaacccuagaagaaaaccugggcaauaccauucaggacauaggcaugggcaaggacuuuaugucuaaaacaccaaaagcaauggcaacaaaagccaaaauugacaaaugggaucuaauuaaacuaaagagcuucugcacagcaaaagaaacuaccaucagagugaacaggcaaccuacaaaaugggagaaaauuuucacaaccuacucaucugacaaagggcuaauauccagaaucuacaaugaacucaaacaaauuuacaagaaaaaaacaaccccaucaaaaagugggcgaaggaugugaacagacgcuucucaaaagaagacauuuaugcagccaaaaaacacaugaaaaaaugcucaucaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaaggcaguguggcgauuccucagggaucuagaacuagaaauaccauuugacccagccaucccauuacuguguauauaccuaaaggauuauaaaucaugcugcuauaaagacacaugcacacguauguuuauugcggcacuauucacaauagcaaagucuuggaaccaacccaaauguccaacaaugauagacuggauuaagaaaauguggcacauauacaccauggaauacuaugcagccauaaaaaaugaugaguucauguccuuuguagggacauggaugaaacuggaaaccaucauucucagcaaacuaucacaaggacaaaaaaccaaacaccacauguucugacucauaggugggaauugaacaaugagaacauauggacacaggaaggggaacaucacacuccggggaauguuguggggugggaggagguggggagggauagcauuaggagauauaccuaaugcuaaaugacgaguuaaugggugcagcacaccaacauggcacauguauacauauguaacaaaccugcacauugugcacauguacccuaaaauuuaaaguauaauaauaauaaaauuaaaaaaauauauauauauaaacagaaaaaaaaaaaagaggaguuggauguuuguuacaaagagcaaagccagacgauucuuggaagaugaagcagucuaagcaagcaagaagauaagagaaagguuauaucauguucugguugcuaaaaggagggagugguuagagaucagccacaaaggaggacagugcccugauaggaaguuuuguucucuguguuaagguuuuuggauuuugugcuaagacuaaagauaaaccauucaaaaccaguuuuaaguaugaucuguaaacuuugaucugaaucagaaucaucugguagagauauuaaaaauacagcuuuggcugggugugauggcucccacuggugaucacagcauguugggagaucaaggcaggaggauugcuugaugccaggaguucaagaccagcuuggguaacauggugggacaccaucucuacaaaguaaaaauaaaaauaaaguaaaaauuagccagacuuuggacugcaggaagacuaaagaaaaagaaauuguccagacuuaguggcaugugccuguagcuguagccacuugggaggcuuaggcaggaggauugcuugagccugggaguuugaggcugcagugagcugugaucaugccauugcacuauagccuaugcaacagagagagacccugucucuuaaaaaaaaaaaaaaaaaauagaggccaggcacaauggcucacaccuguaaucccagcacuuugggaggccaggguggguggaucaccugauguuaggcauuccagaccagccuggccaacauugugaaaccucgucucuacuaaaaauaccaaaauuagccaggcacgguggcagauguuuguaaucccagcuacucuggaggcugaggcugaggccagagaaucacuugaacccaggagguagagggugcagugagcugagauugugccauugcacugcagccugggcgacaagagugaaacuucgucuuaaaaaaaaaaaaaaagcuuucuucacuaaaaauucugauucuguacaucugaguugcuugaauaucaauauauuuaaucuuaccaaaugguuuugauucacaccuaaauuugacaaaguuaaccuguucccuuaugcacaccaccaucuuacauaaauucauuauuggcacccuuuuccuuuuucagaucccuucccugaaaguauuauauuuuauacuuaggccauuuguuuaauggauuuuguaugcauguauguuauaggaaaauaaaauagguuugccuucuucauuucuuucagauuuggagucaaaauauggaccugagaaaauaucuccagaaaaugauauuuuugaaauaaauuuacccaaacauguuauaaagcaaauaaguaaaacacuuggccucgaggccuuuuauuuuagaaaugacucagaauauagaaguagauuugagggacgacagggacaucaagaaggauauaucaaccagaagaucaucagcuaugaagaaaugccugcuuauacucaugcuucuccuauucauaauacacauaaaccauaugaauguaaggaaugugggaaauacuuuaguugugguucaaaucuuauucagcaucagaguauucauacuggagagaaacccuauaaaugcaaagaaugugggaaagccuuucaacuucacauacaacuuacucgacaucagaaauuucauacuggugagaaaacuuuugaauguaaggaauguggaaaagccuuuaaucuucccacccagcuuaaucgccauaagaacauucacacaguuaagaaacuguuugaauguaaggaaugugggaagucuuuuaaucguagcucaaaccuuacucagcaucaaaguauucaugcugguguaaaaccauaucaauguaaggagugugggaaagccuuuaaucgugguucaaaucuuauucagcaucaaaaaauucauuccaaugagaaacccuuuguauguagggaaugugagauggccuuucgauaucauuaccaacucauugaacauugccgaauucauacuggcgagaaacccuuugaauguaaagaaugcagaaaggccuuuacucuucugacaaagcuuguucgacaucagaagauucauaugggugagaagcccuuugaaugcagggaaugcgggaaggccuuuagucuccucaaucagcuuaaucgccauaagaauauucacacaggugaaaaaccauuugaauguaaagaaugugggaaguccuuuaaucguaguucaaaccuuauucaacaccagaguauucaugcugauguaaaaccauaugaauguaaggagugugggaaaggcuuuaaucguggugcaaaucuuauucagcaucaaaaaauucauuccaaugagaaacccuuuguauguagggaaugugagauggccuuucgauaucauuaccaacuuauucaacauugccaaauucauacuggugggaaacccuuugaauguaaagaauguggaaaggccuuuagucuucugacacagcuugcucgacauaagaacauucauacuggugagaaaccauuugaauguaaagacugugggaaggccuucaaucguggcucgaaccuuguucaacaucagaguauucacacuggugagaagcccuaugaauguaaggagugugggaaggcuuuuagacuucaccuacaacuuucucaacaugagaaaacucauacaggugagaaacccuuugaauguaaggaaugugggaaauucuuucgucgugguucaaaucuuaaucaacaucgaaguauucauaccggaaagaaacccuuugaauguaaggaaugugggaaagccuuucgacuucauaugcaccuuauucgacaucagaaauuucauacuggugagaagcccuuugaauguaaggaauguggcaaggccuucagucuucacacccagcuuaaucaccauaagaacauucacacaggugagaagccauuuaaauguaaagaaugugggaaguccuuuaaucgugucucaaaccuuguucaacaucagaguauucaugcugguguaaaaccauaugaauguaaggagugugggaaaggcuuuagucguguuucaaaccuuauucagcaucagaaaacucauuccagugcgaaacccuuuguauguaaggaguguaggaagaccuuuagauaucauuaccagcuuacugaacauuaccgaauucauacuggugagaaacccuuugaauguaaagaaugcggaaaggccuuuggucuucugacacagcuugcucaacaucagaucauucauacuggugagaagccauuuaaauguaaggagugugggaaggccuuuaaucguggcucaaaccuuguucaaccucagaguauucauacuggugagaaacccuaugaauguaaggagugugggaaggcuuuuagacuucaccuacaacuuucucugcaucaaaaacuuguacaggugagaaacccuuugaauguaagaaaugugggacagccuucagacaucaguagcaacuuacugaacaucagaaaauucauacuugggugaaaaccuuugaauguaaggaaugugggaaggccuuucaauaucauuaccaauuucauggacauuauagauuucauauucgugagaacccuuaugaaugucaaggaugugggaaaugcuuuaccagugguagaaaccuuagaguacaucagagaauucauacuggugagaaaccauaucaaugugaagaaugugggaaagccuuuagucauaguucaaaccuguuaaacauguuaaaauucauacugaugagaaacccuaugaauguaaggaaugugaaaaggccuuuagcaguaauuaugaucuuacuguacaucugagaauccguacugcugagaaacccugugaguguaaagaauguggaaaacuuuuggauuuagcuuagucuuuacugcacaucaaagaauucauacugguaugaaccguaugaauguaaagaauguggaaagaccuuuacuuguagcucgagccuuguucaacauguuaaaauucauacuggugagcaacccugugaauguaaaggaugugggaagaccuuuagacuuaguucaguccuuucugcacaucacagaauucauacuggcaugaaacccuaugaauguaaagaaugugagcaaacccuuacugugaaugaucugcuuacgcaacaucagaaaauucauuauaguuagaaguuuuaugaauauaaggaguguagacaagccuucacuguguaugaaaaauuuacucaacaccagagaauucauauugaugagaaauccugugaacauaaaagaaugugugaagaacuuucaucguggccugggauuugcucaacaucagaguauucauacugcugagaacuccuuugaguguaaagaaugugggauauuuuauagccacacuaaaugccuuagaguucagagaagauaauuuuggugagaaaguuacugaugugaggaauguagaguagcugccauguucacaguuuacugcccgugaaauauuuuacuggauacaggcguaccuugcuuaauugugcauugcaguuacugcauuuuauacacacugaagguuugcagcaaccuugcagugaauaagucuaucagcaccauuuuccaaacagcauaugcacauuucaugucuuugugucacacuuugcuaguuuucauaauauuucaaacuuuuucauuguuaaaucuguuauggugaucugugaccaguguuuuuugauuacuaguguaauuguuacuaguguaauuguuuggggauaccacaaauccugcccauaaaagauggugaaccuaguugauaauuguuguggguuuugaaagaauaguaaaauauauacacauaucccccccaccuagauucaaaauuguuaacaauuugccacauuuauuuuuuguauauuuguuguaccauugagaauaaguuuuagaccauugagaauaaguuuuagauaucaugacacuuuacuccuuguuacaucagcauguguguuacccaaacauaaagacaauaucauauaaccauaguaccauaauuacccuuaaggaaaauauucauaauucuguaauaucauuccaucuucagauuucuuccuuggccugcaaaccaucuuuuacagcuauucauuuucucuuuuuuuuuuuuuuuuuuugagauggagucucgcucugucgcccagacuggagugcaguggugcgaucugggcucacugcaagcucugccuccuggguucacgccauucucccgccucagccuccugaguagcugggacuagaggcacccgccaccaugcccagcuaauuuuuuguauuuuuaguagagacaggguuucacucuguuagccaggauggucucgaucuccugaccucgugauccacccgccuuggccucccaaagugcugggauuacaggcaugagccagcaugccuggccuacagcuauucauuuucuaaggagaguccauugcagauucugcauugcauuugguuaucucucuuuaguguauuguagcauggaaaccccaugaaaguaugcucucaaauuaugguggguaucagaauccccuguggaacuuaguaaaccuacagaaguguagcccuaguuuauaagccugggccucuguuuuuuauuauuucuccagguuuugugucugugauaccaaccagaguuagagagccacuggucuagaacauuucucauuuuaaaaaaaugacauugaauuuugaguagcccagaaauguuguuggcuauguguuuagauuucuuucuuuauagugucauuuagccuuguucuugguuguauuuucuuuacaagggaaaguaaguccagaggcuuucuuaggucuagauuaaacguuuuggggaagaauacuuuguagguuauuucuaugucauauuguacugucagaaaacauuuaaguacagguccuugcauuagugaaacuaaggaugaucauuuggguaagcugguaaccgccguaaguccauuguaaagauuuaguuuguaguggguaaguaaucuauggagagacguugucaucucugaaaaguuauagucacguguacuuaagcccuggauugaauacaaaaugaaaauugaaauagacuauugagaaaugaaugccauuaaagcgucaacauaauucaacuugugugauauggcugacacuguacucaguacaaaacuggcacccuuuggauuguauagggagccaagauuguccggaaccucuuuuuuguucagcauuuaucaccagcaccuauaccauggcugguacaugagcuguugauaaaaauuugaaaaaauauuaacccuuuaaaucaagcuguaaaacaugauaccauuaagccgggagcaguggccucaugccuguaaucccagcacuuugggaggccaaggugggcagaucaccugaggucaggaguuugagaccaacuuggccaacauggcaaaacuccaucucuccuaaaaauaaaaaaauuagcuggacaugguggugcauuccuguaaucccagcuacuugggaggcugaggcaggagaaucacucgaaauuggaagguggagguggcagugagccaagaucgugccacugcacuccagccugggcgacaaagugagacuucaucucaaaaaaaccccaaaacaaaacaugauaccgauguggcaucaugaauuagauuaaauuuuuuuuaagauuaagaauaauccuuugugauuuuauuccauuguguugaaaaaucuauaaagugauaauuuauauugauagcuuucuucuuuuuaugaauauacccuggucagaugauuauucuuucaauagacuacuuaauucuaucuuuuaccauuuaauugcaucuauaaucauaaguaaaguuauaauuuuccaaguauuuuucagguauugauauugcaaugauguuauacaacuuauaaaacaagauuauauaaaacuuggcuuucaaaucuuauguuccuauuuuuuauuuccaguuucaucuuuuuucuauccauucucuugaacuuucuucuuugaaaucagcagagucccuggguauuaaccuagcacaacuccuuucugggucauugcacaucccgguaguaucauuaagaguugucagaaagaucccuggcagccuuucggugaaacucuaucaucaugcaaucauggcaguacuauguuggaagucagagucccuuugcaaacauaauaaaacacuuuaauauauuuguuaaaguuacaaaccaaguauguacaaauuuaaaaaucacggccaggcacgguggcucacgccuguaauccccaacuuaaaaugguuugacuuauaauuuucagcuuuauaauaguacaaaagugauaugcugcuauaguuuggauauuuauccccuccaaaucucauauugaaguuugaucccaauguuggagguggggccuaaugggaggugugugggucaugggagaagaucccucaugaauaaauuaauguccucucuggauuggggggugaauuaucacucuguuaguuccuaugagagcugguuguacaaaagagccuggcaccuccuuccucacccucuugcuuccucucuugccaugugaugucugcauacacugcccccuuucaucugccaugaguggaagcagccugaggcccuuaccagaagcagauguugcaccaugauucuuguaaauccuacagaacacugagccaaauaaaccucuuucuuuauuaauaacccaaccucagacauuccuuuauagcaacacaaaacuaagacauacucagucagaguaugcuccuugacuuaaaauggggcuauaucuagauaaacccauuguuaaauugaaaauauuguagaccauaaaugcacauaugguguaugauguuuucaauuuaugauggguuuauuuggacauaacuccccguaaguugagaagcaccuguaguaauuauuauuauuuaugcucaaauugacauaauguggccaguaggaauccauuuacauuuuuuuuuuacuacuuauuuuuuucuuuugauguuuuaaaggaauauuguuuucaggccguaagaggauguuuaagacugacccuguuuguugguucaugucccccaugccucuuguccugagucauggaaucaacucaugauuuaauacccucuuaucuuagggaguccugguuccuuuuagaggaaaaaagaauuagagaccaaaaaaucuggcugcugugagugcacauggcaguuacagguauggaaaaaaagaugcugcuuuuguuagaauucuuuuaauaguuucagaguugaaaaugucauccuaaggucagaaguucccucugaauuuucucaacuuacauuucuaugaucugcucuuguuugcauuugguauuuuauugaauuauguuuuauguauggugauagcugagaaguuuaucuccuuuuaaggccuggcugaaaugauacauuaaucugccucccauuuuuggagauauugcucugauuuaaauuugucaugguguuucugagcagcguuguaaagaaacuuguuuuagaauauucagucauggauguuaucuugaauguucauagacuccccagaaaagaagaaaaaguagacacaagauuucugucauccuuuuacaggguauugugaucauccagcuugggguaugagggauaacggaccugugugucuuaauuuccagaauaccauuccauuucaaugagucuucugcacaaguuguggucucagggauucacugucuucauuuguaauugaucaaaaugaaaccaucuccaggauuccucagugggucaggaucuguuauuuauuaggcccgcauauccauucuacccugcuuucaugauuauagaaccaguaauuuuuauugauaguuggcugugacuaucuagaauaaggacugcaguuauuucuccaagguguugucaugugacauaacuuauggcaaguaggauguaagugaauauuuuggcaauucuggaaaccucuuaaaacaaacuagcuuaauauauuaauauuugagaaaucugggugaaggguaaccagaauuauuuacuauucuuccaaguucuguauaagucugagugcucauuccauucugaugccagaaugguaaaauucaugauugguuuagagcaaggccacaguaucaggcuuacauccauauuauaugacagagaaauuaacuuuuauuauauuuuauccacuuuaauuuggggcaguuuuacuauuuuacucacaaccaaauuuaaucuuaaacgcuacaacuagauugucacauguaaaaaguaauaaccaucauuauaucuuuuauguucuguaauuccaaagcacggaucuguagagaacagagugucuaucccaugcauguugucauguacuuaucccacacccuauugaaaucacaguacccauaagggagacauuuuuuuucuucaagaauauguauuucugccacaucuaugauucuccagaaugagaugacagaaaaugcuaaacuauuguuaaaugacuauauguaguuccacuucuggaugguagaugggggggcucugcaaacucauuuucuaauaaaacuggcaaaaaaaaaugua

SEQ ID NO: 191736 - RNA, 7728 nt, Homo sapiens
guuggaugaaaccuuccuccuacugcacagcccgccccccuacagccccgguccccacgccuagaagacagcggaacuaagaaaagaagaggccuguggacagaacaaucauggucaggggccagggguucuaugggaagagcuggggcugggguuggggcuggggcuuggaggacaccugggcgaaggucaggcuaugggauggaggucacgggccgggaagggggcccaacuguggugaacagcccggcuggaagaacagagagacaguggcucuggguuuaggcucaggaaguggaucucugcaccuccuugagugucccccaagaguccccguggagaaggcgggaacccagccucugcuccgccccccaagcugagugcccuggugagggguaucuacucugugggaagggugccuuuucucaauguucacaaaggcaucagaugggccggcgcgaugcuccucuucauuaguggauggagaaacagguuuggggaaggggugagggcugaggccaggccauuucagcucuuccugggucccuccggcagucugacucccugguggugugcgagguagacccagagcuaacagaaaagcugaggaaauuccgcuuccgaaaagagacagacaaugcagccaucauaagugagugacaucuucccccacagaaggaugggagggcgguggugagggcagauagggagggcugggcuugugucccccauggaucagggggagugucuaaucccugugugccaccccuccccagugaagguggacaaagaccggcagaugguggugcuggaggaagaauuucaggugaugggcuggggugauugggacugggagguacagggugagacugggagaaccaagugguuggaacugauaugaagagccuggcauggggguagaaagaccuggagauuggccgagcacaguggcucaugccuguaaucccagcacuuugggaggccgaggcagguggaucaccugagguugggaguucaagaccagccuggcaaacauggugaaaccccaucuguacuaaaaauauaaaaaguuagcuaggcaugguggugggcaccuguaaucacagcuacuugggaggccgaggcaggagaaucgcuggaacccgggagauggaggcuguagugagccgagauugugccacuacacuucagucugaaccacagagcaagacucugucucaaaaacaaaaacaaaaaacaaaaaaacaaaaaacccuggagaucaaguucuagcucacucaugacccccagcaagagacuuugccuguuugugucucuauuuccucaucugugaaauggggagaauaguacuuaucucauaggcuuguuuuuacauccagugauuuaauucuuguaauggguuuagaacaaggccuggcacuuaguaugugcucaauaaggugaugaugaucuuaauaaugaugauaauaaugcuuuauuggcauuuaaaugaaagaguuuccauauaaguuaaaaagcuagccaggcaugguggcucaugccuguaaucccagcgcuuugggaggcugaggcaggaggaucacuugagcccaggaguuuaagaccagccugggcaacaugguaacacccuaacucuacuaaaaauacaaaaauuagccaagcacaguggugugcaccugugaucucagcuacacaggaggcugaggugggaggguugcuugaggcugggaguuuugagaccaaccugggcaacaaagcaagaccccaucucggcugggugccguggcucacgccuguaaucucagcacuuugggaggcugaggcgggcggaucacaaggucaggagaucgagaccauccuggcuaacauggugaaaccccgucucuacuaaaaauucaaaaaauuagcugggugugguggcgggugccuguagucccagcuacucgggaggcugaggcaggagaauggcgugaaccccggaggcggagcuugcagugagccaagaucgugccacugcacuccagccugggcgacagacucugucucaaaaaaaaaaaaaaaaaaaaaaagacuccaucucuacaaaaaaaaaaaaggggguagaccucaccccccugguggccucacugucuuuaucaauaacaagaaugauaauaaggcuuauuucucuaguguugcgauaaggauuuauaagggaauccauggagacugggggcuggggcucucucaggcccucugaaaggcaguauagugaagcaguuaugauucgaacccagauucaaaucucaacucugcugcuuucuaucugugcaaucuugggcaaaugccuuaacaccucugggccucaguuuucucagcuguauagugggcauaaugaugggaccuaccccacagacuuacgggauaguugcaugaauuaauccauguguguuucauagaacgaugccuuggcacaugguaagugcucaccuaaagguggucauucuuuuuuuuuuuuuuuuuuuugagacggaguuucgaucuuuuuugcucaggcuggagugcuauggcacaaucuugauucacugcaaccuccgccucccggguucaagcaauucuccugccucagccuccugaacacgccuggcuaauuuuuuuguuggaaauggagucucacucugucucccaggcuggagugcaguggcgcgaucucggcucacugcaaccucugcaucccggauucaagcaauucuccugccucagccucucgaguagcugggacuacaggugcaugccaccaugccuggcuaauuuucuguauuuuuaguagagacggguuucacccuguuagccaggauggucugaaugauuuccugaccuugugauccgccugccucggccucccaaagugcugggauuacaggugugagccacugcgcccugccucauucuuugucuuuucuucuguuuucuugccucagaacauuuccccagaggagcucaaaauggaguugccggagagacagcccagguauccugggggaagaaaggguuggaucaggccaugaggggaggggugauguuggagguauaggcuaagggacugcuggaguuccagcccuauucauggacuuugaaucucuguguuuggccgagugagguggcucaucccuguaaucccagcacuuugggaggucaaggaggguggaucacuugaggucaggaguucaagacuagccugaccaacauggugaaaucccgucucuacuaaaaauacaaaaauuaacugggcgugguggcaugugacuguaaucccagcuacuugggaggcugaggcacgagaaucgcuugaaccuggcaggcagaggcugcagugagcugagaucacaccacugcacuccagccugggugacacagcgagacucuaucucaaaaaaaaaaaaaaaaaaaagaaucucuguguuugaggccaagaguucauacucuagaacuuuuuguuuguauagcaauauuuuauugcagaauuuuauaccgauuauuuaugauaccgguuuaagagucuuuuuuuuuuuuuuguacaaacuuuguugaguuuuuguuucaacauuacgcuggcaucauuuuuuaaaaaugaaauuuuggccagguacuaugacucccaccuguaaucucagcccuuugggagccugaggcgggaggaucaccugaggccaggaguucgagacuagccugggcaacauagcaagaccuugucucuauuuuuuuuuuuuuuuuguuagagacagagucucgcucuguugcccagguuggagugcaguggcgcgaucuugacucacugcaaccuccgccuccuggguucaagcgauucucuggccucagccuccugaguagcugggauuacaggggcccaccaccaugucuggauaauuuuuguauuuuuaguagagacauguuggccaggcuggucucgaacuccuaaccucaggugaucccugcuucggccucccaaagugcugggauuacaggcgugagccaccgcgccugguggaggaccuugucucuauuaaaaaaaaaaaaaauuagccaggcaugguggcaugugccugugguuccagcuacuugggaggcugaugucgggggucaguugaguucaggaagcugaggcugcaagugagccaagauagcaccccuguacuccagccugggugacagagcaagacccugucucaaaaaaacaaaaaaagaaauuuuccuucuuuuucaauguuugggaacacuuuagguagcaaacaaauuaauuauuauuauuguuauuuuauuaaaaaaauuuuuagagacagggucucacugugucacccaggcuauugggcagugcugugauccuggcucacuguagccucuaacuccugggcucaagccauccuccugccucagccucccaaguaacugggacuacaggcacugccacugcacccugcuaaaggaaugacucgacuuuuaacuaucagguagaauccugggcgaagucacaugagccuggugcuuuuuuugguggaagagcucuuugacuauuucugugaaaacuggucugcuaagauuuuucaucuugacugaauucauuuugggucucuaggauuagaggcuguaggacucaacaaggaccagcuucaugggcauaugauaauugcacagggccccgcacccaggagggggccucacacauggggguuaacggucaccuucuuuauaguuuuaucuuugaauuucuguuuuguaugaagucagaugggacaauggacuucacacaaaugugcugggguuuggagcuagguucacaggcaguccaccaccuggcugccucccugaacagguucucagccacccacucucugcacccacccagugaccgcugcuguccuuggguuuccugcugguguagggagggucaggguccagaaggcaccccuugccugacaaguuacaggguguuccugugagcaucugcacucugccugcgcauauccucaugcccgagggagcacgacuuuaaauagcaaacuaaaaaagacaggcugagcgcaguggcucacaccuguaaucucagcacuuugggagucugaggugggaguacugcuuguggccaggaguucaagaccagccugggcaacauaacaagacccccauuucuacuaaaauuuuuuaaaaaaaggccaggcgcaguggcucaugccuguaaucccagcacuuugggaggcugagguggacagaucacuugagcucaggaguucgagaccagccugggcaacauggugaaacucugucucugcaaaaaacacaaaaaacauuagcuggaugugguggcacgccccuguaaucucagcuacuuggggggcugaggcaggaggaucaccugaaccugggaggucgaggcugcaaugagcugagaccacgucccuguacuccaaccugggugacaaagugagacccugucucaaaaaaaaaaaaaaaaaaauuagcugggcaugguggugugcaccuauacucccagcuacucuggaggcugagauaggaggauugcuugagcccaggaguucaagacugcagugagcuaggaucgcaccauugcacuccagccugggcaacagagugaggcccugucucuaauaacaguaaaaaaaaaagacgaugaucagucuagagagagacuacaaaagaaaggaaaacaauuuuccugcuucuugaacaagaugccccacauuuucauuuuauaccgggcuuggaugauucuguagccaucacuggucacagugcaccugggguucaagugcacuggacagaauugcauagggggugagaacuuacacgcuggcauucacuuucccagguucaaaucucuccccuaucuguagaaccuuaggcaagugacuuugggccucaguuuucucaucuguacgauggggauauuaauagcaccuauauuauaaaguaauugugagucaaaugagcacuaucauuauuauuauuauuugagauggaguuccacuuuugucacccacgcuggagugcaauggcgugaucuuggcucacugcaaccucugccuccugaguucaagcgauucuccugccucagccuccugacuagcugggauuacaggcgcccaccacuacuccaggcuaauuuuuguauuuuuaguagagacgagguuucaccauguuggccaggcuggucucgaacuccugaucucaggugauccacccgccucggccucccaaagugcugggauuauaggugugaguccugcgcccggcccuaugauuauuuuuuaaucauuuguuguguuugaggucaguacccugagucccagacaucaacccuggguucucagacucagccaacauuucaaggcuguggacucagguaauggcuguuaagccugggcugcaggccagaguccugauuuucaauucccuuucacgguagguucgugguuuacagcuacaaguacgugcaugacgauggccgaguguccuacccuuuguguuucaucuucuccagcccugugggugagacacagcucuacuguccucaggagagggucuucgauucuguguguguguguuuguguguaaaugcgaaugugugcaggcacuuguguaagagugugagcaugugacagccugugugugacugggugaggaugugugugugucgcacgcaugaugugggagggcagugaaguggaggugggggcucagauucaccaagagcccacccguucucaguccuggggccuaagccaacccaccuuuuccuuucaccuagaaauccccgucuggccccuaaaucaucuccagagacccucagaauaacuugaagcccccaagccaaccuagaaacugaguacagugcagggaccuccuuagaagagcuccuaggacccuuggcaagcugcagggccuucaggacauuacuagagcuuuagagaacacgccuggguccccacugaugugccuuucuccucuuuuccacgcaggcugcaagccggaacaacagaugauguaugcagggaguaaaaacaggcuggugcagacagcagagcucacaaagguucagacugggauggggcuccagaguguuagggagaggugguguggguccugggucugagggaagagggacuagaguccucacugucucagugguuuuuguuuuuguuuuuguuuuuuuaaagaacugggucucgcucugucauccaggcuggagugcaguggcacaaccucggcucacugcaaccuccuccuccuggguucaagcaauucuccugccucagccucccaaguagugggacgacaggcacacgccaccacaccuggcuacuuuuuguauuuuuaguagagucaggguuucaccauauuggccaggcuggucucgaacuccugaccuuaagugauccacccaccucagccucccaaagugcucucuuacaggugagccaccgugcccagccacugucucaguguuugaguagaucauaaugccgagaccucucucugcccagguguucgaaauccgcaccacugaugaccucacugaggccuggcuccaagaaaaguugucuuucuuucguugaucucugggcuggggacugaauuccugaugucugaguccucaaggugacuggggacuuggaaccccuaggaccugaacaaccaagacuuuaaauaaauuuuaaaaugcaaaaacucgga

SEQ ID NO: 191737 - RNA, 2066 nt, Homo sapiens
uuacaucacaagcgccagggucuguuuauuaaaaccccuucccagcagagggcaguacagugucuugucccagcagaaaagguccuucaggccaccccucuaaacacaggagccaaggguguugacagaggggcacccuuugcacccccaggacuccuauggcuuaauagugguccugauggaagaggcggagccaggacuugaauccaugaguggcugccucuagaggcgcaaaggccagcaucggaggacccuguggcagccaggagcggaagguucauguucugcaggggcgcccagcccacugugcccccagccgucacuucuucugcacguggccacagucguacuugccacgcacaacggugagcuugacgccuggcagguccugggugcggccgcccuccacaaggacaaucuggugcuccugcaggguguggcccuccccagggaugaagcagacggccucgcggccagugcugagccgcacucgacagcacuugcgauuggcugaguugggcuucuucggcuugcggguaaacgugcacaggaccacacccuucagcugcggccggccuuccguggggcccagcuuccgaggcggccgcuuggggggccccaggcggugcaucugguucaggguagccauggagcagguagcccagagccggggaaccagagcugggccuggagagggccgaaagggguuauuaucccagagaacagaucuuagaguaguagcaacucaauuuugguguuuuaggcauuguuuaaagcacuuuacaaagaugcauuuguucacaucuaauguuaucuacagacaaaaguaacucuuuauucuucaaggaagcauuaccuuuuuuuuuuuuuucuuuuuuuuuuuugagacaaagucucacucugucgcccaggcuggagugcaguaccucaaucuuggcccacugcaaccucugccuccuggguucaagcaauucuccugucucagccuccugagcagcugggacuacaggcacccaccaccacgcucggcuaaucuucguauuuuuaaguagagacgggguuucaccauguuggucaggcuggucucgaacuccugaccucggccucucaaagugcugggauuacaggcgugagccaccacggcuggccaggaagcauuauuuuuaaugcuguuuaaaauaauaguaggcucaguggcucaugcauguaauccuagcacuuuuggaggcuguggagggucacuugagcucaggaguuaaggccagacugggcgacacagggagaccucccucucuacaaagaaucaaaaaguuagcugguugugguucugcaggccuguggucccagcuacuugggaggcugaggcgggaggaucacuugagcccaggaggucgagacugcagugagcugugaucacaccgcugcacuucagccugggcgacagagggagaucuuaaauaaauaaauaauaaaacugacccaaacgccgcuugacacgcaguagcccuccaugcagcugcuucccaccucuugcucuagcagcccuagcucugccaaaaccccaccguguuuuuccacccccguuucccucggggcuccgacggaggcacacaaguccaagagcgaauaacccucccccucuagccucgucccugaagcccaagucccccacuuaccacaaguuagggacguguugaggccauggagaaggccagaccaggacauccugccaccugggccgucccugugguaggggauaagagacucagaaaggaggaaaaagugaccgauccgcaaaugcuccccgauccgcucucaggacuuucuggcuuaaaucaaaggaaauaccucuauaggucuaaccacaggcccucaugcugcuaacagaaagucccuccguaaauuuagccucgcucugaguggguucccgagggcccaaccacucucgcccgcacgcaggaagaacugggaaacuggggagauggccugguagauuuggaggaccccaggauuccaccgaccucacaggaccuaaaggugaggucgcggacacgcugaauccagcu

SEQ ID NO: 191738 - RNA, 15633 nt, Homo sapiens
ugaagaggcgggacacagacgacgauugggcgacgaaggacucuaucgcggucaacuuuccucaggaucugauuggcucgucacggucagguucgcugccuugcaauuggucuaaacgcggagugggcgggacgaagugccgccuuguucccgguccaagauggcugcguccauggcgcggcgcuuguggccuuugcugacucgucggggguuccggccccggggaggcugcaucuccaacgauaguccaaggagaaguuucacuacagagaaacgaaaccggaaccuccuguacgaguaugcgcgcgagggcuacagcgcacucccucagcuggacauagagcgguucugcgcaugcccagaagaggccgcacacgcccuggagcuccgcaagggggagcugcgcucggcggaccugcccgcgaucgugagugcgccugcgccggccggggggcgcagacguuugcuuuacggaagaauuggguuugcaagaugcccuccggcagggggcgaaccuguaguaggaauuuuaguuauuucccaaguuagccaacgucuugugcauggcacccacuuaugugccaguuguccagugagugcugaggcccuacuaugugccaagaaugccuacuguguccuggacacccauuaugcgcuuguuucauacugcucgcuggguaccuccuguccuuuaggaacuugcuaugugacauugcccuccgugcugcaaccucaugccagccuuucccuaagaccacaaaggaaaauggggagccaagugugaaucggacggggucagggcuggggugugguggagcucuugcguuuagagagagagguagggagaguugugcaccuccgccacacauagcaggcaguuaaauagaguuaaugaaugaaugaaugaauccauuaaugaaugguucuauuaaacugauacuuaaggugcaacugcuauauuccgguguucuagauguugcaaauaugcggugaauaauaauaaaauugcuagcacuuauaaaagggaauuaggaccggguucacaauaucucuguguugaggugcuaacgauagugggguccccacgucuucccauuccucucuuggacuccccucccagccuguuugaagugcuuuauucacuuuaaccucguuuaauuuucacagcaacucuaugaaguaggugccauuauuucucccauuuuaucagaggggaaacuaaggcuucgagaagcuaauucacuugcgcuaggucaugcaacugggaaguggcagagugggaauuuuaaccugugcuuucuggccuagaauccacuuuuuuuuuuuuuuuuuuugagauaggguguuguucugucgcccaggauggcaggauggaguacagugguacaauuauagcucacuggaaccuugaauuccugagcucaaauaauccucccacucagccucccguguagcugggacuacaggcagacaccaccacgcccggcuaaacuuuuguauuuuuuguugagacagggacauacuauguugcccaggcuggucuugaacuccugcgcccaagugauccucccacccuggccucccaaaaugcugagauuacaggcaugagccaccacacccagacuccacaaucuuaaguacccugcugugcccucucaugaucugaguucacagucuaguaaaagacauuuuuuuuuugagauggaguuuugcucuugucucccaggcuggagugcgcugcgacuucugccucccagguugaagugauucucccaccucagccucccgaguagcugggauuacaggcacaugccaccacaucugcauaauuuuuguauuuuuaguagagacgggguuucaccauguuggccaggcuggucucgaacucuugaccucaagugauccacccaccuuggccucccaaagugcuaggaguacagaugugagccaccaugccccacuaaaagacauuuaacauauacaacuauacauauauacuaauuacaauuucugguaaauuugacuaccuagaguaaucaaauucauagagacagauauacucauuauaaucugugguaaaugcugugaaggcaaaguggaggacagccugggaggacuucucagaggagguggcauuaaacaaagaucuguggauugagaaaucaccagggaagagggaagaagaguaucccaaguaggggaccagaauauacaaaagccuggagguaggauggaaaauuccauuugauggccauguagauaauuuagagcgucacauccuuuagcaggcuuuuucaaacuuuguggccaagaguaagaaauacauuucacauccugacccaguacacacacccaaaauugaaaccgguuucauuaacaauuauugcucuuaccacgugugaugcauucuuguucuuuaauuauauucucuuucauuuguaaagugcuaguuguuguuuuuuuuuuuugcgggggggggggccagggguguguuuuuguuguuuguucguuuguuuuuuaagacugagucuuccucugucgcccaggccugagugcagucgcacaaucuccggucacugcaaccuccgccuccuugauucaagugaucgucgugccucagucucccaaguagcuaggguuauaguugugcaccaccacacccaacuaauuuuuguauuuuuaguagagauggauuuugccauguuggccaggcuggucucgaacuccuaacuucaaaugauccacuggccacggccucccaaagugcugggauuacaggcaugagccacugcgccuggcuauucucuucauuuucaaaguaguaguuuagacgugcauuugagcagcuguuuguuuguuuguuugagauggagucuugcugugucgcccaggcuagagugcaguggugcagucuuggcucacugcaaucucuaccucccggguucaagcaauucuccugccuuggccuccugaguagcugggauuacaggcgcacgccuccacccccaauuaauuuuuguauuuuuaguagagacaggguuucaccaucuuggccaggcuggucucgaacuccuaacuuugugauccaccugccucggccucccaaagugcugggauuacaggugugagccaccacacccagccucaaguagcuauuauuaaaaacaaaacagaaaaggacaaguguuggcaagaauuguguuguggaaacgucggaaucguugugcauugcuguugggaauguguauaaagugguacggcugccauggaaaaccguauggcaguuccucaaaaaaauaauaaauuuuuuuuuuuuuuggagacaaggucucacucugucacccacgcuggagugcaguggcaugaucuuggcucauggcagccucucaggcuccgugagacuuccaggcucaagcacaagcaauccuccaaccucagccucccaaguagcugggauuacaagcaugugccaccaugcccagcuaauuuuuguagagacaggguuucuccauguugcccaggcuggucucgaacuccugggcucaaaugauccaccugccucagccucccauauuauguacauuguaacaauuuuuuuuguuuuugagacaaggugucaaucugucacccagcuaauuuuuuuaaaguuuuuuuguagagaccgggugcuguggcucacaccugcaaucccagcacuuugggaggccaaggcaggcagauugcgugaggccgggaauuccagaccagccuggccaacauggugaaacccugccucuauuaaaaaauacaaaacuuagccaggugcaguggcacguaccuguggucccagcuacucaggaagcuaaggcaggagaaucaccugaaccugggaggcagagguuguaaugagccaagaucaugccacuacacuccagccugggugacagagugagacucugucucagaaaaaaaaaaaaaaaaaaaauuucuuagaggcaggucuuccuguguugcccaggcuggucuggaacuccugggcucacucaagcaguccucccaccuaggccucccaaagugccacacccagccaugauuuuuuaaagugcuaguuuagagacuuuuuuuguuugagacagaguuucacucuuguugcccaggcuggagugugcaguggcacgaucucagcucagugcaaccuccgcuuccugguuucaagcgauucucgugccucagccuccuggguagcugggauuacaggugccugccaucacaccugggugauuuuuguauuuuuaguagagaugggguuucaccauguugaccaggcuggucuugaacuccugaucucaagugauccacccaccuuggccucccaaagugcugggauuauaguuaugagccacuaugcucggccagugugucugaauucugggcaucuguguggccagcugaaccucagggcauuccaguacugaagggaggaggggaggauggccacugagggcuagguagggaucucugccucacugcgccgcagguccagguggccagugggcuccagagagaaggguaggggugauggcugcuucaucuccuuuucucuuauauccaccccagaucucgacauggcaggagcugaggcagcugcaggagcagauccggagccuggaggaagagaaggcagcugugacugaggcagugcgggcccugcuggugagcauggugcccugaguagguggggaguggccacgagggugucucuagacacagguaacaggaaaccgaauuuaaagaacuugaacaggcuggcacgguggcucacgccuauaaucccagcuacucgggaggccuagguugguggaucagcugaggucaggaguuugagaccagccugggcaacauggugaaaccccaucucuacuaaaaauacaaaaguuaggcggcauggcgguggacaccuguaaucccagguacuugggaggcugaggcaggagaaucgcuugaaccuaggaggcggaaguugcagugagcugagauggcgccacugcacuccagccugggcgacagagcgagacucccuaaauaaauaaauaagcaagcgugaacaauguggacaugcauuaccucacauagcgagcuguugcaggacccuggcaucccuagggcugauuaauuagcgguucuuccagcauccccagcccagguccuuuccuucucucuguaccggcaacuucacugcacugaucuuuccucaguuucccaucaggguuuccagauggcugcuguaguccagcaucuccucacaugacugugccaggggaaggagacagagacuucucuggcuugaguuccuuuuucaggagcaaguacaccuuuccugaagcauccagcaaaguccccucguguccccugggcccagacccccaccacacuccaguugucagccggaggaauggaguuccggcagccggcauaggcugaucagaggccauccuccaccugggcccacuuccccugaacuacaggcuaccagggaagggugaacugcgucagaguucuguggggaaggaggaagaagggaucuuuauuuuguuuuuauuuuuuugagaccgagucucacucuguuacccaggcuggagugcaguggcaugaucugggcucacugcacccucugcccccuggguucaagugauucuucugccucagccuccccaguagcugggauuacagacaugcgccaccacgcccggcuaauuuuguauuuuuaguagagauaggguuucaccauguuggccaggcuggucucaaacucaucaccucaggugauccacccgccuuggccucccaaagugcugggcuuacaggugugagccacugcgccuggccuggaaggagggaucuuggguuauacaaccaacagugucugccacagacggcuuaaaaacaaucauaaaaacaacagcagaccuuuauguagaagucgcuacacaccauaccagguguuuuccauacucuuaauccucacagccauuugucacacaggaacaauacaaacccaauuuuacagcugggaaaaagugaggcccuaagagauuaaaacgggccuaaauggccggguauggggguacgcacuuguagucccagcuacucuggggcugaggcaggaagaucgcuugaguccaagaguuugaggcugcaguuagcuaugaucgcaccaucacacugcagccugggcgacagagugagacccugucuccgagaaaaaacaaccagaaaaaguacguaagucucacagccaggaagugggagaggcaagguucgcaccuaggcaguugguuuuuaccacucuguuuggaggccucugccaccaagaaucacaucucccagcaccuacugaguggccagccucgggcugucuacaucauggacaaccaaugaaagcaacacaauggaucauuuaauguucuuugagugcuaacucaucucagggaagcugcacaacagcccugcccagggagguccuguuaucaucccacuucacagauggggauacugaggcucagagggggcagagauuuucccaagggcucacagcauguaggugcccaacauucagacccaggcuguucgauucccucagcugcuuaggaucauggaagguucagaaugucaaggggccuugguugcaggcccucaaaugcacacugauagacuuuaccucucugagcuuccauuuucgaaucuacagacaggguauauuaguccauuuucuucuuuuuuuuuuuugagacagagucucacugugucacccagaccagaguacaguggcacgaucucggcucacugcaaccuccaccucccagguucaagggauucucgugccucagccuccugagucgcugggauuacaggcacgugccacugcacccagcuaauuuuuuuuugagacugagucucgcucuuccaccuaggccagacugcaguggcacuaucucggcucacuguaagcuuugccucccggguucacgccauucuccugccucagccucccgaguagcugggacuacaggcgcccgccaccgcgcccagcuaauuuuuuuucuguauuuuuaguagagaccauguuagccaggauggucucgaucuccugaccucgugauccgcccgccucagccuuccaaagugcugggauuacaggcguaagccaccaagcccggccugauuuuuguauuuuuaguacaagguuuuagagaugagguuucuccauguuggccaggcugcucuccaacugcuggccucaggugaucugcccaccucagccucccaaagugcugagauuacauuugugaaccaccacgccuggccccauuuucacacugcuauaaagaaaaccugaggccgggcgcgguggcucacgccuguaaucccagcacuuugggaggccgaggugggcggaucacgaggucaggagaucgagaccaucccggcuaaaacggugaaaccccgucucuacuaaaaauacaaaaaaauuagccgggcguaguggcgggcgccuguagucccagcuacuagggaggcugaggcaggagaauggcgugaacccgggaggcggagcuugcagugagccgagauccccccacugcacuccagccugggcgacagagcgagacuccgucucaaaaaaaaaaaaaaaaaaaagaaaaccugagaucaggcugggcgcgguggcucacgccuguaaucccagcacuuugggagaccaaggcagguggaucacaaagucaggagaucgagaccauccuggcuaacauggugaaaccuugucucuacgaaaaauacaaaaaaaauuagccgaucgugguggcgggcaccuguagucccagcuacucaggaggcugaggcaggagaauggcgugaacccaggagguggagcuugcagugagccaagaucgcgccauugcacuccagccugggcgacagagcaagacuccgucucaaaaaaaaaaaaaagaauaccugagacuggguaauuuauaaagaaaagagguuuaauugacucacaguuccauauggcugggaggccucaggaaacuuaaaaucauggcggaaggggaagcaaggcacuuucccuuccacaugguggcuggagacagccacaggggguaacugccaaaugcuuuuaaaccaucagaucucgugagaacucacuaucaggauaacagcaugggggaaaccgcccccaggacccgaucaccucccaccaggucccuuccucaacagguggaauuacaauuugagauauuauuuggguggagacacagccaaaccauaucacaggguuuacacgaaugccuaccuccuaaaguggauuuugaagaaaucauggcaugggagagcccuguacauagagccuggcauggaggcaucacuuccuauacggaucugcggcugugauuacuguuaauuaucuugccuccuuguagcguuagcaauagagaaacagaaacacagaguugcagagggacccagcuaggcacugacagagcaggagacuaagauccucuggccuuguuugaccuuucaccauuuuuucucuuccccacccucgacuuugucaaccuaaucacccacccugucucuuuucuaccaggcaaaccaggacaguggugaagugcagcagguacugugaagaguugauguccuauccaggguugggggugggcagggaggauacccugccagucacgauucuacuauuguaacagaaaacaacucaaacagguuuaaggggaaaaaaaaaauaggcucuauugaugcaugaaacuaaaacuggcuucaggugcggcuggauccaggugcuggcuccauauuugguccuacguuccucccauucccaggccagcuuucucuccuuguguaaguaggaggcaaagucaagcacgcuuuccugauaguuccaguuaaaguccuggggcugauucucaugaguucagcugacaucaggugccugucucugagccagucauuguggccaaggcaauagaacguucuaguuggccaggccugauucuuuuccccacaaaccugccauguggugguaagggaaguucugcgaagacguucaggauccugggccuggagaagaggcaugaauguccaccacaggggcucugccggucaggaucaaggucacacuggaugagggaguccugacccucucccgggcugagcccaccugugcugcccccaggaccccaaguaccagggucugcgggcacguggccgggagauccggaaggagcuuguucaccuguaccccagggaggcccagcuugaggagcaguucuaccugcaggcgcugaagcugcccaaccagacccacccagacguggugagcaccgugcuggguggcagggaggccaggggcccaccuagugccaccuuuccgugacuccugcugucucccugcagcccgucggggaugagagccaggcucgagugcuccacauggucggagacaagccaggugggccacaccccaggccugggagcugacaagcccugcgguguggggguucuggggucucggggugggggccccuggggucugggaacaugucuggagccuggagaacuccuggcgguacaggagguggcuccagcuuccugccuuggccgagcucgagcugucucugagaggcgguccuuggguuuucauucucucccccuucaccauugggcagucucacccuguguugugugauuguaucguaugugugugagugugugucguguauguauguguugugugacugugugucaugugugucuguaucugugugucuguaucuguaugugugugucuguaucuguguaucugugugugucuguaucuguguaucugugugugucuguaucugugugugugugucuguguuugugugugucuguaucugugucugugucugugugugugugucuaugugugugucuaucucuguguguguauaucuguguuugugugugugugugucugugugugucuauguaucuguguguauguaucugugugucuuucucugugucuguguguaugugucugucucugugugucuguguguguaucugcauaucuccguguaucucuguguguaugucuguaucugugucuguguaucugugucuuuguguguaucugugugugcgugucugucuuugugugucuguauccguguaucugugugucugucucugcgugucuguguaugugucugucucugugugucuguauaugugugugugucuucguaccucuguguguaucucuguguguguauguaugugugugagugugugugugucucugucucucucucugaccccccugcuuuggucccugucuccggggcuuuuucuccccaacucugugccuccucucugauucuccuccucccuuccucgugguguuuccuucuccucuggccucucuccucuguuucuaacucugccuuccccaccccgcgcccucuuauuucccucucugccuccucucauuuccucucccugucucuguuuuuaucucccucccuuccugucugucuuuucuucccuuucccucccuuuccgugucuucuucucccuucucuccuccugccccuccuuuauuuucucucaccgucccuccucucugcugucucuggaagcuucuaucugggccccaucccucucuccccgcugccuuacaccggugcuuuucacccacauccaguuuucuccuuccaaccucggggccaccuggaaauuggcgagaaacucgacaucauccgucagaagugagccccuccccuggcuccccacgccccucucccagcugccugcaccccgacagcuggcuccugccucauuggccucagcgugagauguggaaaugccaugaaucuuugaugccccagccccacccagcagccgggccucuucccccggguguuuucauccccacauucccugccagccuggcccaugugcacccgccugucugucugucucccaggcgccugucccacgugucuggccaccgguccuauuaccugcgcggggcuggagcccuccugcagcacggccuggucaacuucacauucaacaagcuucuccgccggguaugggccaagauaggagggcugccuggaggggguggcaucgaagcugagcucagagggcccaacggggaugggagugaucucugcucugcccuagucacugcucucagagcuucauguguaucauugacacauuuaguccuuacgacaacuuuaugaagugggugcugucaucauccccacuuuacagagagggcuugaggcccagagaggggagguaccuauagcccaaggucucacagccagucuggagcugggccuagagccugugcuuguaaucauugcaccucacugccugcuugcgguauaaagggagcauuugggaaucauagcauccauugaaacauggcagggacugguugcauggagcauuggucacggugaggaacucagacauuuucagaggguacuagggagccaugggaggcuuuuaagcaggggaggguguggccaaaucuguacuuuuuuguuuuuugagacggagucucgcucugucacccaggcuggaguacaguggugcaaucuuggcucacugcaaccuccaccucccggguuuaaguaauucuccugccucagccuccugaguagcugggauuacaggcacaugccaccaugcuggcuaauuuuuuuuuuuuucuuuuugacagaguucgcucugucacccagacuggagugcaguagcacgaucuccaugccggcuaauuuuugccuuuuuaguggagaggggguuuugccauguuggccaggcuggucucaaacuccuggccucaagugauccgcccaccucagccucccaaagugcugggauuacaugggugagccacugcgccagccccugccucaguuucgucugaggaggaaggggcucugcagcaccccuucuucagggcugagcuuggggucugguaggggucccagcucugcucacucauccucuccccugaacagggcuucacccccaugacggugccagaccuucuccgcggagcaguguuugugagugaggccucuccgcuucccucgcccaccugggugucaggcccugccgugggugcccgaggcagggaaaccugaggagaccgcccuggggcuggguugagggggccaggccauaccagggaggccagggcagcuccagauguuuucaggggaggagcugggguugggacuguaaaacgagaggccaggguuaccuguccccugaucccuguggccuggccuccucccccaggaaggcugugggaugacaccaaaugccaacccaucccaaauuuacaacaucgacccugcccgcuucaaagaucucaaccuggcuggaacagcggagguggggcuugcaggugaggaccugugugggugguggggaggagcaggagugauguggaaggacaacugggagcguccagggagcacugggggggaucaccugccccgagcagcucagcagccccagggccaacauguacggcuguguagguuguuuacuguacagcaguacagugauaauccagccccgggccuugaccugggguugcauccaccagagggagugccucuuaaucuuccaaaggcuuccucugggcacuggcagcccuggcucacccuguggucucuccucccaggcuacuucauggaccacaccguggccuucagggaccugccagucaggugacaccugguuuccuuagaccuugaccccaccugugacaaucagucuucccuccuugacccgacuuucccugcucucugccaggaugguuugcuccagcaccugcuaccgggcagagacaaacacgggacaggaaccccgggggcuguaucgaguacaccacuucaccaaggcuggugucgcugggacuaaacggggcugggguggggggccaccccaagagcucagagccuccugacuccugugcccucugucccagguggagauguuuggggugacaggcccugggcuggagcagagcucacagcugcuggaggaguuccugucccuucagauggagaucuugacagagcugggcuugcacuuccgguguggagaggggccagggauccagggauggcaggggugggguaggggagggacaaggggcuggccagcugcucuucgcucuggaaccaccucuccagcccccucguugcccccauuuuccuguacaaggauuacaggagcauauacaggaucccaaucugucugccgugugccggucgucccucacaggacuguaacagaagcacgaacagugcacggugugccagaguggagacccgggccccuuuccuccugcugcucccccucucucugggccacugccucaucugugcaacccaagauacuuuuucaccucccaguggagagugggggugggaaaagggggagccagagguugggaaccccacuuccucucacccugucagucacacgcagcuuucaagagaggcugagaaauguggacuucuuuucugggugacccauuguaaaaaacugggagcguaagccgggugugguggcucacgccuguaauuccagcacuuugggaggccauggcaggaggauugcuugaggccaggaguucaagaccagccugggcaacacagcgagagcucgucuuuacguuuuuuaaaauuagccggguaugguggcacacaccuguggucccagcuacuugggagacugaggcaggagaauugcuugaacccaggagguggaggcuacaaugagcugugaucaugccacugcacucuagccuggggcaacagagugagacccugucucuaaaaaaaaaaaauaaaggccaggcacgguggcucacaccuacaaucccagcacuuugggaggccgggacaggcggaucaccugaggucaggaguucaagaccagccuggccaacauggugaaaccccaucuauacuaaaaauauaaaaaucagccgggcaugguggcacacaccuguaaucccaucuacucaggaggcugagacaggagaaucacuugaacccugaagguggagguugcagugagccgagaucgcgccacugcucuccagccugggcaacagagccagacuccgucucaaaaaaaaaaaaaaaaccgagggugccuagaaggugcaaaugugugaauggccacugugaagagccgguggacccugccacgugccuuuuuccccucccaucaaccucuuuugugcuucccccuccauguaccaccuucuccauaaccaccccuggccucacaacucucuccuuuggcacuaucgucuccuuuuuuuuguuuguuuuuuuggaguagaugaggucuccuuauguugcccaggcuggucucaaacuccugggcuuuuuccugcuuuuuggcugccuucucuuccaucguuuccauuuguuccucuugcuccuccucucacccgcugaccuuccccacaccuucguccuugaccgcaggguccuggauaugcccacccaagaacugggccuccccgccuaccgcaaguuugacauugaggccuggaugccaggccgaggccgcuuuggagaggugagcccugugccgcuggggacggggugggcaggaggacaggccugccccccaucccugauccgcucagccugccgcuccuccaccccaggucaccagugcuuccaacugcacagacuuccagagccgccgccuccacaucauguuccagaccgaggcuggggagcugcaguuugcccacacggugaggcccgcacagccuccugcccgcgugcccucgcccgcagccucugccgcccuagacccacccaccuuggcuccuccccgggcucagcuuggggugggcgccaguuccgagcauggcugucucacaggugaacgccaccgccugugcugucccccgccuucucaucgcgcuccuggagaguaaccagcagaaggugaggggcugaggggcccacccagagaggcagcucagcgccggggagggcuggggcaucugcaguguccugaggucugcucuguccccaggacggcucagugcucgugcccccugcccuccaguccuaccucggcacugaucggaucacagccccuacccacgugccucuccaguacaucggccccaaccagccccggaagccugggcugccuggccagccugcuguaagcuaagaacccacccacagcagcccucgggggugucacugcuuccuggaguucaggagaccccggacaccugggaccuguguugcugagcccguccugacaucuguguucuuccugucagcuccacgcccgggccccuggaccacgggguccaccucuccucuguccuugcugccucagagucagucacugacccuguuaucauugagggucccagugggaagcaggacgucugggcuuuacgguucuagggacaggagaagcagaggaagaggcuuccaucccuccuuccuucuuuccuccuacagugcugagcaaaaaguccccaauaaauggucaggacaaagg

SEQ ID NO: 191739 - RNA, 21308 nt, Homo sapiens
agaguauucgggaggacuacaacucucuagccguucccacauuuuccgggcgcccuuuaccaacauggcugcugacgccacgccuucugggacucguaguccgguccucgcgcgcuuucuuaccuaacuggggcgcucuggguguuguacgaaagcgcgucugcggccgcaaugucugcugagaguuguaguucugugcccuaucacggccacucccauuucuggugccgucacgggacagagcagucggugacaggacagagcagucggugacgggacacagugguuggugacgggacagagcggucggugacagccucaagggcuucagcaccgcgcccauggcagagccagaccgugagucggggauccggguaggagggucgggccgcgccggggccuggcugaaugcugcaggccccggggcccaaggguggccgcgguggggcgggaaguagggagcgcuucggggagugggauucugagggcuguugcuuagcgaucuguaucgcuaggcugguggguuucugggucgcaguguguucaggguucguuuaccacauccacuugccaaguugccaaugaucgcguguuucucgcaccuugguugcuaaggucccucgcugcaaagaacauaaguugccccggucccgcuugcuauggguaccugauuguuagaggcaaccagaggaugcugagggaccccugcugaccccuccuauggcuuccccuuguuccgcgccucuccuaaaccuaccgccuccacugcaccacugcaccucccuccuaaaccugccucccagccaaagcgucucuucccuucucuuuuccuuucuaaacuucccucugccuuguaaaucuaacccuccccgcacacacacucacacacugucguguccuuccuaacuccuccugaguguuccuucaugcccugaauccccuagguaggaggaggaggaucgcuugagcccaggaauuugaggcugcagugagcuaugaucgcacuauugcacuccaaccugggugacaugagcgagacccuuucucuaaaaaguaaaaaagaaagaaaguaagucagggccagaaacaauggcucaugcuuguaaucccaguacuuugggaggccaaggugguuggaucgcuugagcccaggaguucaagaccagccugggcaaaagccccuacuuucucccugucccccuaaaucuuccucuccagccucucugccccucacuaaucaccucucccggcaucacuuugcauguagauaagaucuuuucuccguccccucccucccucugcuccauuuuuaccaccaucccaucccaguguaacuagguugguggguguucuugcccccucacugaccauuugaaccccuuuauuccccccuuaaucguucuccccacuguaaccaccucugcuccccucccccagccucucacccucuggagacccaggcagggaaggugcaggaggcucaggugagaugggggaaaggguggaggggaggagagagacggacuuguuccacaucccacacuggggggagguggcaaaggggaaacagucaccccagggcccucggcucauugccccaaucccucacaccacccagugcagcuuucuggggaaaggcagauucuggggauugucagagaagaguuuccagccucaaguccaggccuguccucccaaacuuuccuucuuccuugccacugccugccaucccuucugaaccacauuuguccugggacuggaagagacagguaucccauuuggucuuggaacgcacagaucucguggacaagugaugggaaaaaaugaucucacagcgugaugacgaaaguaacucagggggccagaugcaguggcuuaugccuguaauuccaauaacucaggagacugaggcgcgaggaucgcuugagcccaggaguuugaggcugcagugagcuaugauugcaucacugcacuccagccggggugaaagagcaagacccuuucucuaaaaaguaaaaaagaaagaaaguaacucagggccagacacaguggcucaugcuuguaaucccaguacuuugggaggcugagguaggaggaucgcuugagcccaggaguuccagaccagucuuggcaacauagggaggcccccaccucuacaaaauauuuaaaaauuagccauguguaguggugcaugccugcauugccagcuacucaggaggcugaguugggggaggauugcuuaagcccaggagguuaaggccguagugugccuugacugugccacugcaccccaaccggggcgacagagcaaaacacggucucaaaaaaaaaaaaaggaagaaaaguaaagaaacucaggguacugugggagcacagagaaaauuuucugggucaaagaagauucuagccaggccauucccuggaggaauccacaggcuggucuagcugucagaccaagauacagacacagcauaagugaagagugacuuagaauuuucuuagacaaggugagaaauggugauccacacaacagguaucgcuugugcaaagaccuggggggcaugaaggggugugauguguuccauaauuggguggcuggugguggucagcuuguuauagucgugguuagcauuuacugacggcuuacuaaagcugggcccacuguuuagugccaaacgugccucaucucaauuucaucuuccuggcaucccugugaagagaaacgccuaucacggccauuuuacagaugcagaaucugaggcagaguuguuaagucacuuaucccccgucccucggcuacaggagcagggaaggguuugagucccccagcacugggcacgccaccugucagaggcugccaggagagguggacaggcagucucauaggagcuugaaggcccccgucagcaccuccggcucucccuuaggccaagcugcagacacaugcugggcacaggccuuccacacagccucacuguguacagccugaaagagugccagcccacccacaccccugagauugccuuucagacgugggguggugcagaagcgggcaucagaauaccucacaaaugcacaguggagcuuugcuaaggauauaagagccuccuguuaggcuguggcaacucacucgccuggcucccaaagcacgaccacugucagagaaaaagguugaauguuaaaaaggauccucagucccaaagagagagaggcgaggauguaaaaugcagcauuguccgucacagggcaaaacuggaaacaguccaaauggcugucaguggauggguuaaaugaacuaugguucauccauacaauccaauacuauguagcugcucugaaaaacgaggugaggccgggcacgguggcucacaccuguaaucccagcacuuugggaggcagggggaucacuugagcccaggaguuuugagaccagccugggcaacauagcaagaugccgucucuuuuuuaaaaaauuauuuuuuaaauuaggugggucuguagcauauuguucugccgaaaacucaagauguuguauuguacuaugaccuauuucuguaaaaaauauuaguuuuaugcagagaaaacuggaguaauuuccauuaagcuuagcuaacagugguuaucuuuauaagggugggcuugggcaauuacaaggugagugccgcaaguuauauguuguugaaguauacaugaguauaaucaagguuuuugcagagguuguccaaucucucuuucucucugucucucucucucucucauucucacucucucuuucucucucucuuuuuuuuugagacggagucucgcucugucacccaggcuggagugcaguggggugaucucgcugacugcaaccuccaccucccagguucaagcgauucuccugccucagccuccugaauagcugggacuacagacacgugccaccaugccuggcuaauuuuuuguauuuuuauuagacacgggguuucaucauguuggccaggauggucucgaucuccugaccucgugauccacccaccucagccucccaaaguguugggauuacaggcgugagccaccgugcucagccuuucucucucuuuuuaaauagagacagagucucacuguguugcccaggcuggucuugaacuccuggcaucaagcaaccuuccugccucagccucccaaaguggugggauuacaggcaugagccaccacgcccagccggaguugcacagucuuaaaaagcaauuuuuuaaauugucguauguucggaagggagggucuuauucaaaaagacuuggacgcagagcagugaguauccggggaagggaguugucugaggugguggcuuggucagaacugcauuuuggugaaauccauugcagggcccagccgugguccagccugaagcaggcauucauuccaagguagaggagcuccuggagcuccugccaggagccagacccuguucucagugcugggcacccagacaaagucccugcccuuguggacauccuggcaauuccauagaugucugggaagacugcagaagccagagagaagggccuuugaaguggagaggggcgagcugacccagacagccucacaugcagggcagcaggguggaugggagguggagacugaggcugggaggcugggggaggaggcuggggcaggacccccggaggagaggacaggcuggaccagguggagcgccggggagggaaaggggguugguggacagacccuuaggaggcucagcguacaugcucuggagcugaagggcuguggcaggagggcgaggagggaggcgggggcaggaaacaucuggcugaugggggggacaguacgaucgcauugagaugaggccugggaggaggaugggcuuggaggagaugccaggguccauuugggacauaguaggagugagaggcuggggggcaccuagggcaagguguccaggaagccagggaaccccggaucugagggcagagagaugguaucaugagugacgaggcagaggucauuggcauggaugagacagguaaccccaggaaaguggaaagagaaagcagagaggcccuggacagagucccagagaccugccagucuggagcugggcugaggggaggcuucgaggaaggagacagagguugcuggagaggugggcagagugucugaggccucgagcagggggcacauagguccuugaagugagggccaaggcuuugcauuggaaucauucccagagugacuugggacauuauucagaggcccccagggcugcugggaagggacagcaggcccacgcuccaggggacccgggaacgaagggaagaccccaggcugugauaauaacagcaacagccagcgcuuaccaagcacuucccccgccccuggugcugcgcccagcacccaagcucccuuuccaaggugagggacaccaagacuuagaaaaucaaagucacgaccaggcacaguggcucacgccuguaaucccagcacuuugggaggccgaggcaggagacuugcuugagcccaggaguucaagaccacccugggcaacagaggaagaccucgucucuacaaagcaaacaaacaaacaaacaaaaaaugagccuggcaugguggcacgugccuguggucccagcuacuugggaggcugaggugggaggaucccuugagcuugggagguugaggcugcagcaagcugugacugcaccagugcacuccagccugggcaacagagcgagacacugucucaaaaaagaaaagcaaagcaaagccacucacaugaggucuugcuccuggggacgggcauggccaggacuccaaccccggcagccugucccagagcccuggagcuagccccagugcagucucuccaccaccccgcacuuccucaggccaccuuccugccacagccuuuuccccaaaccugguaucacccccucuccucccucccuaaucccaccucucgggccuggccacuccaccccaccccuuccaggacucagauucagacucugagggaggagccgcugguggagaagcagacagugaguaucuuccuggagggacagggagcaggguucuggggggcggggggauuucagggcaggggugugggugauaccuccucaacuccaucaggagugacauccaaaguauguagcaguggguuggguaccagugccagagcaggcuccuggaggccgcuggcugggccgggccuugugccuuuagauguggggaggccgggaaccccagggcuggggccagggugccggagacauccaugccccuggcugaaugcccguccugccgcugucucucuucuuuccggucaguggacuuccugcggaacuuauucucccagacgcucagccugggcagccagaaggagcgucugcuggacgagcugaccuuggaagggguggcccgguacaugcagagcgaacgcugugaguccccugucaggauugggccacuuugccuggcuccuggccccaagugaccucccauccccagccacuugaaccauuuauugaaaccuuuucuuuauaaguagcaagaaacccagcuggaacuggcuuaagccaaaaaggaguguguuggcucuaauccagcuugaagcacggcuggguccaggugcuuccacuuuguuaaaaaucauaacucucucugaugcugcuuuucuuguuuugggguaaagguaacuccuggcagcugcaaaugcagguuccacuagccuaggagcugccaccgagagagcaccuuuucccaguaguucaaaccaaacagcagagauuggcucccauuggucccgguugagucaaaugccugcccccaugccucugauuggccagaccugggucgcuucuccauugcugagugaauuacugcacucugauugaccaggccuguuucauaaaaugaggauaaugauuauaguaucuaacucauaagguuauuggcggggcuaaauaaauuaauauaggaccaggggcaguggcucauguauguaaucucagcacuuugggaggccaucgugggaggaucacucaacgccaggcguucaagaccagccugggcaacauagugagacccccccgccaucucuacaagaaaaaaaaaaauagucagauaugggggcguugccuguagucucaguuacucaggaggcugagaagggaggauuguuugagcccaggaauuggaggcugcagugagcuaugauggcaccacugcacugcagccugggcaacacagugagacucugacucuaaaaaaaaauaaaguaauaaaauuuaaaagauaaauaaaaaugcaaaugcuuagagcagggccuggaacauagcgagagcuguggcagggugugccgugguuauuacuacaggaggcuuauuucagaugugguggauagguguccacuuacugagucagcaugaaauuuauauuucuuuuucuuuuuuuuuuuuugagauggagucuugcucuguugcccaggcuggagugcaguggcacaaucucagcucacugcaaccuccaccucccggguuccagcaauucuccugccucagccucccgaguggcugggauuacagacgcacaccaccacgacuggcuaauuuuuuguauuuuaguagagacaggguuucaccauguugcccaggcuggucuugaacaccugagcucaggcaauccacccuccucggccucccaaagugcuaggauuagaggcaugaaccacccgucccggccugaaauuuauauuucuugccacaaguugaggucaccaaagucugagaaaccaggcccuuggcaguccucaacuagaacaaucgacccuuugugguuccugagcagccuuuuguugaggacaucuucuccugugucccuguccuccagcugccacugucucccuccucaggcagccaggccugcugcccugagccucccucuccugcggcaggcgagcagcugucugcagccaucuuuuagccugggcaggccccaaagacaacacaggcaguggcuacaaagcauuuguuccuuguguccuccugcaccuggauucugggguaauuggcucaugagggugcccaggaggagauaguaaugaaaaauaacaauuaguugaggccgggaguggugguucaggccuauaaucccaccauuuugggaggcugaaagcaggaggaucgcuugaggccaguaggucaagacuagccugggcaauaagcgagacccccucucugcaaaaauuuaaaggugaggcuccaacccucaccucacugcucuaaaaauuuauuauuauuauuauuuugagacagagucucacucuguuacccaggcuggagugcaguggcgcuaucauggcucacugcaaccucugccucccggguucaagcgauucuccugcuucagccucccgaguagcugggauuacaggcgcgugccaccacgcccggcuaauuuuuguacuuuuaguagagacgggguuucaccauguuagccaggcuggucuugaacuccugaccucaggugaucugccccccucggccucccaaagugcugggauuacaggagugagccaccgggcccggcccuaaaaauuucuuuuuaaccacuuaauugaggcuucacuauuugccaggcacugggcucagcacuuuacaagugcccuauuauuugauauucacauuauaccuguaagaucauuauggaagugaucugaacagaggaggaaaaggaggcacaaaaaggucacgacucaguguagggucaaacaguugccaaguggcagagccaggauuugaccccagguccccugaauccagaccacauguagccaccacuggauucaaccaggccuggccugauggcaucucagagcugaagcucagggcugaagcuguggcaggcuuugugcucuguucaccuuugcuguccucccuuggacagggcaucccagaggcaucugauccacagcauaucacacuugugccugucuaucagcugaugggcagaugccaggguacuauggccugguggcuacucaccagccaccagcuagcuauuucugcucagcccaggguucuuauccuaaaguggccuuuucucaaguccaaguuggugugauuuccaacaguggauucucuuuuuuuuuuuuuuuuccuuuuuuugagauggagucucgcucugucacccaggcuagagugcaauggcaugaucucggcucacugcaaccuccgccucccggguucaagugauucuccugccucagccucccaaguagcugagauuacaggcacgugccaccacgccuggcuaauuuuguauuuucaguagagaugagguuuugccauguuggccaggcugggcucaaacucuugaccucagaugacccgccugccucagccucccaaaguucugggauuacaggcaugagccacugcacccagcccaacacuggauucuuuauccgcuggcuggcucuuccgcaguugauugugugacuucuuccccuaucugagccccaguuuucucauuuauaaaauggggauguuaacaccauccccgucuagaugauuggaaggcccgucaugcaucugagaugcuugccccagggccuggcauggaguaaacgaugucaggggcugugauggguggugcuaucguagggacugagcaaacggugucauauggugcauaaguuccucuccuccaggucgcagagucaucuguuuggugggagcuggaaucuccacauguaaguaacccuucucccccagcagcuacccccaggaacuggggagucccucccaagggcuggggaggagcccuaucugagcccuguccugggaggguuaguaugguauagaccaacugcucccugaccccccuuuccuagccgcaggcauccccgacuuucgcucuccauccaccggccucuaugacaaccuagagaaguaccaucuucccuacccagaggccaucuuugagaucagcuauuucaagguuugugcucccccaggaaggggcgucugugagggguggggauggggucaccuggcuccaacccucacgcuaccuggggcaucuggcccucuggcugucucuccuacagaaacauccggaacccuucuucgcccucgccaaggaacucuauccugggcaguucaaggugagaucuuuguuuugcagggggcgaaacaggaaggguugggggagggcacgcaugagaagccccgccaaggcccugcagacaaauauuauguagccauuaaguacaugggugcugggcccagacugccucgguucaaguccugguuccucgugucuucaucuuacgaccuugagccuccgauuugccuccugugaagugaagcuaaugguacugucugaagagggcugcugcgaggcuuagcugacuaaugaugccguugagagcccgggacccugcagccgggcugccugggugugaaucucagcucugcagcuuacccaccgugugacuuuggcaacacaauccccuucccuguccuucaguuuccucaucugugaucuggggauagcaguggucucuccccgacgcggcugcugugacgguucccuggggguaaaacagucacagugccuagaacaguuccuggcaugcggcaguggccuguggcuguucccugcagucgucagcagugcugucgcucuucccugcagccaaccaucugucacuacuucaugcgccugcugaaggacaaggggcuacuccugcgcugcuacacgcagguaggcggaugcgagcauccugggaggaggaugggcggguggaacgggcaugguguccucagcagaggagcagagcugcgugcccaagagcucaggcggggacuccagcaaugcggggccagggcuuggccuacugccuccuugcugcaugaccugccgugagucacgucuucucugccucaguuuccccuuccgucaaacaggggccagaaaagguuugcccucucaggucugcccucucaggucugcagugcgguggcagugaccuccucucagggccaucccaugugugauguggaaggagccuauggcugaagggacucugugugcacuauaggcaccccagauuucacauugguuaugagcgaguuuccaaagugacuucaucuaacaaaauccauacacuaugacacguguccaacaaguagauguugugccuuaaggaaggggcaccuuuuuauaguuuuuugugcuuugcccaauuauaaacaugucucguacacgucaggugcuuagccaagggccucucccuggggcauucaagcaaggauggcucacauuguuggcuucugguuuggagagucucacaccccuaacaguaaaaaaaucuugaugggcugggcacaguggcucacaccuguaaucccagcacuuugggaggccaaagcgagagauagcucgagcccaggcguuugggacccgccugggcaacauagggagacccugucucuacaagaaauacaaaaauuagcugggcaggguggcgugugccuguagccccagcuacucaggaggcugagguagggggauugcuugaguucaggaagucaagacugcagugagcuaugauggugccacuguacuguagccugggagaccugguuucaaagaaacaaaaaacaaaucaaaacaacaacaaaauguugcugccucuaccuguuuuaugaauauguauagaaaugacaugaugcacuacaacaguauuaauucaagcucuagaucacaccucagaaccccgaauuauaaaacagguggccgggcgcgguggcucacgccuguaaucccagcacuuugggacaccgaggugggcagaucacgaggucaggaguucaagaccagccuguccaacaucaugaaaucuggucucuacuaaaaauacaaaaauuagccaggugugguggugccuguaaccccagcuacucgggaggcugaggcaggagaaucgcuugaaccugggaggcagagguuguagugagucaagauugugccacugcacuccagccugggugacagagcaagacuccaucucaauuuaaaaaaacaaacaaacaaacaaaaaagagugguaacauugaaaauaaauaaguguucuaguguuuucucccuguaccugcaguuuggcaccugcagccccaaaagcuaccgccagggggaggaacaacuggcuuuaaguucagauuucucaggugggcgagguguucccaccuggggcugguaggaggcagagggcagcggaggccuccuucuuccaagaggaggaguccugugauccccacacuuugggaggccaaagugggagaucgcuugagcccaugaguucaagaccagccugggcaacauagggagacuccgggcucagaauaaaccuucugcccagagagucaccauuauuccaggacguggcucagauaugauaacagcuugcuugaagccaagugcuuuuugugguugaugucaugacacucaccccaagaccccgcuggcccuuguuugucagcuucugucaaaguaaauguucacugaguugauucccuacagcagggagggagaugauggacaagauggagacaccauauacugagcauauaagauggucaugggucccuggaacacaguuaagcuggaaggggagucagaaacgguguauguguucgggaaagggggugcuguuguaaaccccaucucuacgaaaaauacaaaaauuagccaggcgugguggcacaugccuguaguccuaguuacucaggaggcugaggcaugagaguugcuugaaccugggagguggagguugcccugagcugagauugccccacugcacuccagccugggugacagagagagacuccgucucaaaaaaagaaaaaaaaugacacaucacauacaaacuauuauauaaaggccaggcgcgguggcucacgucuguaaucccagcacuuugggaggccaaagucaacgucaggaguuuaagaccagccuggccaacauggugaaacccugucucuacuaaaaauacaaaaauuagcugggugugguggugcgugccuguaaucccagcuacucaggaugcugaggcaggagaaucacuuaaaccugggaggcagagguugcagugagccaagauuccgccauugcacuccaaccugggcaacagagcaagacuccaucucaaaaaaaaaaaaaaaaaaauuagccaggcaugguagugcacaccuguagucccagcuacuugggagcuugagagaggaggauugcuugagcccaggauuucaaggcuacagugagcuaugaucaagcuacuguacuccagccuggaccaguagagcaaaauccugucaaaagaaaaaaaaaaaaaaaccauguugucaaagaauaacagaacgcagagguauuucggugguucuuuuccacgcuguucaguuauuugcuuacuguucaguuauuugcaaauugcucacucacaugugagggagucaguggguagacugagucaaguaccaaaggcaaaaccaagauuuagaauagugggcaagggaggaaaguuacagggcgugugggaacagugacagugacucuugucuguaggcuuuggagauaaggugguugcugguagggagcccagaaggcaguuagagcauucuuucugcccuugaagggaaacaaacccuucccguuguuucuggagucccugggaaacgcugucaguuuggcccugggccacacaugcgagccaucucugcguaaccucugccaguguccucugucagcaccuguuuuagcggcauuccucacaggcaaacaacagcugcuccaaagggggugguuguuuuaagaaaaaugagcgcgcacaaaugucugugcagaaaagaacauucccaccuguuuaauauggaaagucucacugucuuaaaagaaaacaguggccgggcgcaguggcucacaccuguaaucccagcacuuugggaggcugaggugggcagaucacgaggucaggagaucgagaccauccugaccaacauggugaaaccccgucucuacuaaaaauacaaaaauuagcuaggcaugguggcgcgugccuguguucccagcuaccuggaaggcugaggcaggagaaucacuugaaccugggaggcggagcuugcagugagccaagauugcgccacugcacuccagccuggcaacagagcaagacuccgucucaaaaaaaaaaaaaaaaauagccacgcaugguggcgggugccuguaaucucagcuacuugagaggcggaggcagggagaauugcuugaacucaggaggcagugguugcagugagccgagauagcgccauuguacuccagccugggcaacaagagugaaacuccaucugaaaaaaaaaaaaaagaaaagaaaagaaaagaaaacaguggcugggcauggugucucacgccuguaaucccaacgcuuugggaggcugaagugggaggaucacuugagcccaggaguucaagaccagcccgggcaaauagggagaccaccccaccccccaucucuacaaaaauaauuaaaaagauaaaaaauuagccgggcaugguggcauuugccuguagucccagcuacucagugggcugaggugggaggauggcuugagcccaggaggugaaggcuacagugagcugugaucagaccacuacacuccagccugagugacagagcaagacccugccuccaaaaaaagaaaagaacacaggugaauaugccaucuaugaaacaggccauaguaagaaaggacccuggcuacuaaaggggaagauagugauuaaagccaaggaagggccaggcaugaugacucacacuguaaucccagcacauugggaggcugaggcagaaggcucgcugaccagccugggcaacauagugagaccccaucucuacagaaaauuuuaaaaaucagccagauguggaggcugaggugggaggauugcuugagcccaggaguuggaggcugcagugagcuaugauuguaccacugcacuauagccugggcgacagagugagaccuugucucaaauacauaaaaaaacauggcuaggcacaguggcucaugucuauaaucccagcacuuugggaggccgaggcaagcaaaucacgagguccagaguucgagaccagccuagccaacauggugaaaccccaucucuacuaaaaauacaaaaauuagccagucaugguggugcgugccuguaaucccagcuacuugggagacugaggcaggaaaaucucuugaaccugggagucagagguugcagugagccgagauugugccacugcacuccagccugggugacagagcaagacuccaucucaaaaaacaaacaaacaaacaaacaaacaaaccacaccuaguaagcccuccugauucauuuauguuaaugcuugccuagagcugccacaugcagcugugcagggugcgcacugcacaaggaugccacaucugagggggcuccauuaauaacagagacauuguaaauguauguuaauuucagcaauuaaugacagguggaaauaaagcaucuggcucuaauaaaacaacauuuuuuuucugaaaaaugaaagcaaauggccugaauuugcagaauaaaagccacacaggcuguggaguggcugugggccuggccucauagauauuuagguuugggccccuuuuuuuuuuuuuuuuuuuuuaauuuuuuguagagacaagcgucuugauauguugcucaggcaggucuugaacuccuggccucaagugauccucccaccucagccucccaaagugcugggauuauaggcgugagccgccaugcccagccuggccccugccuuuaagcagccuugacugucacccuuuaaguggcaccauugggaugaacagaagagucuucagauaaacccugccacuugcuucuccucccucccuucuccaccuguccccaccaccucacugcuccucguggcccucaacucccuacugugccuucuggccuacaagggguggcucacuccucaccccucuucccuccaucucucccucuagaacauagauacccuggagcgaauagccgggcuggaacaggaggacuugguggaggcgcacggcaccuucuacacaucacacugcgucagcgccagcugccggcacgaauacccgcuaagcuggaugaaaggugaggcuggagggcauccugagggcaggccuccucucagcaccaggagcagugucuccaugcagugggcacccauucuguccugcucaauucuuugggguuuuuuuguuuuguuuguuuguuuuugagacagagucucacucugucgcccacgcggggaguucagugggugaucauggcucacugcagcccaacugccugauuuccugucuuuggcuguuuuuaauauaugauaguaggccaggagcaguggcucacaccuguaauccuagcacuuugggaggccaaggcgggcagaucaccugaggucaggaguucaagaccagccuggcuaacauggugaaaccccguuucuacuagaaauacaaaaaaaaaaaaauuagccuggugugguggcaugcgccuguaaucccagcuacucaggaggcugaggcaggagaaucgcuugaaccugggaggcggaggcugcagugagcugaguucgcaccauugcacuccagcuugggcaacaagagcaaaacucugucucaaaaaaaaaaaaaaaaaaaaaacaagaagucacuuauuccacucauggaaagccauuucugacauucuuuaugcugauuuaacaaagccucuggugucccugugagauaaggacagcugcagcauuugcagaagggccucuggaguguggcuguucugauaaaaugccagcugagugccccugggcugaggauuccugaauagcccaacugcaagcagcugggggcaguguacaauucacauuacccccauuaugugucauugacagcagcgucacaggcagcacccacggugucaugcuguccaugcagaaauauuuuaaagaaaauuaccgacuacugacauugaaacaaugcuuuauaaaugugugcugaaugaaugaauggacaguugagcaaaugacuuagaauucaguggguugcaagugacagaaaugcuuucuuucuuucuuuuuuuuuuuuuugagauggagucuugcucugucacccaggcuggagugcaguggugcaaucucggcucacugcaaccuccgccucccggguucaagcaauucucccugccucggccucccaaguagcugggauuacaggcacgugcuacaaccccuggcuaauuuuuauauuuuuaguagagacgggguuucaccacguuggccaggcuggucucaaacuccugaccucaaacgauccacucgccucagccucccaaagugcugggauuacaggcgugagccaccacacccggccagaaaugcuuucaagcuuccuaaaucaauaagaaauaaggccaggcacaguggcucaugccuguaaucccaacacuuuuggacgucgagguggguggaucacuugagcccaggaguuugagaacagccugggcaacauagggagaucccaucucuaaaaaaaauaaaauguagccaggugcgaugguggaugccugugagcccagcuacucgggaggcuaaggcaggaggaucacuugagccugggaagucgguggugcaguaagcuaugaucacaccacugcacucaaccaugauugcaccaccacacuccagccugggcaacagagugagaaccugucucaaaaaaacaaacaaaccaauaaggccgggcgcaguggcucacaccuguaauugcagcucuuugagaagccaaagugggcagauuugcuugagcccaggaguuugagaccagccugggcaacauggcgaaacccugucucuacaaaaaauacaaaauuuagccgggcgugcuggcaugcaccuguaaucccagcuacucaggaggcugaggcaggaggaucacuugaagcugggagguugaggcuacaguaagccaugaucgugccacugcauuccagcccgggcaacagagugagaccuuaucucaaaaaaaaaaagaaagaaaaaaacaaaaaaaaugcaacaacaagaagagaggucuuuucugagcagaguggacaccucaggagacacccaucacacuccaagugauggagguguguucauguuaacaguggaagaggggugggggugcugcaccuccagacuccggcccagauccucuuacugccuucucuuucuuccccuuccccauacccagagaagaucuucucugaggugacgcccaagugugaagacugucagagccuggugaagccuggugagccucuggccagggaccugcccagguggauuuggguggggguccccuccucccccugacccccucccaaaggccacacccgcacacaucuggccaccucugucucucugaacagugccccagauccauccuggggagaauggggucugugccccuggccgguccccacugcucccaacucccacuguggccuccgggucugccauugcucccaccuguccucucugccuccccaugucacugucucuguccguccaucugucuccaccucagauaucgucuuuuuuggugagagccucccagcgcguuucuucuccuguaugcagucaguaaguggccccccagccuccccgcauccccaaccgccgccuccaccugugcugggccccaugggggcagccugggcccugccucaggaaaggucaccuccccagcuauggggggcggcagggagguuugcugcugggggcgggggagggagcgguggcgcagccugggcggaggcucccaagcucacgccccuccccgcaggacuuccugaagguggaccuccuccuggucauggguaccuccuugcaggugcagcccuuugccucccucaucagcaaguagguugggggcuguggcugggaggacggcugggcacccagggccaggacagacccugaccccuuagcucccccuccccacagggcaccccucuccaccccucgccugcucaucaacaaggagaaagcuggccagguaagagcccuucuucaagcccccgucgucacaggcucccccuucccucucacccuuuuccucagagggaacccccacuguggaaccccagcacuuugcauuccucagcucagaaccuggggcucuagaauccagaggggucggguuccaggccucugggacauucacugcccuuuugagcaagugauagaauuccaacucaaaccagcugaagccagauaggaaggccgggcuuccagggacugaggaggugggagggggugcaggggucaggagagacagugcggggggcgggguuggguccacgcucugggucucucaggucuguuuuuccugggcagccucacucuagggcaggugcucccuccuagguguuccccucaggggaaguaggcagggucaccgggcaagcagcgcacgcugugggcagacacugucccaagucuuagccugcgugaacucacuggcgccacaaccccaucgcgguuuugugaucaccccuauucuacaggaaacuaagacacagagaggacaagucacuugaccaaagucacugagcuggcugggcgcaauggcucacgccuguaauuccagcacuuugggaggccgaggcggguggaucaccugaggucaggaguucgagaccagccugaccaacauggugaaaccccgucucuacuaauaauacaaaauuagccgggcauggugcugggcaccugucauccaggcuacucgggagguugaggcgggagaaucacuugaacccaggagguggagguugcagugagccgagaucacaucauugcacuccagccugggcaacaagagugaaacuuugucucaaaaaaaaccaaaaaaacaacaacaaaaaaaaaacaaagucacagagcuaggauacaaacccaggccaccuggcuccagggucugugcucuuagcucucccuucccugcuccugccccugacccacccccucccugacagucggacccuuuccuggggaugauuaugggccucggaggaggcauggacuuugacuccaagaaggccuacaggugaggccccgccggggguuggggcagccuggaagggacagggugaggugggagcgggggcacgaaggcagaugagaggagcaggcaggggcgagcccgccugggaacucugaucuccugcugcaccgcagggacguggccuggcugggugaaugcgaccagggcugccuggcccuugcugagcuccuuggauggaaggugaggagcugagcaaccccagccuguccugagccccaucccuggacccucuccccaccccauggguccucugaccccaugaugcacagugaccuuugacuucugugaccuuugcuccugcagaaggagcuggaggaccuuguccggagggagcacgccagcauagaugcccagucgggggcggggguccccaaccccagcacuucagcuucccccaagaaguccccgccaccugccaaggacgaggccaggacaacagagagggagaaaccccagugacagcugcaucucccaggcgggaugccgagcuccucagggacagcugagccccaaccgggccuggcccccucuuaaccagcaguucuugucuggggagcucagaacaucccccaaucucuuacagcucccuccccaaaacuggggucccagcaacccuggcccccaaccccagcaaaucucuaacaccuccuagaggccaaggcuuaaacaggcaucucuaccagccccacugucucuaaccacuccugggcuaaggaguaaccucccucaucucuaacugcccccacggggccagggcuaccccagaacuuuuaacucuuccaggacagggagcuucgggcccccacucugucuccugcccccgggggccuguggcuaaguaaaccauaccuaaccuaccccagugugggugugggccucugaauauaacccacacccagcguagggggagucugagccgggagggcucccgagucucugccuucagcucccaaaguggguggugggcccccuucacgugggacccacuucccaugcuggaugggcagaagacauugcuuauuggagacaaauuaaaaacaaaaacaacuaacaauccgg

SEQ ID NO: 191740 - RNA, 153865 nt, Homo sapiens
ugcuggggggcguagcacagauuuauuuuccaguacuaggucaccucucccccagcugccuuagggggaggggcuuggggacuaaggggcuugcugugagaauaaggcacuugagguggggguggagggccagcugggggugugucagcuaagcugguccucauacugcuuacggaaacaaucaccagcugggaagaaaucccaacaucucucuugguacaucuuccagacauaagacuccuaggauuggggauagaaagaguucauuggucacaucuucaaacccuugagacauauauauauauauauuuuuagacaggguguugcucuguugcccaggcuggagugcaguggcgacaaucacagcucacuacagccuccuggcucaagcgauucuccaccucagucuccagaguagcugggacuacaggugcacaccaccaccccuggcuaauuuuuuaauagagaaagggucucgcuguguuccuaggcugucuugaacuucuggucucaagcaauucucccgcuguggccucccgaagugcuaggauugcaggcgugagccaggacgcccagcccaaacccauuuuuuuugagauggaguaucgcucugucaccuaggcuggaguacaguggcaugaucuuggcucacugcaacuucugccuccuggguucaagcgauucucccaccucagcuuuccaaguagcugggauuacaggcaugcacaaccacgcccugcuaaucuuugcauuuuuaguagagacugaauuucaccaugcuggccaggcuggucuugaacuccugaccucaaguaauccacccgccuuggccucccaaaguguugggauuacaggcgugagccgccgugcccagcccccagcccuaacccuugauauugauaggagcuuuuuacugccaccuacugacuggccuuauguuaaagggcuccacguccugcccacuguccucccauuaacacccccuuaccugacccguguguucugucucauccuuguuuaucaaauacaucaggaaaaaccugagggugagaggaccacaggagacaagucagaaccacccuuaccuuauuuuauuuuucauuuauaguagagaggaagucuugcuauguugcccaagcuggucucgaacuccuggccucaaguaauccuccccacuuggccucccaaagugcugggcuuacaggugugaaccaucuugcggggccccacccuuaccuucugauuggcuggcagggaaucugcccacauggacacuacacccccuuuccuaacuggccaaagcuaaguaccccacugcuggcuauuggcagccaugccccccacccuccugacuggccagugugucugcucacauguaauuggccagguugugcuccuccagcgugugagucucgaagccaugcggugucguaucaaaguagucacugccgauuccacagaugaagcacuuggucugugaguggcaagagacaucagaguggaggcccacuugacccccugaaucccguaaucccucugggucacccccagacaugaccuaccuccauauccuccuucacuugcucuuguuggucucggagcucaccaaaagcgucgaugaucagaccugggguggcaggacacaagucagugcccgaccucugaccugguucagacuccccccucuccagcuaccuaccuccagggcuugcccuccaucccccauuucccuaaucucaccccuaaucucgcuuccuaagaagauaguauuaggccuuuauuggccgggugcgguggcucacgccuguaaucccaguacuuugggaggcugaggugggcggaucaucugaggugaggaguucaagagcagccuggccaacauggugaaacccccucacuacuaacaauaaaaaaauaaaaaaaauuagcugggugugguagcaugugccuguagucccagcuaaucaggaggcugaggcagaagaaucgcuugaaccugggagguagagguugcagugagccaagauugcaccacugaacucuggcccgggcaacagagcgagacucccucucaaaaaaaaaauuauacauauauauauauagacacacacacauauauauaaauauauauaaacacauauauaaauauauauaaacacauauauauauaaauaaacauauauauauauauauaucucaggccuuuauugagcacucauaugagccagacaccgagcgccuaugaacugacuuaauccugaucacaaccuaugagguuaguaccauugacacccucguuuugcagauggagaaacggaggccccgagaggugacuugcccaaggucucacaguagcgagagguagagaugggguaugaaugcaggccgacuggauccugggccugcauucuuagccauggagcuagccugccuccgggcccugagcgcccacucccagcacugacccuggaugauggccaacaggaugacgaugacgaagaagaagaaggugaugucgaagaccacccuguagagcucguauucgucacccgcgggguccucgaucucguccccaaugccuccgccagcccggacacccacguacaugugaaacagguaacacugagggaggggagcacacuggucacucauucauucgacauucacugaguaccagccaaggccccgggauaggcagggcugaagacaugguaacgacugagacagcccugggcccugcccucaaagggcucacagauacggcaucagacagggaccaacagccagaaauggucagggcugugacaggaacagcacgggcaggggggugagggccagguuggguguggggcgcaggcagaggggucagggccaggauggggggcacaggcagaggggucagggccaggauaaggggggcacaggcagaggggucagggcugggauggggggcacuggcaggggaaucagggccaggauaaggggggcacaggcagaggggucagggccaggauaggggggcacagggagaggggucagggcuagcaugggggggcacaggcagaggggucagggcuggaaugggggguacaggcagaagggucagggccagguuggguggggggcacaggcagaggggucagggccaggauggaggguacaggcugagagguuagggccaggauaguggggcacaggcagaggggucagggccgggauggauggggggcacagacggagggaugagggccgggaugggugggggggggcacagguguagggaucagggccaggauaggggggcacaggcagaagggugagggcgaggaugggaggggcacaggcagagggucgaggcugggguggggaggcacagugugaccagggaugagcuaggggaagcacuggaagcuuuaacagcccgcuggaggcaucugauccagccuaggugaucaggugaggcuuccuggaagaggaggcaggugugagcugaaaccuaaaggaggccuuagguggagggguggugggagaguguucccagcagagaaggccacaugcugccucgccaucagugaggaaagaguacauccugcugcugugaggaacugaaaaugguugggugaggcuggaaaauagagcuccugugcaggagagcagggagagaugaggcagggccugggcauguggcucugugggcccuggcccagcccgcggucaaggggcuuccuguaggauguggcauuuaaguggaaaggugagguaucaagugaaugggguguguguguaugucaggccugggguaggggacagagagaacaucaggugcaaagggcuugaauugggagaaaacacacaguccuaggggaacugaaagaggaccaggcggcuagaaagcaaaaagcaagaggguuugcgguuagacccaggcagggccagcccuucccaggcuuuguaagccacggcagggugauucgacuuuaucuacagugggcuggggagccacaagaagggucugaguggggguggggagggagcauggucuaccuggcauuugggaacaacuuuacauauguuuuuuuuuuuuuuugagacagagucuugcucuguugcccaggcuggagugcuguggugcaauauuggcucacugcgaccuccaccaccgaguucaagagauucuccugccucagccuccugaguagucgggaauacaggugcgugucaccccacccagcuaauuuuuguacuuuuuucuuuuuuuuuuuuuuuugagauggaguuuugcucuuguugcccaggcuggagugcaauggcgugaucucggcucacugcaaccuccgccuccgggguucaagagauucuccugccucagccucccagguagcugggauuauaggcgcccaccaccacaucccacuaauuuuuguauuuuuaguggagacaggguuucaccacguuggccagacuggucucaaacucuugaccucagaugauccaccugccuuggccucccaaaaugcugggauuaaaagcgugagccacagcgcccggcauacacuuguucuuuccguguccccaggaugugagagaacacagucauccuagaguaaaaacuaagauaagugacuauaaugagaacgaggcugugggcagcgaggccgugucuggaagagccucagaugucagguugaggagcuggacuuuguccugagagcagggaggaacccacggagccagacugcaggacaucuuuggagauaaaccccagaaaugauucuuuuaauuguggauuguggccugugucucuaguaaguucgcaucaauuuggguuaugaucaccauuauuagaauagaagagaaaauauaaaugugcauugaacgcuggguauaccuugggugaaacuuuuuuuuaaacuugacacagagucucaauguguuacccaggcuggagugcaguggcgcagucauagcacacugcaaccucaaacuccuaagcucaagcaauccucuugccucagccucccacaguguugggauuacaggcgugagucacugcgcccggccugggugaaacuuuuaauuguggauaaugaugauagaagcuaacaucuauauaauccugaggaugugccaggcacuagucuaagucuuuuuuuuuuuccuuuuuuuugagacggaguuucacucucguugccuaggcuggagugcaguggcgcaaucucggcucauggcaaccuccaccucccggguucaagugauucuccugucucagccucccgaguagcugggauuacaggcaugcgccaccaugcccagcuaauuuuguauuuuuaguagauaugggguuucuccauguuggucaggccggucucaaacucccaaccucagguaaucugccccccucagccccccaaagugcugggauuacaggcaugagccaccgugcaaggcaauggucuaagucuuuuaagucuucgauagccagggagcaccuauuaguccuaaaagcaacuacuauuacacacucauuuuacaggugaggcccccagggcauagggaggagguugaguagccugccccaaaaucacacggcucauaaguggcaggggcacgcucccugaguaccuuuccaauaauaauaguuugaaaagcucaaauaaggccgggugcaguugcucacaucuguaaucccagcacuuugggaggccgagguggguggaucauuugaggucaggaguucgagacaagccuggccaacauugugagacccccccaccuccaucucuacuaaaaauacaaaaaucagcugggugugguagugugcgccuguaaucccagcuacucaggaggcuaacgcaggagaaucacuugaaccugagagacagagguugcaguaagcugaggucaugucacugcacuccagccugggugacagaacgagacucugucucaggaacaacaacaacaaaaaaccucagcucaaauaauauugaaacaauggcgaagagguguggagcacucauaugccuggcacuguucaaaguaucugacauggccaggugcggcggcucacaccuguaaucccagcacuuugggaggccgaggugggcagaucacgacggcacaggcagagauggagaccauccuggccaacauggugaaacuccgucucuacuaagaauacaaaaauuggccgggcgcaguggcucaugccuguaaucccagcacuuugggaggcccaggcgggcggaucaccaggucaggagaucgagaccauccuggcuaacauggugaaaccccggcucuacuaaaaauacaaaaaauuugccaggcgugguggcgggcgccuguugucccagcuacucgggaggcagaggcaggagaauggcaugaacccgggaggcggagcuugcagugagcugagaucacgccacugcacuccagccugggccagacucugucucaaaaaaaaaagaaagaaagaaaauuaagaauacaaaaaguaucugggugugguggcaugcgccuguagucccagcuacuugggaggcugaggcaggagaaucacuugaacccaggaagcggagguugcagugagcugagauugcgccacugcacucuagccuggcaacacagugagacuccaucucaaaaaaaaaaaaaaaaaaugugccuggcaugcaucagcuugccaaacuguagguacuauuuucauuuuuuagagauagggucucugucugucugccaggauggaguguaguggcccauucguagcucacuaaagccucaaacugcugggaccaagugauccucuugccuuagccuccaggcacacaacacaacacccagcuaacguuuaaauuuuuuuuuauagagacaggauuuuugcuuuguugcccaggcugguuuccaacuccuggacucaaguaaucgucccgccucggccucccgacgcacugggauugcaggcuggaggcaccacgcccggccuggagguaccauuauuaacuccuucaacagaugcgagaaggaagggucccagagugcuaggggaggggcucaccgucaucaugucaucacacuucaugucagguucauccucauccucgcucuuguuguagaacuugcggaagaaguugaaggccaccacgguguacagguagacgaccaccgccagaaggcccacggucaucaccagcugggggcaggauggggccaggucagcuccgcccugggcuugcccuccccccacccugcccaugcuggguccuggccccgguucagucccuguggcucuaccuugcugccccacacacccccggcucagcgcaccuggccuugccccuccucagcccagcugcccggcccuuaucccuucaccacccacugccacgcuggucccugcuggcccacgccccacagccagguccuccccacaccuguuucccauugugggugacagaggacaggauggugcgcagcgucuugacccccauggcgauguccaggagaugggcagcaaagaagaaguuguuguagugucccaagagggacaucaccauauaccagcccagguacaggaaggacugugggcacacagggccaggggucagggggaaggcagggacacacgaggagcacucuggaggguaggggccacucgagagucagcugugcccugggggucgggugccagcucuguuuggggaguacauggaggaucagggcauuccgggugagaaggcauccugcggggagaugagagcccccuccagaaggaaauaaucuggcaaucuaagggcacacugagggagccaaaggauguucugggccgggugugguggcucaugccuguauccccagugcuuuggggggcugaggcaggagcaucacuugaggucaggaguugaagaccagucugggcaacauagcgagacuccaucaucucuuccucugucuuuuuuuuuuuuuuuuuuugagauggaguuucacacuugucacccaggcuggaaugcuauggcgcaaucucagcucacugcaaccuccgccucucagguucaagugaaggaggcuaagccugccaaguagcugagaccacagguguggguaaccacacccagcuaauuuuuuuuuuuuuuuuuuugagauggagucuuagucuguugcccaggcuggagugcaguguugcaaucucagcucacugcaaccuccgccucccggguucaagcgauucuccugccuuagccuccaaaguagcugggaccacaggcgugggucaccacacccagcuaauuuuuguauuuuuaguagagauggguuucaccaugauggccaggcuggucucuaacuccuggccucaagugauccacccaccucggccucccaacccaaagugcugggauuacaggccugagccaccgcaccuggccacucucuguuuuuuguuagagacagggucucgcucuguuauccacgcuggagugcaguggugcacaugcagcucacugaaaccucugccuccugggcucaagccauccucccaccgcagcuuguugaguggcugggacuacaggugugcaccaccacgccuggcuaauuuuuguauuguuuguagagacaggguuucaccgucucuacaaaaguugcccaagcuggucuuaaacguuugagcucaagcaaaccucugccuccgccucccaaagugcugggauuauaggccugagccacugugccugucugccuggcuaauuuuuuguguuuuuguuguuguuguuguugagauggauucucauucugucgcccaggcuggagugcaguggugcgaucuuggcucacugcagccuccaccuccuggauucaagccauucuccugccucagccuccugaguagcugggauuacaggcaccugcugccaugcccagugccagguuugucuugaacuccugaccucaagugaucugccugccucggccucccaaagugcugggacuacaggcguaagccagcacgcccagccccagcuaauuuuuaaauuuucuguagagagaggaucucacuauauugcccaggcuggucucaaacucugggcuccagugauccaccagccuuggcuucucaaaguguugggaguacaggcgugagccaccacacccaaucccagcuauuuaaaaaaaaauaguaauaauaauacuaauaagaugucuagggggauaaggagccuuguguggauaagaagauacccuagggucacagccacucagggucccaggagucauucuuuggucaggaacacccgacguugggaacccuccuaacgccccaccccugcagagucccuccccagucugugggccccugcucacguugucugugaagaugaccccgaacuuccagaucugguacuugacaucgauggacaugagccugugggggcggggguggggagagaugcuugagugucagacuccagucaccuccccugcaugccccaggccugugcagggguguccugggcucaccaggucagcagcccuggcggcggguugggcuugcgcucauugugggcugugaucucuaguguggccagguccaugcccaguagcucagcaauccgcucccgcccguagauguccccauguuuguccaggaccugcacaagagagcaucaggcuguguagacacagcuggagugugggugugugucguggccugcaaggggguucuggggacacuccaaacucugagugagaaaugggaggugcauuuuuuuuuuugagacagucucccucugucacccaggcuggagggcaguggcgccaucucugcucacugcaaccugugccucccggguucaagcgauucuccugccucagccaccugaguagcugggauuacaggcaugcaccaccaugcccggcuaauuuuguauuuuuaguagggacgggguuucucuguguuggucaggcuggucuugaacuccuaaccucaagugaucugcccuccuuggccucccaaagugcugggauuacaggcgugagccaccgugcccagcccacuuuguuuuuuucuacagcauuuaucaccacugacauacuguacuuggguucaucaucuaucuuuccaacuugaaggucagaaucacuguuuuguuuaacacgggaucccagguuucuaaaacuguuccuggcacauaauaggugcuccguaaauaugagugaacgaauuauaguaacagccaacauaucuaguguucuccuauaugccagauacugcucauguaguacauaauacaacaacccuguaggguuggccguauuauuaccccacuuugaguaugagguacagaaaggucaauaagccagaaauagaaaggcaggcaaucggcugggcgcgguggcucgugccuguaaucccagcacuuugggaggccgaggcggguggaucaccugaggucaggaguucgagaucagccuggcccacauggcgaaaccccgucucuacuaaaaauacaaaaauuagccagacgugguggugggugccuguaaucccagcuacucgggaggcugaggcaggagaaucgcuugaacccgggagguggagguugcagugagcugagauugugccacugcacuccagacuggguaacagagcgagacuccgucucaaagaaaaaaacaaaagaaaagcaggcaaucugguuccagagugugugugcuuaagacauauugcuaacuuccucucuuucaacuaguauuucucucuuuuuuugagacggagucucgcucugucacccaggcuggaaugcaauggcgcgaucucggcucacugcagccucugccgcccggguucaagugauucuccugccucagucucucaaguagcugggauuacaggugcccagcuaauuuuuguguuuuuaguagagaugcaguuuugccauguuguccaggcuggucucaaacuccugaccucaagugaucugcccaccucggccucccaaagugcugggauuacaggcgugugccacugcuccuggccucaaccaguauuucuugaguauucacucugugccaggcacuaugcuaugcuuucuuauuuuuuguuauuauuauuuuuuuugagaugaggucucacucuuucacccaggcuguagugcaguggugcaaucuuggcucacugcaacuucugccucccagguuaagcgauccucccaccucagccuccugaguagcugggacuacaggcaugcgguaccgugcuaauuuuuuguauuuuugguagagacggcauuuugccauguugcccaggcugcugugaaauuccugagcucaaguguuacauccaucucagccucccaaaguucugggauuacaggcgugagccaccacgcuuggccuugaugcucugcucuuuccaugugcccauucaagaaagggaagcaagcuuacuaugcccaucuccccauggggaaacugaggugcuacucagaaaggcaaaaaaaccucuugcccaaggucacacaccaagcaagugcuuggcaggccugugauggccugguggcaggcagggacccaauccaggacccagggcauccauguccucucaccuugcgcuugacaaacuugucccaguaguugcuagggaaagaccugcagagagagagagagaaagcgugaguauaagauguuagggccagagggaucagagcugucagccacgacaggguuggcugaaacuccacuguuuuucuuuuuccuuuuuuuuugagauggagucucacucuguugcccaggcuggagugcaguggugugauaucugcucacugcaaacuuugccucccagguucaagcgauucuccugccucagccuccugaguagcugggauuacaggcgcccaccaccacgcccggcuaauuuucguauuuuuaguagagacgagguuuugccauguuggccaggcuguucuugaacuucugaccucaggugaugcccccacccgccuuggccucccaaagugcugggauuacaggcgcccaccaccacgcccggcuaauuuuuguauuuuuaguagagacaggguuuugccauguuggccaggcuggucucaaacuucugaccucaggugauccccccucccgccuuggccucccaaagugcugggauuacaggcgugagccaccugcgccuggcuccacugcuuuucuuguaggaaccuugaacaguggggaccccacugccaucuuugcuagaccccaaaugaggcagagaauuugcauucagagccagaugugcaaaaaagaccucagaauggcacucugauaaagaggcucuggcguggugauggguggggaggaguccaaaacagcagccuaacucagcaccaacuccagugcaacugccugcuuccucauacugguugauuucauuuaauuucaugauucuggcccuuuauucaccaguuuuccaagugacaaauugaugcccuaacauccucaaauauggccaacgaguuuuuuuuuuuuuuuuuugagacggagucucgcucugucgcccaggcuggagugcaguggugccaucugggcucacugcaagcuccgccuccucgguucacgccauucuucugccucagccucccgaguagcugugacuacaggcacccacugccacgcccagcuaauuuuuuuguauuuuuaguagagacaggguuucaccauguuagccaggauggucuggaucuccugaccucgugauccgccugccucggccucccaaagugcuaggauugauuacagaugugagccacugugcccagccacgaguuuuguuuuuugagaggguggagcgaugauugauuaugaauucacggauuugcaauuauuugaagugcuuugauucauugcacuuccaauuccuacuuguuuuuuuuuuggcccccagacauagggucuugcucugucacucaggcugaaggacaguggcauaaucauagcucacugcagccuagaacuccugggcucacgccauccuccagccucagccucccaaacagcuaagacuacaggcaugcgcuagccaggcuagcaugucuggcuaacuuuuuaguuuuuuuuuucuaaagauauaggucucucuauguuguccaggcuggucuugaacuccugggcacaagggauccuccugccucagccucccaaagugcugagauuacaggcgugagccacugagugcggccccuagggccccuaaugauuucuuuucuuucuuuuuuuuuuuuccuuucuuuuucuuuuccuuuuuuuuuuuuuuuucagauggagucucgcucuguugcccaggcuggagugcagaggcacaaucucggcucacugcaaccuccaccucgcagguuuaagugauucucaugccucagccuccggaguagcuaggaccacaggcacccaccaccaugccuacuuuuuguauuuuuaguagagacuaauuuuuguauuuuuaguagagaugggguuucaccauguuggcuaggcuggucucgaacuccugaccucaagugaucugccaccuuggccucccaaguguugggauuacaggcaugagccaucgugccuggccauguuuuuuuauuuugcacucauugcaccugaguaagaaucacaccuggagacaggguuuaaaacacggguuccugggcucacaccccagagucacugaacaggaaccuccaggccucaagucuaggaaucucugugugccaaccucacccacacagaugcuguaaugcaugggaaaugugccucuuuuauggaaagaaagaguaagacuuggggagaaugaggcagggccugcagggacugaaacccuagguuuuuuuuuuuuugucuggggggaaggggguggaauuucacucuuguugcccaggcuggaguguaauggugcgaucucggcucacugcauccuccacaucccagguucaagugauucuucugauucagccuucccaguagcugggauuacaggcgcccgccaccacgcccagcuaauuuuuguacuuuuaguagagacgggauuucaccauguuguccaggcuggucucaaacuccugaccucgugauccgcccgccuuagccucccaaagugccgggauuacaggugugagccaccgugcccggaccgaaacccuaguuuuuugggguccaggccuggacuggguggaaacccagguccccuccugcugccacccugaggugggggcuggguccuuacggcguguugagcaccagucggucccacugccccuucacgucaucguccucaggcugcuccgugauguacaggccaucaaacuccagcuuccgggccagcuccuucucccgcuuaaagauuaccaggggcaccuggauagugggaggaggccaaaggugggcgucaggcaccuuggcuggaccauagucucagcagaagccaugacaucuugcuggggucugugugugaccccacaucagaagugcuuucccagugauaaggguagaaaugaggcccaggcagagggcuuagggcugggauguggggaacaugggcagaggggucagggcagggaugggggaggcacaggcaggggggucagggcuggaauguggugcauagauagaggggucagggccgggauagggggcauagauagaagagucagggcuggaauuggggggcacaggcagagcagucggggcuggcaguggagaggcacaggcaggggugucagggcugggauguaggggcauauaggggucagggcuggaauggggguggggcacaggcagagggaucgggccaggaugugagaacaggggagcugugggagcccaggaguggugccugaugccaccuggggcuucccaagggagggaggucugaacucagaacugaaggaugaauaaaacaggcaggugcaaggagguggaagcagggcaaaguauugcaggcagagggaauagcauguaugaaaguuuuaagcccaaagaacucuaguucaauagcaaaguaucaagacagugguccagaaccugguuccucagcuauaagccguguccguucccaaucugaaugucguccuuacuggagaccccugucauccuugcuggagaccccaauccuguacccaguuccccagcccucaccccaacccuaggcccccucugucccaaccacuuugagggcccccagccccagccagugcuccagcacugcccccacccccacccagccaauaagcccuugccccagaaccauggccaugggcccaccuugagacaauuauagccaaugaugcagagaaaggccaccaguguaugcaggaggcucagacaccgcagggcggguuccauguagccugugcuuuccuccaggaaguaguacaccauguucucauccucaucgcccucugccuccucuccggcccccaagccccagccagagcugccaccagagccugcaccugacacauccccagcagcugagccuuccaugucguccuccccugguggagagucugagaccugaaauggggacagagauucaucugugggucugccacaugcagagcccacucacaaaauugagccuccauucccgagauuggacugggaccauaccagauacagucuugguguggcugucaaucaagaucaaggguugggccuagggcuguagcuagcaaaucagacucugaccugggaauuagccuauugaacugaguggcacagaacugaagacagaguugguucaucuugauaguggagcccuaaagagacugcccacuaauauuaacacuaacaugaaaauuaguagcagcuaaacauuuacacagugcuuuuuauaugccagguacuguugcucuaacugccuuacacacacucauccucuuuuuuuuggugggguggacggaguuucacucuugucaccuaggcuggaguguaguggugcaaucucggcucacugcaaccuuugccuccuggguucaagggauucuacugccucagccuccugcauagcuuggauuacaggugcccgccaccaggccuggcuaauuuuuuuuuguauuuuuaguagagacgggguuucaccauguggccaggcuggucuugaauuccggacuucagguaauccaccuaccucggccucccaaagugcugggauuacaggcgugagccacugugccuggugccuuauccucuuucaauccccacagcucuaagagguauuccauuuuacagaugagggaguugaggcacagggaugguaagcaccuugccuaucgucaugcgccagugggcagucccacugugggacuucugggucccacagaagccaugcuucgaucucucuagucuaccuuacuguccuguuaucuagaccccuggcaagaccccaagggucccuuuguccuucaggaggccugguucuuaacccauuccuuccauucugugaguggcccauuucuuccucccugcaaacuucuguuuagcuuaugugaaaccaaagaugcuuaacagaaucaguggguguugccaagagcugagggccugcacccaggcgcacaggacuggcauguggccgagcugagcagagaacucagcuccugcuccugcucuaacucccacagacacucaggcuucugucccagauggauccagauauccccuacucacccccauggaggggggucccaggauccagguguccagccugaacccuccuaacgacccaaagcccaauaccuuaucccuucaguggaggaacccugaaauucugauaggggcugagccucccaucccacagcauggaaaagggccugacccucccagcccuucaggaccagcaccuuauaaaacagcaagaugaaguugauggcaaaugccaagaagagggcaaggaaccgcaggguguaaaaguuccgggacagguaguucugagagagaagagaaaaagagagaaagcgcucacagaucagccucuucccuggagaauucaucccaucauuuaccugcaaucaaaguaccugggcucucaauaucuuuccuacaaccuccuauuuauuuauuaauuauuauuauuauuauuuuugagacagagucuugcucugucguccaggcuggagugcaguggugcgaucuuggcucacugcaaccucugccgcccggguucaagcaauuccucugcugccgccucccgaguagcugggacuacaggcgugugccaccacgcccagcuaauuuguguauuuuuaguagagacaggguuucaccauauuggccaggcugaucucaaacuccugaccucgugauccgcccuccucagccuaagugcugggauuacaggcuugagccaccacguccagccuauuuauuuauuuuugagacaaggucucacucugucacccaggcucgaaugcaguggcgccaucucggcucacugcaaccucugccuaccggguucaaauucucaugacucagccuccuaaguagcugggauuacagguaugcaccaccacacucaguuaguuuuuguauuuucaguagagacggggucucaccauguuggucaggcuggucucaaacuccugaccucaggugauccacccaccucagccucccaaagugcuaggauuauaggugugagccaccucggcuggccucaaccuccuauuuguugagugcuugcuuauaccaacaucugggcuaagaacuuuauuugcaugagcuuguuuaauucucaguacaccccugugaagugggcacuacuguuaugcgcacuuuacagaugaggaaacugaggcucagggaaguggugucuugcucaagguaacauaaccaacgaguggcagagaugggauuugaacccgggcagucagccuccagaguccaagcuccaagccacuuggccaugcugcuuccugagugaggucaccccaccugucgcccugccugcuuuacagaagaugaaagggaauuuuuuuuuuuuuugagucaaggucuuacucucacccagguuggagugaagugacacaaccauagcucacugcugccucaaccuccugugcuuaagugauccucccgccucagccuccugaacagcugggaccacaggcaugugucaccucacccagcuaauuaaaaaaacauuuuuggcuacucugggugcacugccuagaggguagcccugcucugcaaggagcaguaauuaaaaaaaaaaaaagauuaaaaauauucggccaggugcaguggcucacgccuguaaucccagcacuuugggaggccaaggcggguggaucacaaggucagaucuaggccauucuggcuaacacggugaaaccccguuucuacuaaaaauacaaaaaauuagccaggcguggcggcgggcgccuguaguccuagcuacucgggaggcugaggcaggagaauggcgugaacccaggagucagagcuugcagugagccgagauugugccacugcacuccaaccugggcaacagagcgagacuccgucucaaaaaaaaaaaaaauucuuuuguagagacagggaucucccuauguugcccuggcuugccccaaacuccugggcuccagugauccuccuaccuuggacuuccaaaguacuggacuuacaggcaugagcccccucgcacggccaggaacaucuuccaucucucccucuuucucuccaccuuucccuccaucccucauucuucccacaaauucugacggaaccaccuucguuccacaugauucccucaccgcccccccgccccccaccaccacuuuguuugaggcagagucucacucugucgcccaggcuggagugcaguggcacgaucucggcucacugaaacuucugccucuuggguucaagcgauucucaugccucagcauccugaguagcuggaauugcaggcaugcaccacuauggcuggcuaauuuuuuuuuuuuuuuuuuuuuguauuuuuaguagagaugggguuucaccauguuggccagucuggucuugaacuccugaccucaggcgauccgccugccucggccucccaaggugcugggauuacaggugugacccaccgugcccagccucccucacccccuccuaucgggccaggccuggaggggagacaggauggagggaacccugggaccugccucccaacacccacccuucuuccuggccuggaugagaugaacgcuuccccaggaauugggagagcucagaccuccacagcagcacugggagugguggagggacugagacuguaagggcugacagccaagaacaggccacggugggaaggccagagugguggccucacugaauguagcucuggacagaggauggagguggaaguguggguggguggccccgaugaacagagguauggagguuggaauaaggauagugagcagggaagggacaaggaaccaagugagggccaucugaaaaugcuacccuguccgcaggucuggggauaccucugcccuuuccccagcuaggguucuucuuagagacgagcuugaacagaugaacucaagaacaaggugagcaggagaggugggcaccagagguggggcucccggggagaagaagguucaggugaccuggcuggauccuuaccaggaacuucacccucugcaccuccaguucuccccagaauucgccuccagcuuccuccuucuuuggagggggugagggaggugcuugcuucuuggggggcucuggugugggcucgggaacuucuuccuucuccccauucucggcacugcagggcaggacagagagaggucaggaggugccugggcaggcaaugcaugaguucauucauucaaaaccauucaccaagggcccgcccugugccuggcccagguuuggaugguacuggguacaugggaugaugagauaaucaggacuugcccuuauggggcuccaguccaaugugggagacaggcagugacagugacaccaggcagugacagcccagaguggucggggcugggauggaggaagcucaggggguugugggaaucuggaggagacaccuccucaacuuaggagggggucagguguccuggagaauuggaaaggaugagaaagacucagaguaggcaugggggccuguguuccaggcagcgggaaagcacaugcgaaggccuggcaguuagaugggaguuuucauuuuucuaucucuccauauuuuuuuuucuuuuucgacacagggucuugcucugucacccaggcuggagggcaaugcugcgaucagggcucacugcagccuccaccuccaggggucaagugauccucccaccucagccuccccacacaccaccaugcuuggcuaauuuuaauuuuuuuuuuauguugcccagguuggagcauuuauuucuugauucuuuuacucagagccccuccuccgugccugagucugggcugggugaugccgaggacacaggguggccaggacagccuuggggccugaccucuggaggcuccuacucuaggagggaggcagugauaggggcuaggccccucagccccaaggccacucacucggcuuucuccggcuccagcucugguuccggcucgggcucuggcucuggcgggagcuccuccuccacuccauccaccuagggacagggcaagcaucagggcugaguccucacccuaagcgcuucucaggcugccugccugcuccucucaucuccuuucucucuuauuuccccuggguaaucuaaguuuuacacuucccuccaccagaaagaggcagauuaugauucccguuuuacagaggggaaacugaggcucaucgaggugaagcccuuugcccaaagcacugcgcagggucgggcugacuccaagugcagcucugcuuguccccagggcuucccaccaccuugaccuccacauucccaaggcauucccagcaccaagggccugaggauguuuggggucccuuccuccacgguguacuucauucccacaacgaguaucuccgagggucuuuuccuaguggcccugacccugucucgggacuuuuuuuagucuuggucuuucuuuuccuuuuuuuuuuuuuuuuuuuuuuuuuuuuugagacagagucucgcucugucgcccaggcuggagugcaguggcaccaucuuggcucacugcaaccucugccucccggguucaagcgauucuccugccucagccucccgaguagcugggauuacaggcgcacaccaccaugcccggcuaauuuuuauauuuuuaguagagacgggguuccaccacgguggccaggauggucucaaacuccugaccucaggugaucggcccgccucggccucccaaagugcugggaucacagguguaagccaccgcgccuggcuuaguuuuggucuuuccugcccucuaauuuggucucuggguuucuuacucucucuggcucugcagguaucauuuucucuaccucuccgggcccugcacucuguccggcccugcacucuguccggcccugcacucucucuccccggcccuuucuccaggucuccaucucugagucucuuucucugugggucugaguaucccucugucucugagcgucucucuugcccggcgcccgcuguccccgugugcguccuccaugggugcguccuccgugggugcgugugcccaucccccuagccaguucucuccucugugugugucuccacccagccgggcucucuuccucccuccaaucccccaucuuuccaaaaccccaaaaccccgccugcucucucacccccaauuuccucuugaggaugggagagcccucgggugugggcgguuccgcaggcgucgugucccccauguccccgagaccgccagccccuucgggccggaaggggcccccaucggucacggccaccgccccgucggcaccgcccggcccggccucgugcaccgccuccuccucgucuccagcgcccuccgcggcgucuccagcgcccucgcuggcacccucgccgucugcgucuccgcccggcccggccggcugcucgccgugcaccucgucgcugguggggucgggcaugccugccaggagcucggucaccgucaccuucuuggcgcccuccaccaggccgccgccgaacagcgagccccagagcaggcccagcgcgcccgccgccgcccccgcgccagcggccccagcgcgcgucacugcugcccagagcagcgccgccacugcgguggccgccucgcgggccguaagccgccgcagccgccgcacgcgccgccgcaggcugcgguagcugaggccucgcagggcccggccugcggccgccacaacccgcgccgucgcccccgccgccgccguggccgccgugcccucgagccccgccgcgcccuccuccgcgccuuccgcgcccgccuccgccgcgcccgcgcccucguccucgucggucuccggcucgcccucgggcuccgagaucugcgcggcgaucugcaucucgaagaugguguccucgcagaaacucacgaagagcuccaucuucucagccucgccgcccucguucaccacgucgaagaugaacuggcgcuuggacuccuucaccugaagcgaggggcggcagacaggauagggcgccgucagcgggggcucggacagcagcgacagcgcaguggcagcuacaaggggucaccgcggcaggcgcuguucuaaaugcauuguugguauuuuguuuuugagacagggucaggcugggcgcgguggcuccgccuguaaucauagcacuuugggaaacugaggcuggcagaucacuuggggucaggaguucgagaccagccuggccaacauggugaaacccccgucucuacuaaaaaugcaaaaauuagccggugugguggcgcaccccuguaauccguuacucgggaggcugagguaggagaauaacuugaacccgggaggcggagguugccaugagcugugaucgugccacugcacuccagccugggcaacagagugaaagucugucucaagaaaaaaaaaaaaaaagacaagaucuagcucugucuccuaggcuggaaugaagugacgcugucucacuguaaccuucguccccaggguucacaugauccccaugccucggccuccugaguagcugggauuacaggcgccugccaccaugcugggcugaguuuuugaauuuucaguagagacaggguuuugccauguuggccaggcugaucuggaacuccuggccucaagugaucugcccgccucacccucccaaagugcugggauuacaggcauaagccaccaugacuggccugcuaauuucuaaaaaaaauuuuuuugcagagacagggucugucuguguuggucaggcuggugucgaacuccuggccucgagcaauccucuggccuuggccucccaaagugcugggauuacaggcaggagccacagcgccuggccaaguuguuguuuugauuaucaauagcaaaccuauagagagagcuuuauagagagcacucacuguggguacuccuguaaaugcuucaauaaggccaggccccauacaagcaguuuccauaaaacucauuuaauccucacaaacaagccuagggcuagcggguuuucuucccauuuuauagaugaggacagggaggcccagaaaguuacaugcccaggugacacagacaagguggcacauauaggauucgaacccccagagagcuggcuccagaauggauguguuuagcuuccuugagaggaggagcauagugcuuaaaggcaaaggcucugcagccagccugccuggguucaaauccugauucugccacugaguagcugggugauuuugaauuaacucucuggaccuccguuuuccccucuguaaaaugggcauaauaggaccuacauuauaggguuggugugaggguuaaaugaguuaauagaugcugcaugauuagaacagcgcccggugccugauaaaugcuguauagugggcaggccacgguggcgcacaccuguaaucccaacacuuugggaggccgaggcgggcggaucaccugaggucaggaguucaagaccagccuugccaacauggcaaaaccccgccucuacugaaaauauaaaaauuaggugggcaugguugcacauggcuguaaucucagcuacucaggaggcugagacaggaaaaccgcuugaacccaggagguggagguugagugagcugagaucgugccauugcacuccagccuggucaacaagagcgaaacucugucucaaacaacaacaacaccguaguguuaccuauuauuauacugccccacaggugcuccaaggccacaugggcauacguggaugccugagaagcaggggaaaguggaaugggaaggggugagcagaaggaagcggguguuuggaggaauagcacuaaggcaaagaguguuuguauggggagcacgcagggucagaggaagagaggagggcagagcucccccagcacgugcaaagaaugagugggaagggccguggugaacaggggcuuccugcagaggcagggauguguggacauccugggugccaggaugcugcaaccacuugugugccagauggggguguguaugcaguggggccccgaggggcacagaugagugugcaagaucucaaggguuccugcggaguaugugaggagacaccgggggccagggagggaucaggaguaaggagggcguggcggcaugggaagaugccaaaagugugcaaccacgagaggcucagugugcacgguggacgugggcacacggggcaggugugcaagggccugggacucuguggggggacaggaggaguaugagugugagaggggccugcaguuaugcagugugcgugaggcaggcaugaaugugggaaggggagccaaggguuuguguacuggcucccagaacaugaggacagggcucugugugggacaugagcccgcgugcaugagcugguguccccugaggagacauaugaagggcccacucaugaaggaggugacgggugcgcaaaccucccgggcuaugugugugagacaagaaggggugugcaaguaccuggcggcaucugaggaacaacaagcaagugugugugcaagagaaugaggugagggugugucaggggcguguggggagugugagggaauggggaggggaaccauaugucagccaggugugccagcucugcuggggacaugccgggaccacgugaguguacccuuggggcaagcgagugugugagggauguucaagcauuugugggcugggcauaggaggagcugagauagggcaugucagauuagagaguaggucugagggcucuucugggugagccugagaccguggcccaagugugcaugggugagcaugguugugccagggcuacagugagggcaaguggacagugaacaaaugaagcaugccaggguucugagagggcucauuggcauccucagggugugugugcaagaggugugcacccacgugugggcccagaauaaguugggguacacauaugcuaggacuucagaaggcaucugggggcaaacgugaugacuggugaagggugggucagcaugccagggcaccccagagcccccaaggcgagcguguacaagagugagcaugagcgggccaggaccaagagacggcacgccgggggcuacugggaaggugagcaaggggugugucgccaugcagguucgaggaggugagaguguggguagggcugcaucagggcuauaagggccugccagagcucccaggguguggguguaaggggaaagcauggcgugugagcagccacagucaggacacacugacccugcuucaugcccaaggggugugcauccuugugugggccagguccgcaagaaguggccaggggcgagccagggaugugcaagggcgcagcuggacgaaauguguacaaaagggugggcgugggcuugccggagcagggcagauaugcgaggcacgcacagcccccguggggucugagggugcaggaagugagcacccgcaugcccgaagccccaggaggcgagcuugcacgcgcgcggguucccugaccuggggcaucucccacugggcgcgguuggucucugagaucucgaaguagaugcgcucgaugcggcgugacgcgcccaugaucucgaugcggcccagguaggggcggaaguacucaaggaugcucucggccagcuccaggaaguugugcaggcgagggucaugcggcacaugcuccgacagguuggucagcagcaccgccacguugaagccgaugucgcgugcuggcuccuggaagcgguuggcgaacucuucgcaguugaucauuucguucucauccgcuucggagcacgaaagcaggaacuggauuucuggaccgcugaacugcuucuggcuguccauggccugggggcgggcagggaggucaguggggugaccuggagagccucaauucucucucuuuuuuuuuuuuuuuuuaagacaaggucucgcugugucgcccaggcuggagugcaguggcgcaaucacagcucaacccagccucaagacauccccucucguccccauccccacccccgggcucaaguacccagcauccagagcagcugggacuacaggcacacaccgcuacaccuggcuaauuuuaauuuuaauuuuuuuuuguagagauaaggucucccuauguugccaaggcuggucucaaacuccugggcucaagggauccucccaccucagcugaaacuugcuuuuuuuucuuuuucuuucucuuuuuuuuuuuuuuuuuuuuugagacggaguuucgcucuugucgcccaggcuggagugcaguggcaugaucucagcucacugcaaccuccaccucccagggucaagugauucuccugccucagccuccugagcagcugggauuacaggugcccgccaccacaccuggcuaauuuuuuguauuuuuagugagauaggguuucaucauguuggccaggcuggucucgaacuccuguccucaggugauccacccgccucggccucccaaagugcaggggugacaggugugugccaccgcgcccagccauaacacucuuuaucuguuauccugcuaauggaaauguagguugcuuccagauuuguauuuuguuuuuguuuuuuuuuucugagacagggucucacucuuucacccaggcuggaguggugcaguggcacgaucucagcucauugcagccuccaccucccagggucaaaugagucucgugcuucagccuccugaguagcuaggacuacaggugcaugccacugugccuggugaauuuuuguauuuuuuuguagacgggguuuugccauguugcccaggcuugucccaaacuccugaacucaggugauuugcccuccuccgccucccaaaguguugggauuacaagcauaaaucaccaaguucacccacagauuucuuucagacaacacuuuucuugaacauucuugugcugauugcccaugcauuuuugcaagagguucucuagagcagcauaaaauguucuugaccgcacucacucaaccauaagaauacauuuuacaaugugacucaaaaaaaaaaaaaaagguuucaugacauaauucugaccuuugcuguguagcacacucugcaguguucuauuuuauuucuaaagaugcuggucacgaguuacgcauugcuaaauuaauuucauuaccuccagacggguagcaacaugcagugugagaaauguugcucugggguaugaacagaagcaaaauuuucuggcucucaaaagugcuuuguaaaaaccccagaacuuugcaaaaugcuuucuaaaugaguaacaugcuuugcaaaucaugaagggcucuagaaaccacagagcauggagacauaaucacaccggaaccccucaccuucugcccucaccucgucugcuugccuaccccucuaucaugagcagugugacacugucugucucaaaaauccaccucuggccaggugugguggcucaugccuguaaucccaggacuuugggaggccgaggcggguggaucaccugaggucaggaguucgagaccagccuggacaacauggugaaaccccgucucuacuaaaaauacaaaaauuaguuaggcaugauggugcgugccuguaaucccagcuacuugagaggcugaagcaggagaauggcuugaaccugggaggcggauguugcagugagccaagauugugccauugcaccuagccugggcaauaagagcgagacccugucucaaaaaaaaaaaaaaaaaaaaaaagaagcccaccucuccacaggcgccugggacacuaucaccuccauucacuccuagacuuugcucuugugauuugcugaucucucugugucaucauucauugcccaucccuuuauuuauuuauuuacuuacuuacuuauugagacggagucuugcucugucuugcccaggcuagagugcaguggcacgaucuuggcucacugcagccuccgccuccuggguucaagugauucuccugucucagccuccugaguagcugggacuacaggcgugugccaccacacuggcuaauucuguauuuuuaguagagacaggguuucgccauguuggccaggcuggccuugaacuccugaccucaggugaucugccugccugggccucccaaagugcuaggauuacaggugugagccaccacaccuggacuauuuuuuuaaaaaauuauuuuuauuuuuugagacagagucuugcucugucacccaggcuggagugcaguggcgugaucuuggcucacugaaaccucugccuccaggguucaagcgauucuccugccucagucuucugaguagcugagauuacaggcaugugcuaccacgccaagcuaauuuuuguauuuuuaguagagaugggguuucgccauguuggccaggcuggucuugaacuccugaucucaagugaucugcccgccuuggccucccaaaguguuaggauuacaggcaugagccaggccuuuuuauuuuucauuuuuguggguacauaguaguuguauuuauuuaugggguagaugaacuauuuugauauaggcaugcaauacguacucacaucaggguuaaugcguuauccauucccucuggcauuuauccuuucuuuguguuacagucuacuuauagucuuuuaguuguuuuacuuuauuauuaauuuuuugagacaaagucugucucuacuaccuaggcuggaguguaauggagugaucauggcuugccauagccucgaccuccugggcucaagugauccucccgucuuagccuuccaaguugggaccacaggcaugcaccaccauacccagcuaauuuuuuaaacaguuuuuuuguagagacaaggucucauuauguuuucuaggcuggucuugaacuccugggcucaagcgauccucccaccucagccucccaaaguaucgagauuacaggcaugagucaucgugccuggcuaguauuuuauuuuauuuuauauuuuauuguauuauuuuauuuuauuuuugagagagucucacucuguugcccaugcuggagugcaguggugcaaucucggcucacugcaaccuccgccucccggguucaagcgauucuccugccucagccucccgaguagcugggaauacaggcaugcaccaccaugccuagcuaauuuuuguauuuuuauuucuuuuuuuugagacagaauuucgcucuugucacccaggcuggagugcaaugacgcgaucuuggcucacagcaaccucccccuccuggguucaagugauucucuugccucagccucccaaguagcugggacuucaggcauaggccaccaugccuagcuaauuuuuguauuuuuuguagggacaggguuugguuucgccauguugcccaggcugcucucugucccucuuguucccauuuuucagccuuuccauuuacuguccccuuugccugggacaccacagccucgcugagucauaugguaucuuucaacucucagcuucgcuguccccuccugcagaaggccuuccgccaccagccgguuuacagggcuuaccacacccugcucacucccacacccuucagaccacagauuauaaccugcaauuacuucguguauuucguuauuugcaucugccccuucccacuggacuaucagcccccacagugggcucucuguuuuguucacugcuguaccuucaggaccagggcagugccugacacacaguagguacucauacucauuugucaagugaaggaagcaucaugaaaacuaagaggcugggcgccguggcucaugccuauaaucccagcacuuugggaggcugaggcaggagaaucgcuugaaccugggaggcggagguugcagugagccgagagcaugccacugcacuccagccugggugacagaaugagacucugucacaaaaaaaaaaaaaaaaaaaagaaaugagacuaucgccauuuugcaaucucuaaugaaugaauaugucugaguguugagcagaaacagcugcuggcaucuggaaaggaggugccuccugguggagguauacaguagccccacauaggaagguucuggcuaaaaaacuccuuacacccaaaucugaaucugcucgaacuuuggcugagucccacuuuggaggaaacccaggggacacaggaacacaugaaaugacaccacaaggacgcauuggucagguccagacuaugggaagcucuacaacuaggacagcacuauccacugauagacuuagugugaaaaaagaaugaaaaaugucgagcuaaucauuuuuuagauugauuauggccaggcacaguggcucuugccuguaaucccagcaccuuggguggcugaggaggguggauugcuugagcacaggaguuugagaccagccugggcaacauggcaagaccccaucucuauaaauaaauaaacaggauugauuccauguugaaauaauauccugaguguacuagauuauguguaguguuucauuuuacuuuuuuuuuuuuuuaacagagucuugcucaguugcccagguugaaguacagugccaugaacauggcucacugcagcauuaaccuccaagguucaagagauccuccugccucagccuccccaguaacugggacuacagauaugcacuacuacaccugguuauuuuuuaaaguuuuuauagagauaggguuuugcuguguuacgcaggcuggcucaaacuccuggccucaagugauccucccgccuuggccucccaaagugcugggauuacaggcacgagccaccaugccgguccucuuuuuacuuuuuaaaaaacauggcuauuagaaaauuuaaaauuauggugacucacgccuguaaucccagcacuuucggagggugaggagggcagaucacuuuaggccaggaguuugagacuacccuggccaacauggcgaaaccuugucucuacuaaaaauacaaaaauuagccaggugugguggcgcaugccuguaaucccagcuacucaggaggcugaggcaggagaaucacuugaaccugacagguggagguuacagugagcugagauugccccacugcacuccagccuggacaacagagugagacccugucucaaaaaaaagaagaaaauuuaaaaauauacauauugcucauauuguauuucuguuggacaguaaagaucugcaggacuggaucuccaggagauaaauugcaaggaaaaagaaaagauaauagaggggaagcaagagaugaaagaugauuuuaaaaaguaucagccaauugcaauggguggcccuuguuuggauucugauuuaaagaagcuacaaaaaauccugauaguuacaugaaaguuaugagauuuggaaauuugcacacucacuagauauuugaugauuuaaaggacugugacuuuuuuauuuguacuguuuuauuuuggguuaggagugaugacauugugguuuguuaaauaaaaggaacgucuuuuaaggccacacacacauacacacacacgugcgcacacacacaugcauuuuuuuuuuuuuuuuuuugaggcagggucucacucuguugcucaggcuggaguggagugcagugguguguucaggacucacugcgaccucaacuucucgguccucccaccucagccucgcaaguagcuaggacuacaggcaugugccaccacacucggcuaauuuuuuguauuuuuaguggagacaggguuucgccauguugcccaggcucuucucaaacaccuggacucaaacaguccacucucuuggaccucccaaaguacugggauuacaggcgugacccaccgugucuggccaagaccauauauauuuuaugauaccauuuauaugcaguguucagaauaggcaaaucuauagaggcagaaagaucagugguuaccgggggcuggggugggggaagugggaaaugacugcuaauggguaugggguucguuuucaaaggaugauuaaaauguucuaaaauuagauugcagggauggcuucauaauucugugaacacacuauaaaccacugaacuguacauuuuaaauggguggauuuuaugguauguacauucuauuucaguaaagacacuuuaaaaaggaaguguuuuaauuaagagacaaauaaaauuugcagauaggaaaacaaugaagauaaccucaagacuguuuacugaccaggaauaaaucaguaaccuaaaaugugguuucuguugggugaggugacucauuccuguaaucccagcgcuuugggaggcugaggcaggaggaucccuuaaacccaggaguucaagaccagccugggcaacauagggagaccucaucucuguuaauauaauuaaacauuuaaauaaauaaauaaauaaaaugugauuucaaacaccagaaagggccuuccaagcuauaguagauguuuugaaaucuacaaaguacuucaucaaugaagaugugauuuguaaacugucaagaacucuggcaaccaugaagaacuugggaaauuauagaacaaugcuacuuauuuuuuuuuucuuuugagacugagucuuguucugucgcccaggcaggagugcaguggcgcaaucucagcucacugcaaccucuaacucccggguucaagcaauucucugccucagccucccaagcagcugggauuacaggugcaugccaccaugcccgcuauuuuuucguauuuuuaguagagaugggguuucaccguguuggucaggcuggucucgaacuccugaccucaggugauccacaugccucagccucucaaaguguagcaagaguaauuguuauagccagcauugcuuuaggcccaaauacuacagccuuccucagcacauuucccuccaucugcuggaacucugcaguaaaacauguacaaauguaaaaugucugugguauaaaugacauccuugugcagugcacaaugggugcaacuauccaugacagcccugacugcaacauggguuguauagcaaaacauugggaauaaagccaguguccaucaacaaggaauagcaaauaaaccauaauauacacacagcguggaauauuggacaccuguaaaaaagaaugacgacacuuccuauaucuccagaauauguuauuaaauaaugcagaccagugauguuauaccuauuauguacaaaacgagaaaaacaaaaauaucuguuuguauuuucauuuaaaaaaugauggaaggauacaaaagaaacuaacgaaagggcuuuaccaugguagauguggggaagaguggauuggaaaagagcaggaguaagacuucucacuucacgccuugcuguauuuugauaaauguuuuuuugagacaaagucuugugcucuguugcccaggcuggagugcagugguacaaucaugguucacugcagccuugaccuucugggcucaaaggauccucccagcucagucagccuccagaggagcugggacuacaggugcacaccuccacauccagcuaauuuuuugauuuuuuuuuuuuuagcaauggggucuugcuauauuguccaggcuggucuugaacuccuggccucaagcaauccuccugccuuggccuccuaaagugcuggaauuacuggugugagccacagcaccuggcuauauuuugauuuuuuuuuuuuuuuuuuugauauggagucacacucugucacccaggcuggagugcaguggcgugaucucagcucacugcaaucucugccucccaggcucaagggauucuccugccuuagccuccugaguagccgggauuacaggcaccugccaccaugcuuggcuaauuucuguauuuuuaguagagauggggagguucgccauguugcccaggcuggucuugaacuucugaccucaagugaucugccugccuuggccucccaaaguguugagauuacaggcgugagccacugugcccagccuauauuuugauuuuuaaaaucgugaguaauuauauauucaaaaaauaaaaugaauacacuuuucccaguugcagauuauaacuuuguguaacagauguugagcuguaaaaugucagguaggugacauuaaacccugugaucugugcagccccagucaggagagaucauuacucauuuucaauugugaaucauguguacuuuagcuccugcaaaugcuuuuugcuucucuuguagccaccccagacucucucccuaaaccugccaggcucgagaguagggcugagacccccagccagggcccagcccccaggaagugcucacugacuaucgauuagaccagauuaacagaugaaucugaaggcaguguacucugaggccagaccgccugaggucuaacccuaaccuugucacuuauuaagaugggugaccuuaagcauguccguuuaaucucccugugccucaguuuccacauccauaaaaugggaauaaaaagcaauccuggccaggcgcgguggcucacgccuguaaucccagcacuuugggaggccgaggcagguggaucaugaggucaggagaucgagaccaccuuggccaacauggugaagcccgucucuacuaaaaauacaaaaauuagcugggugugguggcgcaugccuguaguccagcuacucgggaagcuaaggcagaagaaucgcuugaacccaggaagcggaguuugcagugagccgagaucacaucacugcacuccagccuggugacagagugagacuccuccaucucaaaaaaaaaaaagcaguccugcugggcaugguagcuuaugcugguaaucccagcacuuugggagccugaggugggcugauugcuucaguccuggaguucaagaccagcuagggcaacaugucaaaccccgucucuaaaauaaauaaauaaauaaaaguagccgggugugguggcacacaccuggagucccaguuacuugggaggcuaagguaggaggaucaccugagccugggagguggaggcuacagugaguugugaucacgccacugcacuccagacugacugauaaagcaagacccugucucaaagaagcaaaacaaaacaaaaauguuuuaccauguaggguugcuguaaggacuaaaugagcaaauucauuuauacgcagggcacagagugagaauaugguaacuaugagcucuucaugaagguggagggcucaggcacagugaaggguaagaggcuaggagggaucagcugggaggcaggguccgaaggaugugaggcucagguucagggaagcaggcauugccccucaggguuggggagggaaacgaaaaggccagcugugacaaaggcugccaagaugacaagucagaggggacagucagagguaaagaggucacugaugaucuuggucagaggaguuucaggagccugacagggacggaagccggcaagccccgaaucagggaaggagugggaggugagaacagaugaucaagggcagaugacucuugcaaggcguggcugagaagcagagagacacagugaggcucuugggggacaacuggaaggcauggggcacuuugauuuuaacucagggaacccugagcuuaccuaagugcagauggccagucacagcugcaacccauagacuaagaagccaugggccaggugcaguggcucacaccuguaaucccagcacucugggaggcugaggcgggcggaucacuugagguugggaauuugaaaccagccugaccaucacuugaggucgggaguucgagaccagccugaccaacauggugaaacccccgucucuacuaaaaauacaaaauuagccaggcaugguggugcauaccuguaaucccagcgacuugggaggcugaggcagaagaaucacugaacccaggaggcggagguugcagugagccaagaucauaccauugcacuccagccugggcaacaagagcaaaacuccgucucaaaaaaaaaaaaaaaaaaaaaaaaaaaaaaaaaaaaaaagccgugaauccacacugauauaaaugaauggaugaaugagaaaaugaaaugaaauggacaagaaggaaacacucuuucuuacaguaaaauggugccuagugaugguaaagcauacggcgaaaugagaaaaccaccauuugucagcuacuagaggaauaauuguuucaggcaagaaucaucaauggaugaugaccccagaguuagcagaauauuuacauagccucaaaguauauccucaugagacacuuauugauuccaaagggaauaacaguaacuucauuguggagccccuggugaacaccgaguuaaccaagccauccaaguuaacaacaguaaugggaagagacauuggccaggugcagugacucacaccuguaaucccagcacuuuggguggcugaggcaggaggaucgccugagcccagggggucaaggaugcagugagcuaggauuguuugacugcacuccagccggggcaauagagcaagacucugacucuaaaaacaaauaaauaagaaaauaaacaguaaugggaugaaaccacaugugccuccuaauacauuacacugaggacacaucacuucucugauauuccugcaaaagaugcauaacccuagucugauaaugaugaaaacucagacaaacccacacugaacgacauuuuacaaaacaguuugccugcguucuucaaacaugucaggaaagauaaagacagacccaggcacaguuccagacugaaggaggaaaacagacagaacaccuaaauacaaucccugguucuggguuggcaaagaaaagacauugacgaaagaaauuuauucaacaagggaaacugaauaaggucuaggauuagauagcagcauugugccaauguuaauuuccugauuagcauaauuguccugugcuuagguaggagaaugaauuuguucucaggagauacacgcugaaguguuucaaaguaaagggaaauuggcuaggcgaggugguucaugcuuguaaucccagcacuuugggaggccgaggcaggcagaucacuugaggccaggaguucaagaccagccuggccaacauggugaaaucccaucucuacuaaaaauacaacacacacacacacacacacacacacacacacacacacacacacacacacaaauuuagcugggcaugguggugcgugccuguaaucccagcuacucaggaggcugaggcaggagaaucgcuugaacccaggaggcggagguugcacugagcugagauugcaccacugcacuccagccugggcaacaagagcaaaacuccgucucaaaaaaaaaaaaaaaaaaaaaaaaggaaaggaaagggaaaucaugauggaguaaauaguaaauagaaaacauuugggcaaugugggugaaagguauucagaaauucuaugugcuguucuugcaacgucucuauaaaccugaaguuauuucaaaauaaaaaguuaacaaaaugguaacauuaaagaucagggaguaguaauagcagcuaacaucucuugaggacucaccauauuccagguacugcccgcacugcccauccucacaauaguuaauaguuguuuuauuuuuauuuuuauagauacaggguuucacuagguugcccaggcugaucucgaacucuugggcucaagcgauccucccaccucggccucccaaauugcugggauuauaggcaugaaccaccgcacacugccaauaguuagugguuaaugugauuauccuauccccauuuuacagaguaggaaacugaggcucagaagaaaagauggagaguuaggaugggagaggugguuagaggaggaggaguggguuucugaauaaggauguuccagcacuucccuccuagcaggcucauuauuuagacuuggaauggucuaguuagugacugccucccccauuagacuauaaacccaugaaagcacgggcugugucuaucuuggucauugaugcgucaauagugucacuacaggcccuacacagagaagaaagccagccaauguuuauugauggaauaacugaugccuauucacaauaaugauaauguuaugacuaucaauaaagauaacaguaauaacgguucucaucuguguuaaugcauuucauccucaaaauaacccaagggggcugagcgagguggcucaugccuauaaucccagcacuuugggaggccaagguaggagaauuguuggagcccaagaguucaagaggagccuggguaauguagugagaccacaucucuacaaaaaauaaacuuaaaaauuagccaggcaugaugucacacacccgucgucccaacuacucaggaggcugaggugggaggauugcuuaagccaggaggucaaggcugcagugagcuaugaucacgccacugcacuccagccugggcaacagagaaagaccuugucucuaaaaugaaauaaaacagaauacauauaacccaaggacuguuuuauccucauuuuacaaacaaggaaagugaggcuugcagagaugucucuugccugaggcagccagccagaaggguauggcuggcccuuggcaaccccacccaaguccugggcccacacgaugucccacacccaccuucuggaaguccuucuuggagaugaggccacggggauccguuacguaguccuggaaggcuucagagcccacaauguccuugaguuucaggaacaugucgaagaacuugaggaucaucuccacauuggaugaggauuccacgagcauguccaccaucugccgggcgaucaugccguucaccacguucccugcaggcagccccaggucaguguggccggugaacacucccuucuggggccccaccaggcuugccucucuuuccagcccaggagccaccacgcugcuggagugucccuggccagccacagccuccccuccacaggucccuuccugaccugcgucagccuccugugccaaccuggcugauccugccuuugcccaccucccccaguaaagcuaaugaugucaggucggacgugguggcucacgccuguaaucccagcacuuugggagaccgagguggguggaucacuugaggccaggaguuugagaccagccuggccaacauggugaaaccccgucucuauuaaaaauacaaaaucagcugggcgugguggcaugugcuuguauuuccagcuacuugggaggcugaggcacgagaauugcuugaaccugggaggcggagguugcagagccgagaucgugccacugcacuccagccugggugauggagugagacucugucucaaaaaaaaaaaaaaagauaaugaugauguacgcuaaagguaggugccaaaugcuacccuggcacaaucacacaaaaagggaagugugugacucuacuuuuaggaagagaaacugagacauagagaaagucaugcacucaaaguuacauagccaguaaaguggggagaauggauuugaacucagagcugcaugaccucagggcuuacacaacuaaaacuuccaccaguacacacagucaggaggguccacagaagacugaggcuagccagugguaagcagcaaggagagguagagauuggcaaacugcgaucccacacucccucuaaaggcagcagcugaagcuuggcuccaguuuauuuuuguaauuuuuaaauuuuaauguaggcugggcgcaguggcucaagucuguaaucccagcacuuugggaggcugaggcgggaggaucacgaagucaggagauccagaccauccugaccaacauggugaaaccccgucucuacuaaaaauacaaaaaaaaaaaaaaaaaaauuagccaggugugguggcgggcgccuguagucccagcuaccggggaggccaagcaggagaauggcgugaaccugggaggcggagcuugcagugagccgagaucgcgccaccgcaccuccagccugagcggcagagcgagacuccgucucagaaaagaaaaaaaaaaaaaagggauccuaauauauccacauucaucaauuguuuaucuuuugccacauuuggacauuugguuuguuuuugggguuuguuuuuuugagacagggucuugcucugucacccaggcuggagugcaguggugugaucacagcucacugcagccuggaccucccgggcucuggugauccucccaccucagccucccgaguagcugggucuacaggcacacaccaccacacuaggcuaauuuuuguauuuuuaguagagacagggucucaccauguugcccaggcuggucucaaacuccugacuucaggugaucuucccaccucggccucccaaagugcugggauuacagguguagccaccgcaucuggccuauuauggcuucuucaucaacccauggauccugacacgaugucagaugggguugaggauuagggucucccgggucucagggggccauucucaggcuucucugaaccucuuuacuguucccucacccucacuccuggguguuuaccuucuaguagcgacagcaacaucaccaccauguccuucugcagauccagcagcuccuucagcagcucgaucuggcuugaguccuagagaucccagcucggugagggcuggucucagcauacaccucccccaccucuguugcuucucccccuccucaccuacccagcagggccuaaacccguuuucuccccucuuaccuccgaggggacccgaguccagacauguuccucggaagcaggggaaggggcagagagacaagauugugggggugggguuggcacuugggggacgggcucgauaggugauggguagugggaaggcuggcagacaaggaggacugagaggcuugcggggcagacauuuggggcagagagagacagagacagacagagacaaacacuggggacagagacccaggucuaggaagggaugugagcccagcacugugccuggccuacggugggauugacagauguauguugaauauaaugugugauggcaagagugggacucuggguucaggaggaaggcugcagagacagccaugugcuuucugguaagccgucugcggggaacauagggccacaguguagggcccauagaaaccuccaauacaaaguuuugccucauggccccuauuuauguuagguugagucacauaaaauugccaacaugugaucacuuuuggcucacaaagugguaauuucuuucuuuuugagacagaguuuugcucuuguugcccaggccggaauguaauggcgcaaucucggcucacugcaacuucugccucccagguucaagcaauuccccugccuaagccucucgaguagcuggauuacaggcaugcgccaccauacccagcuaauuuuuuacuuuuaacagagaugggguuucuccauguuggugaggcuggucucgaacuccugaccucaggugaucugcccgccuagggcucccagagugcugggauuacagguaugagccaccgugccagauccaaagugguaauuucauaugguuccaccaaauaaaauggagaggggaggagaugauaccagauaaaugggauguaaggaucuuuugcucccaugcuaguucuaucaguuguugauuccaauccuaauguauuuccacaguuccaaagcucugcauucugcgccuaaggucccgacacuccuaaucucaagaucuuacagugggugggcgccugugguuugugccuacccaugauucagucccccuccucucuuuacaaucccucaauuuucaccugcggagucccccaucccacagucagagcacauggggcuaacccuaccuccugguucuauagguggguauaugaccgggccuggucagucaaagcuuucuuuccuaagccuaugaugauugguucagggagggacaugugacccaauaggcuagucagagagaaucucagguuuuuuuuuuucuuggagcuuucaggaaagaggagaucucuucccucuagggcuguuaagaaguagaguggauaggagccugaggcaccauuuuuuccagcccagggagacagccugcuugcaaaugcagucaaagaggaggcaguucugcugacaucacucuaagcccuggaucuguaauaugaacugauaaauucuuuauuuuucuuaagccaccacuuugcacuggauuucuagcuuuugcaaccuagacuagaugguggcggaugaauuagcccugcaggauuuggaauucuacaugaugauaccaacacucucuagaauuuuaggauaccaacagcacaacuucagcugcugugacacggaggaauugcauucuaaguuuaacuccuuuuaaaaagucagaugacaacgaauuaggguuucugccagccccuggggcaccuuugagcaaauuagaaaaaaaggcguccccuaaaacacuuccuguagggaaguuauaacaugcuggaugcuuuacugccaucugcuggaaaacuaaacuauuguaauaaauacaccauuauguguaggaugugaaugcucucagagaucgugccuuugugcagugcacgaccugcggaacaguauauggcagccuugaauauaguuaccagacagaagcagagcaaauggauuaaguguucgugagacauuggcaaggcugcaaaggggugagggaaagaggaacaaggauuauggaaauggaagguggugcucaacagggaccuuacaucaugaaugccugauaugggugucaucugccgcaaguaagauaaagaagcaaaacauuuccucagccccaggcucuaaucuagaaaccagccccauccuagcccaaggacuguccacaucugcgaugacucaucagagagaaaaacagcaaucaaucauagaggagcuccggccauugggacggggccaacacgucagaccaauggaagcguggauggaaaaccagcugauugguggggagggaggggcagaggaggaggcggggucaugcagacagccaauccagaaagaggauggauuuggccacugagagggaaccagucuggaacaugccgggagcacucgggugacaaacugaccaaaggggcaagacuuggaaauggaccacuugggggacgcccggaagcagguggauggagaccagaggggcucgaaccugagcgagcuucaucaucaugugggcgaacacgugcaggaaucccaccacugcgucccauaggcgacugugcgccaggcucugcugguucccggugcagggacccugggaggcagagugccgugugggggggaagggaauccccgagaagggaucagggaucacgaugcgggacccccucccuucccacucccgccccagggggagcgcccuaccuggauguacucagugaggcuguugaacaccugcuuagccaccgacauggcuuuggagaaguuccucuugcccugcucuucaaugacauccuugcccgaguaguaccaguagaagucgcugauggauuccuggugggggcggguagggugugagggggugcuggggccgaccauggcccugcagcccccgacccaagucacaccugaaccgucucacguccucaccugcagccgcaggagguaguccacagugcaaaugaugauguuaauaguggucguguucccugucuguguccguagguaguucuggaaaucuggggagaugaaaagucauuuauccagcaccucccaugugcuaggggagaugaacagugggucauuuauucauuuaugcaauacucauguguugaguuccuauuguaugccagaaagcauaucaucaucaauuuauuuaauaacuaucaaguacuuacuaugugacagagaaagauggaugaucauuuauucauuugucuaaaaauacuggccggguggcucacgccuguaauuccagcacuuugggaggcccaggcaggcagaucaccugaggucaggaguuugagaccagccugaccaacauggugaaaccccgucucuacuaaaaauacaaaaauuagcugggugugguggugggcaccugcaauccuaacuacuugggaggcugaggcaggagaaucgcuucaaccccggaggcagagguugcagugaguggagaucucaccauugcaguccagccugggcaacaagauggaaaccccgucucaaaaauaaauaaauaaauaaauaaauaauuuuaaaauaggcugggagcgguggcucacaccuguaaucccagcacuuugggaggcccagguggguggaucacuugaggucaggaguuugagaccagccuggccaacauggugaaaucccgucucuacuaaaaaaaauacaaaauuagccaggugugguggcaugugccuguaaucccagcuaccugggaggcugaggcaggagaauugcuugaacccggaaggcagagguugcagugagccuagaucaugccacugcacuccagcuugggcaacaagagugaaacuccgucucaaaaaauaaauaaauauaaaaaaauaaaauauaaauauuauugagggccugcuaugugucaaaugugguggagcgucauuuauucauucaguuuuuuccaacaaauuuguauauugaccaccaacuauguagcagggagaaauagagauucaguuccucguuaguuuccaaacaauuuuaucaaauuccuccuaugugcuggggauauucaugcauuuauccaacaaauauuuauugagcaccuacuaaaggccagggaacauauggauuggucacuuguucauuuauucaacauauuuuauugaguguauacuacauccucacgagauuaagauugucacauccucuuugcuacaacaaauuuguugcguucuuacuaugugucaugcaguauucuaggcucuggggauacaguaguaaaaaaaaaaaaaacaguccccggccuugggggggauuuuuuuuuuuuuuugacaaggucucccucuguugccuagguuggaguacuguggcaugaucauagcucacugcagccuugaccuccuggguucaagugguccucccaccucagccucccagguagcuggaacuauaggugugagccaccacauccggccaauuuuuaauuuuuuuguugagaccagcccaggcuggucucgaacuccuggccucaagcaacccuccuaccuugaccucccauagugcugggauuacagacaugagccguauguccagccccugcccuugugaaguuuauauucuugugcaguaauuuuuuaaucuuuucugacugcaaucuaugguaggaaauccuuuuuuuuuugagauacagucuugcucugucacccaggcuggagugcaguggcaugaucucaguucacugcaaacucugccucccagguucaagcaauucuccugccucagccuccugaguagcugggauuacaggcaugcgccaccacgcccggcuaauuuuuuugcauuuuuaguagagacaggguuucaccauauuggacaggcuggucuccaacuccugaccuugugauccaccugccucggccucccaaagugcugggauuacagguguaagccaccacacccagccgaggaaauccuuuuuacauugagaccugauacauguguucaaucugaaauuauauucaccuauucccgaaagagaaguuucacauugccuuacucugugccaugcauucuguucuuuucuguccuguacugcucuaguuaacuacaaaagaagaagugugugcuucucauccucucaaccuuggcugcacaucaggacaacuaggaggcuuuuaaaaaccccagugcucaggcccaaccccagaucaauugaauuagaaccuguaaaggcaaaaccugggcuuaagucucuuuuaaagcuccccaggcaugccaguguacaauuacaaugagaaccucugcgugaaacugauucaugaacgucugucugauggguugguucccacuauuuaaaaaacauuguucugugaaagcaaacuguuaaagcugagugauggguaguuggggguuuauuauacuguaauauaugauuggagguuuauuacacuguaguauaugauuggagguuuauuacacuguaguauaugauuggagguuuauuacacuguaguauaugauuggagguuuauuacacuguaguauaugauuggagguuuauuacacuguaguauaugauuggagguuuauuacacuuuaguauaugauuggagguuuauuacacuguaguauaugauuggagguuuauuacacuguaguauaugauuggagguuuauuacacuguaguauaugauuggagguuuauuacacuguaguauaugauuggagguuuauuacacuguaguauaugauuggagguuuauuacacuguaguauaugauuggagguuuauuacacuguaguauaugauuggagauuuauuacacuguaguauaugauuggagguuuauuacacuguaguauaugauuggagguuuauuacacuguaguauaugauuggagguuuauuauacuguaguauaugauuggagguuuauuauacuguaguauaugauuggagguuuauuauacuguaguauaugauuggagguuuauuauacuguaguauaugauuggagguuuauuauacuguaguauaugauuggagguuuauuauacuguaguauaugauuuuuuuuuuuuuugguagagacagggucuccuuauguugcccagacuugucuugaacugcugggcucaagugauccuccugccucagccuccuaaagugcugggauuacaggcaugagccacagugcccagccaaguccuuuuaaauguuuauagcaacaucauguugcacaggaagguuuuaacagccccugaaaguauuuuugccccccguuuuucuuuccccuuaacuuuuuuacagucaguucacaauugcucuaucagguuggcucaacagaaggcccauuuugccuaguuucaugacauagacaaagcauacucaaauauucaaaauuuuauaagcaaagguacagguuuucccaucaacccugcuuucuaacuccuuuauuuguguuaauuuaaauuguuaaauuaaauuguguuaauuuaaauugggcuauaugcaaaaauaaaagauacacagcuccuguaaaaaaaauucuggcaacugacaacaccuguuauagacaugugcaaauaagugagagacaaaccuuuugucugcuuugaauagcacugacuccucaagacaugcaaggggucugagauuugaaagauauuucaaauaucuauuugauuaggucaugaauuuaggcgaggacuggguugcaaauauguugggagacagcaaucccuuucauaacaacauucucauuuucaaaacuucauauuccugaggaauaaaauuuauuuuaaacccaaagacugauuccaucuuaguuaaaauuaaagaaugaaaaucuuagucccggcuggguaugguggcucacaccuguaaucccagcauuuuaggaggccaaggcaggaggauugcuugaauccaggaguuugagauccccugggcaacacagugagaucucaucucuacaaaaaauaaaaaacuuagccagacauggugaugcaugccuguaguccuggauacucgggaggcugagggguggauuacuugagcccaggaggcagagguugcagcgagcugugaucacaccacugcacuccagucugggcgacaagagugagacucugucuaaaaaaaaaaaaaaaaaaaagaaaaaaucuuagucccauggcacaaagguauuuaauaaaccuugaaaaacucguuguggacacaagagcuuuugaaaauucaagacaaagagaucauacuuuauccuuuguugaaagaaaaagaaugaagauuaaagauauuuacaaaucaguuaccuuaaagagcacuaaccaagugggugaagguucuauggaaguaagauuacuaauuacuccaauucuugucacgaaaguugauuuccggguagucugugguuuccuaaucaccugcuaaagguuauaaccacaaucuugagacuguacauguuuguuauaggaaauggcauuggguagaauguuuuuugugcagaauuuugucuguucuguaaaguuguaagcuagguuugcugcaugagacugcauuucucaucauugauguuguguaauuaauuugcugucauccucaaucuuguuaaauuggcugaaccacaacaaaacaaaacucuugcuuaagauaggaaagaaucuguaggccuuuguacagaucuuuccucugcaaagauuuuauaagcaaaauaaacaagugauucuaauagauuuauuuuuaaaugccaggcaguuuuuucccuuaggucuuuucuggaccuaaaguacagaaauccaccacguguauagaacuuuggcagccacugcagagcgccugugggaaaauagcaugugacaaauuguccauuugggcaaauugauuuuuggccaaauugguuuuuggcagguugcuuuuggggaauuggacuggccagaggagaugagggggaaacaaaguggcuagauuccagaaauuccagcgagguuuuuuuuugagauggaguuuugcucuguugcccaggcuggagugcaauggugcgaucuuggcucacugcaaccuccaucucauggguucaagcgauucuccugccucagccuccugaguagcugggacuacaagcaugugccaccacgcccugcuauuuuuuuuauauuuuuaguagagacgggguuucaccauguuggccaggcuggucucgaacuccugaccucaggagauccaccagccuuugccucccaaagugcugugauuauaggccugagucacugcgcccagccuccagagagauuuugaaagcuagguggauugacacuggcuggagaguggccaucauugaccgggggaggaggaggggcggaaacuaauucagucaacccuuccguaccagccccaaaccucggcuuccccuccaccccacaccccuccuccucaccauuauugugccccucacagagcaauuguaggaaucggaacaggucuugugugaauucaucauccgccaugaccuucucuccuagguggaagggaggggacagggcccaggaggggucagaugcgccaagacacagcgcacacaugcacaaggcccaugcacacugcacacgcaugcacaaagcaugggggugcugggaggagcagcugccacuccaaagacacugugagggccaugggcauccaugacgccaggcggucuugaccucagagcccaugacaucagcagacggagacccaaggggcccugagucaugaagcuggggccucaagugucuuucuacaucagugcccucugaugucaccacuuguguuacguucgggagagucugcugaccuagcagacauucaggcagcugguaaugcccucagccccccuucagaccguggagguuaauggauuauggggguuugggucaccuucacacaaaggcucugggcaggggaagauugggcugggagggauaagggauggggauugaaagccagccaauuggcccagaugccuugaaagcagccaauccaggaguagcacaggggaggcguguaaacaagggccaaucagaaugggcaucugaaagaagcaaaucauggugggcgguaggggaggaggcuagaccgcaaaugggccaaccagagcaggcacagaggaggcaggcgcagaggaggcaggcgcacaccaaucagaguggaugccggaggcaaccaauucgguugguggaugggaaacgcugacugaccaaucugaggucggggugcagagagcagaguaggugggaguggggaucacuccacaccgggacugcgaaucugggucuggaaguccgacaauauccagcuggaaagagaucuuuaccauguucucuagcuucugcuucacacauggggaaagugaagcuuagggaagguaagagacuuguucacaggcccauguauucucaguggcugaucugggaccugaaucaugcuccccagacuccugaucuccagguuuugcacuggcagggugcaccugcugaagggucccucccuccccuccacgucccagauccucagccccuagguggagggguggacgggguuaggaggggugggugacagcagcacagcacgggggugggcugggggaauuaccguucuggcgauugaugacuggggcagccaacaggaugggaggaggaagcaggagaaaagagagaaaaagagagggagacagaccgcaaacacacacaaugacagucagggacagagacacagaaagacacacagagagagaggaacaacccacagagagaaaggcagagugauaaggagacagaaggaaauggauuagcagggaagaggguaggaaaugaggguaaaagcagagggaaugaaagaagaggauggagagggagagagagagaugaagacauagagguagaaaggcaggagcgaggauccggguagaaagguuagacacgucacaacacggcaaagaggagacgcgauuaacccggauuagggacauuaauaagagaacagcaaccagggcgugacauuuggggcacguggagggugggguccauguagugaugggugagaacacaagacagaaugacuucugguggcgggggggggcggaggugggugguggacauggggagggagaccccagggggauggagggggugggacugggggaccacagcagagggagggacccgagggagcccuugggaaccagugucuuggaggaagggagcucugggcaauggcggguggggguggggugggaggaaucccaaaggaagaugucucagggggugggaagcccaagggagggccucaccagugccauccucauucaccaugcccagccccucggccuuguucugucucucaaaggcauugagauccaggacgcugaggaaaagaaaggaaagauaggggguaugugaugaagccucugcccuccucucucccagggccuggcagcuccccaccaugguagccuggagagccacaguaaaccaucuaugcgcugaaaucaagaggaagcagaaaugaagaguuggcagaagcuaggacauaugguugggccaggaugaaccaugcgcaagcugaaauaaugaggaaccagaaaccacccauuuagcaaaagcugcagaggguaggaaaaaucagccggcagcaagaggugaauaaaggcagacaacaguagaggcagauuaauugggaucaucagagagcuccuaaaucucccacugccaaguuccccuuaaauucucaaguuuuugguuccacugucuggaauucauaaugcaacucauucuucaagucuaugacauuuugccucccuuauuguucuacauuaauucuuauaauaaauucccuguuauuugagcgauucugagugagucucuuucccuggacugaaagagcagaaucagaacuggaaaugguaccaggagugggguggcaguggcaccaaacacagcuuaacaagaagagguccacucgaaccuaccugcauguuugcaucagugccuggauacucuggaagaagccaacuuccuucuuguccuuaagauaauccagcauuuucugcagagggcgaggcaggggaggagaaacugggagucacacaggaaccucucaucccuccuugccuucuucugaagucccuuugccucuguuaccugcuggaccucagcauugccuccauugaggauggagaugcccagcuucaggguggaggacaccauggcaccugucucuccuggagggagugggagaaaaaagaugguccacccaguuggaaggcaguguguuccacccaccagaaaacagccaucccaagggaugugagagaaggggauuuaagagugugccaaggugugcaugcaggggugaucgugauugaaggaugagugagaaauugcaaggcagguauacaaggggaagcugcaagggcuggggugugcgugcaaaccacaggcauugaggggcggcaaauggguccacagggaaugggcgagccaggaggagugagguuaggaugagugcacucggaagaguccagugcacaugugaggggcaccuuugcaggcacugaucaucugcagcaccaucucggccgccccccgggugugcagccgugcuugcugguacaagagccucugcuucuccaucuguuucuccugggaagggaggcagacacaugaaggcaaguccaggcuuuccagcccagccuuucccccucacauucucacuucugcccucccuguuccagccacauccacaacucacuccuucaaccaugagcucccuccauccccuggggcucacacccucgauguaucuccuguaccuagcacggggcuaggcauuaggcaagaucuacauaaaucagagcugggcaugcagcagucuuaaccugggcccaugggccuccaggccaucugugaacuuggaugaugaaaaguuacauuuuuauguuuuccgcccucuaacagaaaugaagcauuuccuuccuauauggaugaagccauaaaucacagcgauauuagcagaaccuguggcuuugucaccaauaaaaaucacagauguggcugggcaagguggcucacaucuguaaucccagcacuuugggaggccgaggcagggagaucacgaggucaagaggucaagacuauccuggcuaacacagugaaaccccgccucuacuaaaaauacaaaaaauuagccaggcgugguggcaugagccuguaguccuagcuacuugggaggcugaggcaggagaauugcuugaacccgggagguggagguugcagugagcugagaucacgccacugcacuccauccagccugggcgacacagcgagacucugucucaaaaaaaaaaaaaaaaaaaauuacagaugguuccauaucacauuauuauugcuguauauuccauaucacauuauuguugcagaauuagaaccauuuccuauucaaauucugcucuuuugguccaggaagagagacucacucacaauggcucaaagaugucuuuaaauaucaguuauguucaucacuacuucucaauuauaguagcuguuggaucuacugcuagaucuuuuuuuuuuuuuuuugagauggagucucgcccaggcuggagugcaauggcgugaucucggcucacugcaacuuccaccucgcggguucaagcgauucuccugccucaaccuccugaguagcugggauuacaggugccugccaccaugcccagcucauuuuuguauuuuuaguagagaugggguuucaccauguuggccaggcuggucuugaacuccuggccucaggugauccacccgccuuggccucccaaagugcuggaauuacaagugugagccacugcgcccagccuuagaucuuauuugauagauuaacaauguacaaguauuacuggaucacaaauucauuuuuaaaauauuuugauagcuauucaauacuuguuuccucugcuaugaauucauuuuauacauuuaaaaacaugauccugagaaagucuucaccagaugccagaagggacucuggcacagaaacagugaagaaaacuaugaaguaaaugcuugcuaacugucucaaugaaugaauggaucggugaauugcauguuuacuagcucuuucuugcugccuggccuuggcauauacuauucucccuacguagaacauuuuucucuuuuucuucaacuggcaggcuccuuuuauccuucugcucagaaguccccuccuccgagaagcccucccugauacauuuuccugcaggcugggucaggcaccuuguuugggcugcuuuaucccccugagguucccccaucuuggcccugaccccucugccuguauccccaucaucccaacccugaccccucugccugagccuccucaaucccagcccugaccccucugccugagccuccccaauuccagcccugaccccucugccugagcuucccccaugaccaugguguacacuccgugguguuaguuuggcggguguaucugucuccccaguggacugacuuggucacugcuguguccccagagcuuugcucugugaacacaugcugaaugaaugggagaugacugcagucagggucccccaucccuucccuccaggaccuccugagcccaccuaccucaaaggagaccucaaccuccucuucagcuucaccguucuccccucccuccuccagguggcagcucuggggagggggcaucaguuaagggaugaacaaagcagaccccuccaucccgccccagcccuuuuuguggacaagcacugcagguggggagagggaaaucugccccagaagagggggguagggccucaccuuugccaugauaucagcauaggccauguacagguaauccucauccaguuugcuggggaaguaagcaggggaguggucaggacccgguggagaggacccccaucuuauaagagcuucugggcagggugcgguggcucaugccuguaaucccaacacucugggaggcugaggcaggcagaucacuugagaucaggagucugaaaccaaccuagccaacauggugaaaccccgucucuacuaaaaguacaaaaaauuagccgggugugauggugcuugccuguaaucccagcuacucgggaggcugaggcaggagaauugcuugaacccgggaggcagagguugcagugagcugacauugcgccaccguacuccagccugggugacagagcaagacuccaucucaaaaaaaaaaaaaaaaagagcuucugguuuucuuuggagggccaacccuccccauguucaggcugugugacucagguggcuggaguggccauugccaggguggcuugugacaaaugcauggccgaugaggacuuuuaucuguguggccaugaugacagguaagaaauggucauguuguccaugcuguccaguaaaauccauucugggaguuguuuuguuuguuuauuuuguucuugagacagggucuugcucuguuggccaagcuggagugcaguggugccaucaaggcuuacugcagccucaaccucccaggcucaagugaucucccacaucagccuccugaguaguugggacuacaggcacauaccaacacaccuggcuaauuuuuccauuuuuuuguagagacagggucuugcuauguugcccaggcuggucucaaacuccuggccucccaaaguacuggaauuacaggugugagccaccgcgccuggcccauucagugagguuugcuggagcuaaugguggaggcacucccuuuccacuggggaugcuaaaauggagugauggaaggcuggagcucccagagccaucuugccaccugucagcucaauaacaaguauggccaaucccuuucugcuugggucuccucuacaauggccaacaccugcugaguguuuacacuaacaccaugucagugccuguucuaggugccuuguauauauuaacaaacugacccucacagucauccaauuggguggguauguuaauagcccuauuuuaucggugggggaacuaagauacaaagacccuucucggcugggaucacacagcuugcgcugggacucaacuuggauggccaaacuccagagccaucgcucucccacaggaugcaaaaugggaugcucaaauucuucaucaccuugcagcccgagauggccuuaugucagaauuucuggccaaugagaucuguguggaagcucaccagagagauaaagagaccaaagaaggcugggcgcgguggcucgugccuguaaucccagcacuuugggaggcuaaggugggcagaucaccugaggucaggaguuugagaccagccuggacaacauggcgaaacccugucucuacuaaaaauacaaaaaaaaaaaaaaaaaagagaaagaaaaaagaaaaauagcugggcaugguggcaugcaccuguaaucccagcuacucggaaggcugaggcaggagaaucgcuugaacccgggagguggagauugcagcgagccgagauugcgccauugcacuccagccugggcaacaagagcaaaacuccgucucaaaaaaaaaagagagagagaccaaagaucuugcugagggugaagaguggggacccuuuguccuucuuucugccuggcauguggcugugaugccuagaagugcagcauccacccaggacuacagacaaaagcuaagaagggcagagcagaaagcuagaaagacccugggccccugucagugucccugugccacugcccaguccugaagucuuuagcucuugacuucacguuauguaagaaaaacaaaucccugacaggcgcgguggcucaugccuguaaucccaacacuuugggaggcugaguggggaggauugcuugaguucaggaguuugagaccggccugggcaacauagugagacccccaucucuaccagaaaaaaaaaaaaaaaauagccaggcauggaggcacgugccuguagucccagcuacucaggagguugaggcaggaggaucucuugagccuggggugauguggaguggggggucugagcugcaaugagcuaugauaugacacugcauuccagccugggcaagaagagcaagaucuucucaaaaaauaaaaaaguaggccaggugcaguggcucacgccuguagucccagcacuuugagaggccaaggcgggaagaucacuugaggucaggaguuugagacaagcauggccaacauggugaaagcccgucucuacuaaaaauacaaaaauuagcugggcguaguggugggcgccuguaaucccacuugcuugaaccugggaggcggagguugcagugagcugagauugugccacugcacuccagccugggugacagagcgagacuccaucucaaaaauaaauaaauaaauaaauaaacaaaaugaaaaauaaaucccugugccuucauucccuuauccacacaaaggagaugcaauaauccgucucacaguguggcgguuaagugagaggauauagauauccccgcuuagcuuggugccugacacauaauaagcauuugaugaauggcugccugcuacugucagcagcagcggcagcagcugcgccaucugcaucacaauuauuuauuacuaagccugucauuagccuacaugaagcuuuugagggaauuacagaaaaccuccccacuacuucugucuguuggaaauuugucauacauauggauuuuuuucauaauauacugauuuuauuugagcaagacacuuucuucuagaaaagccuaguuaaucuacauugucugugauacgaaccccucagacaugcccuugugaaguguucagccaugcaacgguguauguuggcugugccuguccuagcaaagugacauuuacguuccuuuucuuuucuuuuugagacagagucucgcucugucgcccaggcuggagugcagugguaugaucucggcucacugcaaccuccgccucccagguucaagcgauucuuccgccucagccuccugaguagaugggauuacaagugcccaccaccaagccuggcuauuuauuguauuuuuguagaaacgggguuuugccauauuggccaggcuggucuugaacuccugggcucaagugauugccugccucagccucccagauugcugggacuacaggcgugagccaccgugccugaccagcaaagugauauuuaaagauccgucugucuugggcucccccaggaccuggagggccucuccugaggcacagggaagcugcugggcuggggguggccccaggaccuugggggcauuucuggggcccuggcaagagucuucaccucuuuuccgucagggcagugcggcugaagugcaggaccaacuggugcagggggucuggcuucuucucuuccaccucuuccuccuccuccuccugcuccccagcuuucuggugggagaggggagacuuggggagaggguuucuagaguccccuccugucacugcccccaugucccuguuggucuggauuuuuuuuucucuuuucccacauccugcgcccuacuuugguucuacucaagccaggagcuggcauuucuauaccccuugauguggagggccgaccccuggaggugugccaaggguggccuccgccccagcccuauccagcucgccccccacucccccaggcgggucccagcucacugaaaggucaucuaucaugcgguccucaaaacuguggucuucagucaggauccaugcagccuuguagcucuccaggaacauguuacaugcccggugccugcaggggagaggugugacgucacugggacgcgcccuccuccgugcuucccgaccucccaugcgccugcagcccccaaccacccucaaggccccaucacguuggcccuccauucuccagacucuccagccacccuuucuccgcagcccuucacgcuucccuugucccugggggccuuacgugggcagguuguacaggggcgucauacggaaacaggccacgacugcccgccggcgcuguuuggacaaaagcuugugccacacggccuucuuagacuuguaagggugcucggucuggggaggggauagcaggacagucacauccccagacccugccccucucacucccagcccuggaugaaacugcccagcugugucgaaguccauauucagguuaagacucacacggcagaaggaaaaccuugucuccaccaacagagucaggguccugacuccgccuccagaccuaaguuuccauccuaggccaggucccacagagccaggaccacgagccaggccacgaccaauucuacgacccacccaaggcccugcccacaaacucaacgcaucuccucuaggccccaccccuagaccuaaagaucugccccuucccugucccgcccccagaugcaagauuaagcagcagaccccucccccgauccauucuaagccucgccuuaaacucgaggcuccaccuccugcccugccccaaaacuuaauagucaucuccagaccccacccacauccuugaagccccuccccccgccaggcuccgcccagagacccaguagaaagaccccuccggccccacccaccugguccagguaguagagcacggcugacacuuccuggacucugcgcacgauuuucucggggucaucggcguccuccucgcgacccgggacgccccgguacagagccaucugccagcgcagagacggggagccuucgaccugaagggaggaagaaggaguggccggcgugagggacccuucccacaguguccgccggauguccccuuuccguuuuugggaggacucaaugggugagugcauguugaggccuuucuucuucuucaucuuuuuguuuugagacggagccucgccccaucacccaggcuggagugcaguggugcgaucucagcucacugcaaccucugccuccugggcucaagcgauucuccugcuucagccuccugaguagccgggacuacaggcacccgccaucacacccagcuaauuuuguacuuuuaguagagacgggguuucaccacguuggccaggcuggucucgaacuccuaaccucaggugaucugcccgccuuggccuuccaaaguguugggauuacaggcaugagccauugugcccggccuaauuguuguauuuuuaguagaaacaugguuucgccacauuggccaggcuggucucaaacuccugaccuuugaggucuuucuucaaugccuggucuuugguaaaugcucaaaccuucacuaauauugugguuacuuucugacuugcuucuuuugcuugcagaggaaggaggcauaccuuucccugaaggugaagguuguugugcagaaauucccggaccuccucaucugugucuuucuggggagacagagccaggcugggucacucuggaggucccauccuccuuccugacccacaacccuuuccuuccaggcccagcaccccaggaacugaagagguuuuucuggggugggggugggggucugagagaaacaaaaggaugcagagguugacggggucagaagggguccuagaggggccggagggucacagagucaccuugaagauacaguaaggauucgaggggccucguggaggucugggaagaggcaaagggugacaagaggaucucaucaaaggucaaauauggccaaagagggaugacuggggggucagaguggggcagggagucuuugaagaucagaaggggucagcagaggucaugggggaucacguaggucaacggagucacugguuacacaggggccaaagggggcaucagcaggguggggguucacugggguucuaggacggggagcccucaaggaccaaggugagggguccauggagcccuggagggcucucuggcguccuggcaggacucagcaguccugggaggugccugagguucugagggaagggguguccuggugguagcaggggagaagucgguggucuuuagggguccaggggguuaguagguugucaggguguuggugugguccuggggggagggcuauaggggucuuggggcagaauccugggaggguuccuuagagucccugaagcuggaaaggaucggagaggagggagauuguccuuguugucccacacaagggguaaguggggucccgggaggccuccuugauaucccagcaagcuuaagagguucuacagcccggguauuuuggucuccaggacaguugagaccucagagguuuggguacagucccgggcuugggguucauggauccuggggaguuaugcagggucgcagggcucccugagccccugagagucuugggggcuuaguugggcuucaacagggcccaggugucagcaggguccugaaggaaagggauggugagccaagggcucagcaggaacccagagguucagucuuggcagggagggaaggaggggucaugagggucucaguaggucccaaggggcuugaaggggccuugguggaggguucagaggaucucaggggcucaucuuguuggggggacucucagggucucagcagguuuggcaugguccggugggggggcagugggguccugcaguccucaugcgggucccagggguccuagagcuuuucuagguuucagugagggcucuuaggucuguggugcccuggcaauaucuugaacgggguccucagggcaucccaggggcacagugaguccucagcaucccggaaaagaacucaguggggucugaagggaaggcucccagggaccuggggggcucaguggcauugugguuguucccuaaggucccagggguucagugggugcugggcggcauccuggaagguuccgaggacggggcugggcaggcaccagggcguaacgggucuuggccagcgugaugaggucuuggucggugggcgcacacauauucaggccgaugggcagcaucuucuucaguguggccacgaucagugacgucugcacagaguaccgguccccccggcgcuucuucuuggugcguuccugguccgagccaccggacuguggggacacagggcucagcaccagcccaagccccaaucccaugccucagccccaacccgcggccaucauccacaccccaggccccagucuggacaccaggcacucccuccccaacugccgacgacaccucaauuuccaccccagacuugcugacucuacacuucaggcccacagccaugaccggagacccuccagacccaaguccacaacccaaauucccaguuucuuguuuuuuaaacaaauuuauuuuuagagauggugucuugccauguugcccaggcuggacuugaacucuuggcuucaagugauccuccugccucagccucccaaguagcugggacuacaggcacauaccaccaugcuugccuggcuccaauuucuaacccaggcccauccagauuuucccccguucugggccugucucaacuucuagcaguccucuuccagaauccccuaggaaccccaguacaauacccccuccacagcaugcacaaccccacacuucacaucccaaaaccaaguucucaagaaugaaacaaagaugcagguccacaaagaguucaagcgacaagagaaguugcaagaaaaagacacugagagacugaaaaagacaaggagacaggaagaccaaagaugcaagagacauccagaaagaucuggaagcagagacacagggcacagagucccacagccguguucuggagccuugggugcagacccggggccagggccaccccagucacgccagcgagaagcccugaugacaagcuuuugggcagagccacauccacgccggcuggcaacuuugagcaugaccccugugccaggcacugcugcaggccacacaugcagcuucucccugaguccucgcagagcccuggggugggggcugcuggcuggaugcccucagaggcucaaaaggaugaccccaaccaaggucacacggcuaacuaucaagacaggauucuaaccccaguccauacaguccagagcccaagcuuuaaaccauccacggcgagggugcugcccccuccccaaccaugcuccgugugccucucccacccccauuacccuugaccucagcccacgaugcuuugguaaaagcugagaguugcucuuuuuuucuuuuuuuuuuuuuuuuugggaacaaaaguccagaaaaaaaaaaggaaagaagaaaaagaaaagaagucaaauugccaaaagcugaggguugggaugggaacggaugggggugguggggagggaagggaagggaaggaggaugggugggggcugggaggggaggacggggguggggaacagaagcagggguuuucucgaggcgggggcgugcagaggcugggggaagagggcauuagccaagagacaugcggaaggucccagauguggggcugaccuguauaucucccgccugcuucaccggaccgcagacagagacaagaaggguuaccccagccccgcagagaagcccaggcccaacuccaaguugccagcaccccaccuccucugccccacccgccauguauucucuagcugggcauuuccaggccuuggcucgggguggggggucguucucugagaccugagaagggcagugcugagaaggauagggaggaaagcaggaaaugggguaauggggagaggaagaaagaaauggaagagggggaaaauggggaggaggaggaggagggaaaugggaggagagagaggcuuggagaagaggaaaauggagaggagggaaaugggaggagggagaagauacaggaggaggaaggagacagagaugagagaagagggagauggagaggaggagggagaugggaggagggagaagauacaggaggaggaaggagcuggggaggaagggagagggagaggagguaagaggggcugcucugaggacugcagggauugcgcccaggacgggcuggcugggugaggacaggccagguaggaaguccuagagggugcucccgcccucucugccaagugcuccucccagaaccaagccccgaccuuagccauuuugcuuuuguugucagcagucaggaaggacauguuguugaucucauucuggaccacaaaguucugcuccucgcgcuugaaguucuggugggggaagcaguguugcagaccggacaggugaaggcaggcgccugugggcugcggcuccucugguuguggggagggcgguuggggugggcacucacgugggacuuggaccaguagaugaagaucucgcccaccauccugaacagcuccuccgcgcugggauucggcuccgucagccacugcgcccuggggucagcggaggggaggugagggaggggguggggaucccagggaagggggcugcccagagagagaucuuggaggaggagauggggaccaggagacauccagucagagggaugggguuucuagggucaucuggccaugcagaugaacauuaaaaaaauuuuuuuucucugucucagccucccgaguagcugggacuacaggggcccgacaccacaccgggcuaauuuuuguauuuuuaguagagacgggguuucaccauguugggcacgcuggucuugaacucuugaccuuacgugauccacccaccucggccucccaaagugcugggauuacagguguaagccacugugcccagcugaacauuuaaaauuuuuuaacgauccauucucucucucucucucucuuucuuucuuucugagacagggucucaaucugucaggcuggaguacagugaugcgaucuccacucacugcaaccucaaccucccaggcuuaagugauccucccacuucagccucccugaguagcugggacuacaggugcacgucaccaugcccaggccuggcuaauguuuuauuuuauuuuuuguaggaagagggucucccuagguuguccaggcuggucuugaacuccugggcucaagagauccucuuucccugaccucucaaagugcugggauuacaggugugagccaccuucccuggccugacuauuccuuuuuuaaaaaacuuugucuaaccuuuucaucgaaauacauaaauauaauacaugcaugcaauacauagacacacaugauacauacauauguauuauauaaccuacauauuaagaaauaucaaccuggugaauuaucacaaaugaacacacuuguguagccagcaccgaagucaagaaauaggacauuucuggucccuggaaguacuaucauggccccucccagccacucccccuuccuccuccugaaaaaucauccauauucuaacuucuaggcuaaaaacuuuuuaaaauuuuuucuuucagcugggcgcaguggcucaugccuguaaucccagcacuuugggaggccgaggcgggcagaucacgaggucaggagaucgagaccauccuggcuaacacggugaaaccucaucucuacuaaaaaauacaaaaaaauuagccgggugugguggcaggcaccuguggucccagcuacucaggaggcugaggcaggagaauggcgugaacccgggagguggagcuugcagugagcagagaucgcaccacugcaccccagccugggcgagacuccaucucaaaaaaaaaaaaaaaaauuuucuuuuuuucuuuuuugagacagggucucgcucugucgcccaggcuggagugcaguggugugaucucagcucacugcaacuucugccucccagguuccaagugauucuccugccucagccucccacucaggaguacuuagcugggacuacagguaugcgccaccacgcccggcuaauuuuuguauuuucaguagagacaggguuuuugcauguugcccaggcuggucucaaacuucugaguuugagacugaguuugagugauccacucucuuuggccacccaaagugcugggauuacagucacgagccacugcacccagcauaaaauuucuuuuuuuuuugagacagggucagaaucuaaguagguucacauauuuuauuuuauucauuuacuuguauuaaaaaaaaacaaaccuuauugagacagggucuaucucuguugcccagguuggagugcagcggugugaucauagcucacugcagcuuugaccuccugggcucaaacgauccucccaccucagccucccagucccagccugaggcaaggacuacaggugugugucaccaugccugacuaauuuuuguauuucuuuucuuuuuuuguagagacagggucuagccauguugccuaggcuggucucaaauuccugagcucaagugauccucccgccucagucucucaaagugcugggauuacaguuguaagccacugcacccggccccaaacuuauucuuaucugcucgugaacauuaaacagaugguaaaauauguaguuuauuucuugguuuucuggcuucuuucauuccaccuaacauuugugaaagccaaucacauugugcauagaaacaacuuguucacucccacugccguggagucuucuguuguaugaauaaaccacaauuuguucauauuuacugauugaaaaauugaacuauauccaacagcagagaaugucacacgaccaccaagacaaaagaggugaaucuauacaucuuuuuuuuuuuuuuuuuuuuuuuuuugagguggagccucgcucuguuccuaggcuggagugcagugacacgaucucagcucagugcaaccucugccucccaggcucaggcgauucuccugcuucagccucuggaguagcugggauuucaagccugcgucacuacgccuggcuaauuuuuguauucauaauagagacaggguuucgccacguuggccaggcuggucucaaacaccugaccucaggugaucugcccaccucggccucccaaagugcugggauuacaggcaugagccaccacacccggccuauaugucuuucaugguguauuguuguguuaaaaaaaaaaaaaaagcagcuaagugugguggcucacuucuguaaucccaacacuuugggaggcugaggugggaggaucacuugaccccgggaauucaagaccaaccugggcaacauagugagaccccauaaaaauacaagaauuagccgagcauguuggugugagucuauaaucccagcuacucaggggcagaagcagaggaucgcuugaacccaggaaccgaggcugcagcaagccaugaucaugccacagcacuccagccugggcaacagagagagacccugucucaauaaaaaaaaaaaaaaaaaaagcaaacuauuccuuacgguguugugcauagugacaaagaaaucgacacaaucuaaauguccagcauuaggagaaugauuuaaaaaaaaucacacuggccagcugcauuggcucacagcuguaaucccagcacuuugggaggccgaggcaggcaaaucaugaggucaagaguucaagaccagccuggccaacauggugaaaaucugucucuacuaaaaauacgaaacuuagcugggcgugguggcaugcaccuguaauccuagcuacugggaaggcugaggcaggagaaucacuugaacccgggagguggagguuacagugagccgagaucgcgccacugcauuccagccugggcaauaaagcgaggcucugucuccaaaaacaaaaacaaacaaaaaaaaacccaaaaaccaaaaacaaaaagaaacaaacaagugggcuggcugucguuggaccaaugugcucaaagccagaagaaaccaggaggaagagucagaagguugguggggccagagcauuggaagaaguuucuagccagucaggaggcggagaucagauggggcuggaggacgugggaggucggggcggagggcauggggacagcggggccccgcugaccuguuguuguccacguagcggaugagcagcggauacagggcguagaggucccggcagagcacagagaacucgucccgcaccagcagcucgcccuccugggccuccgccuuggccuccaggcgcagcugcuccuccucggacaccaccuucccugcccucuugcgcagccgcccgauaguugggaugaagugggacugcaggagcuccggccgugcacggcucacaaugggcugugcgaacacugcaggggugcgaugggcucugaugccaccuccggccucugacacaggccccaaacuccguucccagcccgacucccaaacagcaucuccaaccuagcagcugccauuugaccccagccugacccuaaccuuggauauagucccugaacacugaucccagccauagccccuaaccugaaccuaagacccagucccuauccugugaccccagccuggcacaaaucccugaccucugacccccaacaacagacgccucaccuguuaccuaacuuuuuuuuuuuuuuugagacagaguuucacucuugucacccagacuggagugcaauggcgcaaucuuggcucacugcaaccucugccucccgaguucaagcgauuuuccugccucagccccgaguagcugggauuacaggcgucugccaccacacccagcuaacuuuuguauuuuugguagagaugggguuucaccauguuggccaggcuggucucgaacuccugaccucaggagauccacccgccucggccucccauagugcugggauuacaggcgugagccacugcaccuggccuguuaccucacccuuaacuagcaugaccccugaccccaaucuuuaaccucugaccuggcccauacccagagucuuaccucacuaugugauuucuggcuaugaccccaagguugugaaugggcuucuuaccccagccucuggccccuuacccuggccucugaucccagcuccugauuucuagguugacccugaucuacaaccuguuuccuuacacaaauauuucuuuuuuuuuuuuuuuuuuuuuuaaauaauagagacgagguuucaccauguugcccaggcuagucuugaacuccuggucucaagugauccacccaccuuggccucucaaagugcugggauuacaggcaugagccauugugccuggcccugacaugaaacuucugaaucaggaaaccuaacgcuuugaggauccauuucuuccuuccuuccuuccugccuuccuuccuucuuuccuucccuuuuauucccucccucucucacuccauccuuccuucuuucuuuccuuuuguuuuguuuguuuguuuugagagaguaucucacucugucacccaggcuggaguacaguggugcaaucacagcucacugcagccuccaacuccugggcucaagagauccuccugccucagccucccaaguagcugggacuauaagcaugugccaccacaccuggcuaauuaaaaaaaaguuuuguuuuguuuuuuaaagagauggggucgugcuauguuaccuaggcuggucgcaaauggcuggccucaacugauccucccaaaguguugguguuacagcugugagccacggugcccagcugaccccuggucuuuugaugcugaaaaaaccuacacucugacuccucccaacuccgaggggaccaugggucucccuuucagaccaucugccaagggagcccaggcugcugacccaccccucagaggcccagugccccccgacccaccagccagccgcuucauccaggaggccucgucaaugcccagguuguugacgaugauucucaggauauuccccagcagggaguugagguggucagaggugacagcugugcagggugggggggcgccggcgggcagggcggaagggggugccucgggcccgcgcucccaccaucggggcagguagcugcauagcaugggcagcgugaucucgaugacaugcggcaucucuguguagcgggcaccugacucggccagccccccaaugucugccaugagccgcuccagcaccgggaugucgggacacaucuccuccacacuguuggggagccccaggacugggguacagggacgggggcagggaaugucaagccaucacccccagaccucagugcccuggccucccccgcaauacaucagacaccauugaauugccaccccccuuaaacagucucccaaacccuauucuucccaucucacccuccaacccaacuaccucucccaacccucacauugaaacucaguggccccgcaaacacuucacacccccgagccugucugcucccuaaaaucucaccccuagaaaccuucccuccuaaaaucucccacaucccaagcccauuccccucaccccugcuguacagcauacuccaaaagagaccuuuuccaaccccacccugucuccccgccuugucucucugaaucccacacccgguucagucccuugaaaccgacaaccugucacuugcucacuugcugacucugggccaggugccauucugggagaacagcugaccaagaagacaaguuuccugccuuggagcguauauuucccccagguccacaccucauucuagccucuggacccaggacucaggggauuuuugucuguuuuaucuguucacugcugaaccucaggugacuaggacagcgccucauacauaguaacugcucgauacauauuugcugaaugaaugaaugaacccugccuucccucaauccucuuaugcucaaauaccccucacccuaugucuccaagcuugaugaugcccucaaaugucaccaucacuaaaauaaauuccauagcuccaaauuccauggaugggguuuugcuauguugcccagguuggucuugaacuccuggacucaagcaauccuccuaccuuggccucccaaaguacugggauuacaggcgugacccacugcgccuggccaccaagugcuacuuuucuuaacuuuuaucaauagauucuguuuucaaaaaucaaauuaaucucuaaauucuccccauguaacggccuugaaaugcccccgaaccauaaacucugggguuccugaauguguggcacucccaaccuggggaauccucagccgcucacagcccagcccagccacacuacccccaaauuagggucuccccaaggcccugugcuggggagauuuggacucccagcacugcucccgccccacacagcuuacuggcccgcucccgcggagacuuggugguguacacggagcaggcguuguacucguucagcugcggcuccaggaacgccaccggcauggcugcugccagacgggccaggcacuccccgagggcuggccgaagccuggaagacggggcuguguuuagcugccacgugucccccucuuugggguccugggucccagccccaucuccauagaaacggcuccucccagaacccuuugggacagagcugccauucauccaugugugccacuuguuuuguuuuuuaagacagggucucgcucuguuacucaggcugcagugcaguggccugaucuuggcucacagcaaccucacauuccuggguucaagugauccucccaccucagccuccugagucgcugggauuacaggcacacaccauaccaugccuagcuaguuuuaaaaaaagucguuuuuguagagaugcagucucccuaugcugcucaggcuggagcucaagcgauccccccaucucagccuuaggaguagguggauuuacaggcaccagcgccacuacaccacaccacaccaggcuaauuaaaaaaaauuuuuuuuuguagagauggagucucacuauguugcccaggcuggucucaaacuccugagcucaagugaucuucccgccucagccucccaaagugcucacaggugugagccaccgcgcaccgcuggugucacuugaaaucugaauaacuucagagcugguggaaacagccgcagccucgcucuugcuguaucaguaaucucagcucagaagcggucacauggccacugccaggggcccuccccagugaccccaguguugcguggcuccugugugcagcccccguggucugcgccucccuuucuuccccagcgaggccugccugcuucacagccccagaccuggcggcucuaccuccguggcugaccugucccugagcgcccucacgcggccgccguggggaaccgcggcugccgccgugugcgggaaaauucuuaacaucuacccugcuuuucacccaccccaucuucuuccccugcucccucccuuccccuccagccccacccagccccaaacgauggcucccucuccuuacuuuuccacauaaguguucuuggugguucccagggaguagauacugcacagcguucgguagcaagagaccuggacgucguccacugagggagacagggggcgaggcugcggcaugcgcucacaagacaagcccuccccaccccaccucccuugucucaaauaggcccaugcaguggggaagagcaagcagauguacagccagccuuccauguacgagucuugugacuugagcaaguuaccaacucucucucagccucagcuucccuaccuguaacauggggauaguuauaguaccuuccucacgggguggucgugaguaucaaaugaguuacuacuuggaaagccacuagaacggggcacacaguaggcacucaauaaaggcuagauguuguuucuuccguggagaggacucauggcccucuauaaugaaagugagggguacuuccuccagaaaaaugcaaacagaacugcaauauugcugcaauuuuaggcuaucuuuuucauuuuauuuaaaauguauauauuuuuaggguuggcgcagaggcucaugccuguaaucccagcacuuuggaggcugagguggacggaucaccugaggucaggaguucgagaccagccugggcaacauggugaaaccccaucucuacuaaaaauacaaaaauuaucugaguguguuggugaaugccuguaaucccagcuacucggggggcugaggcaggagaaucacuugaacccgggaggcagagguugcagugagcugagauugcgccacugcacuccagccugggugacagaccgagacucugucucaaaaaaaaaaaaaaaauuaaaaaaaaauuuuuuuagagauggggucucaguauguugcccaggcugaucucaaacuccuggucucaagugauuugcccaccucggccucccaaagugcugggauuacaggugcgagccacugugcccagaccaauuuuagguuaaccacaugcccuccagaaggccaaguuaagaagcucaucaugaggcaaaaagagggcggggcuauucuagacuuuaaagacacuacagagacacaaccaccaaaugcagcaggagaaacuugacuggauucugaauuucuuuuaaaaaaaucaaagacauuuuguggguaaugagggaaauuuaaauaugguuagguuagguaugauaaugauaccgugguuacacaagagaagguuccuauucuaggaaagccagcugaugaacauuaagggaugagguuacccuggugugugcaacuuacacccaaaaguucaacaaaaaaaacuaaauacuuucaaccauacagugaaggguaggcacacagggcaaauuguuaacaauuuucuuuuuuuuuuuuugagauggagucuugcucugucgcccaagcuggagugcaguggugcaaucucagcucacugcaaccuccaccucccagauucaagcaguucuugugccucagccucccaaguagcugggacuacaggcgugagccaccaugccccgccaacaauuuucuucuuucuaccuuccuguauguuuugaaaauuucaaaauacaaaguuggaugggagaagaacccuauccaggugcuacuuuucuuuucuucuuuuuuuuaagaugggguuuugcuauguugcccagguuggucuugaaauccugggcucaagagaucuuccuaccuuggccucccaaagugcuggaauuacagauaugagucacuguggcuggccaccaacugcuacuuuucuuuucuuuuugagauggagucucgcucuguugcccaggcuggcgugcaauggcacgaucuuggugcacugcaaccuucgccuccuggguucaagcaauucuccugccucagccucccagguagcuaggauuauaggcgaccaccaccaugcccggcuaauuuuuguauuuuaguagagacaagguuucaucauguuggccaggcuggucuugaacuccugagcucaggugaucuguccgccuuggccucccaaagugcugggauuacaggcgugagccacugcgcucggccaagugcuacuuuuccuaaccuuuaucaauagacucucuuuuuuaacaucaaggacccuauuuuauuauuuauuuauuuuagagacagaauuuugcucuguuguccaggcuggagugcagugguaugaucauagcucauugcagccuccaacucuuggacucaagugauccucccuugucagccuccccaguagcugggauuacaggcaugugccuccaugccuggcuaaucuuuaaauuuuucuuuuuuuuuuuaguagagacagggucucgcuauguugcccaagcuggucuugaacuccugagcucaagcgguccuccugccucagccucccaaagugcuggaauuacaggugugagucacugcgccaguccacuuagggucuuuuguuagagcugcugagcucgcguccucauuaacucauuugccaccugccaagguacugacugcaugcuuugcuuacagcaagaaauccacacauucaaacacccagggacucucacaggcacccggaugggugguguuggccacacugacuccccgcaaccugcccuugggucaggcgcccuuacggaugacgucaucuccgaacuggugcugggcgaugugcuggaagaggguggugaggaccggcagcagugccacagugguguaggugagguucuggcccacgccuuucaccugggugcgcgccugcgacaccuugcccagccgcagguucuccaccaucuucucgauguccuccgaggcacucucgaagaaggagcggaggccagccuucacgaucucagggccugacuucaucacuguccuagaagggcagcgggggaacaucagcucuggaaucggagagucuaggagaccagggguuggggugggggcccgaugauggugggagugggcgccacugccuauggcccuaccuggcauccagggagcgggccaggaugugaagacaguugaccacagcuggggcgucugucccugggagaggaagaugggccggggggaugccauggcuaagaggacagaggacagugccucccucuacauccaccccaaccgcucucuuccugaggcuaccugcgggcuaaguuggaaugcuacugcacccccacccccccagacuccuacagcgccuccaaaugucccuccuccccagcccaaccacucuccuggccuuccuccugcccagcccugaccccacugggcuguccuugucuggagauaggucugucucucccacuggccugggagcuccauugagggcaggcccagggcaucucagucacugcccuaccccccggauaccugguccaugucuccagguccaggggaagaaaacaacaaagguuguucaaauuaaggcagaaccugggagcuauuucuucaggguggggaagagaaagauuagggaggaagaccgaagguguggagccacuuaccaaagagagagacucgguggcggacgagagcagcaaguuugcagaagaggcugaagaaagagaaagggacagaaggcaggagaaacagcgagugaggaggccaaggagacgaggacagcgugacccaauuagaggagacagggacagagaagacaaggagagaggaaccaggaggggguccaaaugauggagacaggagggaugggaaggggcagagagaugggcaagcuggaaugucacaggcaguaacugggaugcuggggaggugaggggugagucagccuuucuuauuauucuuuguuuguuuauuuuuuuuagacagggucuugcucugucacccaggcuggaguacaguggcacgaucccagcucccugcagccuccaacuccuggguucaagugauccucccgccucagccuccugaguagcugggacuacaggcaugcaccaccaagcccggcuaauuuuuguauuuuuuguagaaauggggucucaguauguugcccaggcuggccucaaacuccuggcuucaagugaucuucccaccucagcuucccaaaguguuggaauuacaggcaugagccaccacgcccggccuugaguuggccuuccuggacagggugaucgauuugucccaaguugccugagagucccacauccugggaaacccuucagucccggguacacuaggauggcuggucacccuucaaucgccuuugcaggagacggucaguacccaacacccagcacccaggacagagccuccaugggcaaaggauuacaauccugugaggucagggggcuggguccagggucacaggcggcccaccuggugaucauuuccuucuccuuguuagaggcguggccaccgcugcccagcacuuuagccggaguggacaagaaauagaggcagugguuggugaaguacugguugaucaaagggagcaggaucuggagacggguugggggagauaaaggguccaaugagggguggggagagccuaugaguccccagcgcccuccagcuucuaagcccaccucucaccuuggcaaagaauuuaaucuccuguucauguggggacuuuuccacucgcccacugcugaccacagccucuguagggagggcaaauaggguucacaguggguucaaggcuggggaacccaggguguucugaugggaaggaugcugggagcagaguugggaaaugaugggggauaaaguauugguaugaagucauuuguguuggcuuugagauaaaccuuucuccuaucuuucaucugauucccccaacuccuuuuuuuuuucuugucacccagacaggagugcaauggcacgaucucggcucacugcacucucugccuccugaguucaagcgauucuccugacucagccucccaaguagcugggauuacagacaugcucccacacaccaagcuaauuuuuguauuuuuaguacagccaagguuucaccauguuguccaggcuggucucaaacuucugaccucaggugauccacccgccucaaccucccaaugugcuuucccccaacuucuugaucaaauccuucuugaagcugacaacuccuugaucaaacccuuucugaagcugacaauggggaaaacaaacuggaauggguuaaggucauggaacaugcccuuccucacccaccauaagugcuuuucauucuaaacuugaauacauggcacugaguuaaucugcaauaaaugaaugaaugaaccaaaugaaacaagaagucaauguaaacaaauuagaguuaauuucaaaauggaaauaaauuucaaacaauaauaauggugacagucauaacugauacuauuaaaauaauaauacugggccgggcgcaguggcucacgccuguaaucccagcacuuugggaagccgaggcggguggaucacgaggucaggagaucgagaccauccuggccaacauggugaaaccccaucucuacuaaaaauacaaacacaaaaaauuaaccgggcaugguggcaggcgccuguagucccagcuacucgggaggcugaggcaggagaauggcgugaaucuggaggcggagccugcagugagcugagaucgcgccacugcaguccaaccugggugacagagcaagacuccgucucaaaaaaaaaaaaaaaaaaaauaauaauaauaauaauaauacuggcuccaauuauuaaacacuugcuauguccuuggcacugugagacaugucauccucacacagucuccuuacaacuuggaggucugugcaguugguucccaacccccauuuuucagaugaggaaacucaggugaaguaacuaaccccaggucacccaguaaguaacagaaccauggcuaguuauggugaacauaugcccauaucacaggugaggaaacugaggucuagagagggaagggaauugucagggggaugugcagcacugaagcucagcaggcaggcuuugaggugagacgugacagcgaauccugcucugccacucaccuggagggaauuuggggguuccugaggguagcucucaaggggaaugcuggggggggucucuaagggaaacuggaggggauuguagggccuagcuguaauucuuaguggccuguaagaggcacuggggggcaccccagcagccucagccuucaaaauagauccagaaaucugcccaguucucacccuuuucggcuccuguccccaccccagucaagccagagggacccugugaacaccagaauuauggaucacgucccuccucggcucagcccccaacccccaacuccaucucauuccagguaaggucaaaguccucaucacagcuugcaaagcccugcaugaucugccccagucaccucugugaccucguuuaucucaccgucccccucgaugacucugcuucagcuacagggcauccugacacucacaccagggaccucucagggccuuugcacucgcuguuccuuugccugcaaggaacagaugcccccagagguccacacagcuccucucugaccuccuucauggcuugccucagauaucacauucucaucaaagucuuucuggaacacccuauuuaaaauuacaacuggcaagccgggugcgguggcucacgccuuuaaucccagcacuuugggaggccgaggcggcagaucacgaggucgagagaucgagaccauccuggccaacauggugaaaccccgucucuacuaaaaaauacaaaaaauuagcuggguguggcggcgcccgugccuguggucccagcuacucaggaggcugaggcaggagaaucgcuugaaaccagaaagcagagguugcagugagccgagaccgugccacugcacuccagccugggcagcaagaucgaaacucugucucaaaaauaaauaaauaaauaaaauaaaaaauaaaaauaaaauaaaaugaaauaaaauaaaauuacaacuggcuccacacucccaauccccucuaccuggcucuauuguuuucuucuucccauaacacugaucaccuucuaacacuaaacgauuuaguuauuuaugaugcuaauugccugaauccaacauaggaguaguugcaggagagcaggggucauuugucaucuucacugcuguaccccagcaucuagaacagugucuggcacauaguagaagcucaauaaacaucagauaaggggaggacggauugagugcaugaacagguguccuaggugagucuggucugcagaacuggugucugcagguggggcgggcauaagcgggggguauuucuccguacccaggugggcaaugaacuccugagaaauguccauccagcgcagcagcugcugcaggaagccaaaggcaaaccgcuuuucaauggaagacgaguccaguuccauguccuuaaggccucugcauggagauguggagagaaggaucagcccagacgccggcccuacaguuucccacccuucucagguccgccucugcuccugcuggccccgucucuaucagcuuuggcuucaccccagguuggggcuccacucugagucccccaugccccaccccacuuagccuucuccccucucuggccccaccucuguuccccagggccggccccucucagccuccuccccuuuggccccaccucuguuccccgggcccugcccuucucagcccuucucuccucuuuggucccgccuccacucaccaguccccgccccucuguaccuccccaccccucucuggccccgccugugcuccccagcccccgccccucucagccucuuccucuuuggcccuaccucuguuccccgggccccacccuuuucagccuucucuccucuuuggucccgccuccaaucaccgguccccgccccucucagucuccuccacucucuggccccgccucugcucccugggccccgcccuucucuuccuccucuccucucuggucccgccugugcuuaagccccgcccauuucgaacuccuccccaucuggccccgccucuguguccaggccccacucccuuagcuccuccccucugguuccaucuuugcuccucaggccccguuccucucggcuccaccccucucuggccccgccccuuccagccuuugccggguguguucugccugcugcucuuccgcgggagccccaacccgcgugccuuguaaccgcguagccauucaucugcaggaauuucaguagcuccugggccuucucucgaucucgugccuucuccuuggccgugagcgugucguaggggaccagcagggggugggucccaccgccuggggaggcaaagaccagaaaucagggcucuggggaagacccgggccacucucacugaagugguuccugcagugcccggcaugcguaauuauggugauaaagaagauacgaauaacggaaacauugcuugcuggugcucaucucauuaccccauggugguaaacgcuguuauuauucccaucuacagauggagaaaccgaguuucaggggcaugaaggcaaucagcaaaaccacacggugaauccacggggguagcgugggggcggcaugggcgcccucaccuuuggcuuccagcuccugcuucuucuuccguccccacguguugugguaauuuucugccaguuguucugccauggccugggaguggaugcagagucaagggcuagauucagaggaugccagcccccccaaagacacccuauguccccccaaaaggaucagggcucucaccugcagcucccgggacaggguaacagcacuaaggucggggggcugaggguuguagccuucucgaggaucauaggucugagaggacaaggggaagaugggaggugggcugaugggcuagcaggaagcccaggccagccccuccccaggccccacuaguccauucuacccccuccacccuccccuggcucaagaccccuuguccuuuccuuaaggcccugucucuaaaccaccccauccuucucuccucugcccuuugcaguucuucagaccccugcccucuccuuucccagaucucagguuucugcaccccucuugccccaccuaccucccugggccccucuccucuccaucccuucccugucuggccaugccccuuguucuagacccuccccccaucgugccccugcccuccacccaggccccgccuucaccugggcacuuugugauaucuuccgcguuuuuuucuuuuccgucuucuccuccucacccucccuggccuucucuaucguccauucccaggcaaucauggccuucagggacuccuugaugggccagcgguaaaucucuuuguccugggguggacaggaggguggggaguugguggaaugggaugagagagggguggaggaaggaccccaaaggagaaaacccugaccauguggcuaggcaaugguccagucuggauuccaacucaagucucuuaccugcucuguaacagagccucccaaacccaaucuccuuaucccauuagacacuugagucuccgagaagucuuacuacagccaaggaaucaaacccacucucucggagucucuacccacucuaccaaguuugagagaaggcaaaguccaugaauggggagaccuaacccacagauccaccuagaugcaaacaugugaaauugccucacuccuccccgaauccucaaauuuggggguuucauuuugacccucaaugcugggccccaaggccuggucaccuucucugaaaaggucuuguagggccucagcauggggugggucuucagcuccucgucuauguucucuccauaggaccaguuguucuggaucuagagauggaggggaggcagggugagggggaggcagcaguuggggacacacggggcgacccuggaggagccgaggacagagaauccugggggggucccagaacaagcuaagggucuuagggaaggcuggggggucucagggagaucuggggccucagggaagaaccaggucggggggaaagcuggggucuugaggguuucuuggauaggaggacccugaggccaaccuugucgaaggcccacuucucguguguguacuccgcaaacuuguuaaugaaggaguccagcuucuccgggaugaucacacuguugggggcacagggucagcagauguuggagcugggguucccuccaccccugaaaucuuccucucugucucccagcccccaggccucacuugagggucuccacaggccggggaucaaaguugccuucagcauccacuguggccuuuuucucugccuuagaugaguaugaggcauccacauagucggggggcagagccccggcaauggcgcacagacaaggcauggccaugcgguacagcuccgggucguauuucugggaaaaccgggugaagcagggguaggaggucgcuauaagccuuacugacccccaggaccucaaacucacacacugcaaucaucagcccuccucccugaaccccaaaccugaauuauggucccucuccuugaaacccaaaugucagucccaauuguaugcucaaaucauccccauauugcccucuccaagcucccaaacuagagguccacccccucuuucauaaccuccaaaucgaagccucaacccauagauccuccuagauccaaacuugcagaaccuucuccuccuugaaccccccaaaauugagggauuucacucuggacccccaauuuugggccccaaacccuccacauaggccauuuuggggcucccugcugcccagaccuuaugggccagagagucaaagaugccccagaagaguuuccgugugaggugcagcuccuccucugaggugaccccgaaguuggcccagcccguggguaggcaguaguacuuccaacagcgcucauagugguuggugaggagcugggugggaacaagagggggacacacaaaugaggggggcaccagcgaauggcaggcagacgaaggcccagagagacacaggcaugccagugcuuuuaaauuaugaaggagguguggguuaugcaaaugauaugcuaauaagggaagaaaugguauguuuauugaggagugguccuagacagcuuaguaugcaaauuuagcauucuuaauuuagaguuaaaaugggcauuaaacuagagcugguugugucugguauugcuuuacacaaauaagcgugcuaauauuaauccauggguauguagugaguaaaugggcauauggaugcagcaaucugugcuuauguaaauuaacauaccaaguagaaacaaaggcugcaccccaugcaaauauaugguaauugggaagagggccuccacuauccaaaaugcaaauuuuuuuuuuuuuuuugagguggagucucacucucuugaccaggcuggagugcaguggcacgaucucggcucacugcaaccuccgccucccagguucaagaaauucuccagccucagccuccagaguagcugggauuacaggcgugcuccacuaugccuggcuuauuuuuguaguuuuaguagagaugggguuucgccauguuggccaggcuggucucgaacuccugaccucaagugaucugcccaccucggccucccaaagugcugggauuacaggcgugagccaccgcgccuggcuaaaaugcaaauuugaaauaggagcugauuucgauguauuaugcaaaauagucaaaauaucugaguuggggguaucucuuuaugcaaauuagcaugcaaaugaaaaaauaagagagacagugugcaaauauucagaauagcugugauaauguuuauucaaauaaaugcacucauuugaauaguggaagucuggugguccaggcaugcaaauaaacaugcuaauuagggaaaguggugugcuccaugcaaauauaugcuaauugaagcgggggcuggcucacuguuaagcaaauuaaaugcuaauuagggaacgcuagaggcaucaaugaagcaaagugaauguucugggaauccuaguaugcaaauaaggaugcuaagagauuucuacggggacgcugcccuaacuagugcagguuuauugggcugggcagugccgacacaaaugagccccgcaguaggagggaagagcaaaccagugggugcggccuggaaaugagaugcuaaagagcgcuugcccucaccuugaguggcaucuuggcgaacucguugaggaugggcacgucgaacaccaggcggcgcaacaggugcugcagcaucgacgggcggauguaccugcgggacaaugcacaagauguagaaucccccguccaggcccgcucugcugccccugccccugcuccucccccugccccugccccugccccugccccugccccugccccugccccugccccugccccacccugaagccugccccgcuccaccugcagagcgacaugaggcaguccucgaugacgucacgcugcgccuuggugagcgaacgaccccgagacaggcgguacacgguaugcagcauagaguccaccaugauggcgcgguguucugugcccgcaaagagcggcgcacacuuggugaugagcggcagcacggccaggcacagguagcgguucagcgccagcgccaucucgguggugcugaaaguggccuagggcgcagggugaggacaucaggcccgcugcacaccccuggggcugcucuggcaccugucuugagcgacuguggccaaaggauccaagcuucugaugacucccccaaaaccugcuccucccaaucucuaccacccuccucccacccuaugcccacaccccuaugcccacagcccccaccccaccacuuacuacuuuggauuaugcaaaauuucaaacacacacaacuggucgaugagauuaaugaaccccauuacagauuuggcucuucuguaaauaucaauggucugcacgcuuaucuccucucuaacccucaucuuucuuccuguaauacauucuuuuucaucuguuagagacaggggucucugucgcccaggcuggagugcaguggugcaaucauagcucccugcagccucgaauuccugggcucaagugauccuccugccucagccucccuaguagcuaggacuacagggacgcaccuccaugccuggcuaauuuauuuuucuuuuuuuuuucugagauaaggucucgcucugucgcccaggcuggaaugcagagauguaaucaugguucacugcagccucaaugucugucccucaagugauucucccaccucagccucucuaguagaggggacuacaggugugcagcaccaugcccagcuaauauuuaaauuuuuuuuguagagacaggaucucuccauguugcccaggcuggucucaaaauccuggcuucaagcaacccacccgccucggccucccaaaguuauuacaggggugagccaccaugcacagccccaggcucucuuaaacccccucucggaaggcuucuguccccugcugaaacugcucauccccauuuccagugaccuugacuuugccaaaucgguggucacuucucagugcucaucuuccuugcccugucacccuucuguuauugcuguuccuguacagaguucugugugcccacaguaccaaaccaauacugcgaacaaaauauuuuuuuugagauggagucucgcuccauugccaggcgggagugcagcggcacgaucucggcucacugcaaccuccgccuccccgguucaagugauucuccugccucagccuccugaguagcugggauuacaagugugcgccaccacgucuggcuaauuuuuguacuuuuaguagagaugcgguuucaccauguuggucaggcuggucucgaacuccugaccuugugauccgcucgccucggcuccccaaagugcugggauuacaggcgcgagucaccacgccugaccucaaaugaugauuucuuauaacuggaggucuuggagauuccuacucacccuucaucggaauucaguguuucuucguuuucauuuucuaucuugaugaugguauuggggauuaugauauguccacaaucccaagaaaaacaaaagcagcugcugcugcucuaccgugacccaucuccugucccucuguggaaguggggaggguggccaggcugggcaggguugcucaccguguccagcgaggcggcugcccucaugucgggcaggaaccccacguccagcacgugcagcaagaaguccugguucucgaugccauacacacgguccaggaagagcaccauggacgccuugugguccggcacgaaggaugcugacaucuuuggcugcaccagagccccaucugcaggcagggaggguggguucggggaugcccugcggacccagccgcucccuccccagcaucacuccuucgccaaguuccauccccucugcaccuuugcccagggugggaaucugcagugggaggcugaugaugcccacaagguccuccaagggcacaagggagcggaggauggcgcggauccgcagggccucacccuugccggcuuggauuagcuggggaguagagggagggagaggggcacucaucaggcgcuggugccccacucagugacugcucugcucccucccuuaccacacaggaggguagagcaggccucuuucucaggaggcugucuagaguuuccagcccucguuccucugccugugcccccccaccccagucccgaccucucuccuuguuccccccaaccucauccugaccccucucccugcgaccccucauccuggccccgaccccuaucccugugaccccauccccauccugaccccucucccuguguuccccauccccauccugaguccucuccgugugcccugcaaucccagccccgaccccucuuccugugcucccccaucccagcccugaccacucugggugucacuguccgucucccccauuggacugggagcucugugagaccaggcccuggggcugucuuggucacuguuguguccccaacauugcuaguccaggaccacccacauaugggagcucacuccgugucaccgagugccugcaugaggcguucaaagcggcugugccugcccucccuucccauccugcccuggcucagggucucacaugcaucucuggugcacagcguccgagcaggucgaucaaggcggcauagaaggacaugauggcgugucccaggugcacccgguuuucuucaggcgguuccucaccaaagcugcagggaagguggguggguuggggaggcagccaggggccagggagggcggguugcccuauugaggagggggccgggagacucacugcucgcgccgccggucccugcggaugccugggccaucccucgcaggguccucggagaugcggauggccucuucgauggcagccagcagcccugagccacccucaccccgcagggcggguccgaagcacucaggcuuccggaugagcagccgcaccaccacauuggcguucuccuccacgcucucgccuggccacccgcauggggaaagggggucucaugagccaccaucagagaccuccccaugcagccccaggacccaacaccuccagggguaacacaggucccauccagcuccaggacccaacaccuccagagguaacaccaggccccugccagccccaggacccaacaccucuagggguaacaccaggcucccgccagccccaggauccaacacugccagccacaggacccaacaccuccagggguaacacaggccccugccagccccaggccugcuggaagggauuccugccuggaccccaucuguggcucagggugcgagcagucaucucgagggaggugugugaccagugacuccauacuucccgcucugccacugccacccccuccucaccguugacgaagacagcaaagcgcaggaaguccagguagcgcucuccaccacagggguuccagccaaugucuggguacccuuuggccacaagcauggggcagcucuggaggccacagccugccagguaggacacaaccugggggcagaaggggcucagucagagaccagacccaugccaccuuccuccuggggcucagcccucugcccugcccugcccugcccugcggcuccucaguccgguucagcucugaucccucggcccauuagcccugguccugucagaggccuguaaacuacagcaacuccaucuugaacaggagcuugagaccuacugggcugcauucccagaugguuaaggcauucuaagucacagaacaagauagaagguuggcacaagauacaggucauaaaguccuugcugauaaaauaggcugcaguaaagaagccggccaaaacccaccaaaaccaagauggcaacgagagugaccucuggucauccucacugcugcacucccaccagcgccacgacaguuuacaaaugucauggcaauaucagaaaguuacccuacaugguuuagaaaggggaggcaugaauaauccaccccuuguuaugcuaaacagcauaucaucaagaaauaacauaaaaaugggcaaccagcagcccuuggggcugcucugucuauggauuagccauucuuuuauuccuuuacuuuccuaauaaacuugcuuucacuuuacucuauggaguugcccugaauucuuucuuacaugagauccaagaaccuucucuuugggccuggauccagaccccuuuccuguagcgguucuguccacccuugucucccaccuggaccacaacacgagccuccucccuguccuucuguccuucugccuuccccucaaucuguuccccacacacagccagagggacccugugaacaccugagucaggucacgucccuccucugcucagaauccuggccuccucucacucaggguaaaagccagagcccuuguugugaccgaugagaugccacaugacccaccugucaccuccugcccucacccucacuaccucugcuccagccacagcugucuuucugcuguuccuccagcuuaugagguuugcuccugccucagggccuuugcacuggcuguucccgcugccuagaaugcucuuccccaugaugaccaccugaccugucaccuuccuucagagcuuuacacaaaugucacuuucucaaugaggcuuucucuggccacuuuuuuuuuuaaggggucucgcucugucccugaggugaagugcaguggugugaccauagcucacugcagccucagccucgcaggcucuaucaaauccucccaccuuagccuccugaguagcugggacuacaguuacgugccacuacacccaccuacuuuuuguauuuuuuguagagacaaggugucccuauauuguccaggcuggucuuaaacuccugagcuuaagugauccuccugccucggccucccaaagugcugggauuauagauguaagccacuuugccuggccagacagggauuuuugacugucauauugcuacugcuuugcauaugguaagcuaacacuacauauuuguugaaugauaauauaacagcagcuaacguuacugacugccccuuuacaaacacuuuacuggauuaauucauuuaauccucagaaugacuccaugaagucguuucuaugacuacauucauuguacagaugagacaacaggggucuggagagucuaagucacuuauccaaggccacacagccagggagcgaggggagcagaagcaaaguugcugaagucuggagcccacgcauuucaccacuguacacagaaguggaagcucggagagcgaagaaaugugccaaggccaccuggcuggaagccuagacuguggaucggcccccaacccggaagcguagcgugcggauccgcccccagcccggaaguguagacugcggauccgcccccagccuggaaguuagagugcggauccgcccccaucccggaagcguagacuguggaccugcccccagacgggaagcguggagugcggaccggcccacagccaggaagcaucccaugaaugaacaacugggugccguucucucccugcaaauuagucuccuucugguugggcacuggaccauccagaauugccccccagaaugaguuuggaaucagcaggugucccaagcagccggguagcggcccgauuuccucccuuaggccuggggcccagcccugcccuccacaccuuuuccagguccugcuccugcaaugccaaggccagcucauuguugucaaugacggaggcagcagccacguccaggggcguggagcccugcaugccugcaggggcgagagguggggagaacaucucacuccugcuugucucgccuccucugggaagcccucccugaccacccuuuuuccagccuggaucaggugccuccucuggucuguacuucccucauccaagcucugaccacucugggcugucacuauuggggucacuauuguguccccagcauuacucauuacagggccagaaccacaguugagagggaguguuuguugaaugagugagcugguggaaaguggggcaggccuggacggggugccaggaguggguucugggggacagccccugggcucggggguucucacccaggccgaugccacuguucuccagcagguagcucagguggucaaacauggagcgcugguucugccggcugauucggcagaaauagcagaggaagcggcagcagcuugucaccaucuuggggaagcggaucuccugggacaggcaggguggucagggccugcccucuguggcugccuccccugagcuccccagcaccugccugggcccucaccuuggacucgccgcccccgaggacguugaccaugaccuccaugaccgucucgugcaugcccagcgcccucaucagguucggguguugguagaagacuuuguuguucaugauguuccugugcacgggcagagugugcggggucaccaggggcccagguccggagagggccauagccaccacugugacagcguuggcauucuugacccucucacucugugccuagcaccaccgccuuuacagaucugaacucacucaauuccuacagcuggccgggugcgguggcucaugcguguaaucccagcacuuugggaggccgaagcuagaggaucacuugaggucaggagaucgagaucagccuggccaacauggugaaaccccauuucuacuaaaaauacaaaaauuagccaggcgugguggcgcauacccguaaucccagcuacgcaggaggcugaggugggagaaucgcuugaacccgguaugcggagguugcagugagcagacauugcgcacuccaggcuuggcaacagagcaagacuccaucucaaaaaauaaaaaaaaaaaauuccuacagccacugugggaggaagggucccuguuucccucauaaggagacugaggcgugcacccaaggcaggcuccucuagggcagagaucuuugccauguugcccuuugucaaauguugucccagcaugguggcuuuugccuuguaauuccagcccuuugggaggccaaggcaggaggaucacuugagcccaggaguccaagaccagccugggcaacauagcaagacccuaccucuacaaaaaaauuuacaaauuagcuggguaugguggugugugucuguagucccagcuacucaggagacugaggcaggaggaucgcuugagcccaggaaguugaggcugcagugagcugugauugggccacugcacucuagccugggcaacagagugaggcccugucucaaaaacaccuagaaaugccuggcacgaaguaggugcuuaauaaauguuuacugugugaaugagauuuauuugacaaugagugcucaauacugcuaccauaauuauuauuauucgcaugagcucacugaagccacagcacaacccuucagaguaggcuuggcucuccccgguuuuacagaugaggaaacugaagcucaaaaaggguaaaccucagcugggugugguggcucacgucucuaaucccagcacuuugggaggccgaggcggguggaucaccugagguuaggaguucgagacuagucugaucaacauggugaaacccugucucuacuaaauauaaaaaauuagccugguaugguggugcgugccuguaaucccagcuacuugggaggcugagacaggagaauugcuugaaccugggaggcggagguugcagugagcugagauugcgccauugcacuccagccugggugacagagugagacucagucucacaaaaaaaaaaaaaaagggggggguggggaauguccugcugagagucacacagaagcggagcugcuaccacugagggcggagagguaagggaaggagacauuacccaggaggugagcuagccaucgagagacugagaucacccagaggaugggccagaaguuggggaagggaauguuauuguauccugaggguauucauuacccaaggggauaugcaaaguaagggggaagggcggugucucacccgaugcucuggaucaugagguucuccuccugggggcccaucugcacgaugagcagcgagcggaucuggccgaggcacucgagcaggcucauggugucuuccacggaggacggugagaugguguacgcccgcggcagggcacgcagcagcucacccagcccgucguacugccggugcaggaggcugaacauggcccgcaccagcucggggcucugcacgaaguccucuugggcccagcgcaccaccaugugggacaccagcuccugcagggacccugggaaggagacaaugcaaggcuuggagcaccaugcagggcaggucggcacauggggccuuggaccagaacaauguggaaggggcccccuguuccagaaguuuucccaguuacuaccaccugcgcccuccaccugcugggagcaggcagauucuagcagauuguuuuccuuuuuuucuuuuagagacagugucuugcucuguugcccaggcuagggugcuguggggcuaucacagcucacuucagccucgaacucccgggcucaagugauccuccuacuguggccucccaaagggcuaggguuauaggugugagccacugugcccagccuggcaaacuuuuuucuauucgcccaagaaucucucuguucuguucacccuaauauccagcccacaagggcuuccuaaaaauuucaauaggaauaauaaacuguacaacugcaagauaccagagccgaccagaagcacuucgccaugcaccuuugaaggcacaugucacaaucccacuuguucuauaaaaauacuguggauuuggcugggugcgguggcucacagccguaaucccugcacuuugggaggcugaggcggguggaucaccugaggucaggaguuugagaccagccuggccaacauggugaagccccgucucuacuaaaaauacaaaaauuagccaggcauggugcugcgcgccuguagucccagcuacucuggaggcugaagcaggagaaucgcuugaacccaggaggcggagguugcagugagccaagaucgcgccacugcacucuaucuagccugggcgacgcagugagacccugccucaaaaaaaaaaaaaaaaacgaaaaagaaaaagaaaaaaucuaaacucgugggcaggggcuuugacuuuccccccucggcuguauuucccagcccugguaacagugccuggcccauaguuggccccauaaaaguuuccugaauguugugggauaaaaccuguaccaacgucaggaaaucuguccuuguuagauguggcuaauauacaguuugcaaaauaacacauuggcccaacauuaaugauagcugcuugucuaaucccucagcaugguaauccucucaucaagaaagaaaagagaagccccaaggccacggaagccacagugguucaggguuaccgccaucccuuaguuagagguuugccacuaagcugguaggcugugucacccugguccaacacacacguucuacagcccccaucucuggaggcaaaccuccagcaugcaucuuuguuuuuguuuuuuuuuugagacagagucucgcucugucacccaggcuggagugcaguggcgcaaucugggcucacugcaacccccaccuccugcauucaagcaauucucgugccucagucuccaaguagcugggauuacaggcaugcaccgccacacccagcuaauuuuuguauuuuuaguggagaaggggguuucaccauguuggccgggcuggucuccaaauccugaccucaagugauccacccgccucagccucccaaagugcugggauuacaggcgugagccaccacgccugcuuccacuuugcccgccacucuuccccucucacuccugccuaucuaccccucccuugcaucuguccucaugcccucuuugggacccagaggcuccgcaggcauggggcuacccaccccaccccugcccucuccccagugaccccaguccucacgggguuugcucuccucugcugaccgcuccuccucagguuucucuuccuucuucuucaccagccgcacuuucuccaacaggcucaugaggcggcugcccaggguggucucuuccucugguuccuccuccucuccaucuagcugaauuccuggaaguggucaagaaggcgggaaaugucauucauuaguuugcuuauucaccugcuuacacacucauuuauuugugcauaugugcaugcaugcauggaguuuuucauuuccuuuuuuuuuuuuuuuuugagacagugucuuguucuguugcaguggagagcaguagcaugaugucaacucacugcaaccucugccuccuaggcucaagccauccuccuaccucagccuccugaguagcugggacuacagguguaugccaccaugcccuguuaauuuuguaucuuuuucuguagagaugggggucuugccauguugcccaggcugguuuugaacuccugagcucaagcaauccacccaccucagccucccaaaaugccgggauugcaggcaugagccaccaccccuggccucauuuauuucuuuguauguucauguauuuguucauuuauucauucuaucaaacauuuaucuuuuaaaucaauuuugcaaauauguucaaagaacuaaaggaaaccaugucugaagaauuaaaaggaaauaucauaauagugacuuauccaguagugaauacuaauaaaaaggcagacuguuaaaauauagaaauucuggaguugaaaaauaaaauaacugaaauaaaaaauuauuagggggguucaacagcauauuugagcugauaggagaaacagucagugaacuugaagauaggacauagagauugucuagccugaagaacagaaaaguaaaagaaugaagaaaaaugggccaggugcaguggcucacaccuguaauccagcacuuugggaggcccaggcaugcaaauugcuugagcccaggaguucaagaccagccugggcaauauggcaaaaccccgacucuauaaaaaaauuaaaaaauuagccaggcgugguggcacacaccuguucucccagcuacuuuggaggcugagguaggaggauggcuugagcccaggaggcagaggaugcagugagcuaagauugugccccugcacuccugcugggugacagagugagaccgucucaaaaaaaaaaaaaaagcaaaaugaaagaaauccucagagaccugugggaugccaucaaguguaccaauauaugcauaaugagagucccagaggaagaggaaaggggcagaaaaguauuugaauaaauaauugucaaaaauauuccaacuuugauaaaaaguaaguauauauccaagaaacucaacaaacuuucaacaggauaaauucaaagagcucuacaccuagacacgucauacuaaauuguugaaaggcaaagacaaagagaaaaucuuaaaagucagccaaggaaaaauaauucaucaugugcaagggaaucucaguaagacuaucagcagacuucucaucagaaacuauggaggucauccaucuguccuuccacccagccagccaucucuccacccaguucucaaccauccauccauccuucucuucauccuuccaucuauccagccagccauuuuuuacccacuucuucuauccaucaauucacauacccauucauuuaucuggcuuauagccauccacccaaauacccauauaaacacgcauugucuaacuguucacuaacacauucauucacucacucauucauucauucaaccaauaguuacauagcaccgauacuguagaggguugucaggaaaucuuagggaaacuucuggagaggucucgagagaaaguuagcauggggaggacucucugauccccacuccuuaccacagugugccagcaggucuugaugaaagucaagcaaauccugucgaaucucuucagggagaggacagucuuccucaucuguaccaucuuugaauugcaauagcauauugaucuaggggaaggucaaagauuagaaugagggucugagaucccaaagcaggaacucugagaucagagauagaagaugcaauuguuaguccaugucuaaggucaugagucgaagugugaguuaaugaagacuauuugggagacuagggccagagguuugaaaagagucagcaucagucugaggugacucagaggucagguugauucagagaguaggagauaaauguaucacuagggucaggggucaagcacggguuuagagguugaggguccucagugaucagagucaggagauguugagguugggguuuagacaguaaaaguggccagcgucaggggucagaugaccuguuccugggguggggagcggaacucgcggguacgucuugcagucucugcugcggucaugcugaaggcuuuuaugaggaggccauagcggcuccgcugguuggccuggagcuuguccacauagcgcuccgcaaaggcugccagggacuccacacggugcugcagcucuuggucacagaaauacuccagcagguggcacaucuguggaaggacagccgugugggaggagagauggaggugagaccaucaggacuuccuugaaacuucucuugcuuccucuccccucuccauggcccugcccagguccagccaaaaucauuucccgccuggaaccuuaagccugccuuccucaagcaugguggcucaugccuguaaucccagcauuuugggaggccgagguggguggaucaccugaagucaggaguucaagaccagccuggccaacauggcgaaaccccaucucuacuaaaaauacaaaaaauuagcugggcgugguggcacaugccugugaucccagcuacucaggaggcugaggcaggagaauugcuugaacccgggaggcggagguuacagugagccgagaucgcaccacuguauuccagccugggugacagagcaaaauucugucgcaaaaaacaaacaaaaaagacugccuucuccauggucucaucuccauggaaaacagagaucuuuccaaguuggcauugcucacugccauaugcauuuccacagcuccccacugccugaggacgaaguccagacucacaucccaccuacccugugucucccagcccagauggacagaggccgaaaagcaggaagcagcagcccaccuguaacuucacagacucuggcaacuucaucuggagcagcccuuccuccaagccuucuucuuucuccccuucugcugccuccucuuccucuuuuuccucaucuuccuuuuccugugcuguuuccuccucauccuccuccuucuccuccucaucuuccucuucacccucuuccuccucguccuccuccucuucuuccucagugaagaccucaggcucaaucaucuucaagaucuguuucacauccucaucgccaaagaugcccaucaccuacaggacaaagucucgguucuucacuguggccugcaaggccuccaucaucaggcccuggccucauucuccagaccugccccucaugcacaugccaaucauuccugcauuggcugauccgauuccucccacagcaggaauggcaucccccgccuugccauccacccuccuuaagauccacccagguccacacccugugucccacccacacagcccagaccacagacccaaauaugagugccucucccaucacaggcgaguguccuuucucccaagccuaagcaugugcuguguccucuggcccaggacacacccuacgccugcauagcucccagcauacaccagcucucagucaacauaaugaagaugcuaacacaugaggcgaggcucacaccuguaaucccagcacuuugggagaccaaggcgggcagaucacuugaggccaggaguucgagaccagccuggccaacauggugaaaccccgucucuacaaaaauacaaaaaaaaauuagcugggugugguggugcacgccuguauucccagcuacucaggaggcugaggcaagagaaucacuugaaucugggaggcagagguugcagggagcugauauuaugccacugcacuccagccugcaugacagacggagagucugucucaaaaacaaaauaaauuaaaguuuaaaagaugcuaacauauggaaguaaagagggaguagacgaaagggaagaagagugcaggggagagagagagauggaugaauggagggaggauuggauggcuggcuggaugaaucccgagucggaaugguagagguuugaaggaaagaugaauaaguggaugaugauggagagaugaaggaaaugauggaggaagagaugauggguggauggaugagagaaggauaaaugauguauagguaggugaguaggugauggauggguugauagaugcaugaggaaguaaaugaauauguggauaaauagauaaauuagugaauagccaugaggguggggggaugguuggccacauggcuggauagguuuguguaugaaaaguuggggccaggugugguggcucacaccuguaaucacaguacuucgggaggcugaggcaagaugaccacuugaacccaggaguuuaagacugcagugggcuacaaucauaccacugcauucuagccugggcauuacccugucucuuacaaaauaaaauuaaauuaaaaauaauaaauaaaaacaaaauuagguugagcagagcgucucaugccuguaauccuaacacugggaggccaaggugggagaauugcuugagcccaggaguucaagaccagcuugggcaaaauagcgagacuccaccucuacaaaaaauuuaaaacuuaccugggcaugguagugcacaccuguagucccagcuauucaggaggcugaggcagaaggauugcugaagcccaggagguugaggcuacagugagccauuauugugccauugcacuccagccugggugacagagcgagacccugucuugccuggacacgguggcucacgccuauaguuccagcacuuugggaggacgaggugggcagaucacaaagucaggaguucaagaccagccuggucaacauggugaaaccccaucucuauuaaaaauacaaaaauuagccgggcaugguggcgggcaccuguaaucccaucuacuugggaggcugaggcagaagaaucucuugaacaugggaagcggagguugcagugauuugagauugcuccacugcacucuucagccugggugacagagcaagacuuugucucaaaacaaacaaacacacaaacaaaaccaaaaagauggauauauaaaugaauaguuagaugggucuacgaauaaaaggguacaugauacaagggauggagagaaggauagggaacggguagauggauggguguggauggcuaaauggauuuguggguagguggauggguguacguacauaugaauggagagauggauggauggaugaaggguaggugggaacuggaggaacggauggaucuguggauguagguauggauggacgcauaggugggaggagaugauuauuggaccuacggaaggaaagauagauuaauacauaaauggguagguggauagaugaacagauggaaugguagauggacugcuguaugaaugaaugaaaagauggaugggcaaauagauugaaacuuggauagauggguacaugaaugaaugaauggaguggguggagaacaaaaggauagaaaggcagauggaaagauguugauggaaagaucuuguugauggaaagaugaucuauacacaugaauggauaggaugaauggguggauggaaaggcugguggaggacugauggauugauggauggaugaaugaugguugguuggauagaugaauaggaagaaagaagagaugaauaaacauaaagagaugacaggugagcagauggagggaaaggugaaugaaagauagggagauggugggaggauacauagaaagguggauggaggccggacgcgguggcucacgccuguaaucccagcacuuugggaggccaaggugggcagaucaggaggucaggaguuugagaccagccuggccaacauggugaaagcagucucuacugaaaauacaaauauuagcggggcgugguggcacaugccuguaguccccgcuacucggggggcugaggcaggagaauugcuugaaccugggaggcggagguugcagugagcugagauugcgccacugcacuccagccugggcgacagugagacuccgucucgaaaaaauaauaauaauaaaaagaaagguggauggauguauagaggagggaaugaaugggugguuggaugcauaaauagaggaggauugaugcauguaucucuggaguuuugggaaugugggagaagaaugggacagaggaaagcaggaggaagccauuaccagcaggguggacacgagcuugagcacaggcacaaacuggaacuccacggagcccccgacggggucgcgagcgugcugcccaccgucgcgcaccgccucccccagcauccucagugccuugucccgcagggccuccagcgggauggcagggcugaggcgggccggggccucugcugccccagcagcuggcagagcggccacgaaacaggggggcgagaaaugaugcgggggccucagcgaaguggugacuccaacucccggcaggccaugccgggggugaccauuuucugugcuccuuccaggagggaagagcgugauggcgcgggucucaggcgugaggggcacgauguauucagagagcauggagcggcggcugcggcaggcacuuucgagguggaugcugaugaggaggucauaguagccugcgcgcagugggccuggcaggugcgcguccuccagggcgugcagcagcugagcuuggucuacguggcugcacagagcgugcgccacgcgauuguugcccagggcgcacacagcgcgguagaggcgcagggugugcgaguggaagcgcugcagguccaggcgcuccgacagcuccaggauguccaugcaccugcagcagaggugggaaacagacagggacagaugaaugagccuccugcaucagucaagccaccaucucuuccuccauuuccuucaucacuauccacccauuuauucauucgucuuuccuucaaaccccuaccauuccaucuaucaauucacccauccugggagaagaugggagacagaggcacagaccccagaaaggcagagaugcuuagacgagugucgaaggcugcagcagggaguuccaguggccuccuagcuuaggguucugugagggcaguggagcugggucuaggagucuuucaaugguucuggaagucccuaagggaucugggggccccugggauaccucuggggucccugggauggucugggacuucguaagagucugagaguccauguagaacaucugauguuuccaagauguguuugggcccccagacugggucccccucuggcaggucugaguauacuaguuguguuugagugccauuagaauguaaauuccaagggcaggacauuucugccuguuuuguuucugcuuuuguuuguuauauucccagcaccuaaaaccacaccuagcacauaguaaagugcuuagcauuuguuguuguuguuguuuagugauggggucuugcucuguugcccaggcuagagugcaguggugcgauccuagcucugcagccuugaacuccugggcuuaagcaauccuccugccucagccucccaaguagcugagacuacaugugugugccaccaagccaagcuaauuaaaaagaaaaaaaaaauguggagacggguucucacugugcuuccuggugguuucaaaccccuggccucaagcaacccucccuccuccucagccuccugaagugcuuagauuacaaacaugagccacuguacccauaaauauuuguugaaugaauaaauuaauaaacgggugugucuggggcccuggggaugacccugggucccuuugggcauguccgagcauccugaguuauguacaagcauuacuagaaugucacuucacaggggcuuggugucuccagccuggaauacuaccuagcacauaggagggacccaaagcuauuuguugaauggaugaaugaauaaaggaaggaagugagggagggagagaggaaggaaggaagggagggagggagggagaggggaaggaaggaaggaagggaaggagagagggaaggagggaggaaggaaggaaggaaagaaagaaagaggcaugucagaagccuccugggugagucugggauuccucccacguucagaauucuauuuuuugagauggcaucuugcucuguugcccaggcuggagugcaguggcgugauccuagcucaaugcaaccuccgccuccuggguuuaagcaauucucaugccucagccucccgaguagcugggacgaugggugcacaccaccacaacuggcuaauuuuuguauuuuuaguagagacuccugaccucaggugaccugccugccucagccucccaacgugcugggauuacaggugugaggcacugugccuggccacguucagaguucuuaagaguaacccugccauccaugugaacgcaucuguggcccuaggugugucuggguccccugggguggguuugaaauauccacgggauucuucuuaaagccucccugcauaugcccaagagacucuagggugcauccaagccucccugaaucauguccagggauccugggguguacuuggggcccccugggguguugaugugggucuggcucccugagauggguuuggggcccuguggagugggucuggguccuugggguauugucuggguucccuuagggugggccugcgguccacugggaugguguagagccuccugcguugagucugaaucccccugggacauaaucuggggaugucugagcugagcccgaguccccugagguaggucuggagauuccugggguguagucuggaaucccgggguuguguugaggaggggcacugagugggacccagaccccagagggcuugcaacaccugcccaccccugcauagcugggcuggcccugaccgguucuccucggggaugugcagcgccaucauggucagcggcuccuggcacugcacggcccagcccagccgcucgccggcacgccucgucuccaccugcaggaagugguugggcaugcggcuccaggacacuggcaucagcaucugcaucuccagccgcggugggcacugcggggccggguucuugcgcucgcuuuggaacauggcggcugacaacggcaugauguucugagggcagagagacacacaugggucaagauggccagcccccucugucccaccacaccacuuccagggagaccucuuggauugcccccuccccuucaguggcucugcccgccuggccuccccacaucuccugccucagccuggccccauuagugcccccaucacugcacuuguaccuucugcuuccccagcucaaacuggaugacguucuggugggugggcaggacgaagacggcaggaaauagcuuaguguuggguuccaccuggcagaggagaagaggacgaggugagcaaacgggugggcuggagggaggguugacucuggaccucaaacucuggggccaauuuguagguccucaucugggcguuagaggcuccaaaauggcucagaggucacccuuagacugucccaccucugauccagccaggccaaccuccuccaacuuucccagagcaaccugucaucugucucugcacacaucacaccccgcacugggaaugcccuucgcauuucucucccaagcauacucauucaaaacccagagagugugauggcucacaccuguaauccuagaacuuugggaggcugaagugggagggucaccugagccuaagaguucaagagcagccugggcaacguagugagaccccaucucuacaaaacauaaaaaauuagcgaggcauggcgguccauaucuguaguugcagcuacucaggaggcuaagaugagagaaucgcuugauccugggaggucgaggcugcagugagccaugauugcaccaccgcacuucagccugggugacagaacaagacccuaucucaaaacaaaaaauuccaggaaguguccucagacugucuugccccucucccgucuucccaguggagcccauccagccagccucugccuccacaaacaacauugucucugaagcagucccgcccacaccaaaccugaucuaauugcacccugggacccaacucccaguuuacaggaaauaugggggacaaaggaaaauguuaaaaagccaccacaggaaugcaccagccagauccaggcuaugggaaaccaggccagcccucuccagauuuaauauacacaggaagccccugggauccugucaaaauacagauucugauuuggcaggcaugggaaggggucugagacucuggguuuauuuaauuuuguuuauuuauuuuuuugagaugacgucucacucugucauccaggcuagagagugcaguggcaucaucucggcucacugcaaacuccaccucccacguucaagcgauucuccugucucagccucccaaguagcugggauuacaggcgcccgucaccacgccaggcuaauuuuuguauuuuuaguagagaugggguuucaccauguuggucaggcuggucucgaacuccugaccuuaggugaucugcccaacucggccucccaaagugcugggauuacaggugugagccaccacgcccggcccauuuuaacuuuuuuaaaaagaagcagugucucgcucugccacccaggcuggagugcaguggcgcuaucauagcucacuacaaccucugccucccagacucaggugauccuccugccucagccuccaggguagcuggaacugcaggugcccaugacuagacccagcuaaagauccugcagcucuccugcugguugguccagggaccacacuuugaggagcaaagugccacaggacaaauagccugguuccuucaacaaauacauuucugggggguugggaaagaagaaggaauggagggggaaaucuacauaugaaaugaaacucaagguacagagcaaccaccuaaaauauaugacccuggucgagcgugguggugcacaccuguaaucccagcacguuuuauauucugggauuacaugggagguggaggugggcgaauaguuugaggucaggaguucaagacuggccugggcaacauggcaaaacaccgucucuacaaaaaauacaaaaauuagccaggugugguagugcgugucuguggucccagccacuugggaggcugaggugggaggaucguuugaucccaggagguugaggcugcaguaagccaagauugcaccacugugcaccagccugggugacagaaugagacccugucuuaauaaauuaaaauaaauaaauaaauaagguugaguacgguuggcaccacugcgcaccagccugggugacagagcaagacucugucuuaauaaauuaaaauaaauaauuaaauaaauaagguugagcaugcugccucacacuguaaucccagcacuuugggaggccaaggcaggagggucacuugagcccaggaguucaagaccaggcugggcaauauagccagaccccgucucuacuaaaaauacaaaaauuagcugggugugguggcgcacaccuguaaucucacauacuuaggaggcuugagcccgggaggcgaagguugcagugagccaagaccaugccacugcacuccagacugggugacagagugagacauugucucaaaaaauaaaauaaaaauaaauaauaaauaaaauaaaauauaugacccuacuuagauucugauucaaacaaagaaaugguaaaaugacauuuuggggacaaccagagaaaucugaacacaaacuggauauuugaugauauuuagaaacuauuguuuuuuuuucuuuuaggugauagugguauugugguuaugcucuuuaagaucauccuuaucuuuuaaagcuacacacugaaaacagaggaaacuaucugaugucugcaauuuccuucaaaauuauccaguggguguggaagggaaguagauauaaaaagaugaaacaagccaggcgcaguggcuuauaccugucaucccaucacuuugggaggcugaggcaggaggauugcuugagcccaagaguuugagaccagccugggcaacauagcaagauccugucuccacuaaaacuaaaaaaaauuagccaggcaugguggugcauaccuguagucccagcuacucaggaggcugaggugggaggaucacuugaaccugggaggcagagguugcaaugagucgagauugcgccacugcacuccagccugggugacagagggagacccucucucaaaaaacaaacagacaaaaaagaugaaacaagauuggcugugagugggugacaguugaagcugugugacaggggcauggcaguucauuauacuauuccauucuuguauacguuuuuaauucuccauuuaacauaaagcuuuagccaggagcaguggcucacgccugcaaucccagcacuuugggaggcugaggcagaaggauugcuugagaccaggaguuugagaccagccugggcaacauagugagaccccgucugcacaauaaauacaaaaaaaauuagcugggcaugguggcacgugccuguguucucaacuauucaagaggcugaagugggaggaucgcuugaguccaggaagguuguggcugcagugagcugugaucucaccauggcacuccagccuggguaacagagcgaaacccugucucaaaaaauaaaaauaaaaaauaagccaggcacagugacucaagccuguaaucccagcauuuugggaggccaagguggggagaucgcuugagcccagaagcgagagaccagccuggacaauaugaggaaaacccaucucuacaaacaauacacacaaaaaaucagcuagucaagguggugcaugccuauagucccagcuacuuaggaagcugagacagaaggauugcuugagccugggaaguugaggcugcagucagcugugaucacaccacugcacuccagccugggggacagagugaggcccugucucaaaauaaagaaaauaaaaugcaauaaaauuucauaaccaacaauggaugccaaaaaauuaaaauaaaguuguacaaacccaccuuagauuaauggacagguaggugaauaugugauaaagccaauaucuacaacauugauaguagauuccaggugguggguacaggguguuaucuacauagcuccuucaauuuugcuguaugauugaaauuuuucagaauaaaauguugaaaaggaaaaggccaccuuaggauucuggcccauccuagcguguucccugguuggagagaaguuggugacuggugucacccagcucaagagggaacagaaaccucuuuccaaggucaaggcuggacucuggcugggugugguggcucacgccuguaaucccagcacuuugggaggccgagguggguggaccacuugaggucaggaauuugagaccagccuggccaacacagugaaaccucgucucuacuaaaaacauaaaacuuagccggcuguuguggugcucgccuguaaucccagcuacucaggaggcugaggcaggagaaucccucuaacccaggaggcgaagguugcagugagccaagaucgucccauugcacuccagucugggcaacagagugagauucuguaucuccuccagucugggccuuaguuucauggaaguuucaacaagguggucucccagcgaccucuugaggacagccuaggagcuguuuuuguuccaucucugaggucuggccucaggggacaucuauaagagcuguccugggaugcugggacaugaugcucucgcuaaauugcuguggccuggacucaccuggaaaaagguguugcucucuuugccauuggcuguaaaggucauuaagccaguggccaaguccaccaggcacccaaugacaagguccguguggcugauccggcccugcugcccgggacucacaaagucuccgccccacaccauguagcaguugcuacacuugaggcugcaggagacagaagcggucacugcacuccucaugugaguagcucuggacccuggacacccccuuccccaagcucccggaaacacacaaccucagagucccauccccaaacacccaccgccugcagaccugagagcugaaaccccucgccccggacacugagcucuucggagcugggauuccuagcagcuggcgcaguggggagucaggaugggggugggggucugaaaggagggaaagcaagggaagcaggaggagagagaaugagaugacagagaaggagaagggugagaugaaacaggaugagaaggaaaaggagaaaauggaauaggagaaaugcauaaagaggaggaggaggagaagaaaaauaccagggcaggaagagaggaggaaaaagaggaggagggaagcuuccgagcugggugcccagugccccagagaauccucccgcuccagaaaguuccuaggucccacaaccaggcagccacagagcuggugucgggagcucugacugccuccugcccuccccacccugcaccucccaccuccccccagccccggcaccugcuguggacguugccuuguucaucccccauggucaccgucacgacccggaccuugcugaggucgaagcucaugucgugcugaugguagucaggggugacccagcccgcccacacgcagcugggcuccuguccagcaaagacccucacggaguaauaguacuggugacacaaggaggggaacuaguggucagucuggaagucagggacucgggcucccugggacucgaaauugguuucccuggacuguuggguccucugggaguuuaacaggaaguuguuggaucugagucccccacccccugguuaugucuguuucugugucaauuugugcaauucuagauuuaggagucccuugggaauauugugugacagugccauauuuggguuccucccagguuacaguagacugacaaauaaauaauugcaggccaggcaugguggcucacgccuguaaucccagcacuuugggaagcugaggaagguggaucaccugaggucaggaguuugagaccagccugaccaauauggugaaacucugucucuacuaaaaguacaaaaauuagccgggcaugguggugggcgccuguagucccagguacucgggaggcugaggcaggagaaucgcuugaaccugggaggcagagguugcagugagccgagaucgugccacugcacuccagccugggugacagagugagacuccaucucaaaauaaaaaaauacaaaaaauaauuaaauaauugcucacaaauagcacugacugugcuaaggucuuuuuuuucuuuccuucuucuucuucuuuuuuuucuuuccuuauuuuuuuauuuuuauuuuuuuugaguugcagucucccucugucauccaggcuggagugcagaggcaccaucguagccugcagccucaaauuccuggauugaagugauccucucaccuuggccucccaacguucugggacuacgggugugagccaucaugccaggccuguucuaaggucuacacagauuaacucacuucauccuccauaucagguagguauaauuuuuacccccauucuacugauggaaaaccauagcaccuccauaggagagaaggcauagaguggugaaaugacuuuugcccaaguggcacccagucggcccaugaucuaaucucgaggccagggauccccaaccccaggcugugggcugguacugggauccaagccaccuagggugaguacuccuuguaagaaucuacagccgaacgcgguggcucacaccuguaaucccaguacuuugggagucugaggcaguaggaucauuugaggucggggauuugagaccaaccuggccaacauggugaaaccccguuucuaccaaaaauacaaaaauuaggccaggcacgguggcucaugccuguaaucccagcacuuugcgagaccgaggcggguagaccacgaggucaggaguuugagaccagccuggccaauauggugaaaccccguuucuacuaaaaacacaaaaauuagccgggcaugguggcgugugcccauagucccagcuacuugggaggcugaggcagaagaaucacuugaacccgggaggcagagguugcagugagccgagaucgcgccacugcacuccagccugggcgacaggcugagacuccaucucaaaaaaacaaaaaacagaaaacaaaaauuagcugggcaugguggcaggagccuguuaucccagcugcucaggaggcugaggcaggagaaucguuugaacccaggaggcagagguuucagugagccaagaucacaccacugcacuccagacugggcaacagagcaagacuccaucucaaaaauaaaaagaaaaaaaaaaggaaucuaugccugaugauccgagauggaacauuucauccugaaaccauccuuccccgcauccgugguccacggaaaaacugucuuccacaaaauugaucccuggugccaaaauaguuggggagcacugcacuaggcugucugucuaugaaauauuuuggauuuggggaaaucccaaaacuauauuaagacaauuaugaauuuuuguucccaguaauauauuagaguagguauuacauugaggguauuguguuuauaugagugagcccaaauguuggggucccuagucuauauuggcuuauaucauggcuuuggggauccccaggaguuauaucagugugcuguacaccucuacuguacucccugccguuugugggccauagcuauauggauuuagggguucaaaggauuaaaucugugugugccauauuuuaugaguuucuaguguauauuggggaguccccaguguaaggugggcagcuacuggggacugucacacuaaacuuggaaauucaggagugccuaugcuaugcggggggaccccaaaauugaggguuacugguccacaccguggugguguugaggaugaucucggggucaucgcgguugucugcaggcaccacgucgugagggagucggggcagcguggggguggccgguggcugggucaucauggcgaccuucuuggccuugaauaagaagcugguagugggaggagaggcgccaugagagccagcuuucaagcccagcccucccaccgcaauauucaugcccccacauccagcuuggauacacccugcuucuaauaccccaggucuugccucuagagggcuggauucccaccuaccccagacuaauccauucuagaagugcuaugcucugcgcuuguggaugcugaguuacccaaauuaaaggcgccuucugggaauauggagguccccacuggguuauaugggggucccccuaagucagcauuucccacaugcauuucucguauaggugcuaaaugcacuuggaaaaggacaauucuucauugugcggcacuguuuuguacacugcaaggcaggcggaacccuggggcccccgcccagcagcagcagccccucccaaacuguaaugaccacaaagacuccaucauuuccaaacauccaccaagagacacaauggguuuucaaucccauugaaaaccucugccaucguacggaucaccugaggucaggaguucaagaccagccuggccaacauggugaaacccugucucuaccaaaaauacaaaaauuagccgggugugguggcacacaccuguagucccagauacucaagaggcugaggcaggagaauugcuugaacccaggaggcggagauugcagagagccaagaucgugccauugcacuccagacugggcaacagagcaagacuccaucucaaaaaaaaaaaaaaaaaaaaaaaaaaaaggagccgggcgugguagcucaugucuauaaucccagcacuuugggaggcugagguggguggaucaccugaggucaggaguuugagaccagccuggccaacauggcaaaaccccgucucuacuaaaaauacaaaaauuagcugggcaugguggcgcgugccuguaaucccagcuacucaggaggcugaggcagaagaaucgcuugaacccgggagguggagguugcagugagcugagauugcgccauugcauuccagccuggcgacagagauuccuccucaaaaaaaaaaagauagaaagaaaaaaaggaaaccacugccauuguagggaaaaagcagauuuaguaccuucucagaaucucccuuuaaguuagauuucgggggguacauuugugacacagaaaggauccccauuuagaagaccacuggguauucacugggauaccuuacugugcaguaaacucuccuaggaagauacugaagucccuuuuaguguccacggaugauaagguccauugggcgaagcccuuuggggcccuccagguacucaaggauaauagaguucuccauauagauacuaggguacccaauuauauauucuuggggacauuagggcaucccaggaaaauaaugggguucauuggagacaugauagaaucucucgguauucuuacuccacuuagcauauaugggucuacuuugggguacaauggggguuucucagguuacugugguugccuacuugggggucccaaggcagcccccaauccccacucugggccccccucgacucacccucucuucuuguucuucucggugguggcauccuucucauucuccgcccuggcgggcugcgccucuccccccgccugcggggugcccccgggggcgcccuccuucgcagucccuucuuugccguucucugccucgcuccagcccccagcugagcggcgcagguuuucguagucagggucggguuccgccgcccgggccucguccucggcggggggcugcaggccaggaggugccagcgggguggccccugcagugcagcggaagugcugguggaacuggacugggaggcucagccgcaggaaaagcaucuccaccaggcuguucugggagccccaggugcggugggucaggcgcaggcaggggggcguguccacagugccguccacucgggauaccugagguggcagggaauggaguacugggcugggcaggcgggcuaggccaggccguugguccuacaccuggucacacacggagccaccauuaggccauagugcaccugcaugggaauuagucaagggccccccacuccugcagggggaugaagcucccggccggguacaccgcugggcccuggggugcuugcagcccucugcaacauuucucugggcgucguguacacuagcagccccggacacacacuggaaucacuugggguaacuuccaaaaccucccuacauccaucuaacaaucuacucugucauucuguaaccaguaaccaggcagcucaacuucaaugcuuuuuuuuuuuuuuuugagacacagucuugcucuguggcccaggcuggagugcaauagcaggaucucggcucaccgcaaccucugccuacaggguucaaaugauucuugugucucagucuccugaaaauuugccccaaaaacugugcguacaagauucuuuguucucagacuucuuuuuuuuuuuuuuuuuuuuuuagacaagagucuugcucugucacccaggcuggagugcaauggugugaucuuggcucacugcaaccucugccuccuggauucaagcaugagccaacacgccuggcuaauuuuuguauuuuugguagagacgggguuucaccauguugcccaggcuggucucaaucuccugaguucaugugauccgccugccucagucucccaaagugcuaggauuacaggcgugagccaccacccccagccaaguuuccccuuuuuaaacccuugcuuuccccccuagauuugaagugguugcuucggaugggaauccggucacuucuccaugacuaguuuugaugaauaaagucauuuucuuucuaccagaccucgcucuuguuaauuggacucuguaacugaugagcaacugaaccuguguucaguuacaauuccacaaauagcgacagggcgcaguggcucaugccuguaaucccagcacuuugggaggcugaggcgggcugaucaccugaggucaggaguuugagaccagccuggccagcauggugaaaccucaucuguacuaaaaauacaaaaaaauuagccaggcgugguggcacaugccuguaauuccagcuacuaaggagacugaggcaaaagaaucgcuugaacucgggaggcagagguuguggggagcugagaucuugccacuggacuccagccugggugacagagugagacccagucucaaaaaacaaaaaccaaaaacaauggacucucaaaagucuccuagagacucgguaaacaaugaaaguuguucucuuucaugccccuccucacguugaccucuccaaggaccaguugccaagaugaaccuagguacuccuugccagccaaugaauuugcccuaaaacugugcauacaagauucuuuguucucagaaucuuuuuuuuuuuuuuuuuuuuugagacagagucucgcugucacccaggcuggagugcaauggugcaaucuuggcugacugcaacuuuugccuccuggguucaagcaauucuccugccucagccucccgaguaacugggauuacaggcgcccggcaccaugccuggcuaauuuuuuguauuuuuagaagagacgggguuucacuauguuggccaggcuggucucgaacuccugaccucaggugagccacccacaucggccucccaaacugcugggauuacaggcaugagccaccgagcccagccuguucucagacucuuuaggggucuuuuuucucuccucuuucuccccucugucuuauaaaucugguuucugcauucacucuuuuuuucuuagagacaggucuugcucugucaccugggcuggagugcuguggugcaaccacggcucacugcagccccgaaauccugggcucaaacaauccucccacuucagccucccaaguggcugggaccacaggcacauaccaccaugcccagauaauuuuguuuauucuguguagagacaggguuuugcuauguugcccaggcuggucuugaauuccuaggcucaagugauccucccaccuuggcuucccacagugcugagauuacaggcgugagccaccgcauccaaccagccuuuguucuuuggcaauagucuacugacugagcucccuccugugauuugcauucaaaguaacuaacaaugucucugaguuauucuuucauaguaaccaauuucccaacugagcacaccacagauccgcucugccuguucuugaacuuucugugaauggaaucccacagccugugcucucuugucuccggcuucuucuacucgacauuaugucugagauucguccacauggcuguguguauuuccagguauucauucucacuuccguguagcaugcugugccuuggguuggggacaucugguaguggcaggugucaggaacucugcguccacucugcaguacugccccgucccagccaccucuaggauccuucugacuccacugucaccuccuacaauccacugccaauagggaccuuuccaaaacucagaccucaacuggacguucccauacuuaaaacuccuuuugcagaguccuucuguuuuguuuuguuuuguuuguaaagauagggucuugcucugucacccaggcuggagugcaguggugcaaccucagcuuacugcaaccuccaccuccuggguucaagugauucuccugccucagccucuugaguagcugggacuacaggcacccgccaccacgccauuaauuuugggggaguauuuuuaguagagauggguuuuugccauauuggccaggcucaucuugaacuucugggcucaagugaucugcccgccuuggccucccaaagugcugggauuacaggcaugagccaccaugcccagcucuuuuuuuuuuuuuuuuuucaaugagacaggguccucucugucacucaggcuggagugcagucguguaaucagcuuacugcagccucgaccuccugagcucagaggauccuccugccucaguuugccgaguggcugggacaccaggcaugugccacagcacccagcuaaguuuuaaaaauuauuuauuaaaaaaaaauuuuuuuuugagauagggucuugcucugucucuuaggcuagagugcaguggugugaacacagcucacugcagccuuuaacuuuuuuuuuuuuuugagauggaguuucgcucuccuugcccaggcuggagugcaagggcgcaaucuuggcucacugcaaccuccaucucccguguucaagcgagucuccugccucagcccccuaaguagcuggaauuacaggcaugugccaccacaucuggcuaauucacugcagucuugaccucuuggaaucaagcaauccuccagucucaaccuccugaguagcuagggcuauaugugcauacuacacaccuugcuaauuuuuuuuuuuauuuuuuguagagacggggucucccuauguugccaaggcuggucuugaacuccugggcucaagggauccuccugccucagccucccuaagugcugggauaacaggcaugagcuaccaugccuagacuuaauuuuuuuuuauuuuuagagauggaguuuugcuuguugcccaggcaggguuucccuuauuuuauaggugaggcaccuggaccucaggaagcugugguuugccaaaguuacacccggagucauacagcccgugagcccaucacucugacacuugcuuccaugugguuuguguccuaacauggagggaaaagagaaacucaaagaagagcacuguggaaggaaggagcuuuggaggcagaugagaaggcauugaggggcucaguccuuaccucauagugaggguguucaaggggcacuggcucaaacuggggcaggccuuugcugaaccagguggugacugggcgcugcauguugauggcaaauggcucgaagccuuccuggaggccacagauggcaaagaaccucagagagcucacguccuggcccagguucagaugacccaccuggccaggucccaagcugcagacgggcaggaagccuggugggaggggauggaugggcaggggugagggcaggugggcagggcagagggagccgaggggaggagguagggaugggagaguuggaggcagaagggcagugcaggguugggagagacagaggaaaacaagaaagggcaugugaaggggucucagcccucaccguccccaaucucaaucucccggaaggcuguuucggagccugagucagacaugaggaccucgccauugagggugaagauaaugguguucucugugaggucgaucauacagccaacgacaucgcccggcugccaggggcgcccaaaugguucacugcccaagugccagcgcuggcccugugaggacagccagagaagacaugguguggggagacacacagagaaauggagagauaaggaagcagggagggagagauauaugaagacagacauucgaagugucagguucagggcaggugguauggaagaggggucaccccacagugucuccaucuuuccucacauuugcauccaugaucacaggaauuuuucuccccacuaaucucugugucucaucccuucugccuggguucucugcuguugccauggcuagcauuaugcagaccaccaaagugguaguggggggcuggaagcagcaguaaguagagggauggaaaggaaaaaugaaccuaucaguguccccauacagauccauauaugcuuauauacaugcacaaaauagaugaguggcuaaugagacagauagauggaugagaaauuggguacauggcuggacagaagaaugauuggaaaguugagaguuuaccuggguugauacagagaaagaacaaaguguaaguaggggcaagcauaaauaaauggaugacagauagagggaagaagggaaggaugguuguauaaaugguuguuggaugggcagaugguuauuggauggauggauggacaguuggcuggaagaauggauggauggaugguugguuggauggaugagggaugaauggaugauggauggaugguugaaugcauggauggaugcaugguuggcuggucagauggauagaugauggauggauggauggauggauggauggaugaugggacuauaugugcaugcuaccuugccuagcuaauuuuuuuauuuuuuguagagauggggucucccuauguuggcuggaugaauggaugguugguuagcuggauggaugguuggauggauggauggauggauggauggauggauggauggauggaugauggauggauggauggauggaugaauuguugguuggauagauggaugucugauagaucgauggauggauggauggaugaaucauugguugaauggauggauagauggguggaugagugguacaguagaugcaugaaguggggacagagugaggcacagacagaggcagggccagaguagacaagcugugggagagaccacaggaccuggcagaauggugcccagggagguacccacgcggugcccauugaagacauaggccagcucgucagcucccagcucuacaucaggccucagcucgggccucgcccagcccacgcgcaucucgccuguggugacugcuucaaacucgaaguaccagcggccgcucugcacuguauaggauuucucugcccggaagaugcgcacccggucacaacgagacugguucuccaccugaccuauaaaugaggccaggcagagucagagaggcuagggaagauguggaucccaagacaucgagaaguugguagaagacaggcuuugggggacaguaagggcuuuggggaacuguuggaagagggucaauuucuuggaguuagaggagaauuggggaaccucagaaaagucagagagaggcagggaccuguugagagagacccccaucucuguagcagucagaauucucagaaaacagggauacuggcagagacacagaaggaaaaagccagcucagugaacuggucagaguuauggucugggguuaagggucaagaucaggguugauuagaaugaagggcugagaccaggauuggagggucagagccaggauuauggaagggauggaaauucagguuggggccaagaguugagaaacugaagguuggggaccauggccaggguuuggggucaaggcugggauuggaagccagugauaggucaggagucagguuagggguaggggugaccaggcucucuaagcccuugguugggugccuucaugugguagcuacaguucagagauuagugauuagggaucaaagcuagaggucaggaaucagagucaaaggugggguuggcacucauuggguuccuaggcugacggcucugguuugcagucauagcccaggcagggcuggcgucagguaaagggaagugguuccaucagguuccgaguuggaacugggguaaggcucagaguuucggggaggggucaguccuuucugaccuccuggucagucugcucgaugugauagauauagcccauuugggccaggugcaguggcucacgccuguaaucccagcacuuugggaguccgaggcaggcggaucacgaggucaggagaucgagaccauccuggcuaaaacggugaaauccugucucuacuaaaaauacaaaaaauuagccaggcgugguggcacccgccgguaaucccagcuacucggaaggcugaggcaggagaauggugugaacccaggagguggagcuugcagugagcagagaucgcgccauugcacuccagccuggggacagcgagacuccgucucaaaaaaaaaaaaaaaaaaaaagauauagcccauuugggggcugagucaggucagagaucagggaucggggcuggggucagaguugggguaggagucagggccagggccaggggugagcacucacugggcuccuggucaggaggcucgauguuguagccguagcccaggagggugcgcacggccuggcagaggcugucccgguugcugcgcuugguggcuucauccagcaggcgguagggcaccagccgaggguuucggcgcgcugggauguccugcacugcgcuguagcuccagcccuggcccacgcggucucgggcccacacguugugcccauuuucugccagacgguccaccagugucgucugcgccggcgucagccgcacguggcucagguccagcggagccggcuuguacccauugcucaucauauaccugcgggcaugguagggcuccaugggacaaggcccucaccuccacuuccgggcucugcacuauaugggaucccugacugcugacccuugucccagcuucggcguuucugaccuuugauauaauguugcaguucuaugaaauuuuagaauaaguuuugagaucccuggcuucugacccuaggauccugggacccuagcaagggcuuugacaucaaugaccucuagcccccuuugucuugacuuugggaccccuaucucuaaccccggaacucucucagaccucucaccacuaacuuugagguuuuucucucucuuuguuuuuuuuuugauacggaguuucacucuuguugcccaggcuggagugcaauggcacgaucucggcucacugcaaccuccaccuccuggguucaagugauucuccugccucagccuccggaguagcagggauuacaggcaugugccaccacacccggcuaauuuuguauuuuugguagaggguggguuucaccguguuggucaggcuggucucgaauucccgaccucaggugauccgcccgccucggccucccaaagugcucggauuacaggcgugagcgacugagcccggcucuuuuuguuuuuuugagguuguuuucucguucugucacccaggcuggagugcgguggugcaaucauggcucacugcagccucaaacuccuggguucaagcaauucucccaucucaaccucccaaguugcuggaacuacaggcaugucccaccaccauguccugcuaauuuuuaaauuuuuuguagaggggucucaccauguugcccaggcuggucuugaacugggcucaagugaucuuccugccucaaccucccaaagugcugggauuacaggugugagccaccucacccagcccacucugagguuucuuacucugaucccaguccucauccaccccaaacuccugggucuggaguccuugaccucugaacucaggacguguaacugcucaccuauaauuucaggaucccuuacuuagacgacuccaacgaccuccagauucucaccucuuaccauuggccccuuaccccuuacguggacaugugaccucugcucucauuuucccugacucuaggcagacccugagccuggauccuggacucauacccucccucucucucucucugaaacuccuaacuccucaauccuggacauucaccucugaccccagagcccugacccuaugaccuucacccuaacccaagucuccuuccucccuaaccucagccuccccacaagaccccucgaccuccccagcccuuagcacagcauccccagcccccaguccauccccagacgggaccuggcugcccacacucacgucuuggggaguuuugucuucuucagguuguccuccgccuucucauccgccaugcccacguggcagcccagagccagcagaguccugggggugggggaguggaggcgacaggucacgccccucagagcucccugccccgucuccucccacggccucagggucuccagcucccucuaccucugcugcuucagugccuggggcgcucuggcccugucucucuugauccuggccucaggcuucaugacuucugucuuucccugcgccuugucuguauaacuaacuaugucugucuuuuccugucugccacuuucuccugucucccugucucuuucugcaucucucucucuuuccauccccaccuuuucuuucucucucuuucugccucugucccuuucuugcuccccguuugcuucuuuuuuuuuuuuuuuuuuuuuuuuuuuuuuucugaaacggugucucgcucugucgcccaggcuggagugcaguagugugaucucggcucgcugcaaccucugccucccagguucaaaugauucuccugccucagccuccugaggagcugggauuacagaggugcaccaccacgcccggcuaaguuuuguauuuuuaguagagacgggguuuugccauguuggccagacuggucucgaacugcugaccucaagugauccacccgucucggccucccaaagugcuaggauuacaggugugagccaccgugcccggccacuccccauuuguuuaugucucacaaucccuguccccuccauccuucucucucucagucucuaccuccugcccugucucuccaugccucccucccccaccgcaccagcagccagccccaacccccggcuccccugggcccucacuugagcgucuccccagacaucugcagguuguaguuccucucaggcucuggaaggcuguggaaguccacaagacacgggugcagccucuuguugucaucccgaaccuggagaaaacccagggucaacuccaugugcuccccuuuccuucccacuccccacaugcccagacuaugaccccugaccuccaacccuaguucugccacccucaguccaaggacccccuggugcccuguggucccucccuccucuccgccggugagccgcucucccuccuggcaccgcaagucuagccggccucccgcaggcugcaggcagccccucaccgggccguagguccagcccugcucgaugcggguuagcgcccagagcucguggauguucuccgccagcuucucccgaaugcgcuccagauggggcggcaggacaaucuagaggcagagggacguucuugagaccccaaggucccucuacccuccuccaucaugaccccucuuuccaagaacaccugugagcccugggaggcuccuccagcacccccuuucccaccauccagcagcccugcuccccaucccucgccuugacuccaggguugacacucagaugggugagggcuuagcauucucagaauuaaggaauuauccagggccagccguaguggcucacaucuguaaucccagcacuuugggaggcuaaguggggggggggggggcagaucgccugaggucaggaguucaagaccagccuaggcaacacggugaaacaccuucucuucuaaaaauacaaaaaauuagccagaugugguggugcgcaccuguagucccaguuacuugggaggcuaaggcaggagaauugcuugaacucuggaggcagagguugcagugagccaagauugugccacugcacuucagccugggcaacagagcaagacucugucuccaaaaaaaaaaaaaaaaaaaaaagaagagagaguauuaaggaauuaucugggacgggucugucucccccguggacugggagcuccaugagggcagggccuggggcugcccuggucuccaccaaguccccagcccuauccagcccagaaccagacucagacccagaagagaggcucaggaaauguuugcugaaugaaaagaauggaggagucuccuuccuucuccguaugaggaucauagcgauaccuaauaaggacucagugagaucauuaauguaaauuacuaaauguuacauaguuaauaucgaugccuggcagaggguaagagccuaguagacaguagcgguguuggcguuccgcaggcaagaggcaaugaugguuuggacuugggcgggacauggggaugaggaaagcggggucggggggaugucugggaggccgaguggacagcccacgaggcugacaggcugggggauggggacagaggcauccagggugaggcccagggcacuggucuggggacagggggaugaagucacccccgcagaugauaucacugcuacuaauaaugagugacugucuugagugcuuacuguuuaaucaggacuggacuaagcaucuugccuauauccauucaucuuaccuucacaacaaugaacaaugcuaucagauaucaggguguuauccccuuuuccucacggaggaacaaacugaggcucagggaggggaggucacaugcccaagaucacgugacugaaaaccaaaccuuugcugucaggcuuuuaaaccuaaccuauauucccuccuauagggacaugcuuggagggaaggcaaaaacaguccuuucuuucuuucuucuuuugagauggagucuugcucugucgcccaggcuggagugcaguggugcgaucucggcucacugcaaccuccaccucccggguucaagugauucuccugccucagccuccugaguagcugggauuacaggugccugccaccaugccuggcucauuuuuguauuuucaguagagaugggguuucaccauguuggccaggcuggucuugaauuccugacuuuaggugaucugcccgccucagccucccaaagugcugagauuacaggcaugagccaccacacccagccuuuuucuuucuuucucucucucucucccuuucuuuuuuuuuuuuuuuuuuucaggguuuugcucugucacccaggcuggagugcaguggcacaaucauagcucacugcagccucgaaucccugggcucaagugacccucccaucucagccucccaaguagcugggacuacagucguggaccaucaccucagcuaacuuuuaauuuuuaguagagauggggucuugcuauguugccuaggcuggucucaaacucguggacucaagcaauccugccucggccucucagaguucuaggaucgcaggugugagccacccuuucuuuguggggcaguggugaggacucccugagacugcgauucugcucugacagaauccuuugccucucugugcucaguuucuccaucuguuaaacaacgagguucccagcuucuagggcagcuccccaccucucucacuccuuuuaaaaaauugucuaaauuuguaaauauuaaaaauuuuuuucuauaaagacgggguaucacuauguuacccauacuaaucucgaacuuucgggcucaagcgcgaggcccccacuucggcuucccaaaauguugguuguuuuuguuuguuuguuuguuuugagaugaagucucacucuguugcccaggcuggaguguaguggcacgaucuuggcucauugcaaccucugccucccagguucaagcaauucugccucagccucccgaguagcugggauuacaggcaccugccaccaugcuaauuuuuguuuuuuguuuuguuuuguuuugacauggaguuucacucuuguugcuuaggcuggaguacaauggcgugaccucagcucacugcaaccuccaccucccggguucaagcgauucuccugccucagucucccgaguagcugggauuauaggcgcccgccaccacacccagcuaacuuuuuguauuuuuaguagagacaggguuucacuuucaccguguuggccaggcuggucuugaacuccugaccucaggugauccacccgccucggccucccaaauugcugggcuuacaggcgugagccaccacgccuggccauccaaagugcugggauuacaggcaugaacgauggcacccugcccccucucugacuccuaagagacccugccucgccagaaaaccuuugcagggcaggcaguaccuggacaguguccacagggcagggcacgaagucggugugugagaggcagcgacuggggcccaccaggugaggcccccggggccccucccgucgauacuccuugauggguucaagauggagucgcucucgagggagcacagccucauggcauggagcauagccaggugggggcaggaacuugaauucaccauggcggccaccaaggaggaaccgcacccuggguaaggaaggacaauggggaucauugaggggagguuaugggggacagucuguggucagugggggacauggaagcaguccugggaucaauggaaaguucuggggagaccaaaggucaccgggcagucauaguguccuggaggucauuuagaagucauaaaagaaagucuagagucaaaggaauaucauaagggaauuaagagccagggaguugagagcgggagggucucugguuaaucuagaagaguucagaugacugcaaggucauggaacaguccuucagaggagaccccaggucaacagagcauucggggucauuggaagguuggggagaccaauaagaaggucauuugagaagucacugagcaucuguuacaauuaugaaauaaacauaaacaccacugaauggacauucggagagcuuggggugauugggaaaggacuggaucauuggggggucuuuggaauaaaugggguuauucgggagcagggucacugggcaagucugggucuauugaaaggucaucgggagaugcuggcauuauuaagagauuauugagagaguauggugucauuggaagagucugaagucauuaggggguuaaggagggucuggagucauuagaucauuaucagauucuggagucauugggagagucugaggccacuggggagucaaggaaggucuggagucaugagaucaucagauucuggagucacugggaaagucugaggucauugggaggucaccggaagaaccuuggguuguugagagaccacuaggagagucugagaccauuaucucagagguuacuggaaggacgugggguuagggagaaucugaggucauuggaaagagucuggagucacguggaggucccugggaucuucaaguaaggguucuggacaccagucagucuugaugguaggcugcaguguccuggccuccugggggaccauggagugacuggggaagcugucucaggucaguccuaggucugaggacuggccguggggugggggcaaguucucacuugacaccagccgagaagcugacaacagggaagaagagcccguccagguugaaggacucaaagacacccugcacggggcagccguugaugcggaaggagauggacggcacgcugagguccaggcagcagcugaucacgucuucaggggccaggaggugcugcccuggggaagucacugggcgugccacguguccugcaucagucaccagagaugggucagacgucacaggucccacagaaccaaugauaacaagagaaaagggacagauauuggaggcuccuguggagauugcauccuggaaacccuaauggaaagugcucccuuggaugcucccguagcucugaaaugaagggcagaggucaggguuccccugaaguuaggauucugagcuguggggccagagauuaaauccuccugggggccggaugcaguggcucacaccuguaaucccagcacuuuggaaggccaaggcggauggaucacuugaggucaggagaccagccuggccaauguggugaaacccugucucuacuaaaaauacaaaaaugagccgggcgugguggugcaugccuguaaucccagcuacucaggaggcugaggcaggagaauuacuugaacccgagaggcagagguugcagugagcugagaucaugcuacugcacuccagccuaggagacagagugagacuccauuucaaaauaaacaaacaaacaaacaaacaaacaaaauaaauaaauaaauaaauucuccugggguuagaagucaaagaucagagaucacaguaaucugcguggucuucugggauaucuagggucagaggucacaccuacucugggaucagaguucuguagguaacgaggauacaagucagagccgggaaucuagaagcucugggguuagggucuugggaaaugaggacuaaaaggucaaaaguugaccuuuucagggagucaggauccugagaaccccaagguguauggucagagacuuagaaaugcuggggucaauggucaggggugaggguccccuggaaggggucagguaccuguccagagaugcaguccaucaaagccguaggaauagaggucaucgccgaccccguugccgccccagcccucgccggccccaggguaggggguguagcccucggugagggcccagcccacccgcaaguggguggccugagcugucagaaauggagucaccucguccaccaucaccucaaaguaccauuugcuguacugcguggugccuuccgcucggcccacaaagauguuggggcggaugcugcaggagagaugggacaggagagggggaugacggagaggcagagaggagagccaaguggugggaagccagagagagacagacauccaaagacagagagagagagaugggagagagacagggagaaagacauggaggaagaaucaagacagaaacaggcaaagauaaaaagagaaaacagagagagagggagagggagaaagaaagagaaacagauagaggcagaaauggagccaggaagacagaacaagaggaguggaugccaagggagaguggggccacaguggacaucugugaggacugguuguuaacccuggggugggagauuaaggaaaggacauccaucuggguguggagucucuaagucagggagaggguugagagguucugaguucuggggucagauguugagagccagaccuggugacauaguugaugagguuugucugcagcagaagcucacggccaggcagcaaguucucaguaauaagaucuugguuggagcguacagccacaccauuacacacacacagggagcauagcacguccaggaccuagaggucaaggucagagguuaaaggguguguaggcaccagggcaggaucuacagaagaacccugggagggagggaagccaggaggaaaggacagcgcaucgggauaagauguggcaauuuugacugagaggagguggugaaaguggaaggucagggaucagagaaagguuaggggucaaagaggaagaucuggcaagaggcugagggagggucacaugaguugggauaagguaucagcaauguaaggaaggagauacuggaguagugagguaagaggucagaaggcagacugaaacgaccagugagagacacaggaaucaagaugaaauuuuaaaucagcagggguugcaaacuugugucuuuaggggccaaguggaaaauguauuaggcuggagcaaaaguaauucugguuuuuguuauuccuuuuuuuuuuuuuuuuuuuuuuuuuggagauggagucuggcucugucgcccaggcuggagugcaguggcgcaaucucagcucacugcaagcucugccucccggguucacaucauucuccugccucagccucccgaguagcugggacuacaggcgccugccaccaugccuggcuaauuuuuuguauuuuuaguagagacaggguuucaccgcauuagccaggauggucucgaucuccugaccucgugauccgcccgccuuggccucccaaagugcugggauuacaggcgugagccaccaugcccggcugucauuccuuuuaauagcaaaacugcaauuacuuuugcuccgacugaauaaaugugugaagugguuagaaauaaugcaacaggaacuuguagggcuauggcaaacuacagaguguguguauauauauacaguccaccuagaggcuguaauauuugaaaauuuuaaaaacauuucagcgccaccgguggggcacgguggcucacaccuguaaucccagcacuuugggaggccaaaguggguggaucaccugaggucaggaguucgagaccagacuggccaacauggugaaacccugucucuacuaaaauuacaaaaauuagcugggcgugguggcgggcaccuguaaucccagcuacucaggaggcugaggcaggagaauugcuugaacccgggaagcagagguugcagugagcugagaucaugccacugcacucccacuccagucugggugacagagcgagacucuguaucaaaaaaaaaaaaaaaaaaaugccaggcgcuggugguucacgccuguaauuccagcauuugggaggcugagguggacggaucaugaagccaagagaucgagaccauccuggccaacauugugaaacccugucucuacuaaaaaaaaaauacaaaaauuagcugggcgugguggugugugccuguagucccagcuacuugggaggccgaggcaggagaaucgcuugaacccaggaggcagagguugcagugagccaagauagcgccacuacacuccagucugagcgacagugugagacucugucucaaaaaaaaaaaaaaaaaaaaaacauuucagagaucuaaccaagcacaucuguggcccagaaucaacuuaagagucauuguuugagaccccuguguggagaugaaagccagugggaguggcguacaggugagagaugagauggaggagggaagugagggagugagcagaguucuggagcccuggggagaggccagcauucagaguucaggggaugagaggucaggggugaggggccgaccuugugguuccucccaugcuuguccaggagggagaugauggacuugaugugauucuccuggaugauguucagaaccucuggacucucaaugaggacacaguacaggaccuccaggaugccugccagggugcccagaaugagaggugaagcggccaugcccauccccucccacaagccucugucccacucccccggguucuccuaccagacgaggccuccagccgauccagcuugcugaccagccaguccaaguuuguggagaagagggcacaguugcuacgauugccacggauuagagaagcugaggggggaagaggugucagauccaauaggacuggggaucugggguguucucaggggagucaggacugggaccccuaccuaggaguucauagagaagauucacaaucucuuuccaggacucggcugccuccuccccugcaaacucagcaaagugggcagcagugguguagacauuuaggcggucuaugcaauucaggaccauggagagcauccccuaggaugaggaaaauaagaggcaucacaauaggagacccaggcccucccuuccuugucuuucuuggauucacgaauucauauuccuucaacaacuagugacgguguguucccagaucuaaaucagccccuuugguuucauauucccaaucagucccauugcucuccucuccuccuuggcuccccauaucuauucuuguccucucugacucuauccccaauaugagauucagucuaugauaauucaguccuuauuaacaccaggacugaguuuauacuuccccuuccugcacuuuucucuccauccuacucacuuccaggaaccccacucccaccaaccauccaacuggaaccccacucccaccaacuggagaggcccaguucauucuccacaccaaccaucagaaagauuuuucucacuuuaucuuuucuuuucuuuuuuuuuuuacauuuuaauauuuuuucuuauuucauugugaaucauaauauacauacagaaaaguacauaaaacauauacaaucaauucucauuauucauaguuauguucuauaaagugauuaugaagacugaauuaucaaauacugaaccacugcuucuaggggaaauacagggagucccugagagucugugacaguauuuucaucaaccacuuauuacauaaccuuguuuuuuauguuucuguuuaaagacaguuauuuaauauauauuguugagucauuaacauuaaauucacagccaacaguacuauaacucaugccuuaauuaagcuuaucuaacacauauuuucucaguaaggcacaucauagcuuucuugcacuuaggaaagcuagacagcacuucagcacuacacuugggagacauuauaaacagugaaaucaacaaaaaggacaaaacugucugggugcaguggcucacgccuguaaucccagcucuuugggagguggaggcggguggaucaccugaggucaggaguuugagacgagccuggccaacauggcgaaaccccaucucuacuaaaaauacaaaaauuagccaggcgugguggcucacaccuguaguuucagcuacuugggaggcugaggaggcaggagaaucauuugaaccugggagguggagguugcagugagccaagaucacaccacugcacuccagccugggugacagagagagacucuguuucaaaaaacaagacaaaacaaaacaauuguuguaucugcauccuggggccuagaucaguagugagaggagcagugccucaaaguggagagcacaaccaaaguggcaucacacugaccggcucugccacuaacuagcugugacuguagaggaccaaaaccuccuguggcucccaaagccaaaguccucaccaaggccuggcccucgucaccucucugcccucauuuccucccacucccccacccaagccucccugcuccaaucaccaccugacuguuucuggaacaugccaaacacccgcccaccucauggccuuugcacauggcuuccucucuuccuccaggucacccugucugacagcucugucuuaaacugcaaaaccccaacacucccuaccccuuaccugcugaauuuuucucuuuaacaguuauuaccaucuaauaugccauacaauuuacuuauuuauuuuauugaucuccugucucuccccgccaugucaacuccauaaggacagagauuuuuuucuguuuuguucacagcuggccuccccucccuaaugcccaaagaucuauuucugccucggcaccucccauaccccacacugauucuguccgcccaccccacagaccccgcgccagcagaccccgcccgcugagucggcagcccuaccucugaccucuggccccacuccuggccucaccuccccaggccucacccuauaccugagcuucacauaggccccgccccucagcucuuuuauuccauccuucucuccaggccccgcccccuggucggccauacgcccugccccuucccaaagguccugcccaccagcacagcaggcccgccccucccaaggccccgccccaucguguucucacuggcugggguuccuguccggcuccuucuccugccccgcccccuucucagacccuacuuccccaggucccucaggcccugccccgcccagcgccguggccccgccccucaguggucccgcccccugggcccacaggccccgcuccgcccucgccacguccucaccuccuccuggaagaggcucuggcgguugcgcaggcuucgcagcuugcucugcuucuccucgugcugcaaguccucggagggaggcucgaaguagaugaugagguccugcaggcucaggauaacgcccucgaugggcagcgccgugccagcggguggccccgagccccguggcuucccgcugaagcuguccaggcuccuacagggaccucgcagcugucagccacggcugggagcgcuaacugccgcaacgucacugccgcaaccucacucccgcaagacucccccagacccacccguuuuacagagagggagaccgagacgcagagagggaaaagcauuuguccgaggucacacaauggccaagggcagagcugggacugggacucgcuccuguguagguacaggggggucccggaacucagggauggagagguccaggguccaggcucugggugucaggggugugaaaguugggugaugaucaggaaugugaucaugguugucaaggucagauuaggggucaaguguacagaggucaggaguuuagagguuaggggucauguguauauuauuguuauuauuuuuugagaagggucucgcucugucagugaagcuggaguauaguggcucacugcagccucugcccccucggcucaagcaauccuccuuccucagcuucccaugcagcugggacuacaggcacgugccaccacaccuggccaauauuuuguuauuuuuuuuauagagacaggguuucacuauauugcucaggcuggucucgaacuccugggcucaagcgaucugcccgccucagccucucaaagugcuaggauuacaggcaugagccacugugcccagccuaauuuuuuuuuuuuuuuuuuuuuuuuugguagaggcggggucucccuaugcugcccaggcuggucucaagcuccugggcccaagcgauccucaugccuugcccucccaaagucuugggauuacaggugugagccacugcgcuuggcccauguauauguuagacaagggugugggcaacagagguagagaugaaagaggccaaguguauggaugcccggagcaugggacagcacaggagucaccccagcagggagggcagguugcucacuugaugaacugguuguauaggccauuggugcuguggaucaugcgggcggccugggacuccuccugcuggcagcgggucagcgacagugcgucguccauguggcccuccuggugcagcauggccuaggaguggggagacagaggucuggagugggcccagccacccagggccaugcccccaagacgucugucuagacuugaguucugcacuugcccccuccucccugcucugcagaaucucacugcaaauuccuccucauuuuucugucccccgucaucugucuccucugugucuuugauucucucucuccucucugucucucucugucccuguuuuugguuuugucugucuuugucucucuaucucucucaccucugucccugccucucccucucuaucucucuaucccuaucuccuuccugucucugucuccaggccagacccuuuccaccuguaccuacugcugacuuaacauuccccccgaccagaaagcucuaacccccaaauugaaccugucccagauagaaugccagaccaccuuuccacgaggugagaccaucauggcugccagcuucaccccaagccgaccuccccagaacucauccagucugcggcuguaaacaccauccaccugcugaugaugcucacguguccccacuuuggacauggcccaggccccgucucuacgcccuuggcucauguauucaacuacaggccuguuuuugcaaacgagugccuccccaaggauuccuacuuguccauucagcaaggcuguaguaaguggcucuguucuaggcacuggcaguaaagccuaagaucccuguccuucugagccaacacugacuguccccuaacuugguugauggcacugauacaagagguagaaaaaaauuauuuaggcagagaguaagggcaacagaguccucggcagaguuuccuuucuaacggaaagcagcccccaaaauaauuucuuuucuaacaaagagcagccuggaaaaucgagcuacaagcuugcaugggggaaugugccgauagaaaagguauaccuggggcuacgcauguccaacauggaggcuccaucuucccuuuauuuaguuauuuauuuauuuauuguuuccacguuguacagaaaaggaaugggcaacauggccagcucaggcagaggacccgcuuguacaauaaaagcuuaggguggaggcagccagaaauuugugcccuaugcaaauggcacaacugguccaaccagucuuuugcacccuagguaaaucagauaccaccuccccaccagcucaucuguaaagcccccugcauuucaccauggaacccccugcauuucaacccauuuuucugggacccuucucugcaguagagagcuccuucuuucgccuauuaaauguccccucuuaaccucacucuuugugugucugcguccuuguucucuguggcugugagaccacaaaccuugggugauacuccagacaaugaggcuguuucagcacuuccauccuuccaguugcuuggggcaaaaaaucauggcaucauccucaaccccuccccuucucucaccccacagccaaucugucagcaaauccuguuggcucuacccucaggaccccaccagaaucuacuacucuucccaacuccacaguccccuccugguccuguccacugucaucucccauuuguaacaucauggcagucucuucucuggucucccugcucuggcucuguccccugaccguagucuguucccagagacagccuaagaauucugugauccugcgucaggucacuucccugcccugcucaaaaucuccugugagcccaucucacucaggauaaaaacuagaaccuggccaggagcaguggcucacacuucacuuuaaucucagcacuuugggaggcugaggcaggaggaucacuugagccccaggaguuugagaccagccuguguaauauaaugagaccucgucucuacaaaaaacaaacaaacaaacaaaacuagaccucucccauggcccacaaggccucacacgagcuguucccauccccucucuuuccucaccaaccacuacuccagccugcucacccuguuccacacuguggcuucuuucugcuacugcaacaagccaagcucauguuaaccucaggaccuuugcacaugcuguuccugcugccaaaaauaguuuucccacuccuuaauuguaaaacuauguacuucacuaaaggcaguuuguucacaauuucugagcacugggagggcagggaacaggucgcuacagcucaucuauuuucugcacacacaaccagaacaacgcggguacucaguaauuguuuguugaaaguuauucucaguuggucauuauccaucuuuuucucacucucucuguuuuuguuuuuguuuuguuuuguuuuuguuuuucugagacggaguuucacucuugucagccaggcuggagugcaauggcacgauauuggcucacucccaaccuccacuucccagguucaagcaauucuccugccucagccuccugaguagcugggauuacaggcagcugccaccacgccuggcuaauuuuuguauuuuuaguagagacaggguuucaccauguuggccaggcuggucucaaacuccugaccucaggugauccaaccgccugggccucccaaagugcuaggauuacaggcaugagccaccacgcccggccgugucucuguuucucugucucuaucuuucucuauuucucuguuuccaugccucuuuaucucugccuuucccugucugucuacagauuucugcucucucucucucuccauguagauauaucccuuugucuuuuuugcuguuucucucagucucaguuucucucccagucucuaucuuucucucagucucauccucaaacucccaaggucucaagcaccaccccucaguacccuccugcaccccaucucacucugucacccaggcuggaguacaguggcaugaucaccagcucacugcagccuugaccuccuggacucaagcgauucucccaccucagccuccugaguagcugggauuacacccaccuucuucuugagcacgccgagccgcagggccuuggggucuggagcagcauaggugagccacaguccugaggccacaugcugcacgaagcacagugacuccccguacuugaucucaggggggcccaugcccuccacaucccgcuugggggccacauccagcuucuccuacaggggcaggggacacaggucagccuccucugccuguguguuuagcaggggagccccccugagggacugcagagugcaggcugggcugggacugggggcuucaggugagggagggcgccacaaaccccacugaccuuggagaugcggaagcagaaggagguagccuuggugugagccuugcuggcgucaaccaccaccaggcccugguccucggugagcgcuagguacugcccgguagugacaugccggacucggaguggcuggccccagcgcagguggcucccacuccagcuguggagggugagagccaaggggagucagaggaccccccaguucucccauggacauuacagucuuuucuucuuuuucuuuuuuuuacagaaaccaggucuugcuauguugcccaagcugaucuugaacuccagggcucaagcaauccucccaccucggccucccaaagugcugggauuacaggcaugagccacugcacccggccuggacacuauagucuugguccaaaccuccucaagccccgaacccucuuccaguguuccucaaaccaucuuaauuaggaccccuaguccucccuuaggaaccccaauccucucucaggccuucacagcuuccucagggcuucccaaaugucuccagugcccucguuuuuccagaccccuaaauucccccaucauuuuacucagggcccccaaucucucccucaaaaaccccccaaaccuccuuuucccacaggacuccagagagacuucauuuuuuauuuuuguuuugcuuguuuuuuuuuuuuuuuuuaaggcagggccucacucuguugcccaggcuggagugcaguggcacaaucucaccucacugcaaccucugccucccaggcucaagugauucuccugccucagccucccgagaagcugggauuacaggugcgugccacuaccgccuggcuaauuuuguauuuuuaguggagacgggguuucaccauguuggccaggcuggucuugaacuccugaccucaaaugauccaccugccucggcuucccaaagugcugggauuacaggugugagccaccgcccccggccuuuguuuuuguauuuuuuugagauggagucucgcucugucgcccaggcuggaaugcaauggugcaaucucagcucacugcaaccgccaccuccuggguucaagggauucuccugccugagccuccccaguagcaaggauuacaggugcccaccaccacaccaggcaaauuuuuguaucuuuaguagagacaggguuucaccacguuagccagccuggucuggaacuccugaccucaagugauccaccugccucggccucccaaagugcuggcauuacaggcgugagccaccacgcuuggccucuuuuuguuuuuguuuuguuuguuuguuuguuugagacaggaucuugcucugucacccagacuggaguacuguggcaggaucucagcucacugcagccuugacccgcugggcucgagugauccucccaccucagccccacaaaguagcugagacuaaaggugcacaccaccacacccggcuaauucuuuauuuuauuuauuuuauuuuauuuuuuuugcagagacgggggucucaugauguugccuaggcugguuuugaacuucuggccuccagugauccucuugccucagccucccaaagugcugggauuacaggcaugaagucaccacgccuggccgagauuuucaucucucucucaggcugcucugauuuucccucgagacccuucagucucuuuaucagaucuucccucaagaccuuuucuguccucccagccugccaggugaccccagccucucccuggucucuccccaucuuccccgcccuaccugauucucaguggcuccagccuccagagggagcgggcaugagugcacacagcuccccccucauaguagacaagucuggggacacagaagagagugaagucaaggguucagcuccccggaaucuggucccuaauccuacucauagggucccagcccuccacguccaccccuagaccccaggcccucucguccacagcccagaccugcgcuggucaucacugucagcaggggaaauggucagacacucauccauauguccaugaaagaggcggaggacgugaccucccgucacgaagccuggagaggagcaagggaaguuggucaaugggaggcuggagccccaggaagaccaggagccaagaugaagucaggggcccugcuccuccccugggggaaccugagggcugaguuugggguuuugcaguuggaggucugaguuucaggguauuuucaggccaagguugaggccugaaguggggauaugagacuuggggucugaagcugggcaccuaauuuggggggucugggucugcagagcugaggcugggggaguugugagucugucauuuaagguucugaguuuggacuuuugagguuggggucagaguguguguguggugaaagguggaggucuaauguucacugguguuggagucugaguucuaggguugagguuuggccucuggguuuagaagggugaugguugggucugaggcuggguucuggaguuagggccugaauuuugaggguuuuuuuguuucguuuuguuuaguuuuguuuuuaagacagaguuuugcucuguugcccaggcugcagugcaguggugcaaucuuggcucacugcaaccucugccucccagauucaagcaauacugccucagccucccaaguagcuggggcuacagccgcccgccaucaugcccagccaauuuuuguauuuuuaguagagaugggguuuugccauguuggcccaggcuggucucgaacuccugaucucaagugauccacccgccuuggccccucaaagugcugggauuacaggcgugagccaccgcgcuuggccuugaguauugauuuuggaggccagaagcuggaaagugagguuggggaucugagguuacaaucuaggguuuggaagucugagcuuugggguaugacguaggaacgaucugagcuuuguaguuagaaguugaugagucugaguuucagggucugaguuugagggucaaaaaccaucugugguuugagucccagcgugggucugguuuaggacucugaaguuugggguaugagacuuggggucaaaguauugggccaugccuggagucuuagcaugggaaucugaauugggaguuugcuuugguggauuuugguuuuugggauuugaaauugaaguuuggaagucugagguuggagggcugaagauuggagucuugguuuggggaucugagguuugaauuugggggucuggguuugaggggcugagaucauagucuaugcuuauugucuaaggaguuuaauuuuuuuuuuuuuuuuuuuuuuuuuuugaggcagagucuggcucugucacccaggcuccucugccacccagguucaagcaauucuccugccucacccuccugaguaggugggauuacaggcacaugccaccacacucagauaauuuugcauuuuuaauaaagaugggguuucgccauguuggccaggcuggucucaaacuccugaacucaggugauccaccugccucggccucccaaagugcugagauuacaggcgugagccaccaugcccggccuuuaaacaagcuuuaaacuugauguuuuaagauuugaaucugaguuuaggagccuugggggcuaauacuuuggggucuaaguuugggagccugauauuuaguucgggguuuggggggguucugagcucugggggucuggauuuggggucagcuggagaucuaagugugagagccauaauuuggagaucuagguuugaggucugagguuccaaggcuccauuuggguaugccugaagggcaacauuaagggucuguuuuggggggaucuccauuuagggggaggucuggggcccucacccucuucgcagcgggagcagaugggguucauguuccauagugucugcaugaaggaagcgucaaccuggagcuccccacuggcggucgacaggugcugggggccaccaggaugcggcagucagagacgauugcaggggugggcgagagucccagcgucagaggccagaaaucaaggguggauacccggaaaccggcagaugggagacagagucaucagagaucacagaucaggaaaugaucaagucgggcaaugggaggucagaaaucagaaaauuggaugucaggggucaggaaaugggaaauugggagucaggaccuugggggugggagaucagccaggcaaacccauggugagaagauggggaccaucccaugcgcccccagaccugggagcaggaggaaccgcaauggcucaccagguagcgcucggaggagacacugacaaggaugaugucauccccaacgcggaccuuuucuccuucagaccucugcuuggaggcugggugcaugguccaccagcaagccucuccuauggguggggauggaauggggguggcugucagaugauggcuucccagaaugcucuuccccagggcucucccuccaccaggccucccgggcccuuggcccacaacucuccuaucacugccaccaacucucugccuaacaguuccccguuccugacuucagacucucugccuagugguccccaacgugugucugucucccugucuggacuguaccgcagacucucugcuacgaagcccccauucauguccccaggguagucucaugcuugccuuggcguucugcagaccuucuacccccugaaucccugcugcggggccccuucacacccccauccccuccagcugcugcaccuguugcguccuccugcagucccacaucgaaggccagcuugucagucauggagcgggagguggugaggcagcucagauacuaggguuguagagggaggucagccuccuucuagcaggccccacaugcccuggccccugcccacgcccaccgagguugcacucaccaugcggcugugugcaugccggagcaggauggcauggccauacaggagcguccugugucccccgcccugggaugacugcagggggagggagggaacagaauaagcacagauccccggacucuccagauccccaagaggucuggccuagucacaggugacaagaugcucccuguaaaauaccaugcucaggccuagagguaaaacagccucagcucagacuccugcaggacucucugccucaguuuccccauucacggaagcagggacuauaucucugagaugccuauggauggagcauuuuauauuccccaaagcccacucuguccucucugcugccuucaccuuggcuggaaaucacucaggagaaugaacccgucuucuaguuuccuggggacccugaggacacccccaagaucucguguuccguguacucuggccccucugcucugaccucccccaucaugcugcgcugcagcccgugugcucugggacaggccuagcaguuguuccauaggugaaugucacccgcagucuaagacagccgccccuccccagcacaagguccccaacccggaccuuggggcagacaucugacugcucgaugucaccaugccucccaucauggcugucacaugcccaugcuccaagggcgccauggggguaccaugugauggggccaggugaucacaugguggacccacuccuggaccagagggacucacgcuugggaugggggaggugggagaggucccaugcggagaggagcugggaucaggguugggggaaaggacuggaaagaggagaaaggagcaggcgucggggacaggggcucagaagcccccauccccuuccuuccuuccugccuggccuguucugggcuccacagccccugacaacuggggugggggaggacccuccagccccugugugcagggcgugggccugagagacgggccugccuggggucaggagggguggaaggacaggugacauccaaggccggaccuacccacuuauccaaauugagggccuguggggggcagggcagagagaggaagaagagcagaugguaagcgacccccggguccucucacccauccuugccaccgugcccuaaacgaccccuggguccucucgcccaucucugccaccccgcccacccccaggugggguccucaccuccacgccagccuccaccguguuagccagcaucuccugcagggcucgcacagacagggacugcuccaggacgaagcaacagauggccagaucggggggcacauucuggggugggagggggauguaagugaggggucagaagacccccccaccccagcaacauucccugccacacucccuccccuagucuggaugcccacacucuugagacgccagaccccacccccaccccacaggaaggcccugcccucugccaucccccucagacacacugaaucuagaccaacaucacgaaaacaccucuucugugccuccucccucaaacaccucagacccacccagacuccauagaaacuucccuaacccuaacccuccccacuaacccguguuccaccuaaucucauaggaagccucacccccaugccucuccccugagacacacugacccugcuccaaggacaggaaucuccuguucuguguccuccucugcagaugaccccacaucccuccaaccccaaaggaagccccaccuccugccuccaccaucacacaguccucgcuccugccuuuuccuucaaacaccucugaccucugcuucacagacacaggagggcgcucaaccuuauacucccuccucagucucccaccguccaacuccuaaacucaagacucugcuccucagaccccacucgcucagacucugaaacuucccccccaucagauuccacauccccuggucugccagccccugccccuccuccaggucuccuccuuucagaccccaggcuccuuccaccucucagcccccagucucccaagucaggccccugcggguguccccugacccuccaggccccuuugccuuggauccaaggcccucggccccucgauccccugcccucucagacuccagcugcccccacccucagaauucccgagcucggacuuggggaucaccuucccucagacuccacuaccuaagacccucaagcccccacccccaucagaugcccuccgcaucucaggcccugucccauccucccccgcccccgccgagggccuccuucccccuaaaacaccccauaauaauucagucuuguuaccugaaaaacuuuuaaaaauaaaaaauaaaaccccuccuccuugugcuccagguccuuugccucgucccucccuacccccccuccccacgccccagccgucccucaguuucccugcuccucccuccugagacccguuccccaaccagcccuucuucuggacucucaggcuaccuccccuuaaacccgaggcuuucugcccacucagccaccugccaaggaacguucuggaucagcagcccccgcccuggccuaccacacuucugugcacacagggauucccuccaacaccccagacccccugccccucccuucucagaccuccaccccuccccaccucagguagccccucuuagccuuagccccccuccucacuuucucuccugucagcaccuccuuucagacucccagaacccucuucuuuggacccaagauucucugccccuucagacgccccuguccccaggccccucucccuccugcacagaccugcgcguugcuagugggcuccaggaagcacaggcgguugccgaagcccucggcggccaggcagagcuugagcugcuccuugagcacgguagcgcugcacugcaggaccaccucaucguccugcggaaccgaggggcagcgucuccaggggggccuggcccggauaccacaaauacugcagaccacaggccccuccucccacccugguccuuaugaaaaagacagugacugacaagaucaacccacccaagcccucuaccugcuccugacaacuccuugagauacaagccagcaucaucccauuuauuuuauuuuuuauuauuuauuuauuugaaauagucucuguugcccaggcuggagcacaguggugcaaucucagcccacugcagccuccaccuccuggguucaagcgauucuccugccucagccucccaaauagcugaaauuacaagcgugcaccaccacaccuggcuaauuuuuauauuuuuaguagagacaagguuucgccauguuggccaggcugcucucgaacuccugaccucaaguaaucaucccauuuauuuuuauuuuuagagacagggucuugcugugucacccaggcuggagugaagugguguaaauuauagcucacugcaaccuugaccuccuggacucaagcaauccuguugccucagccuccugaguagcugggacuacaggcaugaacuguugugccuggcuuauccccauuuuaaaauggggaaacugaagcucaaagugggacacagauggaccaaggccacacaguugguaacaggaggagcugggauuugaaccucaguccaacuggcuccagaggccucccaaguggggucugcaaagugauccacuggaagguggaaacuugcucaaguuaaauugcuuuuuaagcucaucuuucucuaaauucucucuuuugcguguuguuuuaauaauagacugcuauuuuaucuuuauuuauagacugcuuucuaauggcaccugaaugcaaugugacagcccgggcuggauccuggaaguaccauaaaggacaguauugaguccgggcgcaguaguucccaccuauaaucccagcacucugggaggccgaggagguggaucacuugaggucaggaguucgagaccagccuggccaacauggugaaaccccaucucuacuaaaaaauacaaaaauuagcggggugugguggugcacgccuguaguuccagcuacucgggagucugagccaggagaaucgccugaacccaggaggcagagguugcagggagcugagaucgagccauugcacuccagccugggugacagagugagacuccaucucaaaaacaaacaaacaaaaccaaaaauagccgggugcgguggcucacgccuguaaucccagcacuuugggaggccgaggcagguggaucaccugaggucagaaguucgagaccagccugaacaacauggagaaacccugucucuacuaaaaauacaaaauuacccgggcaugguggcguaugccuguuaucccagcuacuugggaggcugaggcaggagaauggcuugagccugggagguggagguugcuaccaccagauugcacuccagucuggggcaacaagagugaaacuccagccuggggaaaacuccaucucaaaaaacaaacaaaaaaaaaaauaguaaugguauaggcuguuuuuauuaggcacuuuacuggcucccaggccuuaugcucugggccuuacacucauuuaacagacuuugguugagcaucugccaugggccaggugcuguucuaggcacuaaauauagagcagugaauaaagucaaugaagaucaagaucccugccuuggcuggacgcggugguucacaccugcaaaucucaacaguuugggaggcugaggcagaaggauuacuugagcccaggaguuuaagaccagccuggggccaggcacggcggcucacgccuguaaucccagcacuuucggaggacaaggugggagggucacaaggucagaggaucgagaccauccuggcuaacauggugaaaccccgucucuacuaaaaauacaaaaaauuagccgggugugguggcgggcgccuguagucccagcuacucgggaggcugaggcaggagaauggugugaaccugggaggcggagcuuguagugagccgagaucgcaccacugaacucgagccugggugacagagcgagacuccaucucaaaaaaaaaaaaaaaaaaaagacuagccugggcaauauacauaaugagacccccaucucuacaaaaguuaaaaauuaaaaauuagccgagcauggugguauguuccuguagucccugcuacucgggaggcugaggugggaggacugccaagccugggaaaucgaggcugcagugagucauaaucaagccccaccucccuggggccccugagacagauugagaccaugucucaaaaggaaaaaaaaaaaaucacggcccucagggagcuuaaauccucaugguggagacagggaauaaacaggugaauuaauauguaauguuaaugucagugauagguguuauagaaaaaauaacccaggcugauguaagagaguggcuuuuaggauggggaugagaucagugagggagugaagugacagccucuccaaggaggugacauuugaguugagccuuguccaaauaacaagaaggaaucaggccugcucaucucugggguaagaggagggagucugggugcugggguguugagggacagcacaggagauggagcaggaugguggccgcaaggaggaggggcaaacagggaggagaugaggucagagagauacuugcaugggccccuugaaaaauaacuuuuuuuuuuuuuuuaagagacugggucucacucugucuccugggguggagugcagugguacgaucauagcucacugcagccuuggacuccuaggcugagugauccucuccauucagccuccugagaagcuaugacugcaggcucaugccaccacacccagcuaauuuaagauauauauauuuuuguagacacagggucuugcucuguugcccagacuggagugcaguggcgagaucacagcucacugcagcuuccgacuccugguuucaagugaucuucccaccucagccucccaaguagcugguacuacaggugcacacugccacgcccagcuaaaguuuaacauuuuuuguaaagacaaggucucccuauguugcccaggcuguuuuugaacucccggccucaagcaaucguccugcuucagccucccaaagcgaagggauuacaggugugagccauggggucuggcuauuguauauaaucuuguccccauuuuccagaugagaacacugaggcucagagagaaaaauaaaaaucacuugccccaaauuaggaagcaggcaaauggcaaagccagagugcaaagcagcgacagagagcccaaucauuaccacauugauucucaaacuuuuccugaauuagaaugaaggcaggcugggcgagguggcucauuccuguaaucccagcacuuugggaggccaaggugggcgcaucacuugaggucaggaguucgagaccagccuggccaacauggugaaaccccaucucuauuaaaaguacaaaaauuagccgggcguaguggugcaugccuguaaucccagcuacucgggaggcugagacaggagaaucgcuugaacccaggaggcggagguugcagugagccgagauugugccauugcacuccagccugggcuacaaaggaagacuccaucuuaaaaaaaaaagaaaaagaaaaaaaaaaugaaggaagcggaggguucugguuaaaaauauagcuucccugcuggcccaguccccuaccaccaucaagagccugauuuggggucagcagggaauacguacuguuuaccagaccccaggagcuucuaacuugggccaggguuugagaaaccccagccuggguaaggguagaggucaccacccaccaaagggaagugaaaucaguuugggggggcuguggccaucauacuuaaccaaacgaagcaaaauggagcaagaauagaaaaucacagcgugcccaucaugcuucaggggccaucuacauuuuaugagacuuguuucaguuaaaaauagguacaagugaauggucacaggcccuguguugucuauaauaguaaaaauuggagacgacucaaauguccaucagcaggugaacugauaaacacaccacaguauagucgcacaauggaauaauauucggcaacaaaaagcaacaaacucaauacaugcuacauggaugaaugucaaaaauauuaugcugagugaaagaagaaaggccgggcaugguggcuuaugccuguaaucccaaaacuuugggaggccaaggccggaggauuucuugagcccaggaguuugacaccagccugggcaauauagugagaccucaccucuacaaaaaauuuuacaaauuagccaagcauggugcuaugcacguguagucccagcuacucaggaggcugaggugggaggaucacuggagccugggaaguggagguugcguugaaccaaccaccaaacugcuguacuccagccugggcaacagauugagacucugucucaaaaagaaaaaaaaaggccgggcgugguggcucacaccuguaaucccagcaccuugggaggccaagauggguggaucaucugaggucaggaguucaagaccagccuggccaacauggugaaaccccaucucuacuaaaaauacaaaaaauuagcucggcuugguggcacgcgccuguaaucccagcuacucaggaggcugaggcagaagaaucgcuugaacccaggaggcagagguugcagugagcugcgaucacgccauugcacuccagucugggcaacaagagugaaacuccaucucaaaaaaauaaauaaauaaacaaaaacaaaacaacucauugaacacauaaacuggguaaaauuuauugcaggucaauuauaccucaauaaaguugguuuuuagucaugucuaugcaugugugcauguacugaguuguaagacagaauguuucuuaugggcgggaugugguccagaagguuuuuuguucugagauggagucucgcccugucgcccaggcuggagugugcaguggcgcaaucucggcucacugcaaccucugccucccagguucaagcaauccucccacuucagccucccgaguagcuaagauuacaggcaugcaccaccacgccuggcuaauauuuuuuuguauuuuuaguagagacgggguuucaccauguuggccaggcuggucucaaacuccugaccucaagugauccgcucaccuuggccucccaaagugcugagauuacaggcaugagccacugagcccagccuccagaaaguuuugagaaauccaccacgaccucaguaacaaucagaaaaacugacccagucugggguggagagauuccagggccaagccuccagaacccuaacgcugacuacuuuggcaagucugggcccagauuuucucuggugaaggcaauggggcugggcaccaggggcauccagagaugccacuuccuggccuugaccuugggugagugauucuaccauucgggccuugguuucccucaaaucugucagggagauaaagauaggacccuaccucagaagacagggcagcaaggauauaauuagaugucucaggaggcagaggcccagggcacagggccugguuuagagcgacagcucaagagccaguggccauggccauggucuuauuagggcuggggagggcccgacccauggugucugcugaggggcuggggcuggggagagagucucggcugaagcuaggccccuucccagcuguccccauccuucacuaccagccccagcuguuuguuccucucucccaggaaaccggacccggcucgccaggguccuauucuggggcaggaaugcugugucagcauuuccuguguggcuccagggccccggggggaggggcggggcuagcgucuggucagcagaccuagcccagaggagaggacguccccucccauauuuacgaccccacacccugcggagccacugggaggggaagaugggaaggacaaggagauggcagccccuccucccucucauccccuccccauccccugcccaggccccagaaaagccggcuauucugggagggacaccuguuguuccaauucccaucccugcccccagcuggggcucagaugcagggaguaacccagcuagagagacagcgaaaaucagagggccuuaagcuaagaaacagagacagggagacugagauggaggaagagacagagacauggagacacccaaagagacagauggggagagacaccacccagagacccugcaagaccauuagcagccauugggagcagcccuccugcccaaaacgaagaaggaaagaaagacccagaacccaagagaucccucccccacaagacccucaagggcuaggaguuggaagcagcuguguccuccagcucacuccagcucccuucucaagaauuuaaauaggucagagucuggagcaaaaagagaauuagggcuaagguggggguggggggauggcuaaaucaagcccaggaauuagaaccaccuuccccaagugccugcuuccaagauggugugagggugugcucccucggggguccuucuugugggggacaaaucgcuaaagucagaagagagggcaaccgaagaucccuuucccauucuggaguccccaauccuacuaauucucuguagugagaaaggugaaggagacuaaaagacagagugacagucacucaaagugacauaggaagagaccucgagucucagagaccaccagcaagccggacagggacauucagagacagagagacccucagagagccccaagagauagccccacaggccccuaacccagagauacgcaccguccgcaggaacuggaccucgucuucgccuucugcgucacccaugaugucgaggucggaagcccagggucugaggucggggaacagagggagggggcugcgggcugggcgggagggcugggggcgggcuggggucggagaccucuggagacaccagaggcacccgcgagguaga

SEQ ID NO: 191741 - RNA, 153865 nt, Homo sapiens
ucuaccucgcgggugccucuggugucuccagaggucuccgaccccagcccgcccccagcccucccgcccagcccgcagcccccucccucuguuccccgaccucagacccugggcuuccgaccucgacaucaugggugacgcagaaggcgaagacgagguccaguuccugcggacggugcguaucucuggguuaggggccuguggggcuaucucuuggggcucucugagggucucucugucucugaaugucccuguccggcuugcugguggucucugagacucgaggucucuuccuaugucacuuugagugacugucacucugucuuuuagucuccuucaccuuucucacuacagagaauuaguaggauuggggacuccagaaugggaaagggaucuucgguugcccucucuucugacuuuagcgauuugucccccacaagaaggacccccgagggagcacacccucacaccaucuuggaagcaggcacuuggggaaggugguucuaauuccugggcuugauuuagccauccccccacccccaccuuagcccuaauucucuuuuugcuccagacucugaccuauuuaaauucuugagaagggagcuggagugagcuggaggacacagcugcuuccaacuccuagcccuugagggucuugugggggagggaucucuuggguucugggucuuucuuuccuucuucguuuugggcaggagggcugcucccaauggcugcuaauggucuugcagggucucuggguggugucucuccccaucugucucuuugggugucuccaugucucugucucuuccuccaucucagucucccugucucuguuucuuagcuuaaggcccucugauuuucgcugucucucuagcuggguuacucccugcaucugagccccagcugggggcagggaugggaauuggaacaacaggugucccucccagaauagccggcuuuucuggggccugggcaggggauggggaggggaugagagggaggaggggcugccaucuccuuguccuucccaucuuccccucccaguggcuccgcaggguguggggucguaaauaugggaggggacguccucuccucugggcuaggucugcugaccagacgcuagccccgccccuccccccggggcccuggagccacacaggaaaugcugacacagcauuccugccccagaauaggacccuggcgagccggguccgguuuccugggagagaggaacaaacagcuggggcugguagugaaggauggggacagcugggaaggggccuagcuucagccgagacucucuccccagccccagccccucagcagacaccaugggucgggcccuccccagcccuaauaagaccauggccauggccacuggcucuugagcugucgcucuaaaccaggcccugugcccugggccucugccuccugagacaucuaauuauauccuugcugcccugucuucugagguaggguccuaucuuuaucucccugacagauuugagggaaaccaaggcccgaaugguagaaucacucacccaaggucaaggccaggaaguggcaucucuggaugccccuggugcccagccccauugccuucaccagagaaaaucugggcccagacuugccaaaguagucagcguuaggguucuggaggcuuggcccuggaaucucuccaccccagacugggucaguuuuucugauuguuacugaggucgugguggauuucucaaaacuuucuggaggcugggcucaguggcucaugccuguaaucucagcacuuugggaggccaaggugagcggaucacuugaggucaggaguuugagaccagccuggccaacauggugaaaccccgucucuacuaaaaauacaaaaaaauauuagccaggcgugguggugcaugccuguaaucuuagcuacucgggaggcugaagugggaggauugcuugaaccugggaggcagagguugcagugagccgagauugcgccacugcacacuccagccugggcgacagggcgagacuccaucucagaacaaaaaaccuucuggaccacaucccgcccauaagaaacauucugucuuacaacucaguacaugcacacaugcauagacaugacuaaaaaccaacuuuauugagguauaauugaccugcaauaaauuuuacccaguuuauguguucaaugaguuguuuuguuuuuguuuauuuauuuauuuuuuugagauggaguuucacucuuguugcccagacuggagugcaauggcgugaucgcagcucacugcaaccucugccuccuggguucaagcgauucuucugccucagccuccugaguagcugggauuacaggcgcgugccaccaagccgagcuaauuuuuuguauuuuuaguagagaugggguuucaccauguuggccaggcuggucuugaacuccugaccucagaugauccacccaucuuggccucccaaggugcugggauuacaggugugagccaccacgcccggccuuuuuuuuucuuuuugagacagagucucaaucuguugcccaggcuggaguacagcaguuuggugguugguucaacgcaaccuccacuucccaggcuccagugauccucccaccucagccuccugaguagcugggacuacacgugcauagcaccaugcuuggcuaauuuguaaaauuuuuuguagaggugaggucucacuauauugcccaggcuggugucaaacuccugggcucaagaaauccuccggccuuggccucccaaaguuuugggauuacaggcauaagccaccaugcccggccuuucuucuuucacucagcauaauauuuuugacauucauccauguagcauguauugaguuuguugcuuuuuguugccgaauauuauuccauugugcgacuauacugugguguguuuaucaguucaccugcugauggacauuugagucgucuccaauuuuuacuauuauagacaacacagggccugugaccauucacuuguaccuauuuuuaacugaaacaagucucauaaaauguagauggccccugaagcaugaugggcacgcugugauuuucuauucuugcuccauuuugcuucguuugguuaaguaugauggccacagcccccccaaacugauuucacuucccuuugguggguggugaccucuacccuuacccaggcugggguuucucaaacccuggcccaaguuagaagcuccuggggucugguaaacaguacguauucccugcugaccccaaaucaggcucuugauggugguaggggacugggccagcagggaagcuauauuuuuaaccagaacccuccgcuuccuucauuuuuuuuuucuuuuucuuuuuuuuuuaagauggagucuuccuuuguagcccaggcuggagugcaauggcacaaucucggcucacugcaaccuccgccuccuggguucaagcgauucuccugucucagccucccgaguagcugggauuacaggcaugcaccacuacgcccggcuaauuuuuguacuuuuaauagagaugggguuucaccauguuggccaggcuggucucgaacuccugaccucaagugaugcgcccaccuuggccucccaaagugcugggauuacaggaaugagccaccucgcccagccugccuucauucuaauucaggaaaaguuugagaaucaaugugguaaugauugggcucucugucgcugcuuugcacucuggcuuugccauuugccugcuuccuaauuuggggcaagugauuuuuauuuuucucucugagccucaguguucucaucuggaaaauggggacaagauuauauacaauagccagaccccauggcucacaccuguaaucccuucgcuuugggaggcugaagcaggacgauugcuugaggccgggaguucaaaaacagccugggcaacauagggagaccuugucuuuacaaaaaauguuaaacuuuagcugggcguggcagugugcaccuguaguaccagcuacuugggaggcugaggugggaagaucacuugaaaccaggagucggaagcugcagugagcugugaucucgccacugcacuccagucugggcaacagagcaagacccugugucuacaaaaauauauauaucuuaaauuagcugggugugguggcaugagccugcagucauagcuucucaggaggcugaauggagaggaucacucagccuaggaguccaaggcugcagugagcuaugaucguaccacugcacuccaccccaggagacagagugagacccagucucuuaaaaaaaaaaaaaaaguuauuuuucaaggggcccaugcaaguaucucucugaccucaucuccucccuguuugccccuccuccuugcggccaccauccugcuccaucuccugugcugucccucaacaccccagcacccagacucccuccucuuaccccagagaugagcaggccugauuccuucuuguuauuuggacaaggcucaacucaaaugucaccuccuuggagaggcugucacuucacucccucacugaucucauccccauccuaaaagccacucucuuacaucagccuggguuauuuuuucuauaacaccuaucacugacauuaacauuacauauuaauucaccuguuuauucccugucuccaccaugaggauuuaagcucccugagggccgugauuuuuuuuuuuuccuuuugagacauggucucaaucugucucaggggccccagggagguggggcuugauuaugacucacugcagccucgauuucccaggcuuggcaguccucccaccucagccucccgaguagcagggacuacaggaacauaccaccaugcucggcuaauuuuuaauuuuuaacuuuuguagagaugggggucucauuauguauauugcccaggcuagucuuuuuuuuuuuuuuuuuuuugagauggagucucgcucugucacccaggcucgaguucaguggugcgaucucggcucacuacaagcuccgccucccagguucacaccauucuccugccucagccucccgaguagcugggacuacaggcgcccgccaccacacccggcuaauuuuuuguauuuuuaguagagacgggguuucaccauguuagccaggauggucucgauccucugaccuugugacccucccaccuuguccuccgaaagugcugggauuacaggcgugagccgccgugccuggccccaggcuggucuuaaacuccugggcucaaguaauccuucugccucagccucccaaacuguugagauuugcaggugugaaccaccgcguccagccaaggcagggaucuugaucuucauugacuuuauucacugcucuauauuuagugccuagaacagcaccuggcccauggcagaugcucaaccaaagucuguuaaaugaguguaaggcccagagcauaaggccugggagccaguaaagugccuaauaaaaacagccuauaccauuacuauuuuuuuuuuuguuuguuuuuugagauggaguuuuccccaggcuggaguuucacucuuguugccccagacuggagugcaaucuggugguagcaaccuccaccucccaggcucaagccauucuccugccucagccucccaaguagcugggauaacaggcauacgccaccaugcccggguaauuuuguauuuuuaguagagacaggguuucuccauguuguucaggcuggucucgaacuucugaccucaggugauccaccugccucggccucccaaagugcugggauuacaggcgugagccaccgcacccggcuauuuuugguuuuguuuguuuguuuuugagauggagucucacucugucacccaggcuggagugcaauggcucgaucucagcucccugcaaccucugccuccuggguucaggcgauucuccuggcucagacucccgaguagcuggaacuacaggcgugcaccaccacaccccgcuaauuuuuguauuuuuuaguagagaugggguuucaccauguuggccaggcuggucucgaacuccugaccucaagugauccaccuccucggccucccagagugcugggauuauaggugggaacuacugcgcccggacucaauacuguccuuuaugguacuuccaggauccagcccgggcugucacauugcauucaggugccauuagaaagcagucuauaaauaaagauaaaauagcagucuauuauuaaaacaacacgcaaaagagagaauuuagagaaagaugagcuuaaaaagcaauuuaacuugagcaaguuuccaccuuccaguggaucacuuugcagaccccacuugggaggccucuggagccaguuggacugagguucaaaucccagcuccuccuguuaccaacuguguggccuugguccaucugugucccacuuugagcuucaguuuccccauuuuaaaauggggauaagccaggcacaacaguucaugccuguagucccagcuacucaggaggcugaggcaacaggauugcuugaguccaggaggucaagguugcagugagcuauaauuuacaccacuucacuccagccugggugacacagcaagacccugucucuaaaaauaaaaauaaaugggaugauuacuugaggucaggaguucgagagcagccuggccaacauggcgaaaccuugucucuacuaaaaauauaaaaauuagccaggugugguggugcacgcuuguaauuucagcuauuugggaggcugaggcaggagaaucgcuugaacccaggagguggaggcugcagugggcugagauugcaccacugugcuccagccugggcaacagagacuauuucaaauaaauaaauaauaaaaaauaaaauaaaugggaugaugcuggcuuguaucucaaggaguugucaggagcagguagagggcuuggguggguugaucuugucagucacugucuuuuucauaaggaccagggugggaggaggggccuguggucugcaguauuugugguauccgggccaggccccccuggagacgcugccccucgguuccgcaggacgaugaggugguccugcagugcagcgcuaccgugcucaaggagcagcucaagcucugccuggccgccgagggcuucggcaaccgccugugcuuccuggagcccacuagcaacgcgcaggucugugcaggagggagaggggccuggggacaggggcgucugaaggggcagagaaucuuggguccaaagaagaggguucugggagucugaaaggaggugcugacaggagagaaagugaggaggggggcuaaggcuaagaggggcuaccugagguggggagggguggaggucugagaagggaggggcagggggucugggguguuggagggaaucccugugugcacagaagugugguaggccagggcgggggcugcugauccagaacguuccuuggcagguggcugagugggcagaaagccucggguuuaaggggagguagccugagaguccagaagaagggcugguuggggaacgggucucaggagggaggagcagggaaacugagggacggcuggggcguggggaggggggguagggagggacgaggcaaaggaccuggagcacaaggaggagggguuuuauuuuuuauuuuuaaaaguuuuucagguaacaagacugaauuauuaugggguguuuuagggggaaggaggcccucggcgggggcgggggaggaugggacagggccugagaugcggagggcaucugaugggggugggggcuugagggucuuagguaguggagucugagggaaggugauccccaaguccgagcucgggaauucugagggugggggcagcuggagucugagagggcaggggaucgaggggccgagggccuuggauccaaggcaaaggggccuggagggucaggggacacccgcaggggccugacuugggagacugggggcugagagguggaaggagccuggggucugaaaggaggagaccuggaggaggggcaggggcuggcagaccaggggauguggaaucugaugggggggaaguuucagagucugagcgaguggggucugaggagcagagucuugaguuuaggaguuggacggugggagacugaggagggaguauaagguugagcgcccuccugugucugugaagcagaggucagagguguuugaaggaaaaggcaggagcgaggacugugugaugguggaggcaggagguggggcuuccuuugggguuggagggauguggggucaucugcagaggaggacacagaacaggagauuccuguccuuggagcagggucagugugucucaggggagaggcaugggggugaggcuuccuaugagauuagguggaacacggguuaguggggaggguuaggguuagggaaguuucuauggagucugggugggucugagguguuugagggaggaggcacagaagagguguuuucgugauguuggucuagauucagugugucugagggggauggcagagggcagggccuuccugugggguggggguggggucuggcgucucaagagugugggcauccagacuaggggagggaguguggcagggaauguugcuggggugggggggucuucugaccccucacuuacaucccccucccaccccagaaugugccccccgaucuggccaucuguugcuucguccuggagcagucccugucugugcgagcccugcaggagaugcuggcuaacacgguggaggcuggcguggaggugaggaccccaccugggggugggcgggguggcagagaugggcgagaggacccaggggucguuuagggcacgguggcaaggaugggugagaggacccgggggucgcuuaccaucugcucuucuuccucucucugcccugccccccacaggcccucaauuuggauaaguggguagguccggccuuggaugucaccuguccuuccaccccuccugaccccaggcaggcccgucucucaggcccacgcccugcacacaggggcuggaggguccucccccaccccaguugucaggggcuguggagcccagaacaggccaggcaggaaggaaggaaggggaugggggcuucugagccccuguccccgacgccugcuccuuucuccucuuuccaguccuuucccccaacccugaucccagcuccucuccgcaugggaccucucccaccucccccaucccaagcgugagucccucugguccaggaguggguccaccaugugaucaccuggccccaucacaugguacccccauggcgcccuuggagcaugggcaugugacagccaugaugggaggcauggugacaucgagcagucagaugucugccccaagguccggguuggggaccuugugcuggggaggggcggcugucuuagacugcgggugacauucaccuauggaacaacugcuaggccugucccagagcacacgggcugcagcgcagcaugaugggggaggucagagcagaggggccagaguacacggaacacgagaucuuggggguguccucaggguccccaggaaacuagaagacggguucauucuccugagugauuuccagccaaggugaaggcagcagagaggacagagugggcuuuggggaauauaaaaugcuccauccauaggcaucucagagauauagucccugcuuccgugaauggggaaacugaggcagagaguccugcaggagucugagcugaggcuguuuuaccucuaggccugagcaugguauuuuacagggagcaucuugucaccugugacuaggccagaccucuuggggaucuggagaguccggggaucugugcuuauucuguucccucccucccccugcagucaucccagggcgggggacacaggacgcuccuguauggccaugccauccugcuccggcaugcacacagccgcauggugagugcaaccucggugggcgugggcaggggccagggcauguggggccugcuagaaggaggcugaccucccucuacaacccuaguaucugagcugccucaccaccucccgcuccaugacugacaagcuggccuucgaugugggacugcaggaggacgcaacaggugcagcagcuggaggggaugggggugugaaggggccccgcagcagggauucaggggguagaaggucugcagaacgccaaggcaagcaugagacuacccuggggacaugaaugggggcuucguagcagagagucugcgguacaguccagacagggagacagacacacguuggggaccacuaggcagagagucugaagucaggaacggggaacuguuaggcagagaguugguggcagugauaggagaguugugggccaagggcccgggaggccugguggagggagagcccuggggaagagcauucugggaagccaucaucugacagccacccccauuccauccccacccauaggagaggcuugcugguggaccaugcacccagccuccaagcagaggucugaaggagaaaagguccgcguuggggaugacaucauccuugucagugucuccuccgagcgcuaccuggugagccauugcgguuccuccugcucccaggucugggggcgcaugggaugguccccaucuucucaccauggguuugccuggcugaucucccacccccaagguccugacucccaauuucccauuuccugaccccugacauccaauuuucugauuucugaccucccauugcccgacuugaucauuuccugaucugugaucucugaugacucugucucccaucugccgguuuccggguauccacccuugauuucuggccucugacgcugggacucucgcccaccccugcaaucgucucugacugccgcauccugguggcccccagcaccugucgaccgccaguggggagcuccagguugacgcuuccuucaugcagacacuauggaacaugaaccccaucugcucccgcugcgaagagggugagggccccagaccucccccuaaauggagauccccccaaaacagacccuuaauguugcccuucaggcauacccaaauggagccuuggaaccucagaccucaaaccuagaucuccaaauuauggcucucacacuuagaucuccagcugaccccaaauccagacccccagagcucagaacccccccaaaccccgaacuaaauaucaggcucccaaacuuagaccccaaaguauuagcccccaaggcuccuaaacucagauucaaaucuuaaaacaucaaguuuaaagcuuguuuaaaggccgggcaugguggcucacgccuguaaucucagcacuuugggaggccgaggcagguggaucaccugaguucaggaguuugagaccagccuggccaacauggcgaaaccccaucuuuauuaaaaaugcaaaauuaucugagugugguggcaugugccuguaaucccaccuacucaggagggugaggcaggagaauugcuugaaccuggguggcagaggagccugggugacagagccagacucugccucaaaaaaaaaaaaaaaaaaaaaaaaaaauuaaacuccuuagacaauaagcauagacuaugaucucagccccucaaacccagacccccaaauucaaaccucagauccccaaaccaagacuccaaucuucagcccuccaaccucagacuuccaaacuucaauuucaaaucccaaaaaccaaaauccaccaaagcaaacucccaauucagauucccaugcuaagacuccaggcauggcccaauacuuugaccccaagucucauaccccaaacuucagaguccuaaaccagacccacgcugggacucaaaccacagaugguuuuugacccucaaacucagacccugaaacucagacucaucaacuucuaacuacaaagcucagaucguuccuacgucauaccccaaagcucagacuuccaaacccuagauuguaaccucagauccccaaccucacuuuccagcuucuggccuccaaaaucaauacucaaggccaagcgcgguggcucacgccuguaaucccagcacuuugaggggccaaggcggguggaucacuugagaucaggaguucgagaccagccugggccaacauggcaaaaccccaucucuacuaaaaauacaaaaauuggcugggcaugauggcgggcggcuguagccccagcuacuugggaggcugaggcaguauugcuugaaucugggaggcagagguugcagugagccaagauugcaccacugcacugcagccugggcaacagagcaaaacucugucuuaaaaacaaaacuaaacaaaacgaaacaaaaaaacccucaaaauucaggcccuaacuccagaacccagccucagacccaaccaucacccuucuaaacccagaggccaaaccucaacccuagaacucagacuccaacaccagugaacauuagaccuccaccuuucaccacacacacacucugaccccaaccucaaaaguccaaacucagaaccuuaaaugacagacucacaacucccccagccucagcucugcagacccagaccccccaaauuaggugcccagcuucagaccccaagucucauauccccacuucaggccucaaccuuggccugaaaauacccugaaacucagaccuccaacugcaaaaccccaaacucagcccucagguucccccaggggaggagcagggccccugacuucaucuuggcuccuggucuuccuggggcuccagccucccauugaccaacuucccuugcuccucuccaggcuucgugacgggaggucacguccuccgccucuuucauggacauauggaugagugucugaccauuuccccugcugacagugaugaccagcgcaggucugggcuguggacgagagggccuggggucuagggguggacguggagggcugggacccuaugaguaggauuagggaccagauuccggggagcugaacccuugacuucacucucuucuguguccccagacuugucuacuaugaggggggagcugugugcacucaugcccgcucccucuggaggcuggagccacugagaaucagguagggcggggaagauggggagagaccagggagaggcuggggucaccuggcaggcugggaggacagaaaaggucuugagggaagaucugauaaagagacugaagggucucgagggaaaaucagagcagccugagagagagaugaaaaucucggccaggcguggugacuucaugccuguaaucccagcacuuugggaggcugaggcaagaggaucacuggaggccagaaguucaaaaccagccuaggcaacaucaugagacccccgucucugcaaaaaaaauaaaauaaaauaaauaaaauaaagaauuagccgggugugguggugugcaccuuuagucucagcuacuuuguggggcugaggugggaggaucacucgagcccagcgggucaaggcugcagugagcugagauccugccacaguacuccagucugggugacagagcaagauccugucucaaacaaacaaacaaacaaaacaaaaacaaaaagaggccaagcgugguggcucacgccuguaaugccagcacuuugggaggccgaggcagguggaucacuugaggucaggaguuccagaccaggcuggcuaacguggugaaacccugucucuacuaaagauacaaaaauuugccuggugugguggugggcaccuguaauccuugcuacuggggaggcucaggcaggagaaucccuugaacccaggagguggcgguugcagugagcugagauugcaccauugcauuccagccugggcgacagagcgagacuccaucucaaaaaaauacaaaaacaaaggccgggggcgguggcucacaccuguaaucccagcacuuugggaagccgaggcagguggaucauuugaggucaggaguucaagaccagccuggccaacauggugaaaccccgucuccacuaaaaauacaaaauuagccaggcgguaguggcacgcaccuguaaucccagcuucucgggaggcugaggcaggagaaucacuugagccugggaggcagagguugcagugaggugagauugugccacugcacuccagccugggcaacagagugaggcccugccuuaaaaaaaaaaaaaaaaacaagcaaaacaaaaauaaaaaaugaagucucucuggaguccugugggaaaaggagguuugggggguuuuugagggagagauugggggcccugaguaaaaugaugggggaauuuaggggucuggaaaaacgagggcacuggagacauuugggaagcccugaggaagcugugaaggccugagagaggauugggguuccuaagggaggacuagggguccuaauuaagaugguuugaggaacacuggaagaggguucggggcuugaggagguuuggaccaagacuauaguguccaggccgggugcaguggcucaugccuguaaucccagcacuuugggaggccgaggugggaggauugcuugagcccuggaguucaagaucagcuugggcaacauagcaagaccugguuucuguaaaaaaaagaaaaagaagaaaagacuguaauguccaugggagaacugggggguccucugacuccccuuggcucucacccuccacagcuggagugggagccaccugcgcuggggccagccacuccgaguccggcaugucacuaccgggcaguaccuagcgcucaccgaggaccagggccugguggugguugacgccagcaaggcucacaccaaggcuaccuccuucugcuuccgcaucuccaaggucagugggguuuguggcgcccucccucaccugaagcccccagucccagcccagccugcacucugcagucccucaggggggcuccccugcuaaacacacaggcagaggaggcugaccuguguccccugccccuguaggagaagcuggauguggcccccaagcgggauguggagggcaugggccccccugagaucaaguacggggagucacugugcuucgugcagcauguggccucaggacuguggcucaccuaugcugcuccagaccccaaggcccugcggcucggcgugcucaagaagaagguggguguaaucccagcuacucaggaggcugaggugggagaaucgcuugaguccaggaggucaaggcugcagugagcuggugaucaugccacuguacuccagccugggugacagagugagauggggugcaggaggguacugagggguggugcuugagaccuugggaguuugaggaugagacugagagaaagauagagacugggagagaaacugagacugagagaaacagcaaaaaagacaaagggauauaucuacauggagagagagagagagcagaaaucuguagacagacagggaaaggcagagauaaagaggcauggaaacagagaaauagagaaagauagagacagagaaacagagacacggccgggcgugguggcucaugccuguaauccuagcacuuugggaggcccaggcgguuggaucaccugaggucaggaguuugagaccagccuggccaacauggugaaacccugucucuacuaaaaauacaaaaauuagccaggcgugguggcagcugccuguaaucccagcuacucaggaggcugaggcaggagaauugcuugaaccugggaaguggagguugggagugagccaauaucgugccauugcacuccagccuggcugacaagagugaaacuccgucucagaaaaacaaaaacaaaacaaaacaaaaacaaaaacagagagagugagaaaaagauggauaaugaccaacugagaauaacuuucaacaaacaauuacugaguacccgcguuguucugguugugugugcagaaaauagaugagcuguagcgaccuguucccugcccucccagugcucagaaauugugaacaaacugccuuuagugaaguacauaguuuuacaauuaaggagugggaaaacuauuuuuggcagcaggaacagcaugugcaaagguccugagguuaacaugagcuuggcuuguugcaguagcagaaagaagccacaguguggaacagggugagcaggcuggaguagugguuggugaggaaagagaggggaugggaacagcucgugugaggccuugugggccaugggagaggucuaguuuuguuuguuuguuuguuuuuuguagagacgaggucucauuauauuacacaggcuggucucaaacuccuggggcucaagugauccuccugccucagccucccaaagugcugagauuaaagugaagugugagccacugcuccuggccagguucuaguuuuuauccugagugagaugggcucacaggagauuuugagcagggcagggaagugaccugacgcaggaucacagaauucuuaggcugucucugggaacagacuacggucaggggacagagccagagcagggagaccagagaagagacugccaugauguuacaaaugggagaugacaguggacaggaccaggaggggacuguggaguugggaagaguaguagauucuggugggguccugaggguagagccaacaggauuugcugacagauuggcuguggggugagagaaggggagggguugaggaugaugccaugauuuuuugccccaagcaacuggaaggauggaagugcugaaacagccucauugucuggaguaucacccaagguuuguggucucacagccacagagaacaaggacgcagacacacaaagagugagguuaagaggggacauuuaauaggcgaaagaaggagcucucuacugcagagaagggucccagaaaaauggguugaaaugcaggggguuccauggugaaaugcagggggcuuuacagaugagcugguggggaggugguaucugauuuaccuagggugcaaaagacugguuggaccaguugugccauuugcauagggcacaaauuucuggcugccuccacccuaagcuuuuauuguacaagcggguccucugccugagcuggccauguugcccauuccuuuucuguacaacguggaaacaauaaauaaauaaauaacuaaauaaagggaagauggagccuccauguuggacaugcguagccccagguauaccuuuucuaucggcacauucccccaugcaagcuuguagcucgauuuuccaggcugcucuuuguuagaaaagaaauuauuuugggggcugcuuuccguuagaaaggaaacucugccgaggacucuguugcccuuacucucugccuaaauaauuuuuuucuaccucuuguaucagugccaucaaccaaguuaggggacagucaguguuggcucagaaggacagggaucuuaggcuuuacugccagugccuagaacagagccacuuacuacagccuugcugaauggacaaguaggaauccuuggggaggcacucguuugcaaaaacaggccuguaguugaauacaugagccaagggcguagagacggggccugggccauguccaaaguggggacacgugagcaucaucagcagguggaugguguuuacagccgcagacuggaugaguucuggggaggucggcuuggggugaagcuggcagccaugauggucucaccucguggaaagguggucuggcauucuaucugggacagguucaauuuggggguuagagcuuucuggucggggggaauguuaagucagcaguagguacagguggaaagggucuggccuggagacagagacaggaaggagauagggauagagagauagagagggagaggcagggacagaggugagagagauagagagacaaagacagacaaaaccaaaaacagggacagagagagacagagaggagagagagaaucaaagacacagaggagacagaugacgggggacagaaaaaugaggaggaauuugcagugagauucugcagagcagggaggagggggcaagugcagaacucaagucuagacagacgucuugggggcauggcccuggguggcugggcccacuccagaccucugucuccccacuccuaggccaugcugcaccaggagggccacauggacgacgcacugucgcugacccgcugccagcaggaggagucccaggccgcccgcaugauccacagcaccaauggccuauacaaccaguucaucaagugagcaaccugcccucccugcuggggugacuccugugcugucccaugcuccgggcauccauacacuuggccucuuucaucucuaccucuguugcccacacccuugucuaacauauacaugggccaagcgcaguggcucacaccuguaaucccaagacuuugggagggcaaggcaugaggaucgcuugggcccaggagcuugagaccagccugggcagcauagggagaccccgccucuaccaaaaaaaaaaaaaaaaaaaaaaaaauuaggcugggcacaguggcucaugccuguaauccuagcacuuugagaggcugaggcgggcagaucgcuugagcccaggaguucgagaccagccugagcaauauagugaaacccugucucuauaaaaaaaauaacaaaauauuggccaggugugguggcacgugccuguagucccagcugcaugggaagcugaggaaggaggauugcuugagccgagggggcagaggcugcagugagccacuauacuccagcuucacugacagagcgagacccuucucaaaaaauaauaacaauaauauacacaugaccccuaaccucuaaacuccugaccucuguacacuugaccccuaaucugaccuugacaaccaugaucacauuccugaucaucacccaacuuucacaccccugacacccagagccuggacccuggaccucuccaucccugaguuccgggaccccccuguaccuacacaggagcgagucccagucccagcucugcccuuggccauugugugaccucggacaaaugcuuuucccucucugcgucucggucucccucucuguaaaacgggugggucugggggagucuugcgggagugagguugcggcagugacguugcggcaguuagcgcucccagccguggcugacagcugcgaggucccuguaggagccuggacagcuucagcgggaagccacggggcucggggccacccgcuggcacggcgcugcccaucgagggcguuauccugagccugcaggaccucaucaucuacuucgagccucccuccgaggacuugcagcacgaggagaagcagagcaagcugcgaagccugcgcaaccgccagagccucuuccaggaggaggugaggacguggcgagggcggagcggggccugugggcccagggggcgggaccacugaggggcggggccacggcgcugggcggggcagggccugagggaccuggggaaguagggucugagaagggggcggggcaggagaaggagccggacaggaaccccagccagugagaacacgauggggcggggccuugggaggggcgggccugcugugcuggugggcaggaccuuugggaaggggcagggcguauggccgaccagggggcggggccuggagagaaggauggaauaaaagagcugaggggcggggccuaugugaagcucagguauagggugaggccuggggaggugaggccaggaguggggccagaggucagagguagggcugccgacucagcgggcggggucugcuggcgcggggucuguggggugggcggacagaaucagugugggguaugggaggugccgaggcagaaauagaucuuugggcauuagggaggggaggccagcugugaacaaaacagaaaaaaaucucuguccuuauggaguugacauggcggggagagacaggagaucaauaaaauaaauaaguaaauuguauggcauauuagaugguaauaacuguuaaagagaaaaauucagcagguaagggguagggaguguugggguuuugcaguuuaagacagagcugucagacagggugaccuggaggaagagaggaagccaugugcaaaggccaugaggugggcggguguuuggcauguuccagaaacagucagguggugauuggagcagggaggcuugggugggggagugggaggaaaugagggcagagaggugacgagggccaggccuuggugaggacuuuggcuuugggagccacaggagguuuugguccucuacagucacagcuaguuaguggcagagccggucagugugaugccacuuugguugugcucuccacuuugaggcacugcuccucucacuacugaucuaggccccaggaugcagauacaacaauuguuuuguuuugucuuguuuuuugaaacagagucucucucugucacccaggcuggagugcaguggugugaucuuggcucacugcaaccuccaccucccagguucaaaugauucuccugccuccucagccucccaaguagcugaaacuacaggugugagccaccacgccuggcuaauuuuuguauuuuuaguagagaugggguuucgccauguuggccaggcucgucucaaacuccugaccucaggugauccacccgccuccaccucccaaagagcugggauuacaggcgugagccacugcacccagacaguuuuguccuuuuuguugauuucacuguuuauaaugucucccaaguguagugcugaagugcugucuagcuuuccuaagugcaagaaagcuaugaugugccuuacugagaaaauauguguuagauaagcuuaauuaaggcaugaguuauaguacuguuggcugugaauuuaauguuaaugacucaacaauauauauuaaauaacugucuuuaaacagaaacauaaaaaacaagguuauguaauaagugguugaugaaaauacugucacagacucucagggacucccuguauuuccccuagaagcagugguucaguauuugauaauucagucuucauaaucacuuuauagaacauaacuaugaauaaugagaauugauuguauauguuuuauguacuuuucuguauguauauuaugauucacaaugaaauaagaaaaaauauuaaaauguaaaaaaaaaaagaaaagaaaagauaaagugagaaaaaucuuucugaugguugguguggagaaugaacugggccucuccaguuggugggagugggguuccaguuggaugguuggugggagugggguuccuggaagugaguaggauggagagaaaagugcaggaaggggaaguauaaacucaguccugguguuaauaaggacugaauuaucauagacugaaucucauauuggggauagagucagagaggacaagaauagauauggggagccaaggaggagaggagagcaaugggacugauugggaauaugaaaccaaaggggcugauuuagaucugggaacacaccgucacuaguuguugaaggaauaugaauucgugaauccaagaaagacaaggaagggagggccugggucuccuauugugaugccucuuauuuuccucauccuaggggaugcucuccaugguccugaauugcauagaccgccuaaaugucuacaccacugcugcccacuuugcugaguuugcaggggaggaggcagccgaguccuggaaagagauugugaaucuucucuaugaacuccuagguaggggucccaguccugacuccccugagaacaccccagauccccaguccuauuggaucugacaccucuuccccccucagcuucucuaauccguggcaaucguagcaacugugcccucuucuccacaaacuuggacuggcuggucagcaagcuggaucggcuggaggccucgucugguaggagaacccgggggagugggacagaggcuugugggaggggaugggcauggccgcuucaccucucauucugggcacccuggcaggcauccuggagguccuguacuguguccucauugagaguccagagguucugaacaucauccaggagaaucacaucaaguccaucaucucccuccuggacaagcaugggaggaaccacaaggucggccccucaccccugaccucucauccccugaacucugaaugcuggccucuccccagggcuccagaacucugcucacucccucacuucccuccuccaucucaucucucaccuguacgccacucccacuggcuuucaucuccacacaggggucucaaacaaugacucuuaaguugauucugggccacagaugugcuugguuagaucucugaaauguuuuuuuuuuuuuuuuuuuuuugagacagagucucacacugucgcucagacuggaguguaguggcgcuaucuuggcucacugcaaccucugccuccuggguucaagcgauucuccugccucggccucccaaguagcugggacuacaggcacacaccaccacgcccagcuaauuuuuguauuuuuuuuuuaguagagacaggguuucacaauguuggccaggauggucucgaucucuuggcuucaugauccguccaccucagccucccaaaugcuggaauuacaggcgugaaccaccagcgccuggcauuuuuuuuuuuuuuuuuuugauacagagucucgcucugucacccagacuggagugggagugcaguggcaugaucucagcucacugcaaccucugcuucccggguucaagcaauucuccugccucagccuccugaguagcugggauuacaggugcccgccaccacgcccagcuaauuuuuguaauuuuaguagagacaggguuucaccauguuggccagucuggucucgaacuccugaccucaggugauccacccacuuuggccucccaaagugcugggauuacaggugugagccaccgugccccaccgguggcgcugaaauguuuuuaaaauuuucaaauauuacagccucuagguggacuguauauauauacacacacucuguaguuugccauagcccuacaaguuccuguugcauuauuucuaaccacuucacacauuuauucagucggagcaaaaguaauugcaguuuugcuauuaaaaggaaugacagccgggcaugguggcucacgccuguaaucccagcacuuugggaggccaaggcgggcggaucacgaggucaggagaucgagaccauccuggcuaaugcggugaaacccugucucuacuaaaaauacaaaaaauuagccaggcaugguggcaggcgccuguagucccagcuacucgggaggcugaggcaggagaaugaugugaacccgggaggcagagcuugcagugagcugagauugcgccacugcacuccagccugggcgacagagccagacuccaucuccaaaaaaaaaaaaaaaaaaaaaaaaaggaauaacaaaaaccagaauuacuuuugcuccagccuaauacauuuuccacuuggccccuaaagacacaaguuugcaaccccugcugauuuaaaauuucaucuugauuccugugucucucacuggucguuucagucugccuucugaccucuuaccucacuacuccaguaucuccuuccuuacauugcugauaccuuaucccaacucaugugacccucccucagccucuugccagaucuuccucuuugaccccuaaccuuucucugaucccugaccuuccacuuucaccaccuccucucagucaaaauugccacaucuuaucccgaugcgcuguccuuuccuccuggcuucccucccucccaggguucuucuguagauccugcccuggugccuacacacccuuuaaccucugaccuugaccucuagguccuggacgugcuaugcucccuguguguguguaaugguguggcuguacgcuccaaccaagaucuuauuacugagaacuugcugccuggccgugagcuucugcugcagacaaaccucaucaacuaugucaccaggucuggcucucaacaucugaccccagaacucagaaccucucaacccucucccugacuuagagacuccacacccagauggauguccuuuccuuaaucucccaccccaggguuaacaaccaguccucacagauguccacuguggccccacucucccuuggcauccacuccucuuguucugucuuccuggcuccauuucugccucuaucuguuucucuuucuuucucccucucccucucucucuguuuucucuuuuuaucuuugccuguuucugucuugauucuuccuccaugucuuucucccugucucucucccaucucucucucucugucuuuggaugucugucucucucuggcuucccaccacuuggcucuccucucugccucuccgucaucccccucuccugucccaucucuccugcagcauccgccccaacaucuuugugggccgagcggaaggcaccacgcaguacagcaaaugguacuuugaggugaugguggacgaggugacuccauuucugacagcucaggccacccacuugcgggugggcugggcccucaccgagggcuacacccccuacccuggggccggcgagggcuggggcggcaacggggucggcgaugaccucuauuccuacggcuuugauggacugcaucucuggacagguaccugaccccuuccaggggacccucaccccugaccauugaccccagcauuucuaagucucugaccauacaccuugggguucucaggauccugacucccugaaaaggucaacuuuugaccuuuuaguccucauuucccaagacccuaaccccagagcuucuagauucccggcucugacuuguauccucguuaccuacagaacucugaucccagaguaggugugaccucugacccuagauaucccagaagaccacgcagauuacugugaucucugaucuuugacuucuaaccccaggagaauuuauuuauuuauuuauuuuguuuguuuguuuguuuguuuguuuauuuugaaauggagucucacucugucuccuaggcuggagugcaguagcaugaucucagcucacugcaaccucugccucucggguucaaguaauucuccugccucagccuccugaguagcugggauuacaggcaugcaccaccacgcccggcucauuuuuguauuuuuaguagagacaggguuucaccacauuggccaggcuggucuccugaccucaagugauccauccgccuuggccuuccaaagugcugggauuacaggugugagccacugcauccggcccccaggaggauuuaaucucuggccccacagcucagaauccuaacuucaggggaacccugaccucugcccuucauuucagagcuacgggagcauccaagggagcacuuuccauuaggguuuccaggaugcaaucuccacaggagccuccaauaucugucccuuuucucuuguuaucauugguucugugggaccugugacgucugacccaucucuggugacugaugcaggacacguggcacgcccagugacuuccccagggcagcaccuccuggccccugaagacgugaucagcugcugccuggaccucagcgugccguccaucuccuuccgcaucaacggcugccccgugcagggugucuuugaguccuucaaccuggacgggcucuucuucccuguugucagcuucucggcuggugucaagugagaacuugcccccaccccacggccaguccucagaccuaggacugaccugagacagcuuccccagucacuccauggucccccaggaggccaggacacugcagccuaccaucaagacugacugguguccagaacccuuacuugaagaucccagggaccuccacgugacuccagacucuuuccaaugaccucagauucucccuaaccccacguccuuccaguaaccucugagauaauggucucagacucuccuaguggucucucaacaacccaagguucuuccggugaccucccaaugaccucagacuuucccagugacuccagaaucugaugaucucaugacuccagaccuuccuugacuccccaguggccucagacucucccaaugacuccagaaucugauaaugaucuaaugacuccagacccuccuuaacccccuaaugacuucagacucuuccaaugacaccauacucucucaauaaucucuuaauaaugccagcaucucccgaugaccuuucaauagacccagacuugcccagugacccugcucccgaauaaccccauuuauuccaaagaccccccaaugauccaguccuuucccaaucaccccaagcucuccgaauguccauucagugguguuuauguuuauuucauaauuguaacagaugcucagugacuucucaaaugaccuucuuauuggucuccccaaccuuccaaugaccccgaaugcucuguugaccuggggucuccucugaaggacuguuccaugaccuugcagucaucugaacucuucuagauuaaccagagacccucccgcucucaacucccuggcucuuaauucccuuaugauauuccuuugacucuagacuuucuuuuaugacuucuaaaugaccuccaggacacuaugacugcccggugaccuuuggucuccccagaacuuuccauugaucccaggacugcuuccaugucccccacugaccacagacugucccccauaaccuccccucaaugauccccauuguccuuccuuacccagggugcgguuccuccuugguggccgccauggugaauucaaguuccugcccccaccuggcuaugcuccaugccaugaggcugugcucccucgagagcgacuccaucuugaacccaucaaggaguaucgacgggaggggccccgggggccucaccuggugggccccagucgcugccucucacacaccgacuucgugcccugcccuguggacacuguccagguacugccugcccugcaaagguuuucuggcgaggcagggucucuuaggagucagagagggggcagggugccaucguucaugccuguaaucccagcacuuuggauggccaggcgugguggcucacgccuguaagcccagcaauuugggaggccgaggcggguggaucaccugaggucaggaguucaagaccagccuggccaacacggugaaagugaaacccugucucuacuaaaaauacaaaaaguuagcugggugugguggcgggcgccuauaaucccagcuacucgggagacugaggcaggagaaucgcuugaacccgggagguggagguugcagugagcugaggucacgccauuguacuccagccuaagcaacaagagugaaacuccaugucaaaacaaaacaaaacaaaaaacaaaaauuagcaugguggcaggugccuguaaucccagcuacucgggaggcugaggcagaauugcuugaaccugggaggcagagguugcaaugagccaagaucgugccacuacacuccagccugggcaacagagugagacuucaucucaaaacaaacaaacaaacaaaaacaaccaacauuuugggaagccgaagugggggccucgcgcuugagcccgaaaguucgagauuaguauggguaacauagugauaccccgucuuuauagaaaaaaauuuuuaauauuuacaaauuuagacaauuuuuuaaaaggagugagagagguggggagcugcccuagaagcugggaaccucguuguuuaacagauggagaaacugagcacagagaggcaaaggauucugucagagcagaaucgcagucucagggaguccucaccacugccccacaaagaaaggguggcucacaccugcgauccuagaacucugagaggccgaggcaggauugcuugaguccacgaguuugagaccagccuaggcaacauagcaagaccccaucucuacuaaaaauuaaaaguuagcugaggugaugguccacgacuguagucccagcuacuugggaggcugagaugggagggucacuugagcccagggauucgaggcugcagugagcuaugauugugccacugcacuccagccugggugacagagcaaaacccugaaaaaaaaaaaaaaaaaaagaaagggagagagagagagaaagaaagaaaaaggcugggugugguggcucaugccuguaaucucagcacuuugggaggcugaggcgggcagaucaccuaaagucaggaauucaagaccagccuggccaacauggugaaaccccaucucuacugaaaauacaaaaaugagccaggcaugguggcaggcaccuguaaucccagcuacucaggaggcugaggcaggagaaucacuugaacccgggagguggagguugcagugagccgagaucgcaccacugcacuccagccugggcgacagagcaagacuccaucucaaaagaagaaagaaagaaaggacuguuuuugccuucccuccaagcaugucccuauaggagggaauauagguuagguuuaaaagccugacagcaaagguuugguuuucagucacgugaucuugggcaugugaccuccccucccugagccucaguuuguuccuccgugaggaaaaggggauaacacccugauaucugauagcauuguucauuguugugaagguaagaugaauggauauaggcaagaugcuuaguccaguccugauuaaacaguaagcacucaagacagucacucauuauuaguagcagugauaucaucugcgggggugacuucaucccccuguccccagaccagugcccugggccucacccuggaugccucuguccccaucccccagccugucagccucgugggcuguccacucggccucccagacauccccccgaccccgcuuuccucauccccaugucccgcccaaguccaaaccaucauugccucuugccugcggaacgccaacaccgcuacugucuacuaggcucuuacccucugccaggcaucgauauuaacuauguaacauuuaguaauuuacauuaaugaucucacugaguccuuauuagguaucgcuaugauccucauacggagaaggaaggagacuccuccauucuuuucauucagcaaacauuuccugagccucucuucugggucugagucugguucugggcuggauagggcuggggacuugguggagaccagggcagccccaggcccugcccucauggagcucccaguccacgggggagacagacccgucccagauaauuccuuaauacucucucuucuuuuuuuuuuuuuuuuuuuuuuggagacagagucuugcucuguugcccaggcugaagugcaguggcacaaucuuggcucacugcaaccucugccuccagaguucaagcaauucuccugccuuagccucccaaguaacugggacuacaggugcgcaccaccacaucuggcuaauuuuuuguauuuuuagaagagaagguguuucaccguguugccuaggcuggucuugaacuccugaccucaggcgaucugccccccccccccccacuuagccucccaaagugcugggauuacagaugugagccacuacggcuggcccuggauaauuccuuaauucugagaaugcuaagcccucacccaucugagugucaacccuggagucaaggcgagggauggggagcagggcugcuggauggugggaaagggggugcuggaggagccucccagggcucacagguguucuuggaaagaggggucaugauggaggaggguagagggaccuuggggucucaagaacgucccucugccucuagauuguccugccgccccaucuggagcgcauucgggagaagcuggcggagaacauccacgagcucugggcgcuaacccgcaucgagcagggcuggaccuacggcccggugaggggcugccugcagccugcgggaggccggcuagacuugcggugccaggagggagagcggcucaccggcggagaggagggagggaccacagggcaccaggggguccuuggacugaggguggcagaacuaggguuggaggucaggggucauagucugggcauguggggagugggaaggaaaggggagcacauggaguugacccuggguuuucuccagguucgggaugacaacaagaggcugcacccgugucuuguggacuuccacagccuuccagagccugagaggaacuacaaccugcagaugucuggggagacgcucaagugagggcccaggggagccggggguuggggcuggcugcuggugcggugggggagggaggcauggagagacagggcaggagguagagacugagagagagaaggauggaggggacagggauugugagacauaaacaaauggggaguggccgggcacgguggcucacaccuguaauccuagcacuuugggaggccgagacggguggaucacuugaggucagcaguucgagaccagucuggccaacauggcaaaaccccgucucuacuaaaaauacaaaacuuagccgggcgugguggugcaccucuguaaucccagcuccucaggaggcugaggcaggagaaucauuugaaccugggaggcagagguugcagcgagccgagaucacacuacugcacuccagccugggcgacagagcgagacaccguuucagaaaaaaaaaaaaaaaaaaaaaaaaaaaaaaagaagcaaacggggagcaagaaagggacagaggcagaaagagagagaaagaaaagguggggauggaaagagagagagaugcagaaagagacagggagacaggagaaaguggcagacaggaaaagacagacauaguuaguuauacagacaaggcgcagggaaagacagaagucaugaagccugaggccaggaucaagagagacagggccagagcgccccaggcacugaagcagcagagguagagggagcuggagacccugaggccgugggaggagacggggcagggagcucugaggggcgugaccugucgccuccacucccccacccccaggacucugcuggcucugggcugccacgugggcauggcggaugagaaggcggaggacaaccugaagaagacaaaacuccccaagacgugagugugggcagccaggucccgucuggggauggacugggggcuggggaugcugugcuaagggcuggggaggucgaggggucuuguggggaggcugagguuagggaggaaggagacuuggguuagggugaaggucauagggucagggcucuggggucagaggugaauguccaggauugaggaguuaggaguuucagagagagagagagggaggguaugaguccaggauccaggcucagggucugccuagagucagggaaaaugagagcagaggucacauguccacguaagggguaaggggccaaugguaagaggugagaaucuggaggucguuggagucgucuaaguaagggauccugaaauuauaggugagcaguuacacguccugaguucagaggucaaggacuccagacccaggaguuugggguggaugaggacugggaucagaguaagaaaccucagagugggcugggugagguggcucacaccuguaaucccagcacuuugggagguugaggcaggaagaucacuugagcccaguucaagaccagccugggcaacauggugagaccccucuacaaaaaauuuaaaaauuagcaggacaugguggugggacaugccuguaguuccagcaacuugggagguugagaugggagaauugcuugaacccaggaguuugaggcugcagugagccaugauugcaccaccgcacuccagccugggugacagaacgagaaaacaaccucaaaaaaacaaaaagagccgggcucagucgcucacgccuguaauccgagcacuuugggaggccgaggcgggcggaucaccugaggucgggaauucgagaccagccugaccaacacggugaaacccacccucuaccaaaaauacaaaauuagccgggugugguggcacaugccuguaaucccugcuacuccggaggcugaggcaggagaaucacuugaacccaggagguggagguugcagugagccgagaucgugccauugcacuccagccugggcaacaagagugaaacuccguaucaaaaaaaaaacaaagagagagaaaaaccucaaaguuaguggugagaggucugagagaguuccgggguuagagauaggggucccaaagucaagacaaagggggcuagaggucauugaugucaaagcccuugcuagggucccaggauccuagggucagaagccagggaucucaaaacuuauucuaaaauuucauagaacugcaacauuauaucaaaggucagaaacgccgaagcugggacaagggucagcagucagggaucccauauagugcagagcccggaaguggaggugagggccuugucccauggagcccuaccaugcccgcagguauaugaugagcaauggguacaagccggcuccgcuggaccugagccacgugcggcugacgccggcgcagacgacacugguggaccgucuggcagaaaaugggcacaacgugugggcccgagaccgcgugggccagggcuggagcuacagcgcagugcaggacaucccagcgcgccgaaacccucggcuggugcccuaccgccugcuggaugaagccaccaagcgcagcaaccgggacagccucugccaggccgugcgcacccuccugggcuacggcuacaacaucgagccuccugaccaggagcccagugagugcucaccccuggcccuggcccugacuccuaccccaacucugaccccagccccgaucccugaucucugaccugacucagcccccaaaugggcuauaucuuuuuuuuuuuuuuuuuuuuugagacggagucucgcuguccccaggcuggagugcaauggcgcgaucucugcucacugcaagcuccaccuccuggguucacaccauucuccugccucagccuuccgaguagcugggauuaccggcgggugccaccacgccuggcuaauuuuuuguauuuuuaguagagacaggauuucaccguuuuagccaggauggucucgaucuccugaccucgugauccgccugccucggacucccaaagugcugggauuacaggcgugagccacugcaccuggcccaaaugggcuauaucuaucacaucgagcagacugaccaggaggucagaaaggacugaccccuccccgaaacucugagccuuaccccaguuccaacucggaaccugauggaaccacuucccuuuaccugacgccagcccugccugggcuaugacugcaaaccagagccgucagccuaggaacccaaugagugccaaccccaccuuugacucugauuccugaccucuagcuuugaucccuaaucacuaaucucugaacuguagcuaccacaugaaggcacccaaccaagggcuuagagagccuggucaccccuaccccuaaccugacuccugaccuaucacuggcuuccaaucccagccuugaccccaaacccuggccaugguccccaaccuucaguuucucaacucuuggccccaaccugaauuuccaucccuuccauaauccuggcucugacccuccaauccuggucucagcccuucauucuaaucaacccugaucuugacccuuaaccccagaccauaacucugaccaguucacugagcuggcuuuuuccuucugugucucugccaguaucccuguuuucugagaauucugacugcuacagagaugggggucucucucaacaggucccugccucucucugacuuuucugagguuccccaauucuccucuaacuccaagaaauugacccucuuccaacaguuccccaaagcccuuacugucccccaaagccugucuucuaccaacuucucgaugucuugggauccacaucuucccuagccucucugacucugccuggccucauuuauaggucagguggagaaccagucucguugugaccgggugcgcaucuuccgggcagagaaauccuauacagugcagagcggccgcugguacuucgaguuugaagcagucaccacaggcgagaugcgcgugggcugggcgaggcccgagcugaggccugauguagagcugggagcugacgagcuggccuaugucuucaaugggcaccgcguggguaccucccugggcaccauucugccagguccuguggucucucccacagcuugucuacucuggcccugccucugucugugccucacucuguccccacuucaugcaucuacuguaccacucauccacccaucuauccauccauucaaccaaugauucauccauccauccauccaucgaucuaucagacauccaucuauccaaccaacaauucauccauccauccauccauccaucauccauccauccauccauccauccauccauccauccauccauccaaccauccauccagcuaaccaaccauccauucauccagccaacauagggagaccccaucucuacaaaaaauaaaaaaauuagcuaggcaagguagcaugcacauauagucccaucauccauccauccauccauccauccauccaucaucuauccaucugaccagccaaccaugcauccauccaugcauucaaccauccauccaucauccauucaucccucauccauccaaccaaccauccauccauccauucuuccagccaacuguccauccauccauccaauaaccaucugcccauccaacaaccauuuauacaaccauccuucccuucuucccucuaucugucauccauuuauuuaugcuugccccuacuuacacuuuguucuuucucuguaucaacccagguaaacucucaacuuuccaaucauucuucuguccagccauguacccaauuucucauccaucuaucugucucauuagccacucaucuauuuugugcauguauauaagcauauauggaucuguauggggacacugauagguucauuuuuccuuuccaucccucuacuuacugcugcuuccagccccccacuaccacuuugguggucugcauaaugcuagccauggcaacagcagagaacccaggcagaagggaugagacacagagauuaguggggagaaaaauuccugugaucauggaugcaaaugugaggaaagauggagacacuguggggugaccccucuuccauaccaccugcccugaaccugacacuucgaaugucugucuucauauaucucucccucccugcuuccuuaucucuccauuucucugugugucuccccacaccaugucuucucuggcuguccucacagggccagcgcuggcacuugggcagugaaccauuugggcgccccuggcagccgggcgaugucguuggcuguaugaucgaccucacagagaacaccauuaucuucacccucaauggcgagguccucaugucugacucaggcuccgaaacagccuuccgggagauugagauuggggacggugagggcugagaccccuucacaugcccuuucuuguuuuccucugucucucccaacccugcacugcccuucugccuccaacucucccaucccuaccuccuccccucggcucccucugcccugcccaccugcccucaccccugcccauccauccccucccaccaggcuuccugcccgucugcagcuugggaccuggccaggugggucaucugaaccugggccaggacgugagcucucugagguucuuugccaucuguggccuccaggaaggcuucgagccauuugccaucaacaugcagcgcccagucaccaccugguucagcaaaggccugccccaguuugagccagugccccuugaacacccucacuaugagguaaggacugagccccucaaugccuucucaucugccuccaaagcuccuuccuuccacagugcucuucuuugaguuucucuuuucccuccauguuaggacacaaaccacauggaagcaagugucagagugaugggcucacgggcuguaugacuccggguguaacuuuggcaaaccacagcuuccugagguccaggugccucaccuauaaaauaagggaaacccugccugggcaacaagcaaaacuccaucucuaaaaauaaaaaaaaauuaagucuaggcaugguagcucaugccuguuaucccagcacuuagggaggcugaggcaggaggaucccuugagcccaggaguucaagaccagccuuggcaacauagggagaccccgucucuacaaaaaauaaaaaaaaaaauuagcaagguguguaguaugcacauauagcccuagcuacucaggagguugagacuggaggauugcuugauuccaagaggucaagacugcagugaauuagccagaugugguggcacaugccuguaauuccagcuacuuagggggcugaggcaggagacucgcuugaacacgggagauggagguugcagugagccaagauugcgcccuugcacuccagccugggcaaggagagcgaaacuccaucucaaaaaaaaaaaaaaguuaaaggcugcagugagcuguguucacaccacugcacucuagccuaagagacagagcaagacccuaucucaaaaaaaaauuuuuuuuuaauaaauaauuuuuaaaacuuagcugggugcuguggcacaugccuggugucccagccacucggcaaacugaggcaggaggauccucugagcucaggaggucgaggcugcaguaagcugauuacacgacugcacuccagccugagugacagagaggacccugucucauugaaaaaaaaaaaaaaaaaagagcugggcaugguggcucaugccuguaaucccagcacuuugggaggccaaggcgggcagaucacuugagcccagaaguucaagaugagccuggccaauauggcaaaaacccaucucuacuaaaaauacucccccaaaauuaauggcgugguggcgggugccuguagucccagcuacucaagaggcugaggcaggagaaucacuugaacccaggagguggagguugcaguaagcugagguugcaccacugcacuccagccugggugacagagcaagacccuaucuuuacaaacaaaacaaaacaaaacagaaggacucugcaaaaggaguuuuaaguaugggaacguccaguugaggucugaguuuuggaaaggucccuauuggcaguggauuguaggaggugacaguggagucagaaggauccuagagguggcugggacggggcaguacugcagaguggacgcagaguuccugacaccugccacuaccagauguccccaacccaaggcacagcaugcuacacggaagugagaaugaauaccuggaaauacacacagccauguggacgaaucucagacauaaugucgaguagaagaagccggagacaagagagcacaggcugugggauuccauucacagaaaguucaagaacaggcagagcggaucuguggugugcucaguugggaaauugguuacuaugaaagaauaacucagagacauuguuaguuacuuugaaugcaaaucacaggagggagcucagucaguagacuauugccaaagaacaaaggcugguuggaugcgguggcucacgccuguaaucucagcacugugggaagccaaggugggaggaucacuugagccuaggaauucaagaccagccugggcaacauagcaaaacccugucucuacacagaauaaacaaaauuaucugggcauggugguaugugccuguggucccagccacuugggaggcugaagugggaggauuguuugagcccaggauuucggggcugcagugagccgugguugcaccacagcacuccagcccaggugacagagcaagaccugucucuaagaaaaaaagagugaaugcagaaaccagauuuauaagacagaggggagaaagaggagagaaaaaagaccccuaaagagucugagaacaggcugggcucgguggcucaugccuguaaucccagcaguuugggaggccgauguggguggcucaccugaggucaggaguucgagaccagccuggccaacauagugaaaccccgucucuucuaaaaauacaaaaaauuagccaggcauggugccgggcgccuguaaucccaguuacucgggaggcugaggcaggagaauugcuugaacccaggaggcaaaaguugcagucagccaagauugcaccauugcacuccagccugggugacagcgagacucugucucaaaaaaaaaaaaaaaaaaaaagauucugagaacaaagaaucuuguaugcacaguuuuagggcaaauucauuggcuggcaaggaguaccuagguucaucuuggcaacugguccuuggagaggucaacgugaggaggggcaugaaagagaacaacuuucauuguuuaccgagucucuaggagacuuuugagaguccauuguuuuugguuuuuguuuuuugagacugggucucacucugucacccaggcuggaguccaguggcaagaucucagcuccccacaaccucugccucccgaguucaagcgauucuuuugccucagucuccuuaguagcuggaauuacaggcaugugccaccacgccuggcuaauuuuuuuguauuuuuaguacagaugagguuucaccaugcuggccaggcuggucucaaacuccugaccucaggugaucagcccgccucagccucccaaagugcugggauuacaggcaugagccacugcgcccugucgcuauuuguggaauuguaacugaacacagguucaguugcucaucaguuacagaguccaauuaacaagagcgaggucugguagaaagaaaaugacuuuauucaucaaaacuagucauggagaagugaccggauucccauccgaagcaaccacuucaaaucuaggggggaaagcaaggguuuaaaaaggggaaacuuggcugggggugguggcucacgccuguaauccuagcacuuugggagacugaggcaggcggaucacaugaacucaggagauugagaccagccugggcaacauggugaaaccccgucucuaccaaaaauacaaaaauuagccaggcguguuggcucaugcuugaauccaggaggcagagguugcagugagccaagaucacaccauugcacuccagccugggugacagagcaagacucuugucuaaaaaaaaaaaaaaaaaaaaaagaagucugagaacaaagaaucuuguacgcacaguuuuuggggcaaauuuucaggagacugagacacaagaaucauuugaacccuguaggcagagguugcggugagccgagauccugcuauugcacuccagccugggccacagagcaagacugugucucaaaaaaaaaaaaaaaagcauugaaguugagcugccugguuacugguuacagaaugacagaguagauuguuagauggauguagggagguuuuggaaguuaccccaagugauuccaguguguguccggggcugcuaguguacacgacgcccagagaaauguugcagagggcugcaagcaccccagggcccagcgguguacccggccgggagcuucaucccccugcaggaguggggggcccuugacuaauucccaugcaggugcacuauggccuaaugguggcuccgugugugaccagguguaggaccaacggccuggccuagcccgccugcccagcccaguacuccauucccugccaccucagguaucccgaguggacggcacuguggacacgccccccugccugcgccugacccaccgcaccuggggcucccagaacagccugguggagaugcuuuuccugcggcugagccucccaguccaguuccaccagcacuuccgcugcacugcaggggccaccccgcuggcaccuccuggccugcagccccccgccgaggacgaggcccgggcggcggaacccgacccugacuacgaaaaccugcgccgcucagcugggggcuggagcgaggcagagaacggcaaagaagggacugcgaaggagggcgcccccgggggcaccccgcaggcggggggagaggcgcagcccgccagggcggagaaugagaaggaugccaccaccgagaagaacaagaagagagggugagucgaggggggcccagaguggggauugggggcugccuugggacccccaaguaggcaaccacaguaaccugagaaacccccauuguaccccaaaguagacccauauaugcuaaguggaguaagaauaccgagagauucuaucaugucuccaaugaaccccauuauuuuccugggaugcccuaauguccccaagaauauauaauuggguacccuaguaucuauauggagaacucuauuauccuugaguaccuggagggccccaaagggcuucgcccaauggaccuuaucauccguggacacuaaaagggacuucaguaucuuccuaggagaguuuacugcacaguaagguaucccagugaauacccaguggucuucuaaauggggauccuuucugugucacaaauguaccccccgaaaucuaacuuaaagggagauucugagaagguacuaaaucugcuuuuucccuacaauggcagugguuuccuuuuuuucuuucuaucuuuuuuuuuuugaggaggaaucucugucgccaggcuggaaugcaauggcgcaaucucagcucacugcaaccuccaccucccggguucaagcgauucuucugccucagccuccugaguagcugggauuacaggcacgcgccaccaugcccagcuaauuuuuguauuuuuaguagagacgggguuuugccauguuggccaggcuggucucaaacuccugaccucaggugauccacccaccucagccucccaaagugcugggauuauagacaugagcuaccacgcccggcuccuuuuuuuuuuuuuuuuuuuuuuuuuuuugagauggagucuugcucuguugcccagucuggagugcaauggcacgaucuuggcucucugcaaucuccgccuccuggguucaagcaauucuccugccucagccucuugaguaucugggacuacaggugugugccaccacacccggcuaauuuuuguauuuuugguagagacaggguuucaccauguuggccaggcuggucuugaacuccugaccucaggugauccguacgauggcagagguuuucaaugggauugaaaacccauugugucucuugguggauguuuggaaaugauggagucuuuguggucauuacaguuugggaggggcugcugcugcugggcgggggccccaggguuccgccugccuugcaguguacaaaacagugccgcacaaugaagaauuguccuuuuccaagugcauuuagcaccuauacgagaaaugcaugugggaaaugcugacuuagggggacccccauauaacccaguggggaccuccauauucccagaaggcgccuuuaauuuggguaacucagcauccacaagcgcagagcauagcacuucuagaauggauuagucugggguaggugggaauccagcccucuagaggcaagaccugggguauuagaagcaggguguauccaagcuggaugugggggcaugaauauugcggugggagggcugggcuugaaagcuggcucucauggcgccucuccucccacuaccagcuucuuauucaaggccaagaaggucgccaugaugacccagccaccggccacccccacgcugccccgacucccucacgacguggugccugcagacaaccgcgaugaccccgagaucauccucaacaccaccacgguguggaccaguaacccucaauuuugggguccccccgcauagcauaggcacuccugaauuuccaaguuuagugugacaguccccaguagcugcccaccuuacacuggggacuccccaauauacacuagaaacucauaaaauauggcacacacagauuuaauccuuugaaccccuaaauccauauagcuauggcccacaaacggcagggaguacaguagagguguacagcacacugauauaacuccuggggauccccaaagccaugauauaagccaauauagacuagggaccccaacauuugggcucacucauauaaacacaauacccucaauguaauaccuacucuaauauauuacugggaacaaaaauucauaauugucuuaauauaguuuugggauuuccccaaauccaaaauauuucauagacagacagccuagugcagugcuccccaacuauuuuggcaccagggaucaauuuuguggaagacaguuuuuccguggaccacggaugcggggaaggaugguuucaggaugaaauguuccaucucggaucaucaggcauagauuccuuuuuuuuuucuuuuuauuuuugagauggagucuugcucuguugcccagucuggagugcaguggugugaucuuggcucacugaaaccucugccuccuggguucaaacgauucuccugccucagccuccugagcagcugggauaacaggcuccugccaccaugcccagcuaauuuuuguuuucuguuuuuuguuuuuuugagauggagucucagccugucgcccaggcuggagugcaguggcgcgaucucggcucacugcaaccucugccucccggguucaagugauucuucugccucagccucccaaguagcugggacuaugggcacacgccaccaugcccggcuaauuuuuguguuuuuaguagaaacgggguuucaccauauuggccaggcuggucucaaacuccugaccucguggucuacccgccucggucucgcaaagugcugggauuacaggcaugagccaccgugccuggccuaauuuuuguauuuuugguagaaacgggguuucaccauguuggccagguuggucucaaauccccgaccucaaaugauccuacugccucagacucccaaaguacugggauuacaggugugagccaccgcguucggcuguagauucuuacaaggaguacucacccuagguggcuuggaucccaguaccagcccacagccugggguuggggaucccuggccucgagauuagaucaugggccgacugggugccacuugggcaaaagucauuucaccacucuaugccuucucuccuauggaggugcuaugguuuuccaucaguagaauggggguaaaaauuauaccuaccugauauggaggaugaagugaguuaaucuguguagaccuuagaacaggccuggcaugauggcucacacccguagucccagaacguugggaggccaaggugagaggaucacuucaauccaggaauuugaggcugcaggcuacgauggugccucugcacuccagccuggaugacagagggagacugcaacucaaaaaaaauaaaaauaaaaaaauaaggaaagaaaaaaaagaagaagaagaaggaaagaaaaaaaagaccuuagcacagucagugcuauuugugagcaauuauuuaauuauuuuuuguauuuuuuuauuuugagauggagucucacucugucacccaggcuggagugcaguggcacgaucucggcucacugcaaccucugccucccagguucaagcgauucuccugccucagccucccgaguaccugggacuacaggcgcccaccaccaugcccggcuaauuuuuguacuuuuaguagagacagaguuucaccauauuggucaggcuggucucaaacuccugaccucaggugauccaccuuccucagcuucccaaagugcugggauuacaggcgugagccaccaugccuggccugcaauuauuuauuugucagucuacuguaaccugggaggaacccaaauauggcacugucacacaauauucccaagggacuccuaaaucuagaauugcacaaauugacacagaaacagacauaaccagggggugggggacucagauccaacaacuuccuguuaaacucccagaggacccaacaguccagggaaaccaauuucgagucccagggagcccgagucccugacuuccagacugaccacuaguuccccuccuugugucaccaguacuauuacuccgugagggucuuugcuggacaggagcccagcugcgugugggcgggcugggucaccccugacuaccaucagcacgacaugagcuucgaccucagcaagguccgggucgugacggugaccaugggggaugaacaaggcaacguccacagcaggugccggggcuggggggaggugggaggugcaggguggggagggcaggaggcagucagagcucccgacaccagcucuguggcugccugguugugggaccuaggaacuuucuggagcgggaggauucucuggggcacugggcacccagcucggaagcuucccuccuccucuuuuuccuccucucuuccugcccugguauuuuucuucuccuccuccuccucuuuaugcauuucuccuauuccauuuucuccuuuuccuucucauccuguuucaucucacccuucuccuucucugucaucucauucucucuccuccugcuucccuugcuuucccuccuuucagacccccacccccauccugacuccccacugcgccagcugcuaggaaucccagcuccgaagagcucaguguccggggcgagggguuucagcucucaggucugcaggcgguggguguuuggggaugggacucugagguuguguguuuccgggagcuuggggaaggggguguccaggguccagagcuacucacaugaggagugcagugaccgcuucugucuccugcagccucaaguguagcaacugcuacaugguguggggcggagacuuugugagucccgggcagcagggccggaucagccacacggaccuugucauugggugccugguggacuuggccacuggcuuaaugaccuuuacagccaauggcaaagagagcaacaccuuuuuccaggugaguccaggccacagcaauuuagcgagagcaucaugucccagcaucccaggacagcucuuauagauguccccugaggccagaccucagagauggaacaaaaacagcuccuaggcuguccucaagaggucgcugggagaccaccuuguugaaacuuccaugaaacuaaggcccagacuggaggagauacagaaucucacucuguugcccagacuggagugcaaugggacgaucuuggcucacugcaaccuucgccuccuggguuagagggauucuccugccucagccuccugaguagcugggauuacaggcgagcaccacaacagccggcuaaguuuuauguuuuuaguagagacgagguuucacuguguuggccaggcuggucucaaauuccugaccucaagugguccacccaccucggccucccaaagugcugggauuacaggcgugagccaccacacccagccagaguccagccuugaccuuggaaagagguuucuguucccucuugagcugggugacaccagucaccaacuucucuccaaccagggaacacgcuaggaugggccagaauccuaagguggccuuuuccuuuucaacauuuuauucugaaaaauuucaaucauacagcaaaauugaaggagcuauguagauaacacccuguacccaccaccuggaaucuacuaucaauguuguagauauuggcuuuaucacauauucaccuaccuguccauuaaucuaagguggguuuguacaacuuuauuuuaauuuuuuggcauccauuguugguuaugaaauuuuauugcauuuuauuuucuuuauuuugagacagggccucacucugucccccaggcuggagugcaguggugugaucacagcugacugcagccucaacuucccaggcucaagcaauccuucugucucagcuuccuaaguagcugggacuauaggcaugcaccaccuugacuagcugauuuuuuguguguauuguuuguagagauggguuuuccucauauuguccaggcuggucucucgcuucugggcucaagcgaucuccccaccuuggccucccaaaaugcugggauuacaggcuugagucacugugccuggcuuauuuuuuauuuuuauuuuuugagacaggguuucgcucuguuacccaggcuggagugccauggugagaucacagcucacugcagccacaaccuuccuggacucaagcgauccucccacuucagccucuugaauaguugagaacacaggcacgugccaccaugcccagcuaauuuuuuuuguauuuauugugcagacggggucucacuauguugcccaggcuggucucaaacuccuggucucaagcaauccuucugccucagccucccaaagugcugggauugcaggcgugagccacugcuccuggcuaaagcuuuauguuaaauggagaauuaaaaacguauacaagaauggaauaguauaaugaacugccaugccccugucacacagcuucaacugucacccacucacagccaaucuuguuucaucuuuuuugucuguuuguuuuuugagagagggucucccucugucacccaggcuggagugcaguggcgcaaucucgacucauugcaaccucugccucccagguucaagugauccucccaccucagccuccugaguagcugggacuacagguaugcaccaccaugccuggcuaauuuuuuuuaguuuuaguggagacaggaucuugcuauguugcccaggcuggucucaaacucuugggcucaagcaauccuccugccucagccucccaaagugaugggaugacagguauaagccacugcgccuggcuuguuucaucuuuuuauaucuacuucccuuccacacccacuggauaauuuugaaggaaauugcagacaucagauaguuuccucuguuuucaguguguagcuuuaaaagauaaggaugaucuuaaagagcauaaccacaauaccacuaucaccuaaaagaaaaaaaaacaauaguuucuaaauaucaucaaauauccaguuuguguucagauuucucugguuguccccaaaaugucauuuuaccauuucuuuguuugaaucagaaucuaaguagggucauauauuuuauuuuauuuauuauuuauuuuuauuuuauuuuuugagacaaugucucacucugucacccagucuggagugcaguggcauggucuuggcucacugcaaccuucgccucccgggcucaagccuccuaaguaugugagauuacaggugugcgccaccacacccagcuaauuuuuguauuuuuaguagagacggggucuggcuauauugcccagccuggucuugaacuccugggcucaagugacccuccugccuuggccucccaaagugcugggauuacagugugaggcagcaugcucaaccuuauuuauuuaauuauuuauuuuaauuuauuaagacagagucuugcucugucacccaggcuggugcgcaguggugccaaccguacucaaccuuauuuauuuauuuauuuuaauuuauuaagacagggucucauucugucacccaggcuggugcacaguggugcaaucuuggcuuacugcagccucaaccuccugggaucaaacgauccucccaccucagccucccaaguggcugggaccacagacacgcacuaccacaccuggcuaauuuuuguauuuuuuguagagacgguguuuugccauguugcccaggccagucuugaacuccugaccucaaacuauucgcccaccuccaccucccauguaaucccagaauauaaaacgugcugggauuacaggugugcaccaccacgcucgaccagggucauauauuuuaggugguugcucuguaccuugaguuucauuucauauguagauuucccccuccauuccuucuucuuucccaaccccccagaaauguauuuguugaaggaaccaggcuauuuguccuguggcacuuugcuccucaaaguguggucccuggaccaaccagcaggagagcugcaggaucuuuagcugggucuagucaugggcaccugcaguuccagcuacccuggaggcugaggcaggaggaucaccugagucugggaggcagagguuguagugagcuaugauagcgccacugcacuccagccuggguggcagagcgagacacugcuucuuuuuaaaaaaguuaaaaugggccgggcgugguggcucacaccuguaaucccagcacuuugggaggccgaguugggcagaucaccuaaggucaggaguucgagaccagccugaccaacauggugaaaccccaucucuacuaaaaauacaaaaauuagccuggcguggugacgggcgccuguaaucccagcuacuugggaggcugagacaggagaaucgcuugaacgugggagguggaguuugcagugagccgagaugaugccacugcacucucuagccuggaugacagagugagacgucaucucaaaaaaauaaauaaacaaaauuaaauaaacccagagucucagaccccuucccaugccugccaaaucagaaucuguauuuugacaggaucccaggggcuuccuguguauauuaaaucuggagagggcuggccugguuucccauagccuggaucuggcuggugcauuccugugguggcuuuuuaacauuuuccuuugucccccauauuuccuguaaacugggaguugggucccagggugcaauuagaucagguuuggugugggcgggacugcuucagagacaauguuguuuguggaggcagaggcuggcuggaugggcuccacugggaagacgggagaggggcaagacagucugaggacacuuccuggaauuuuuuguuuugagauagggucuuguucugucacccaggcugaagugcgguggugcaaucauggcucacugcagccucgaccucccaggaucaagcgauucucucaucuuagccuccugaguagcugcaacuacagauauggaccgccaugccucgcuaauuuuuuauguuuuguagagauggggucucacuacguugcccaggcugcucuugaacucuuaggcucaggugacccucccacuucagccucccaaaguucuaggauuacaggugugagccaucacacucucuggguuuugaaugaguaugcuugggagagaaaugcgaagggcauucccagugcggggugugaugugugcagagacagaugacagguugcucugggaaaguuggaggagguuggccuggcuggaucagaggugggacagucuaagggugaccucugagccauuuuggagccucuaacgcccagaugaggaccuacaaauuggccccagaguuugagguccagagucaacccucccuccagcccacccguuugcucaccucguccucuucuccucugccagguggaacccaacacuaagcuauuuccugccgucuucguccugcccacccaccagaacgucauccaguuugagcuggggaagcagaagguacaagugcagugaugggggcacuaauggggccaggcugaggcaggagauguggggaggccaggcgggcagagccacugaaggggagggggcaauccaagaggucucccuggaagugguguggugggacagagggggcuggccaucuugacccaugugugucucucugcccucagaacaucaugccguugucagccgccauguuccaaagcgagcgcaagaacccggccccgcagugcccaccgcggcuggagaugcagaugcugaugccaguguccuggagccgcaugcccaaccacuuccugcagguggagacgaggcgugccggcgagcggcugggcugggccgugcagugccaggagccgcugaccaugauggcgcugcacauccccgaggagaaccggucagggccagcccagcuaugcaggggugggcagguguugcaagcccucuggggucugggucccacucagugccccuccucaacacaaccccgggauuccagacuacaccccaggaaucuccagaccuaccucaggggacucgggcucagcucagacauccccagauuaugucccagggggauucagacucaacgcaggaggcucuacaccaucccaguggaccgcaggcccacccuaagggaacccagacaauaccccaaggacccagacccacuccacagggccccaaacccaucucagggagccagacccacaucaacaccccagggggccccaaguacaccccaggaucccuggacaugauucagggaggcuuggaugcacccuagagucucuugggcauaugcagggaggcuuuaagaagaaucccguggauauuucaaacccaccccaggggacccagacacaccuagggccacagaugcguucacauggauggcaggguuacucuuaagaacucugaacguggccaggcacagugccucacaccuguaaucccagcacguugggaggcugaggcaggcaggucaccugaggucaggagucucuacuaaaaauacaaaaauuagccaguugugguggugugcacccaucgucccagcuacucgggaggcugaggcaugagaauugcuuaaacccaggaggcggagguugcauugagcuaggaucacgccacugcacuccagccugggcaacagagcaagaugccaucucaaaaaauagaauucugaacgugggaggaaucccagacucacccaggaggcuucugacaugccucuuucuuucuuuccuuccuuccuuccucccuccuucccucucuccuucccuuccuuccuuccuuccccucucccucccucccucccuuccuuccuuccucucucccucccucacuuccuuccuuuauucauucauccauucaacaaauagcuuugggucccuccuaugugcuagguaguauuccaggcuggagacaccaagccccugugaagugacauucuaguaaugcuuguacauaacucaggaugcucggacaugcccaaagggacccagggucauccccagggccccagacacacccguuuauuaauuuauucauucaacaaauauuuauggguacaguggcucauguuuguaaucuaagcacuucaggaggcugaggaggagggaggguugcuugaggccagggguuugaaaccaccaggaagcacagugagaacccgucuccacauuuuuuuuuucuuuuuaauuagcuuggcuugguggcacacacauguagucucagcuacuugggaggcugaggcaggaggauugcuuaagcccaggaguucaaggcugcagagcuaggaucgcaccacugcacucuagccugggcaacagagcaagaccccaucacuaaacaacaacaacaacaaaugcuaagcacuuuacuaugugcuaggugugguuuuaggugcugggaauauaacaaacaaaagcagaaacaaaacaggcagaaauguccugcccuuggaauuuacauucuaauggcacucaaacacaacuaguauacucagaccugccagagggggacccagucugggggcccaaacacaucuuggaaacaucagauguucuacauggacucucagacucuuacgaagucccagaccaucccagggaccccagagguaucccaggggcccccagaucccuuagggacuuccagaaccauugaaagacuccuagacccagcuccacugcccucacagaacccuaagcuaggaggccacuggaacucccugcugcagccuucgacacucgucuaagcaucucugccuuucuggggucugugccucugucucccaucuucucccaggaugggugaauugauagauggaaugguagggguuugaaggaaagacgaaugaauaaauggguggauagugaugaaggaaauggaggaagagaugguggcuugacugaugcaggaggcucauucaucugucccugucuguuucccaccucugcugcaggugcauggacauccuggagcugucggagcgccuggaccugcagcgcuuccacucgcacacccugcgccucuaccgcgcugugugcgcccugggcaacaaucgcguggcgcacgcucugugcagccacguagaccaagcucagcugcugcacgcccuggaggacgcgcaccugccaggcccacugcgcgcaggcuacuaugaccuccucaucagcauccaccucgaaagugccugccgcagccgccgcuccaugcucucugaauacaucgugccccucacgccugagacccgcgccaucacgcucuucccuccuggaaggagcacagaaaauggucacccccggcauggccugccgggaguuggagucaccacuucgcugaggcccccgcaucauuucucgccccccuguuucguggccgcucugccagcugcuggggcagcagaggccccggcccgccucagcccugccaucccgcuggaggcccugcgggacaaggcacugaggaugcugggggaggcggugcgcgacggugggcagcacgcucgcgaccccgucgggggcuccguggaguuccaguuugugccugugcucaagcucguguccacccugcugguaauggcuuccuccugcuuuccucugucccauucuucucccacauucccaaaacuccagagauacaugcaucaauccuccucuauuuaugcauccaaccacccauucauucccuccucuauacauccauccaccuuucuuuuuauuauuauuauuuuuucgagacggagucucacugucgcccaggcuggagugcaguggcgcaaucucagcucacugcaaccuccgccucccagguucaagcaauucuccugccucagccccccgaguagcggggacuacaggcaugugccaccacgccccgcuaauauuuguauuuucaguagagacugcuuucaccauguuggccaggcuggucucaaacuccugaccuccugaucugcccaccuuggccucccaaagugcugggauuacaggcgugagccaccgcguccggccuccauccaccuuucuauguauccucccaccaucucccuaucuuucauucaccuuucccuccaucugcucaccugucaucucuuuauguuuauucaucucuucuuucuuccuauucaucuauccaaccaaccaucauucauccauccaucaauccaucaguccuccaccagccuuuccauccacccauucauccuauccauucauguguauagaucaucuuuccaucaacaagaucuuuccaucaacaucuuuccaucugccuuucuauccuuuuguucuccacccacuccauucauucauucauguacccaucuauccaaguuucaaucuauuugcccauccaucuuuucauucauucauacagcaguccaucuaccauuccaucuguucaucuauccaccuacccauuuauguauuaaucuaucuuuccuuccguagguccaauaaucaucuccucccaccuaugcguccauccauaccuacauccacagauccauccguuccuccaguucccaccuacccuucauccauccauccaucucuccauucauauguacguacacccauccaccuacccacaaauccauuuagccauccacacccauccaucuacccguucccuauccuucucuccaucccuuguaucauguacccuuuuauucguagacccaucuaacuauucauuuauauauccaucuuuuugguuuuguuuguguguuuguuuguuuugagacaaagucuugcucugucacccaggcugaagagugcaguggagcaaucucaaaucacugcaaccuccgcuucccauguucaagagauucuucugccucagccucccaaguagaugggauuacaggugcccgccaccaugcccggcuaauuuuuguauuuuuaauagagaugggguuucaccauguugaccaggcuggucuugaacuccugacuuugugaucugcccaccucguccucccaaagugcuggaacuauaggcgugagccaccguguccaggcaagacagggucucgcucugucacccaggcuggagugcaauggcacaauaauggcucacuguagccucaaccuccugggcuucagcaauccuucugccucagccuccugaauagcugggacuacaggugugcacuaccaugcccagguaaguuuuaaauuuuuuguagagguggagucucgcuauuuugcccaagcuggucuugaacuccugggcucaagcaauucucccaccuuggccucccaguguuaggauuacaggcaugagacgcucugcucaaccuaauuuuguuuuuauuuauuauuuuuaauuuaauuuuauuuuguaagagacaggguaaugcccaggcuagaaugcagugguaugauuguagcccacugcagucuuaaacuccuggguucaaguggucaucuugccucagccucccgaaguacugugauuacaggugugagccaccacaccuggccccaacuuuucauacacaaaccuauccagccauguggccaaccauccccccacccucauggcuauucacuaauuuaucuauuuauccacauauucauuuacuuccucaugcaucuaucaacccauccaucaccuacucaccuaccuauacaucauuuauccuucucucauccauccacccaucaucucuuccuccaucauuuccuucaucucuccaucaucauccacuuauucaucuuuccuucaaaccucuaccauuccgacucgggauucauccagccagccauccaauccucccuccauucauccaucucucucucuccccugcacucuucuucccuuucgucuacucccucuuuacuuccauauguuagcaucuuuuaaacuuuaauuuauuuuguuuuugagacagacucuccgucugucaugcaggcuggagugcaguggcauaauaucagcucccugcaaccucugccucccagauucaagugauucucuugccucagccuccugaguagcugggaauacaggcgugcaccaccacacccagcuaauuuuuuuuuguauuuuuguagagacgggguuucaccauguuggccaggcuggucucgaacuccuggccucaagugaucugcccgccuuggucucccaaagugcugggauuacaggugugagccucgccucauguguuagcaucuucauuauguugacugagagcugguguaugcugggagcuaugcaggcguaggguguguccugggccagaggacacagcacaugcuuaggcuugggagaaaggacacucgccugugaugggagaggcacucauauuugggucuguggucugggcugugugggugggacacaggguguggaccuggguggaucuuaaggaggguggauggcaaggcgggggaugccauuccugcugugggaggaaucggaucagccaaugcaggaaugauuggcaugugcaugaggggcaggucuggagaaugaggccagggccugaugauggaggccuugcaggccacagugaagaaccgagacuuuguccuguaggugaugggcaucuuuggcgaugaggaugugaaacagaucuugaagaugauugagccugaggucuucacugaggaagaagaggaggaggacgaggaggaagagggugaagaggaagaugaggaggagaaggaggaggaugaggaggaaacagcacaggaaaaggaagaugaggaaaaagaggaagaggaggcagcagaaggggagaaagaagaaggcuuggaggaagggcugcuccagaugaaguugccagagucugugaaguuacaggugggcugcugcuuccugcuuuucggccucuguccaucugggcugggagacacaggguaggugggaugugagucuggacuucguccucaggcaguggggagcuguggaaaugcauauggcagugagcaaugccaacuuggaaagaucucuguuuuccauggagaugagaccauggagaaggcagucuuuuuuguuuguuuuuugcgacagaauuuugcucugucacccaggcuggaauacaguggugcgaucucggcucacuguaaccuccgccucccggguucaagcaauucuccugccucagccuccugaguagcugggaucacaggcaugugccaccacgcccagcuaauuuuuuguauuuuuaguagagaugggguuucgccauguuggccaggcuggucuugaacuccugacuucaggugauccacccaccucggccucccaaaaugcugggauuacaggcaugagccaccaugcuugaggaaggcaggcuuaagguuccaggcgggaaaugauuuuggcuggaccugggcagggccauggagaggggagaggaagcaagagaaguuucaaggaaguccugauggucucaccuccaucucuccucccacacggcuguccuuccacagaugugccaccugcuggaguauuucugugaccaagagcugcagcaccguguggagucccuggcagccuuugcggagcgcuauguggacaagcuccaggccaaccagcggagccgcuauggccuccucauaaaagccuucagcaugaccgcagcagagacugcaagacguacccgcgaguuccgcuccccaccccaggaacaggucaucugaccccugacgcuggccacuuuuacugucuaaaccccaaccucaacaucuccugacucugaucacugaggacccucaaccucuaaacccgugcuugaccccugacccuagugauacauuuaucuccuacucucugaaucaaccugaccucugagucaccucagacugaugcugacucuuuucaaaccucuggcccuagucucccaaauagucuucauuaacucacacuucgacucaugaccuuagacauggacuaacaauugcaucuucuaucucugaucucagaguuccugcuuugggaucucagacccucauucuaaucuuugaccuuccccuagaucaauaugcuauugcaauucaaagaugguacagaugaggaagacuguccucucccugaagagauucgacaggauuugcuugacuuucaucaagaccugcuggcacacugugguaaggaguggggaucagagaguccuccccaugcuaacuuucucucgagaccucuccagaaguuucccuaagauuuccugacaacccucuacaguaucggugcuauguaacuauugguugaaugaaugaaugagugagugaaugaauguguuagugaacaguuagacaaugcguguuuauauggguauuuggguggauggcuauaagccagauaaaugaauggguaugugaauugauggauagaagaaguggguaaaaaauggcuggcuggauagauggaaggaugaagagaaggauggauggaugguugagaacuggguggagagauggcuggcuggguggaaggacagauggaugaccuccauaguuucugaugagaagucugcugauagucuuacugagauucccuugcacaugaugaauuauuuuuccuuggcugacuuuuaagauuuucucuuugucuuugccuuucaacaauuuaguaugacgugucuagguguagagcucuuugaauuuauccuguugaaaguuuguugaguuucuuggauauauacuuacuuuuuaucaaaguuggaauauuuuugacaauuauuuauucaaauacuuuucugccccuuuccucuuccucugggacucucauuaugcauauauugguacacuugauggcaucccacaggucucugaggauuucuuucauuuugcuuuuuuuuuuuuuuugagacggucucacucugucacccagcaggagugcaggggcacaaucuuagcucacugcauccucugccuccugggcucaagccauccuccuaccucagccuccaaaguagcugggagaacaggugugugccaccacgccuggcuaauuuuuuaauuuuuuuauagagucgggguuuugccauauugcccaggcuggucuugaacuccugggcucaagcaauuugcaugccugggccucccaaagugcuggauuacaggugugagccacugcaccuggcccauuuuucuucauucuuuuacuuuucuguucuucaggcuagacaaucucuauguccuaucuucaaguucacugacuguuucuccuaucagcucaaauaugcuguugaaccccccuaauaauuuuuuauuucaguuauuuuauuuuucaacuccagaauuucuauauuuuaacagucugccuuuuuauuaguauucacuacuggauaagucacuauuaugauauuuccuuuuaauucuucagacaugguuuccuuuaguucuuugaacauauuugcaaaauugauuuaaaagauaaauguuugauagaaugaauaaaugaacaaauacaugaacauacaaagaaauaaaugaggccaggggugguggcucaugccugcaaucccggcauuuugggaggcugagguggguggauugcuugagcucaggaguucaaaaccagccugggcaacauggcaagacccccaucucuacagaaaaagauacaaaauuaacagggcaugguggcauacaccuguagucccagcuacucaggaggcugagguaggaggauggcuugagccuaggaggcagagguugcagugaguugacaucaugcuacugcucuccacugcaacagaacaagacacugucucaaaaaaaaaaaaaaaaaggaaaugaaaaacuccaugcaugcaugcacauaugcacaaauaaaugaguguguaagcaggugaauaagcaaacuaaugaaugacauuucccgccuucuugaccacuuccaggaauucagcuagauggagaggaggaggaaccagaggaagagaccacccugggcagccgccucaugagccuguuggagaaagugcggcuggugaagaagaaggaagagaaaccugaggaggagcggucagcagaggagagcaaaccccgugaggacuggggucacuggggagagggcaggggugggguggguagccccaugccugcggagccucugggucccaaagagggcaugaggacagaugcaagggagggguagauaggcaggagugagaggggaagaguggcgggcaaaguggaagcaggcgugguggcucacgccuguaaucccagcacuuugggaggcugaggcggguggaucacuugaggucaggauuuggagaccagcccggccaacauggugaaacccccuucuccacuaaaaauacaaaaauuagcuggguguggcggugcaugccuguaaucccagcuacuuggagacugaggcacgagaauugcuugaaugcaggagguggggguugcagugagcccagauugcgccacugcacuccagccugggugacagagcgagacucugucucaaaaaaaaaacaaaaacaaagaugcaugcuggagguuugccuccagagaugggggcuguagaacguguguguuggaccagggugacacagccuaccagcuuaguggcaaaccucuaacuaagggauggcgguaacccugaaccacuguggcuuccguggccuuggggcuucucuuuucuuucuugaugagaggauuaccaugcugagggauuagacaagcagcuaucauuaauguugggccaauguguuauuuugcaaacuguauauuagccacaucuaacaaggacagauuuccugacguugguacagguuuuaucccacaacauucaggaaacuuuuauggggccaacuaugggccaggcacuguuaccagggcugggaaauacagccgaggggggaaagucaaagccccugcccacgaguuuagauuuuuucuuuuucuuuuucguuuuuuuuuuuuuuuuugaggcagggucucacugcgucgcccaggcuagauagagugcaguggcgcgaucuuggcucacugcaaccuccgccuccuggguucaagcgauucuccugcuucagccuccagaguagcugggacuacaggcgcgcagcaccaugccuggcuaauuuuuguauuuuuaguagagacggggcuucaccauguuggccaggcuggucucaaacuccugaccucaggugauccacccgccucagccucccaaagugcagggauuacggcugugagccaccgcacccagccaaauccacaguauuuuuauagaacaagugggauugugacaugugccuucaaaggugcauggcgaagugcuucuggucggcucugguaucuugcaguuguacaguuuauuauuccuauugaaauuuuuaggaagcccuugugggcuggauauuagggugaacagaacagagagauucuugggcgaauagaaaaaaguuugccaggcugggcacaguggcucacaccuauaacccuagcccuuugggaggccacaguaggaggaucacuugagcccgggaguucgaggcugaagugagcugugauagccccacagcacccuagccugggcaacagagcaagacacugucucuaaaagaaaaaaaggaaaacaaucugcuagaaucugccugcucccagcagguggagggcgcaggugguaguaacugggaaaacuucuggaacagggggccccuuccacauuguucugguccaaggccccaugugccgaccugcccugcauggugcuccaagccuugcauugucuccuucccagggucccugcaggagcuggugucccacaugguggugcgcugggcccaagaggacuucgugcagagccccgagcuggugcgggccauguucagccuccugcaccggcaguacgacgggcugggugagcugcugcgugcccugccgcgggcguacaccaucucaccguccuccguggaagacaccaugagccugcucgagugccucggccagauccgcucgcugcucaucgugcagaugggcccccaggaggagaaccucaugauccagagcaucgggugagacaccgcccuucccccuuacuuugcauauccccuuggguaaugaauacccucaggauacaauaacauucccuuccccaacuucuggcccauccucugggugaucucagucucucgauggcuagcucaccuccuggguaaugucuccuucccuuaccucuccgcccucagugguagcagcuccgcuucugugugacucucagcaggacauuccccaccccccccuuuuuuuuuuuuuuugugagacugagucucacucugucacccaggcuggagugcaauggcgcaaucucagcucacugcaaccuccgccucccagguucaagcaauucuccugucucagccucccaaguagcugggauuacaggcacgcaccaccauaccaggcuaauuuuuuauauuuaguagagacaggguuucaccauguugaucagacuagucucgaacuccuaaccucaggugauccacccgccucggccucccaaagugcugggauuagagacgugagccaccacacccagcugagguuuacccuuuuugagcuucaguuuccucaucuguaaaaccggggagagccaagccuacucugaaggguugugcuguggcuucagugagcucaugcgaauaauaauaauuaugguagcaguauugagcacucauugucaaauaaaucucauucacacaguaaacauuuauuaagcaccuacuucgugccaggcauuucuagguguuuuugagacagggccucacucuguugcccaggcuagagugcaguggcccaaucacagcucacugcagccucaacuuccugggcucaagcgauccuccugccucagucuccugaguagcugggacuacagacacacaccaccauacccagcuaauuuguaaauuuuuuuguagagguagggucuugcuauguugcccaggcuggucuuggacuccugggcucaagugauccuccugccuuggccucccaaagggcuggaauuacaaggcaaaagccaccaugcugggacaacauuugacaaagggcaacauggcaaagaucucugcccuagaggagccugccuugggugcacgccucagucuccuuaugagggaaacagggacccuuccucccacaguggcuguaggaauuuuuuuuuuuuauuuuuugagauggagucuugcucuguugccaagccuggagugcgcaaugucugcucacugcaaccuccgcauaccggguucaagcgauucucccaccucagccuccugcguagcugggauuacggguaugcgccaccacgccuggcuaauuuuuguauuuuuaguagaaaugggguuucaccauguuggccaggcugaucucgaucuccugaccucaagugauccucuagcuucggccucccaaagugcugggauuacacgcaugagccaccgcacccggccagcuguaggaauugagugaguucagaucuguaaaggcgguggugcuaggcacagagugagagggucaagaaugccaacgcugucacagugguggcuauggcccucuccggaccugggccccuggugaccccgcacacucugcccgugcacaggaacaucaugaacaacaaagucuucuaccaacacccgaaccugaugagggcgcugggcaugcacgagacggucauggaggucauggucaacguccucgggggcggcgaguccaaggugagggcccaggcaggugcuggggagcucaggggaggcagccacagagggcaggcccugaccacccugccugucccaggagauccgcuuccccaagauggugacaagcugcugccgcuuccucugcuauuucugccgaaucagccggcagaaccagcgcuccauguuugaccaccugagcuaccugcuggagaacaguggcaucggccugggugagaacccccgagcccaggggcugucccccagaacccacuccuggcaccccguccaggccugccccacuuuccaccagcucacucauucaacaaacacucccucucaacugugguucuggcccuguaaugaguaaugcuggggacacaauagugaccccaauagugacagcccagaguggucagagcuuggaugagggaaguacagaccagaggaggcaccugauccaggcuggaaaaaggguggucagggagggcuucccagaggaggcgagacaagcaggagugagauguucuccccaccucucgccccugcaggcaugcagggcuccacgccccuggacguggcugcugccuccgucauugacaacaaugagcuggccuuggcauugcaggagcaggaccuggaaaagguguggagggcagggcugggccccaggccuaagggaggaaaucgggccgcuacccggcugcuugggacaccugcugauuccaaacucauucuggggggcaauucuggaugguccagugcccaaccagaaggagacuaauuugcagggagagaacggcacccaguuguucauucaugggaugcuuccuggcugugggccgguccgcacuccacgcuucccgucugggggcagguccacagucuacgcuuccgggaugggggcggauccgcacucuaacuuccaggcugggggcggauccgcagucuacacuuccgggcugggggcggauccgcacgcuacgcuuccggguugggggccgauccacagucuaggcuuccagccagguggccuuggcacauuucuucgcucuccgagcuuccacuucuguguacaguggugaaaugcgugggcuccagacuucagcaacuuugcuucugcuccccucgcucccuggcuguguggccuuggauaagugacuuagacucuccagaccccuguugucucaucuguacaaugaauguagucauagaaacgacuucauggagucauucugaggauuaaaugaauuaauccaguaaaguguuuguaaaggggcagucaguaacguuagcugcuguuauauuaucauucaacaaauauguaguguuagcuuaccauaugcaaagcaguagcaauaugacagucaaaaaucccugucuggccaggcaaaguggcuuacaucuauaaucccagcacuuugggaggccgaggcaggaggaucacuuaagcucaggaguuuaagaccagccuggacaauauagggacaccuugucucuacaaaaaauacaaaaaguagguggguguaguggcacguaacuguagucccagcuacucaggaggcuaaggugggaggauuugauagagccugcgaggcugaggcugcagugagcuauggucacaccacugcacuucaccucagggacagagcgagaccccuuaaaaaaaaaaguggccagagaaagccucauugagaaagugacauuuguguaaagcucugaaggaaggugacaggucagguggucaucauggggaagagcauucuaggcagcgggaacagccagugcaaaggcccugaggcaggagcaaaccucauaagcuggaggaacagcagaaagacagcuguggcuggagcagagguagugagggugagggcaggaggugacaggugggucauguggcaucucaucggucacaacaagggcucuggcuuuuacccugagugagaggaggccaggauucugagcagaggagggacgugaccugacucagguguucacagggucccucuggcuguguguggggaacagauugaggggaaggcagaaggacagaaggacagggaggaggcucguguugugguccaggugggagacaaggguggacagaaccgcuacaggaaaggggucuggauccaggcccaaagagaagguucuuggaucucauguaagaaagaauucagggcaacuccauagaguaaagugaaagcaaguuuauuaggaaaguaaaggaauaaaagaauggcuaauccauagacagagcagccccaagggcugcugguugcccauuuuuauguuauuucuugaugauaugcuguuuagcauaacaagggguggauuauucaugccuccccuuucuaaaccauguaggguaacuuucugauauugccaugacauuuguaaacugucguggcgcuggugggagugcagcagugaggaugaccagaggucacucucguugccaucuugguuuugguggguuuuggccggcuucuuuacugcagccuauuuuaucagcaaggacuuuaugaccuguaucuugugccaaccuucuaucuuguucugugacuuagaaugccuuaaccaucugggaaugcagcccaguaggucucaagcuccuguucaagauggaguugcuguaguuuacaggccucugacaggaccagggcuaaugggccgagggaucagagcugaaccggacugaggagccgcagggcagggcagggcagggcagagggcugagccccaggaggaagguggcaugggucuggucucugacugagccccuucugcccccagguuguguccuaccuggcaggcuguggccuccagagcugccccaugcuuguggccaaaggguacccagacauuggcuggaaccccugugguggagagcgcuaccuggacuuccugcgcuuugcugucuucgucaacggugaggaggggguggcaguggcagagcgggaaguauggagucacuggucacacaccucccucgagaugacugcucgcacccugagccacagaugggguccaggcaggaaucccuuccagcaggccuggggcuggcaggggccuguguuaccccuggagguguuggguccuguggcuggcaguguuggauccuggggcuggcgggagccugguguuaccccuagagguguuggguccuggggcuggcaggggccugguguuaccucuggagguguuggguccuggagcuggaugggaccuguguuaccccuggagguguuggguccuggggcugcauggggaggucucugaugguggcucaugagacccccuuuccccaugcggguggccaggcgagagcguggaggagaacgccaaugugguggugcggcugcucauccggaagccugagugcuucggacccgcccugcggggugaggguggcucagggcugcuggcugccaucgaagaggccauccgcaucuccgaggacccugcgagggauggcccaggcauccgcagggaccggcggcgcgagcagugagucucccggcccccuccucaauagggcaacccgcccucccuggccccuggcugccuccccaacccacccaccuucccugcagcuuuggugaggaaccgccugaagaaaaccgggugcaccugggacacgccaucauguccuucuaugccgccuugaucgaccugcucggacgcugugcaccagagaugcaugugagacccugagccagggcaggaugggaagggagggcaggcacagccgcuuugaacgccucaugcaggcacucggugacacggagugagcucccauaugugggugguccuggacuagcaauguuggggacacaacagugaccaagacagccccagggccuggucucacagagcucccaguccaaugggggagacggacagugacacccagaguggucagggcugggaugggggagcacaggaagaggggucggggcugggauugcagggcacacggagaggacucaggauggggauggggaacacagggagaggggucaggauggggauggggucacagggauaggggucggggccaggaugaggggucgcagggagaggggucaggaugagguuggggggaacaaggagagaggucgggacuggggugggggggcacaggcagaggaacgagggcuggaaacucuagacagccuccugagaaagaggccugcucuacccuccugugugguaagggagggagcagagcagucacugaguggggcaccagcgccugaugagugccccucucccucccucuacuccccagcuaauccaagccggcaagggugaggcccugcggauccgcgccauccuccgcucccuugugcccuuggaggaccuugugggcaucaucagccucccacugcagauucccacccugggcaaaggugcagaggggauggaacuuggcgaaggagugaugcuggggagggagcggcuggguccgcagggcauccccgaacccacccucccugccugcagauggggcucuggugcagccaaagaugucagcauccuucgugccggaccacaaggcguccauggugcucuuccuggaccguguguauggcaucgagaaccaggacuucuugcugcacgugcuggacgugggguuccugcccgacaugagggcagccgccucgcuggacacggugagcaacccugcccagccuggccacccuccccacuuccacagagggacaggagaugggucacgguagagcagcagcagcugcuuuuguuuuucuugggauuguggacauaucauaauccccaauaccaucaucaagauagaaaaugaaaacgaagaaacacugaauuccgaugaagggugaguaggaaucuccaagaccuccaguuauaagaaaucaucauuugaggucaggcguggugacucgcgccuguaaucccagcacuuuggggagccgaggcgagcggaucacaaggucaggaguucgagaccagccugaccaacauggugaaaccgcaucucuacuaaaaguacaaaaauuagccagacgugguggcgcacacuuguaaucccagcuacucaggaggcugaggcaggagaaucacuugaaccggggaggcggagguugcagugagccgagaucgugccgcugcacucccgccuggcaauggagcgagacuccaucucaaaaaaaauauuuuguucgcaguauugguuugguacugugggcacacagaacucuguacaggaacagcaauaacagaagggugacagggcaaggaagaugagcacugagaagugaccaccgauuuggcaaagucaaggucacuggaaauggggaugagcaguuucagcaggggacagaagccuuccgagaggggguuuaagagagccuggggcugugcaugguggcucaccccuguaauaacuuugggaggccgaggcggguggguugcuugaagccaggauuuugagaccagccugggcaacauggagagauccugucucuacaaaaaaaauuuaaauauuagcugggcauggugcugcacaccuguaguccccucuacuagagaggcugaggugggagaaucacuugagggacagacauugaggcugcagugaaccaugauuacaucucugcauuccagccugggcgacagagcgagaccuuaucucagaaaaaaaaaagaaaaauaaauuagccaggcauggaggugcgucccuguaguccuagcuacuagggaggcugaggcaggaggaucacuugagcccaggaauucgaggcugcagggagcuaugauugcaccacugcacuccagccugggcgacagagaccccugucucuaacagaugaaaaagaauguauuacaggaagaaagaugaggguuagagaggagauaagcgugcagaccauugauauuuacagaagagccaaaucuguaaugggguucauuaaucucaucgaccaguuguguguguuugaaauuuugcauaauccaaaguaguaagugguggggugggggcugugggcauaggggugugggcauagggugggaggagggugguagagauugggaggagcagguuuugggggagucaucagaagcuuggauccuuuggccacagucgcucaagacaggugccagagcagccccaggggugugcagcgggccugauguccucacccugcgcccuaggccacuuucagcaccaccgagauggcgcuggcgcugaaccgcuaccugugccuggccgugcugccgcucaucaccaagugugcgccgcucuuugcgggcacagaacaccgcgccaucaugguggacucuaugcugcauaccguguaccgccugucucggggucguucgcucaccaaggcgcagcgugacgucaucgaggacugccucaugucgcucugcagguggagcggggcaggcuucaggguggggcaggggcaggggcaggggcaggggcaggggcaggggcaggggcaggggcagggggaggagcaggggcaggggcagcagagcgggccuggacgggggauucuacaucuugugcauugucccgcagguacauccgcccgucgaugcugcagcaccuguugcgccgccugguguucgacgugcccauccucaacgaguucgccaagaugccacucaaggugagggcaagcgcucuuuagcaucucauuuccaggccgcacccacugguuugcucuucccuccuacugcggggcucauuugugucggcacugcccagcccaauaaaccugcacuaguuagggcagcguccccguagaaaucucuuagcauccuuauuugcauacuaggauucccagaacauucacuuugcuucauugaugccucuagcguucccuaauuagcauuuaauuugcuuaacagugagccagcccccgcuucaauuagcauauauuugcauggagcacaccacuuucccuaauuagcauguuuauuugcaugccuggaccaccagacuuccacuauucaaaugagugcauuuauuugaauaaacauuaucacagcuauucugaauauuugcacacugucucucuuauuuuuucauuugcaugcuaauuugcauaaagagauacccccaacucagauauuuugacuauuuugcauaauacaucgaaaucagcuccuauuucaaauuugcauuuuagccaggcgcgguggcucacgccuguaaucccagcacuuugggaggccgaggugggcagaucacuugaggucaggaguucgagaccagccuggccaacauggcgaaaccccaucucuacuaaaacuacaaaaauaagccaggcauaguggagcacgccuguaaucccagcuacucuggaggcugaggcuggagaauuucuugaaccugggaggcggagguugcagugagccgagaucgugccacugcacuccagccuggucaagagagugagacuccaccucaaaaaaaaaaaaaaaauuugcauuuuggauaguggaggcccucuucccaauuaccauauauuugcauggggugcagccuuuguuucuacuugguauguuaauuuacauaagcacagauugcugcauccauaugcccauuuacucacuacauacccauggauuaauauuagcacgcuuauuuguguaaagcaauaccagacacaaccagcucuaguuuaaugcccauuuuaacucuaaauuaagaaugcuaaauuugcauacuaagcugucuaggaccacuccucaauaaacauaccauuucuucccuuauuagcauaucauuugcauaacccacaccuccuucauaauuuaaaagcacuggcaugccugugucucucugggccuucgucugccugccauucgcuggugccccccucauuugugugucccccucuuguucccacccagcuccucaccaaccacuaugagcgcuguuggaaguacuacugccuacccacgggcugggccaacuucggggucaccucagaggaggagcugcaccucacacggaaacucuucuggggcaucuuugacucucuggcccauaaggucugggcagcagggagccccaaaauggccuauguggaggguuuggggcccaaaauuggggguccagagugaaaucccucaauuuugggggguucaaggaggagaagguucugcaaguuuggaucuaggaggaucuauggguugaggcuucgauuuggagguuaugaaagaggggguggaccucuaguuugggagcuuggagagggcaauauggggaugauuugagcauacaauugggacugacauuuggguuucaaggagagggaccauaauucagguuugggguucagggaggagggcugaugauugcagugugugaguuugagguccugggggucaguaaggcuuauagcgaccuccuaccccugcuucacccgguuuucccagaaauacgacccggagcuguaccgcauggccaugccuugucugugcgccauugccggggcucugccccccgacuauguggaugccucauacucaucuaaggcagagaaaaaggccacaguggaugcugaaggcaacuuugauccccggccuguggagacccucaagugaggccugggggcugggagacagagaggaagauuucagggguggagggaaccccagcuccaacaucugcugacccugugcccccaacagugugaucaucccggagaagcuggacuccuucauuaacaaguuugcggaguacacacacgagaagugggccuucgacaagguuggccucaggguccuccuauccaagaaacccucaagaccccagcuuuccccccgaccugguucuucccugaggccccagaucucccugagaccccccagccuucccuaagacccuuagcuuguucugggacccccccaggauucucuguccucggcuccuccagggucgccccguguguccccaacugcugccucccccucacccugccuccccuccaucucuagauccagaacaacugguccuauggagagaacauagacgaggagcugaagacccaccccaugcugaggcccuacaagaccuuuucagagaaggugaccaggccuuggggcccagcauugagggucaaaaugaaacccccaaauuugaggauucggggaggagugaggcaauuucacauguuugcaucuagguggaucuguggguuaggucuccccauucauggacuuugccuucucucaaacuugguagaguggguagagacuccgagagaguggguuugauuccuuggcuguaguaagacuucucggagacucaagugucuaaugggauaaggagauuggguuugggaggcucuguuacagagcagguaagagacuugaguuggaauccagacuggaccauugccuagccacauggucaggguuuucuccuuugggguccuuccuccaccccucucucaucccauuccaccaacuccccacccuccuguccaccccaggacaaagagauuuaccgcuggcccaucaaggagucccugaaggccaugauugccugggaauggacgauagagaaggccagggagggugaggaggagaagacggaaaagaaaaaaacgcggaagauaucacaaagugcccaggugaaggcggggccuggguggagggcaggggcacgauggggggagggucuagaacaaggggcauggccagacagggaagggauggagaggagaggggcccagggagguagguggggcaagaggggugcagaaaccugagaucugggaaaggagagggcaggggucugaagaacugcaaagggcagaggagagaaggauggggugguuuagagacagggccuuaaggaaaggacaaggggucuugagccaggggaggguggaggggguagaauggacuaguggggccuggggaggggcuggccugggcuuccugcuagcccaucagcccaccucccaucuuccccuuguccucucagaccuaugauccucgagaaggcuacaacccucagccccccgaccuuagugcuguuacccugucccgggagcugcaggugagagcccugauccuuuuggggggacauagggugucuuugggggggcuggcauccucugaaucuagcccuugacucugcauccacucccaggccauggcagaacaacuggcagaaaauuaccacaacacguggggacggaagaagaagcaggagcuggaagccaaaggugagggcgcccaugccgcccccacgcuacccccguggauucaccgugugguuuugcugauugccuucaugccccugaaacucgguuucuccaucuguagaugggaauaauaacagcguuuaccaccaugggguaaugagaugagcaccagcaagcaauguuuccguuauucguaucuucuuuaucaccauaauuacgcaugccgggcacugcaggaaccacuucagugagaguggcccgggucuuccccagagcccugauuucuggucuuugccuccccaggcggugggacccacccccugcugguccccuacgacacgcucacggccaaggagaaggcacgagaucgagagaaggcccaggagcuacugaaauuccugcagaugaauggcuacgcgguuacaaggcacgcggguuggggcucccgcggaagagcagcaggcagaacacacccggcaaaggcuggaaggggcggggccagagagggguggagccgagaggaacggggccugaggagcaaagauggaaccagaggggaggagcuaagggaguggggccuggacacagaggcggggccagauggggaggaguucgaaaugggcggggcuuaagcacaggcgggaccagagaggagaggaggaagagaagggcggggcccagggagcagaggcggggccagagaguggaggagacugagaggggcggggaccggugauuggaggcgggaccaaagaggagagaaggcugaaaaggguggggcccggggaacagagguagggccaaagaggaagaggcugagaggggcgggggcuggggagcacaggcggggccagagagggguggggagguacagaggggcggggacuggugaguggaggcgggaccaaagaggagagaagggcugagaagggcagggcccggggaacagagguggggccaaaggggaggaggcugagaggggccggcccuggggaacagagguggggccagagaggggagaaggcuaagugggguggggcaugggggacucagaguggagccccaaccuggggugaagccaaagcugauagagacggggccagcaggagcagaggcggaccugagaagggugggaaacuguagggccggcgucugggcugauccuucucuccacaucuccaugcagaggccuuaaggacauggaacuggacucgucuuccauugaaaagcgguuugccuuuggcuuccugcagcagcugcugcgcuggauggacauuucucaggaguucauugcccaccuggguacggagaaauaccccccgcuuaugcccgccccaccugcagacaccaguucugcagaccagacucaccuaggacaccuguucaugcacucaauccguccuccccuuaucugauguuuauugagcuucuacuaugugccagacacuguucuagaugcugggguacagcagugaagaugacaaaugaccccugcucuccugcaacuacuccuauguuggauucaggcaauuagcaucauaaauaacuaaaucguuuaguguuagaaggugaucaguguuaugggaagaagaaaacaauagagccagguagaggggauugggaguguggagccaguuguaauuuuauuuuauuucauuuuauuuuauuuuuauuuuuuauuuuauuuauuuauuuauuuuugagacagaguuucgaucuugcugcccaggcuggagugcaguggcacggucucggcucacugcaaccucugcuuucugguuucaagcgauucuccugccucagccuccugaguagcugggaccacaggcacgggcgccgccacacccagcuaauuuuuuguauuuuuuaguagagacgggguuucaccauguuggccaggauggucucgaucucucgaccucgugaucugccgccucggccucccaaagugcugggauuaaaggcgugagccaccgcacccggcuugccaguuguaauuuuaaauaggguguuccagaaagacuuugaugagaaugugauaucugaggcaagccaugaaggaggucagagaggagcuguguggaccucugggggcaucuguuccuugcaggcaaaggaacagcgagugcaaaggcccugagaggucccuggugugagugucaggaugcccuguagcugaagcagagucaucgagggggacggugagauaaacgaggucacagaggugacuggggcagaucaugcagggcuuugcaagcugugaugaggacuuugaccuuaccuggaaugagauggaguuggggguugggggcugagccgaggagggacgugauccauaauucugguguucacagggucccucuggcuugacugggguggggacaggagccgaaaagggugagaacugggcagauuucuggaucuauuuugaaggcugaggcugcuggggugccccccagugccucuuacaggccacuaagaauuacagcuaggcccuacaauccccuccaguuucccuuagagaccccccccagcauuccccuugagagcuacccucaggaacccccaaauucccuccaggugaguggcagagcaggauucgcugucacgucucaccucaaagccugccugcugagcuucagugcugcacaucccccugacaauucccuucccucucuagaccucaguuuccucaccugugauaugggcauauguucaccauaacuagccaugguucuguuacuuacugggugaccugggguuaguuacuucaccugaguuuccucaucugaaaaauggggguugggaaccaacugcacagaccuccaaguuguaaggagacugugugaggaugacaugucucacagugccaaggacauagcaaguguuuaauaauuggagccaguauuauuauuauuauuauuauuuuuuuuuuuuuuuuuuuugagacggagucuugcucugucacccagguuggacugcaguggcgcgaucucagcucacugcaggcuccgccuccagauucacgccauucuccugccucagccucccgaguagcugggacuacaggcgccugccaccaugcccgguuaauuuuuuguguuuguauuuuuaguagagaugggguuucaccauguuggccaggauggucucgaucuccugaccucgugauccacccgccucggcuucccaaagugcugggauuacaggcgugagccacugcgcccggcccaguauuauuauuuuaauaguaucaguuaugacugucaccauuauuauuguuugaaauuuauuuccauuuugaaauuaacucuaauuuguuuacauugacuucuuguuucauuugguucauucauucauuuauugcagauuaacucagugccauguauucaaguuuagaaugaaaagcacuuauggugggugaggaagggcauguuccaugaccuuaacccauuccaguuuguuuuccccauugucagcuucagaaaggguuugaucaaggaguugucagcuucaagaaggauuugaucaagaaguugggggaaagcacauugggagguugaggcggguggaucaccugaggucagaaguuugagaccagccuggacaacauggugaaaccuuggcuguacuaaaaauacaaaaauuagcuuggugugugggagcaugucuguaaucccagcuacuugggaggcugagucaggagaaucgcuugaacucaggaggcagagagugcagugagccgagaucgugccauugcacuccugucugggugacaagaaaaaaaaaaggaguugggggaaucagaugaaagauaggagaaagguuuaucucaaagccaacacaaaugacuucauaccaauacuuuaucccccaucauuucccaacucugcucccagcauccuucccaucagaacacccuggguuccccagccuugaacccacugugaacccuauuugcccucccuacagaggcuguggucagcagugggcgaguggaaaaguccccacaugaacaggagauuaaauucuuugccaaggugagaggugggcuuagaagcuggagggcgcuggggacucauaggcucuccccaccccucauuggacccuuuaucucccccaacccgucuccagauccugcucccuuugaucaaccaguacuucaccaaccacugccucuauuucuuguccacuccggcuaaagugcugggcagcgguggccacgccucuaacaaggagaaggaaaugaucaccaggugggccgccugugacccuggacccagcccccugaccucacaggauuguaauccuuugcccauggaggcucuguccugggugcuggguguuggguacugaccgucuccugcaaaggcgauugaagggugaccagccauccuaguguacccgggacugaaggguuucccaggaugugggacucucaggcaacuugggacaaaucgaucacccuguccaggaaggccaacucaaggccgggcgugguggcucaugccuguaauuccaacacuuugggaagcugaggugggaagaucacuugaagccaggaguuugaggccagccugggcaacauacugagaccccauuucuacaaaaaauacaaaaauuagccgggcuugguggugcaugccuguagucccagcuacucaggaggcugaggcgggaggaucacuugaacccaggaguuggaggcugcagggagcugggaucgugccacuguacuccagccugggugacagagcaagacccugucuaaaaaaaauaaacaaacaaagaauaauaagaaaggcugacucaccccucaccuccccagcaucccaguuacugccugugacauuccagcuugcccaucucucugccccuucccaucccuccugucuccaucauuuggacccccuccugguuccucucuccuugucuucucugucccugucuccucuaauugggucacgcuguccucgucuccuuggccuccucacucgcuguuucuccugccuucugucccuuucucuuucuucagccucuucugcaaacuugcugcucucguccgccaccgagucucucucuuugguaaguggcuccacaccuucggucuuccucccuaaucuuucucuuccccacccugaagaaauagcucccagguucugccuuaauuugaacaaccuuuguuguuuucuuccccuggaccuggagacauggaccagguauccgggggguagggcagugacugagaugcccugggccugcccucaauggagcucccaggccagugggagagacagaccuaucuccagacaaggacagcccaguggggucagggcugggcaggaggaaggccaggagagugguugggcuggggaggagggacauuuggaggcgcuguaggagucugggggggugggggugcaguagcauuccaacuuagcccgcagguagccucaggaagagagcgguugggguggauguagagggaggcacuguccucuguccucuuagccauggcauccccccggcccaucuuccucucccagggacagacgccccagcuguggucaacugucuucacauccuggcccgcucccuggaugccagguagggccauaggcaguggcgcccacucccaccaucaucgggcccccaccccaaccccuggucuccuagacucuccgauuccagagcugauguucccccgcugcccuucuaggacagugaugaagucaggcccugagaucgugaaggcuggccuccgcuccuucuucgagagugccucggaggacaucgagaagaugguggagaaccugcggcugggcaaggugucgcaggcgcgcacccaggugaaaggcgugggccagaaccucaccuacaccacuguggcacugcugccgguccucaccacccucuuccagcacaucgcccagcaccaguucggagaugacgucauccguaagggcgccugacccaagggcagguugcggggagucaguguggccaacaccacccauccgggugccugugagagucccuggguguuugaauguguggauuucuugcuguaagcaaagcaugcagucaguaccuuggcagguggcaaaugaguuaaugaggacgcgagcucagcagcucuaacaaaagacccuaaguggacuggcgcagugacucacaccuguaauuccagcacuuugggaggcugaggcaggaggaccgcuugagcucaggaguucaagaccagcuugggcaacauagcgagacccugucucuacuaaaaaaaaaaagaaaaauuuaaagauuagccaggcauggaggcacaugccuguaaucccagcuacuggggaggcugacaagggaggaucacuugaguccaagaguuggaggcugcaaugagcuaugaucauaccacugcacuccagccuggacaacagagcaaaauucugucucuaaaauaaauaaauaauaaaauaggguccuugauguuaaaaaagagagucuauugauaaagguuaggaaaaguagcacuuggccgagcgcaguggcucacgccuguaaucccagcacuuugggaggccaaggcggacagaucaccugagcucaggaguucaagaccagccuggccaacaugaugaaaccuugucucuacuaaaauacaaaaauuagccgggcauggugguggucgccuauaauccuagcuaccugggaggcugaggcaggagaauugcuugaacccaggaggcgaagguugcagugcaccaagaucgugccauugcacgccagccugggcaacagagcgagacuccaucucaaaaagaaaagaaaaguagcaguugguggccagccacagugacucauaucuguaauuccagcacuuugggaggccaagguaggaagaucucuugagcccaggauuucaagaccaaccugggcaacauagcaaaaccccaucuuaaaaaaaagaagaaaagaaaaguagcaccuggauaggguucuucucccauccaacuuuguauuuugaaauuuucaaaacauacaggaagguagaaagaagaaaauuguuggcggggcaugguggcucacgccuguagucccagcuacuugggaggcugaggcacaagaacugcuugaaucugggagguggagguugcagugagcugagauugcaccacugcacuccagcuugggcgacagagcaagacuccaucucaaaaaaaaaaaaagaaaauuguuaacaauuugcccugugugccuacccuucacuguaugguugaaaguauuuaguuuuuuuuguugaacuuuuggguguaaguugcacacaccaggguaaccucaucccuuaauguucaucagcuggcuuuccuagaauaggaaccuucucuuguguaaccacgguaucauuaucauaccuaaccuaaccauauuuaaauuucccucauuacccacaaaaugucuuugauuuuuuuaaaagaaauucagaauccagucaaguuucuccugcugcauuuggugguugugucucuguagugucuuuaaagucuagaauagccccgcccucuuuuugccucaugaugagcuucuuaacuuggccuucuggagggcaugugguuaaccuaaaauuggucugggcacaguggcucgcaccuguaaucccagcacuuugggaggccgaggugggcaaaucacuugagaccaggaguuugagaucagccugggcaacauacugagaccccaucucuaaaaaaauuuuuuuuuaauuuuuuuuuuuuuuuugagacagagucucggucugucacccaggcuggagugcaguggcgcaaucucagcucacugcaaccucugccucccggguucaagugauucuccugccucagccccccgaguagcugggauuacaggcauucaccaacacacucagauaauuuuuguauuuuuaguagagaugggguuucaccauguugcccaggcuggucucgaacuccugaccucaggugauccguccaccucagccuccaaagugcugggauuacaggcaugagccucugcgccaacccuaaaaauauauacauuuuaaauaaaaugaaaaagauagccuaaaauugcagcaauauugcaguucuguuugcauuuuucuggaggaaguaccccucacuuucauuauagagggccaugaguccucuccacggaagaaacaacaucuagccuuuauugagugccuacugugugccccguucuaguggcuuuccaaguaguaacucauuugauacucacgaccaccccgugaggaagguacuauaacuauccccauguuacagguagggaagcugaggcugagagagaguugguaacuugcucaagucacaagacucguacauggaaggcuggcuguacaucugcuugcucuuccccacugcaugggccuauuugagacaagggaggugggguggggagggcuugucuugugagcgcaugccgcagccucgcccccugucucccucaguggacgacguccaggucucuugcuaccgaacgcugugcaguaucuacucccugggaaccaccaagaacacuuauguggaaaaguaaggagagggagccaucguuuggggcuggguggggcuggaggggaagggagggagcaggggaagaagauggggugggugaaaagcaggguagauguuaagaauuuucccgcacacggcggcagccgcgguuccccacggcggccgcgugagggcgcucagggacaggucagccacggagguagagccgccaggucuggggcugugaagcaggcaggccucgcuggggaagaaagggaggcgcagaccacgggggcugcacacaggagccacgcaacacuggggucacuggggagggccccuggcaguggccaugugaccgcuucugagcugagauuacugauacagcaagagcgaggcugcggcuguuuccaccagcucugaaguuauucagauuucaagugacaccagcggugcgcgguggcucacaccugugagcacuuugggaggcugaggcgggaagaucacuugagcucaggaguuugagaccagccugggcaacauagugagacuccaucucuacaaaaaaaaauuuuuuuuaauuagccugguguggugugguguaguggcgcuggugccuguaaauccaccuacuccuaaggcugagauggggggaucgcuugagcuccagccugagcagcauagggagacugcaucucuacaaaaacgacuuuuuuuaaaacuagcuaggcaugguauggugugugccuguaaucccagcgacucaggaggcugaggugggaggaucacuugaacccaggaaugugagguugcugugagccaagaucaggccacugcacugcagccugaguaacagagcgagacccugucuuaaaaaacaaaacaaguggcacacauggaugaauggcagcucugucccaaaggguucugggaggagccguuucuauggagauggggcugggacccaggaccccaaagagggggacacguggcagcuaaacacagccccgucuuccaggcuucggccagcccucggggagugccuggcccgucuggcagcagccaugccgguggcguuccuggagccgcagcugaacgaguacaacgccugcuccguguacaccaccaagucuccgcgggagcgggccaguaagcuguguggggcgggagcagugcugggaguccaaaucuccccagcacagggccuuggggagacccuaauuuggggguaguguggcugggcugggcugugagcggcugaggauuccccagguugggagugccacacauucaggaaccccagaguuuaugguucgggggcauuucaaggccguuacauggggagaauuuagagauuaauuugauuuuugaaaacagaaucuauugauaaaaguuaagaaaaguagcacuugguggccaggcgcagugggucacgccuguaaucccaguacuuugggaggccaagguaggaggauugcuugaguccaggaguucaagaccaaccugggcaacauagcaaaaccccauccauggaauuuggagcuauggaauuuauuuuagugauggugacauuugagggcaucaucaagcuuggagacauagggugagggguauuugagcauaagaggauugagggaaggcaggguucauucauucauucagcaaauauguaucgagcaguuacuauguaugaggcgcuguccuagucaccugagguucagcagugaacagauaaaacagacaaaaauccccugaguccuggguccagaggcuagaaugagguguggaccugggggaaauauacgcuccaaggcaggaaacuugucuucuuggucagcuguucucccagaauggcaccuggcccagagucagcaagugagcaagugacagguugucgguuucaagggacugaaccgggugugggauucagagagacaaggcggggagacagggugggguuggaaaaggucucuuuuggaguaugcuguacagcaggggugaggggaaugggcuugggaugugggagauuuuaggagggaagguuucuaggggugagauuuuagggagcagacaggcucgggggugugaaguguuugcggggccacugaguuucaaugugaggguugggagagguaguuggguuggagggugagaugggaagaauaggguuugggagacuguuuaagggggguggcaauucaauggugucugauguauugcgggggaggccagggcacugaggucugggggugauggcuugacauucccugcccccgucccuguaccccaguccuggggcuccccaacaguguggaggagaugugucccgacaucccggugcuggagcggcucauggcagacauuggggggcuggccgagucaggugcccgcuacacagagaugccgcaugucaucgagaucacgcugcccaugcuaugcagcuaccugccccgauggugggagcgcgggcccgaggcacccccuuccgcccugcccgccggcgcccccccacccugcacagcugucaccucugaccaccucaacucccugcuggggaauauccugagaaucaucgucaacaaccugggcauugacgaggccuccuggaugaagcggcuggcuggugggucggggggcacugggccucugaggggugggucagcagccugggcucccuuggcagauggucugaaagggagacccaugguccccucggaguugggaggagucagaguguagguuuuuucagcaucaaaagaccaggggucagcugggcaccguggcucacagcuguaacaccaacacuuugggaggaucaguugaggccagccauuugcgaccagccuagguaacauagcacgaccccaucucuuuaaaaaacaaaacaaaacuuuuuuuuaauuagccaggugugguggcacaugcuuauagucccagcuacuugggaggcugaggcaggaggaucucuugagcccaggaguuggaggcugcagugagcugugauugcaccacuguacuccagccugggugacagagugagauacucucucaaaacaaacaaacaaaacaaaaggaaagaaagaaggaaggauggagugagagagggagggaauaaaagggaaggaaagaaggaaggaaggcaggaaggaaggaaggaagaaauggauccucaaagcguuagguuuccugauucagaaguuucaugucagggccaggcacaauggcucaugccuguaaucccagcacuuugagaggccaagguggguggaucacuugagaccaggaguucaagacuagccugggcaacauggugaaaccucgucucuauuauuuaaaaaaaaaaaaaaaaaaaaaagaaauauuuguguaaggaaacagguuguagaucagggucaaccuagaaaucaggagcugggaucagaggccaggguaaggggccagaggcugggguaagaagcccauucacaaccuuggggucauagccagaaaucacauagugagguaagacucuggguaugggccaggucagagguuaaagauuggggucaggggucaugcuaguuaagggugagguaacaggccaggugcaguggcucacgccuguaaucccagcacuaugggaggccgaggcggguggaucuccugaggucaggaguucgagaccagccuggccaacauggugaaaccccaucucuaccaaaaauacaaaaguuagcugggugugguggcagacgccuguaaucccagcuacucggggcugaggcaggaaaaucgcuugaacucgggaggcagagguugcagugagccaagauugcgccauugcacuccagucugggugacaagagugaaacucugucucaaaaaaaaaaaaaaaguuagguaacaggugaggcgucuguuguugggggucagaggucagggauuugugccaggcuggggucacaggauagggacugggucuuagguucagguuaggggcuauggcugggaucaguguucagggacuauauccaagguuagggucaggcuggggucaaauggcagcugcuagguuggagaugcuguuugggagucgggcugggaacggaguuuggggccugugucagaggccggagguggcaucagagcccaucgcaccccugcaguguucgcacagcccauugugagccgugcacggccggagcuccugcagucccacuucaucccaacuaucgggcggcugcgcaagagggcagggaaggugguguccgaggaggagcagcugcgccuggaggccaaggcggaggcccaggagggcgagcugcuggugcgggacgaguucucugugcucugccgggaccucuacgcccuguauccgcugcucauccgcuacguggacaacaacaggucagcggggccccgcuguccccaugcccuccgccccgaccucccacguccuccagccccaucugaucuccgccuccugacuggcuagaaacuucuuccaaugcucuggccccaccaaccuucugacucuuccuccugguuucuucuggcuuugagcacauugguccaacgacagccagcccacuuguuuguuucuuuuuguuuuugguuuuuggguuuuuuuuuguuuguuuuuguuuuuggagacagagccucgcuuuauugcccaggcuggaaugcaguggcgcgaucucggcucacuguaaccuccaccucccggguucaagugauucuccugccucagccuucccaguagcuaggauuacaggugcaugccaccacgcccagcuaaguuucguauuuuuaguagagacagauuuucaccauguuggccaggcuggucuugaacucuugaccucaugauuugccugccucggccucccaaagugcugggauuacagcugugagccaaugcagcuggccagugugauuuuuuuuaaaucauucuccuaaugcuggacauuuagauugugucgauuucuuugucacuaugcacaacaccguaaggaauaguuugcuuuuuuuuuuuuuuuuuuuauugagacagggucucucucuguugcccaggcuggagugcuguggcaugaucauggcuugcugcagccucgguuccuggguucaagcgauccucugcuucugccccugaguagcugggauuauagacucacaccaacaugcucggcuaauucuuguauuuuuauggggucucacuauguugcccagguuggucuugaauucccggggucaagugauccucccaccucagccucccaaaguguugggauuacagaagugagccaccacacuuagcugcuuuuuuuuuuuuuuuaacacaacaauacaccaugaaagacauauaggccgggugugguggcucaugccuguaaucccagcacuuugggaggccgaggugggcagaucaccugaggucagguguuugagaccagccuggccaacguggcgaaacccugucucuauuaugaauacaaaaauuagccaggcguagugacgcaggcuugaaaucccagcuacuccagaggcugaagcaggagaaucgccugagccugggaggcagagguugcacugagcugagaucgugucacugcacuccagccuaggaacagagcgaggcuccaccucaaaaaaaaaaaaaaaaaaaaaaaaaagauguauagauucaccucuuuugucuugguggucgugugacauucucugcuguuggauauaguucaauuuuucaaucaguaaauaugaacaaauugugguuuauucauacaacagaagacuccacggcagugggagugaacaaguuguuucuaugcacaaugugauuggcuuucacaaauguuagguggaaugaaagaagccagaaaaccaagaaauaaacuacauauuuuaccaucuguuuaauguucacgagcagauaagaauaaguuuggggccgggugcaguggcuuacaacuguaaucccagcacuuugagagacugaggcgggaggaucacuugagcucaggaauuugagaccagccuaggcaacauggcuagacccugucucuacaaaaaaagaaaagaaauacaaaaauuagucaggcauggugacacacaccuguaguccuugccucaggcugggacugggaggcugaggugggaggaucguuugagcccaggaggucaaagcugcagugagcuaugaucacaccgcugcacuccaaccugggcaacagagauagacccugucucaauaagguuuguuuuuuuuuaauacaaguaaaugaauaaaauaaaauaugugaaccuacuuagauucugacccugucucaaaaaaaaaagaaauuuuaugcugggugcaguggcucgugacuguaaucccagcacuuuggguggccaaagagaguggaucacucaaacucagucucaaacucagaaguuugagaccagccugggcaacaugcaaaaacccugucucuacugaaaauacaaaaauuagccgggcgugguggcgcauaccuguagucccagcuaaguacuccugagugggaggcugaggcaggagaaucacuuggaaccugggaggcagaaguugcagugagcugagaucacaccacugcacuccagccugggcgacagagcgagacccugucucaaaaaagaaaaaaagaaaauuuuuuuuuuuuuuuuugagauggagucucgcccaggcuggggugcaguggugcgaucucugcucacugcaagcuccaccucccggguucacgccauucuccugccucagccuccugaguagcugggaccacaggugccugccaccacacccggcuaauuuuuuuguauuuuuuaguagagaugagguuucaccguguuagccaggauggucucgaucuccugaccucgugaucugcccgccucggccucccaaagugcugggauuacaggcaugagccacugcgcccagcugaaagaaaaaauuuuaaaaaguuuuuagccuagaaguuagaauauggaugauuuuucaggaggaggaagggggaguggcugggaggggccaugauaguacuuccagggaccagaaauguccuauuucuugacuucggugcuggcuacacaaguguguucauuugugauaauucaccagguugauauuucuuaauauguagguuauauaauacauauguauguaucaugugugucuauguauugcaugcauguauuauauuuauguauuucgaugaaaagguuagacaaaguuuuuuaaaaaaggaauagucaggccagggaagguggcucacaccuguaaucccagcacuuugagaggucagggaaagaggaucucuugagcccaggaguucaagaccagccuggacaaccuagggagacccucuuccuacaaaaaauaaaauaaaacauuagccaggccugggcauggugacgugcaccuguagucccagcuacucagggaggcugaagugggaggaucacuuaagccugggagguugagguugcagugaguggagaucgcaucacuguacuccagccugacagauugagacccugucucagaaagaaagaaagagagagagagagagagaauggaucguuaaaaaauuuuaaauguucagcugggcacaguggcuuacaccuguaaucccagcacuuugggaggccgagguggguggaucacguaaggucaagaguucaagaccagcgugcccaacauggugaaaccccgucucuacuaaaaauacaaaaauuagcccgguguggugucgggccccuguagucccagcuacucgggaggcugagacagagaaaaaaaauuuuuuuaauguucaucugcauggccagaugacccuagaaaccccaucccucugacuggaugucuccugguccccaucuccuccuccaagaucucucucugggcagcccccuucccugggauccccacccccucccucaccuccccuccgcugaccccagggcgcaguggcugacggagccgaaucccagcgcggaggagcuguucaggauggugggcgagaucuucaucuacugguccaagucccacgugagugcccaccccaaccgcccuccccacaaccagaggagccgcagcccacaggcgccugccuucaccuguccggucugcaacacugcuucccccaccagaacuucaagcgcgaggagcagaacuuugugguccagaaugagaucaacaacauguccuuccugacugcugacaacaaaagcaaaauggcuaaggucggggcuugguucugggaggagcacuuggcagagagggcgggagcacccucuaggacuuccuaccuggccuguccucacccagccagcccguccugggcgcaaucccugcaguccucagagcagccccucuuaccuccucucccucucccuuccuccccagcuccuuccuccuccuguaucuucucccuccucccaucucccuccuccucuccaucucccucuucucucaucucugucuccuuccuccuccuguaucuucucccuccucccauuucccuccucuccauuuuccucuucuccaagccucucucuccucccauuucccuccuccuccuccuccccauuuucccccucuuccauuucuuucuuccucuccccauuaccccauuuccugcuuuccucccuauccuucucagcacugcccuucucaggucucagagaacgaccccccaccccgagccaaggccuggaaaugcccagcuagagaauacauggcggguggggcagaggagguggggugcuggcaacuuggaguugggccugggcuucucugcggggcugggguaacccuucuugucucugucugcgguccggugaagcaggcgggagauauacaggucagccccacaucugggaccuuccgcaugucucuuggcuaaugcccucuucccccagccucugcacgcccccgccucgagaaaaccccugcuucuguuccccacccccguccuccccucccagcccccacccauccuccuucccuucccuucccuccccaccacccccauccguucccaucccaacccucagcuuuuggcaauuugacuucuuuucuuuuucuucuuuccuuuuuuuuuucuggacuuuuguucccaaaaaaaaaaaaaaaaagaaaaaaagagcaacucucagcuuuuaccaaagcaucgugggcugaggucaaggguaaugggggugggagaggcacacggagcaugguuggggagggggcagcacccucgccguggaugguuuaaagcuugggcucuggacuguauggacugggguuagaauccugucuugauaguuagccgugugaccuugguuggggucauccuuuugagccucugagggcauccagccagcagcccccaccccagggcucugcgaggacucagggagaagcugcauguguggccugcagcagugccuggcacaggggucaugcucaaaguugccagccggcguggauguggcucugcccaaaagcuugucaucagggcuucucgcuggcgugacugggguggcccuggccccgggucugcacccaaggcuccagaacacggcugugggacucugugcccugugucucugcuuccagaucuuucuggaugucucuugcaucuuuggucuuccugucuccuugucuuuuucagucucucagugucuuuuucuugcaacuucucuugucgcuugaacucuuuguggaccugcaucuuuguuucauucuugagaacuugguuuugggaugugaagugugggguugugcaugcuguggaggggguauuguacugggguuccuaggggauucuggaagaggacugcuagaaguugagacaggcccagaacgggggaaaaucuggaugggccuggguuagaaauuggagccaggcaagcauggugguaugugccuguagucccagcuacuugggaggcugaggcaggaggaucacuugaagccaagaguucaaguccagccugggcaacauggcaagacaccaucucuaaaaauaaauuuguuuaaaaaacaagaaacugggaauuuggguuguggacuugggucuggagggucuccggucauggcugugggccugaaguguagagucagcaagucugggguggaaauugaggugucgucggcaguuggggagggagugccugguguccagacuggggccugggguguggaugauggccgcggguuggggcugaggcaugggauuggggcuugggcuggugcugagcccuguguccccacaguccgguggcucggaccaggaacgcaccaagaagaagcgccggggggaccgguacucugugcagacgucacugaucguggccacacugaagaagaugcugcccaucggccugaauaugugugcgcccaccgaccaagaccucaucacgcuggccaagacccguuacgcccuggugccugcccagccccguccucggaaccuuccaggaugccgcccagcacccacugaaccccugggaccuuagggaacaaccacaaugccacugagccccccaggucccugggagccuucccuucagaccccacugaguucuuuuccgggaugcugaggacucacugugccccugggaugcccugaggaccccguucaagauauugccagggcaccacagaccuaagagcccucacugaaaccuagaaaagcucuaggaccccugggacccgcaugaggacugcaggaccccacugcccccccaccggaccaugccaaaccugcugagacccugagaguccccccaacaagaugagccccugagauccucugaacccuccaccaaggccccuucaagccccuugggaccuacugagacccucaugaccccuccuucccucccugccaagacugaaccucuggguuccugcugagcccuuggcucaccaucccuuuccuucaggacccugcugacaccugggcccuguugaagcccaacuaagcccccaagacucucaggggcucagggagcccugcgacccugcauaacuccccaggauccaugaaccccaagcccgggacuguacccaaaccucugaggucucaacuguccuggagaccaaaauacccgggcuguagaaccucuuaagcuugcugggauaucaaggaggccucccgggaccccacuuaccccuugugugggacaacaaggacaaucucccuccucuccgauccuuuccagcuucagggacucuaaggaacccucccaggauucugccccaagaccccuauagcccuccccccaggaccacaccaacacccugacaaccuacuaacccccuggaccccuaaagaccaccgacuucuccccugcuaccaccaggacaccccuucccucagaaccucaggcaccucccaggacugcugaguccugccaggacgccagagagcccuccagggcuccauggaccccucaccuugguccuugagggcuccccguccuagaaccccagugaacccccacccugcugaugcccccuuuggccccuguguaaccagugacuccguugaccuacgugaucccccaugaccucugcugaccccuucugaucuucaaagacucccugccccacucugaccccccagucaucccucuuuggccauauuugaccuuugaugagauccucuugucacccuuugccucuucccagaccuccacgaggccccucgaauccuuacuguaucuucaaggugacucugugacccuccggccccucuaggaccccuucugaccccgucaaccucugcauccuuuuguuucucucagacccccacccccaccccagaaaaaccucuucaguuccuggggugcugggccuggaaggaaaggguugugggucaggaaggaggaugggaccuccagagugacccagccuggcucugucuccccagaaagacacagaugaggagguccgggaauuucugcacaacaaccuucaccuucagggaaagguaugccuccuuccucugcaagcaaaagaagcaagucagaaaguaaccacaauauuagugaagguuugagcauuuaccaaagaccaggcauugaagaaagaccucaaaggucaggaguuugagaccagccuggccaauguggcgaaaccauguuucuacuaaaaauacaacaauuaggccgggcacaauggcucaugccuguaaucccaacacuuuggaaggccaaggcgggcagaucaccugagguuaggaguucgagaccagccuggccaacguggugaaaccccgucucuacuaaaaguacaaaauuagcugggugugauggcgggugccuguagucccggcuacucaggaggcugaagcaggagaaucgcuugagcccaggaggcagagguugcagugagcugagaucgcaccacugcacuccagccugggugauggggcgaggcuccgucucaaaacaaaaagaugaagaagaagaaaggccucaacaugcacucacccauugaguccucccaaaaacggaaaggggacauccggcggacacugugggaagggucccucacgccggccacuccuucuuccucccuucaggucgaaggcuccccgucucugcgcuggcagauggcucuguaccggggcgucccgggucgcgaggaggacgccgaugaccccgagaaaaucgugcgcagaguccaggaagugucagccgugcucuacuaccuggaccagguggguggggccggaggggucuuucuacugggucucugggcggagccuggcggggggaggggcuucaaggauguggguggggucuggagaugacuauuaaguuuuggggcagggcaggagguggagccucgaguuuaaggcgaggcuuagaauggaucgggggaggggucugcugcuuaaucuugcaucugggggcgggacagggaaggggcagaucuuuaggucuagggguggggccuagaggagaugcguugaguuugugggcagggccuugggugggucguagaauuggucguggccuggcucgugguccuggcucugugggaccuggccuaggauggaaacuuaggucuggaggcggagucaggacccugacucuguugguggagacaagguuuuccuucugccgugugagucuuaaccugaauauggacuucgacacagcugggcaguuucauccagggcugggagugagaggggcagggucuggggaugugacuguccugcuauccccuccccagaccgagcacccuuacaagucuaagaaggccguguggcacaagcuuuuguccaaacagcgccggcgggcagucguggccuguuuccguaugacgccccuguacaaccugcccacguaaggcccccagggacaagggaagcgugaagggcugcggagaaaggguggcuggagagucuggagaauggagggccaacgugauggggccuugagggugguugggggcugcaggcgcaugggaggucgggaagcacggaggagggcgcgucccagugacgucacaccucuccccugcaggcaccgggcauguaacauguuccuggagagcuacaaggcugcauggauccugacugaagaccacaguuuugaggaccgcaugauagaugaccuuucagugagcugggacccgccugggggaguggggggcgagcuggauagggcuggggcggaggccacccuuggcacaccuccaggggucggcccuccacaucaagggguauagaaaugccagcuccuggcuugaguagaaccaaaguagggcgcaggaugugggaaaagagaaaaaaaaauccagaccaacagggacaugggggcagugacaggaggggacucuagaaacccucuccccaagucuccccucucccaccagaaagcuggggagcaggaggaggaggaggaagagguggaagagaagaagccagacccccugcaccaguugguccugcacuucagccgcacugcccugacggaaaagaggugaagacucuugccagggccccagaaaugcccccaagguccuggggccacccccagcccagcagcuucccugugccucaggagaggcccuccagguccugggggagcccaagacagacggaucuuuaaauaucacuuugcuggucaggcacgguggcucacgccuguagucccagcaaucugggaggcugaggcaggcaaucacuugagcccaggaguucaagaccagccuggccaauauggcaaaaccccguuucuacaaaaauacaauaaauagccaggcuugguggugggcacuuguaaucccaucuacucaggaggcugaggcggaagaaucgcuugaaccugggaggcggagguugcagugagccgagaucauaccacugcacuccagccugggcgacagagcgagacucugucucaaaaagaaaagaaaaggaacguaaaugucacuuugcuaggacaggcacagccaacauacaccguugcauggcugaacacuucacaagggcaugucugagggguucguaucacagacaauguagauuaacuaggcuuuucuagaagaaagugucuugcucaaauaaaaucaguauauuaugaaaaaaauccauauguaugacaaauuuccaacagacagaaguaguggggagguuuucuguaauucccucaaaagcuucauguaggcuaaugacaggcuuaguaauaaauaauugugaugcagauggcgcagcugcugccgcugcugcugacaguagcaggcagccauucaucaaaugcuuauuaugugucaggcaccaagcuaagcggggauaucuauauccucucacuuaaccgccacacugugagacggauuauugcaucuccuuuguguggauaagggaaugaaggcacagggauuuauuuuucauuuuguuuauuuauuuauuuauuuauuuuugagauggagucucgcucugucacccaggcuggagugcaguggcacaaucucagcucacugcaaccuccgccucccagguucaagcaagugggauuacaggcgcccaccacuacgcccagcuaauuuuuguauuuuuaguagagacgggcuuucaccauguuggccaugcuugucucaaacuccugaccucaagugaucuucccgccuuggccucucaaagugcugggacuacaggcgugagccacugcaccuggccuacuuuuuuauuuuuugagaagaucuugcucuucuugcccaggcuggaaugcagugucauaucauagcucauugcagcucagaccccccacuccacaucaccccaggcucaagagauccuccugccucaaccuccugaguagcugggacuacaggcacgugccuccaugccuggcuauuuuuuuuuuuuuuuucugguagagaugggggucucacuauguugcccaggccggucucaaacuccugaacucaagcaauccuccccacucagccucccaaaguguugggauuacaggcaugagccaccgcgccugucagggauuuguuuuucuuacauaacgugaagucaagagcuaaagacuucaggacugggcaguggcacagggacacugacaggggcccagggucuuucuagcuuucugcucugcccuucuuagcuuuugucuguaguccuggguggaugcugcacuucuaggcaucacagccacaugccaggcagaaagaaggacaaaggguccccacucuucacccucagcaagaucuuuggucucucucucuuuuuuuuuugagacggaguuuugcucuuguugcccaggcuggagugcaauggcgcaaucucggcucgcugcaaucuccaccucccggguucaagcgauucuccugccucagccuuccgaguagcugggauuacaggugcaugccaccaugcccagcuauuuuucuuuuuucuuucucuuuuuuuuuuuuuuuuuuguauuuuuaguagagacaggguuucgccauguuguccaggcuggucucaaacuccugaccucaggugaucugcccaccuuagccucccaaagugcugggauuacaggcacgagccaccgcgcccagccuucuuuggucucuuuaucucucuggugagcuuccacacagaucucauuggccagaaauucugacauaaggccaucucgggcugcaaggugaugaagaauuugagcaucccauuuugcauccugugggagagcgauggcucuggaguuuggccauccaaguugagucccagcgcaagcugugugaucccagccgagaagggucuuuguaucuuaguucccccaccgauaaaauagggcuauuaacauacccacccaauuggaugacugugagggucaguuuguuaauauauacaaggcaccuagaacaggcacugacaugguguuaguguaaacacucagcagguguuggccauuguagaggagacccaagcagaaagggauuggccauacuuguuauugagcugacagguggcaagauggcucugggagcuccagccuuccaucacuccauuuuagcauccccaguggaaagggagugccuccaccauuagcuccagcaaaccucacugaaugggccaggcgcgguggcucacaccuguaauuccaguacuuugggaggccaggaguuugagaccagccugggcaacauagcaagacccugucucuacaaaaaaauggaaaaauuagccagguguguugguaugugccuguagucccaacuacucaggaggcugaugugggagaucacuugagccugggagguugaggcugcaguaagccuugauggcaccacugcacuccagcuuggccaacagagcaagacccugucucaagaacaaaauaaacaaacaaaacaacucccagaauggauuuuacuggacagcauggacaacaugaccauuucuuaccugucaucauggccacacagauaaaaguccucaucggccaugcauuugucacaagccacccuggcaauggccacuccagccaccugagucacacagccugaacauggggaggguuggcccuccaaagaaaaccagaagcucuuuuuuuuuuuuuuuuugagauggagucuugcucugucacccaggcuggaguacgguggcgcaaugucagcucacugcaaccucugccucccggguucaagcaauucuccugccucagccucccgaguagcugggauuacaggcaagcaccaucacacccggcuaauuuuuuguacuuuuaguagagacgggguuucaccauguuggcuagguugguuucagacuccugaucucaagugaucugccugccucagccucccagaguguugggauuacaggcaugagccaccgcacccugcccagaagcucuuauaagauggggguccucuccaccggguccugaccacuccccugcuuacuuccccagcaaacuggaugaggauuaccuguacauggccuaugcugauaucauggcaaaggugaggcccuaccccccucuucuggggcagauuucccucuccccaccugcagugcuuguccacaaaaagggcuggggcgggauggaggggucugcuuuguucaucccuuaacugaugcccccuccccagagcugccaccuggaggagggaggggagaacggugaagcugaagaggagguugaggucuccuuugagguaggugggcucaggagguccuggagggaagggaugggggacccugacugcagucaucucccauucauucagcauguguucacagagcaaagcucuggggacacagcagugaccaagucaguccacuggggagacagauacacccgccaaacuaacaccacggaguguacaccauggucaugggggaagcucaggcagaggggucagggcuggaauuggggaggcucaggcagaggggucagggcugggauugaggaggcucaggcagaggggucaggguugggaugauggggauacaggcagaggggucagggccaagaugggggaaccucagggggauaaagcagcccaaacaaggugccugacccagccugcaggaaaauguaucagggagggcuucucggaggaggggacuucugagcagaaggauaaaaggagccugccaguugaagaaaaagagaaaaauguucuacguagggagaauaguauaugccaaggccaggcagcaagaaagagcuaguaaacaugcaauucaccgauccauucauucauugagacaguuagcaagcauuuacuucauaguuuucuucacuguuucugugccagagucccuucuggcaucuggugaagacuuucucaggaucauguuuuuaaauguauaaaaugaauucauagcagaggaaacaaguauugaauagcuaucaaaauauuuuaaaaaugaauuugugauccaguaauacuuguacauuguuaaucuaucaaauaagaucuaaggcugggcgcaguggcucacacuuguaauuccagcacuuugggaggccaaggcggguggaucaccugaggccaggaguucaagaccagccuggccaacauggugaaaccccaucucuacuaaaaauacaaaaaugagcugggcaugguggcaggcaccuguaaucccagcuacucaggagguugaggcaggagaaucgcuugaacccgcgagguggaaguugcagugagccgagaucacgccauugcacuccagccugggcgagacuccaucucaaaaaaaaaaaaaaaagaucuagcaguagauccaacagcuacuauaauugagaaguagugaugaacauaacugauauuuaaagacaucuuugagccauugugagugagucucucuuccuggaccaaaagagcagaauuugaauaggaaaugguucuaauucugcaacaauaaugugauauggaauauacagcaauaauaaugugauauggaaccaucuguaauuuuuuuuuuuuuuuuuuuugagacagagucucgcugugucgcccaggcuggauggagugcaguggcgugaucucagcucacugcaaccuccaccucccggguucaagcaauucuccugccucagccucccaaguagcuaggacuacaggcucaugccaccacgccuggcuaauuuuuuguauuuuuaguagaggcgggguuucacuguguuagccaggauagucuugaccucuugaccucgugaucucccugccucggccucccaaagugcugggauuacagaugugagccaccuugcccagccacaucugugauuuuuauuggugacaaagccacagguucugcuaauaucgcugugauuuauggcuucauccauauaggaaggaaaugcuucauuucuguuagagggcggaaaacauaaaaauguaacuuuucaucauccaaguucacagauggccuggaggcccaugggcccagguuaagacugcugcaugcccagcucugauuuauguagaucuugccuaaugccuagccccgugcuagguacaggagauacaucgagggugugagccccaggggauggagggagcucaugguugaaggagugaguuguggauguggcuggaacagggagggcagaagugagaaugugagggggaaaggcugggcuggaaagccuggacuugccuucaugugucugccucccuucccaggagaaacagauggagaagcagaggcucuuguaccagcaagcacggcugcacacccggggggcggccgagauggugcugcagaugaucagugccugcaaaggugccccucacaugugcacuggacucuuccgagugcacucauccuaaccucacuccuccuggcucgcccauucccuguggacccauuugccgccccucaaugccugugguuugcacgcacaccccagcccuugcagcuuccccuuguauaccugccuugcaauuucucacucauccuucaaucacgaucaccccugcaugcacaccuuggcacacucuuaaauccccuucucucacaucccuugggauggcuguuuucugguggguggaacacacugccuuccaacuggguggaccaucuuuuuucucccacucccuccaggagagacaggugccaugguguccuccacccugaagcugggcaucuccauccucaauggaggcaaugcugagguccagcagguaacagaggcaaagggacuucagaagaaggcaaggagggaugagagguuccugugugacucccaguuucuccuccccugccucgcccucugcagaaaaugcuggauuaucuuaaggacaagaaggaaguuggcuucuuccagaguauccaggcacugaugcaaacaugcagguagguucgaguggaccucuucuuguuaagcuguguuuggugccacugccaccccacuccugguaccauuuccaguucugauucugcucuuucaguccagggaaagagacucacucagaaucgcucaaauaacagggaauuuauuauaagaauuaauguagaacaauaagggaggcaaaaugucauagacuugaagaaugaguugcauuaugaauuccagacaguggaaccaaaaacuugagaauuuaaggggaacuuggcagugggagauuuaggagcucucugaugaucccaauuaaucugccucuacuguugucugccuuuauucaccucuugcugccggcugauuuuuccuacccucugcagcuuuugcuaaaugggugguuucugguuccucauuauuucagcuugcgcaugguucauccuggcccaaccauauguccuagcuucugccaacucuucauuucugcuuccucuugauuucagcgcauagaugguuuacuguggcucuccaggcuaccaugguggggagcugccaggcccugggagagaggagggcagaggcuucaucacauacccccuaucuuuccuuucuuuuccucagcguccuggaucucaaugccuuugagagacagaacaaggccgaggggcugggcauggugaaugaggauggcacuggugaggcccucccuugggcuucccacccccugagacaucuuccuuugggauuccucccaccccacccccacccgccauugcccagagcucccuuccuccaagacacugguucccaagggcucccucgggucccucccucugcuguggucccccagucccacccccuccaucccccuggggucucccuccccauguccaccacccaccuccgcccccccccgccaccagaagucauucugucuuguguucucacccaucacuacauggaccccacccuccacgugccccaaaugucacgcccugguugcuguucucuuauuaaugucccuaauccggguuaaucgcgucuccucuuugccguguugugacgugucuaaccuuucuacccggauccucgcuccugccuuucuaccucuaugucuucaucucucucucucccucuccauccucuucuuucauucccucugcuuuuacccucauuuccuacccucuucccugcuaauccauuuccuucugucuccuuaucacucugccuuucucucuguggguuguuccucucucucugugugucuuucugugucucugucccugacugucauuguguguguuugcggucugucucccucucuuuuucucucuuuucuccugcuuccuccucccauccuguuggcugccccagucaucaaucgccagaacgguaauucccccagcccacccccgugcugugcugcugucacccaccccuccuaaccccguccaccccuccaccuaggggcugaggaucugggacguggaggggagggagggacccuucagcaggugcacccugccagugcaaaaccuggagaucaggagucuggggagcaugauucaggucccagaucagccacugagaauacaugggccugugaacaagucucuuaccuucccuaagcuucacuuuccccaugugugaagcagaagcuagagaacaugguaaagaucucuuuccagcuggauauugucggacuuccagacccagauucgcagucccgguguggagugauccccacucccaccuacucugcucucugcaccccgaccucagauuggucagucagcguuucccauccaccaaccgaauugguugccuccggcauccacucugauuggugugcgccugccuccucugcgccugccuccucugugccugcucugguuggcccauuugcggucuagccuccuccccuaccgcccaccaugauuugcuucuuucagaugcccauucugauuggcccuuguuuacacgccuccccugugcuacuccuggauuggcugcuuucaaggcaucugggccaauuggcuggcuuucaauccccaucccuuaucccucccagcccaaucuuccccugcccagagccuuugugugaaggugacccaaacccccauaauccauuaaccuccacggucugaaggggggcugagggcauuaccagcugccugaaugucugcuaggucagcagacucucccgaacguaacacaaguggugacaucagagggcacugauguagaaagacacuugaggccccagcuucaugacucagggccccuugggucuccgucugcugaugucaugggcucugaggucaagaccgccuggcgucauggaugcccauggcccucacagugucuuuggaguggcagcugcuccucccagcacccccaugcuuugugcaugcgugugcagugugcaugggccuugugcaugugugcgcugugucuuggcgcaucugaccccuccugggcccuguccccucccuuccaccuaggagagaaggucauggcggaugaugaauucacacaagaccuguuccgauuccuacaauugcucugugaggggcacaauaauggugaggaggaggggugugggguggaggggaagccgagguuuggggcugguacggaaggguugacugaauuaguuuccgccccuccuccucccccggucaaugauggccacucuccagccagugucaauccaccuagcuuucaaaaucucucuggaggcugggcgcagugacucaggccuauaaucacagcacuuugggaggcaaaggcugguggaucuccugaggucaggaguucgagaccagccuggccaacauggugaaaccccgucucuacuaaaaauauaaaaaaaauagcagggcgugguggcacaugcuuguagucccagcuacucaggaggcugaggcaggagaaucgcuugaacccaugagauggagguugcagugagccaagaucgcaccauugcacuccagccugggcaacagagcaaaacuccaucucaaaaaaaaaccucgcuggaauuucuggaaucuagccacuuuguuucccccucaucuccucuggccaguccaauuccccaaaagcaaccugccaaaaaccaauuuggccaaaaaucaauuugcccaaauggacaauuugucacaugcuauuuucccacaggcgcucugcaguggcugccaaaguucuauacacgugguggauuucuguacuuuagguccagaaaagaccuaagggaaaaaacugccuggcauuuaaaaauaaaucuauuagaaucacuuguuuauuuugcuuauaaaaucuuugcagaggaaagaucuguacaaaggccuacagauucuuuccuaucuuaagcaagaguuuuguuuuguugugguucagccaauuuaacaagauugaggaugacagcaaauuaauuacacaacaucaaugaugagaaaugcagucucaugcagcaaaccuagcuuacaacuuuacagaacagacaaaauucugcacaaaaaacauucuacccaaugccauuuccuauaacaaacauguacagucucaagauugugguuauaaccuuuagcaggugauuaggaaaccacagacuacccggaaaucaacuuucgugacaagaauuggaguaauuaguaaucuuacuuccauagaaccuucacccacuugguuagugcucuuuaagguaacugauuuguaaauaucuuuaaucuucauucuuuuucuuucaacaaaggauaaaguaugaucucuuugucuugaauuuucaaaagcucuuguguccacaacgaguuuuucaagguuuauuaaauaccuuugugccaugggacuaagauuuuuucuuuuuuuuuuuuuuuuuuuuagacagagucucacucuugucgcccagacuggagugcaguggugugaucacagcucgcugcaaccucugccuccugggcucaaguaauccaccccucagccucccgaguauccaggacuacaggcaugcaucaccaugucuggcuaaguuuuuuauuuuuuguagagaugagaucucacuguguugcccaggggaucucaaacuccuggauucaagcaauccuccugccuuggccuccuaaaaugcugggauuacaggugugagccaccauacccagccgggacuaagauuuucauucuuuaauuuuaacuaagauggaaucagucuuuggguuuaaaauaaauuuuauuccucaggaauaugaaguuuugaaaaugagaauguuguuaugaaagggauugcugucucccaacauauuugcaacccaguccucgccuaaauucaugaccuaaucaaauagauauuugaaauaucuuucaaaucucagaccccuugcaugucuugaggagucagugcuauucaaagcagacaaaagguuugucucucacuuauuugcacaugucuauaacagguguugucaguugccagaauuuuuuuuacaggagcuguguaucuuuuauuuuugcauauagcccaauuuaaauuaacacaauuuaauuuaacaauuuaaauuaacacaaauaaaggaguuagaaagcaggguugaugggaaaaccuguaccuuugcuuauaaaauuuugaauauuugaguaugcuuugucuaugucaugaaacuaggcaaaaugggccuucuguugagccaaccugauagagcaauugugaacugacuguaaaaaaguuaaggggaaagaaaaacggggggcaaaaauacuuucaggggcuguuaaaaccuuccugugcaacaugauguugcuauaaacauuuaaaaggacuuggcugggcacuguggcucaugccuguaaucccagcacuuuaggaggcugaggcaggaggaucacuugagcccagcaguucaagacaagucugggcaacauaaggagacccugucucuaccaaaaaaaaaaaaaaucauauacuacaguauaauaaaccuccaaucauauacuacaguauaauaaaccuccaaucauauacuacaguauaauaaaccuccaaucauauacuacaguauaauaaaccuccaaucauauacuacaguauaauaaaccuccaaucauauacuacaguauaauaaaccuccaaucauauacuacaguguaauaaaccuccaaucauauacuacaguguaauaaaccuccaaucauauacuacaguguaauaaaucuccaaucauauacuacaguguaauaaaccuccaaucauauacuacaguguaauaaaccuccaaucauauacuacaguguaauaaaccuccaaucauauacuacaguguaauaaaccuccaaucauauacuacaguguaauaaaccuccaaucauauacuacaguguaauaaaccuccaaucauauacuacaguguaauaaaccuccaaucauauacuaaaguguaauaaaccuccaaucauauacuacaguguaauaaaccuccaaucauauacuacaguguaauaaaccuccaaucauauacuacaguguaauaaaccuccaaucauauacuacaguguaauaaaccuccaaucauauacuacaguguaauaaaccuccaaucauauauuacaguauaauaaacccccaacuacccaucacucagcuuuaacaguuugcuuucacagaacaauguuuuuuaaauagugggaaccaacccaucagacagacguucaugaaucaguuucacgcagagguucucauuguaauuguacacuggcaugccuggggagcuuuaaaagagacuuaagcccagguuuugccuuuacagguucuaauucaauugaucugggguugggccugagcacugggguuuuuaaaagccuccuaguuguccugaugugcagccaagguugagaggaugagaagcacacacuucuucuuuuguaguuaacuagagcaguacaggacagaaaagaacagaaugcauggcacagaguaaggcaaugugaaacuucucuuucgggaauaggugaauauaauuucagauugaacacauguaucaggucucaauguaaaaaggauuuccucggcugggugugguggcuuacaccuguaaucccagcacuuugggaggccgaggcagguggaucacaaggucaggaguuggagaccagccuguccaauauggugaaacccugucucuacuaaaaaugcaaaaaaauuagccgggcgugguggcgcaugccuguaaucccagcuacucaggaggcugaggcaggagaauugcuugaaccugggaggcagaguuugcagugaacugagaucaugccacugcacuccagccugggugacagagcaagacuguaucucaaaaaaaaaaggauuuccuaccauagauugcagucagaaaagauuaaaaaauuacugcacaagaauauaaacuucacaagggcaggggcuggacauacggcucaugucuguaaucccagcacuaugggaggucaagguaggaggguugcuugaggccaggaguucgagaccagccugggcuggucucaacaaaaaaauuaaaaauuggccggaugugguggcucacaccuauaguuccagcuaccugggaggcugaggugggaggaccacuugaacccaggaggucaaggcugcagugagcuaugaucaugccacaguacuccaaccuaggcaacagagggagaccuugucaaaaaaaaaaaaaaaucccccccaaggccggggacuguuuuuuuuuuuuuuacuacuguauccccagagccuagaauacugcaugacacauaguaagaacgcaacaaauuuguuguagcaaagaggaugugacaaucuuaaucucgugaggauguaguauacacucaauaaaauauguugaauaaaugaacaagugaccaauccauauguucccuggccuuuaguaggugcucaauaaauauuuguuggauaaaugcaugaauauccccagcacauaggaggaauuugauaaaauuguuuggaaacuaacgaggaacugaaucucuauuucucccugcuacauaguugguggucaauauacaaauuuguuggaaaaaacugaaugaauaaaugacgcuccaccacauuugacacauagcaggcccucaauaauauuuauauuuuauuuuuuuauauuuauuuauuuuuugagacggaguuucacucuuguugcccaagcuggagugcaguggcaugaucuaggcucacugcaaccucugccuuccggguucaagcaauucuccugccucagccucccagguagcugggauuacaggcacaugccaccacaccuggcuaauuuuguauuuuuuuuaguagagacgggauuucaccauguuggccaggcuggucucaaacuccugaccucaagugauccacccaccugggccucccaaagugcugggauuacaggugugagccaccgcucccagccuauuuuaaaauuauuuauuuauuuauuuauuuauuuuugagacgggguuuccaucuuguugcccaggcuggacugcaauggugagaucuccacucacugcaaccucugccuccgggguugaagcgauucuccugccucagccucccaaguaguuaggauugcaggugcccaccaccacacccagcuaauuuuuguauuuuuaguagagacgggguuucaccauguuggucaggcuggucucaaacuccugaccucaggugaucugccugccugggccucccaaagugcuggaauuacaggcgugagccacccggccaguauuuuuagacaaaugaauaaaugaucauccaucuuucucugucacauaguaaguacuugauaguuauuaaauaaauugaugaugauaugcuuucuggcauacaauaggaacucaacacaugaguauugcauaaaugaauaaaugacccacuguucaucuccccuagcacaugggaggugcuggauaaaugacuuuucaucuccccagauuuccagaacuaccuacggacacagacagggaacacgaccacuauuaacaucaucauuugcacuguggacuaccuccugcggcugcaggugaggacgugagacgguucaggugugacuugggucgggggcugcagggccauggucggccccagcacccccucacacccuacccgcccccaccaggaauccaucagcgacuucuacugguacuacucgggcaaggaugucauugaagagcagggcaagaggaacuucuccaaagccaugucgguggcuaagcagguguucaacagccucacugaguacauccagguagggcgcucccccuggggcgggagugggaagggagggggucccgcaucgugaucccugaucccuucucggggauucccuucccccccacacggcacucugccucccagggucccugcaccgggaaccagcagagccuggcgcacagucgccuaugggacgcaguggugggauuccugcacguguucgcccacaugaugaugaagcucgcucagguucgagccccucuggucuccauccaccugcuuccgggcgucccccaagugguccauuuccaagucuugccccuuuggucaguuugucacccgagugcucccggcauguuccagacugguucccucucaguggccaaauccauccucuuucuggauuggcugucugcaugaccccgccuccuccucugccccucccuccccaccaaucagcugguuuuccauccacgcuuccauuggucugacguguuggccccgucccaauggccggagcuccucuaugauugauugcuguuuuucucucugaugagucaucgcagauguggacaguccuugggcuaggauggggcugguuucuagauuagagccuggggcugaggaaauguuuugcuucuuuaucuuacuugcggcagaugacacccauaucaggcauucaugauguaaggucccuguugagcaccaccuuccauuuccauaauccuuguuccucuuucccucaccccuuugcagccuugccaaugucucacgaacacuuaauccauuugcucugcuucugucugguaacuauauucaaggcugccauauacuguuccgcaggucgugcacugcacaaaggcacgaucucugagagcauucacauccuacacauaaugguguauuuauuacaauaguuuaguuuuccagcagauggcaguaaagcauccagcauguuauaacuucccuacaggaaguguuuuaggggacgccuuuuuuucuaauuugcucaaaggugccccaggggcuggcagaaacccuaauucguugucaucugacuuuuuaaaaggaguuaaacuuagaaugcaauuccuccgugucacagcagcugaaguugugcuguugguauccuaaaauucuagagaguguugguaucaucauguagaauuccaaauccugcagggcuaauucauccgccaccaucuagucuagguugcaaaagcuagaaauccagugcaaagugguggcuuaagaaaaauaaagaauuuaucaguucauauuacagauccagggcuuagagugaugucagcagaacugccuccucuuugacugcauuugcaagcaggcugucucccugggcuggaaaaaauggugccucaggcuccuauccacucuacuucuuaacagcccuagagggaagagaucuccucuuuccugaaagcuccaagaaaaaaaaaaaccugagauucucucugacuagccuauugggucacaugucccucccugaaccaaucaucauaggcuuaggaaagaaagcuuugacugaccaggcccggucauauacccaccuauagaaccaggagguaggguuagccccaugugcucugacugugggaugggggacuccgcaggugaaaauugagggauuguaaagagaggagggggacugaaucauggguaggcacaaaccacaggcgcccacccacuguaagaucuugagauuaggagugucgggaccuuaggcgcagaaugcagagcuuuggaacuguggaaauacauuaggauuggaaucaacaacugauagaacuagcaugggagcaaaagauccuuacaucccauuuaucugguaucaucuccuccccucuccauuuuauuugguggaaccauaugaaauuaccacuuuggaucuggcacgguggcucauaccuguaaucccagcacucugggagcccuaggcgggcagaucaccugaggucaggaguucgagaccagccucaccaacauggagaaaccccaucucuguuaaaaguaaaaaauuagcuggguaugguggcgcaugccuguaauccagcuacucgagaggcuuaggcaggggaauugcuugaaccugggaggcagaaguugcagugagccgagauugcgccauuacauuccggccugggcaacaagagcaaaacucugucucaaaaagaaagaaauuaccacuuugugagccaaaagugaucacauguuggcaauuuuaugugacucaaccuaacauaaauaggggccaugaggcaaaacuuuguauuggagguuucuaugggcccuacacuguggcccuauguuccccgcagacggcuuaccagaaagcacauggcugucucugcagccuuccuccugaacccagagucccacucuugccaucacacauuauauucaacauacaucugucaaucccaccguaggccaggcacagugcugggcucacaucccuuccuagaccugggucucuguccccaguguuugucucugucugucucugucucucucugccccaaaugucugccccgcaagccucucaguccuccuugucugccagccuucccacuacccaucaccuaucgagcccgucccccaagugccaaccccacccccacaaucuugucucucugccccuuccccugcuuccgaggaacaugucuggacucggguccccucggagguaagaggggagaaaacggguuuaggcccugcuggguaggugaggagggggagaagcaacagaggugggggagguguaugcugagaccagcccucaccgagcugggaucucuaggacucaagccagaucgagcugcugaaggagcugcuggaucugcagaaggacaugguggugauguugcugucgcuacuagaagguaaacacccaggagugagggugagggaacaguaaagagguucagagaagccugagaauggcccccugagacccgggagacccuaauccucaaccccaucugacaucgugucaggauccauggguugaugaagaagccauaauaggccagaugcgguggcuacaccuguaaucccagcacuuugggaggccgaggugggaagaucaccugaagucaggaguuugagaccagccugggcaacauggugagacccugucucuacuaaaaauacaaaaauuagccuagugugguggugugugccuguagacccagcuacucgggaggcugaggugggaggaucaccagagcccgggagguccaggcugcagugagcugugaucacaccacugcacuccagccugggugacagagcaagacccugucucaaaaaaacaaaccccaaaaacaaaccaaauguccaaauguggcaaaagauaaacaauugaugaauguggauauauuaggaucccuuuuuuuuuuuuuucuuuucugagacggagucucgcucugccgcucaggcuggaggugcgguggcgcgaucucggcucacugcaagcuccgccucccagguucacgccauucuccugcuuggccuccccgguagcugggacuacaggcgcccgccaccacaccuggcuaauuuuuuuuuuuuuuuuuuuguauuuuuaguagagacgggguuucaccauguuggucaggauggucuggaucuccugacuucgugauccucccgccucagccucccaaagugcugggauuacagacuugagccacugcgcccagccuacauuaaaauuuaaaaauuacaaaaauaaacuggagccaagcuucagcugcugccuuuagagggagugugggaucgcaguuugccaaucucuaccucuccuugcugcuuaccacuggcuagccucagucuucuguggacccuccugacuguguguacugguggaaguuuuaguuguguaagcccugaggucaugcagcucugaguucaaauccauucuccccacuuuacuggcuauguaacuuugagugcaugacuuucucuaugucucaguuucucuuccuaaaaguagagucacacacuucccuuuuugugugauugugccaggguagcauuuggcaccuaccuuuagcguacaucaucauuaucuuuuuuuuuuuuuuugagacagagucucacuccaucacccaggcuggagugcaguggcacgaucucggcucugcaaccuccgccucccagguucaagcaauucucgugccucagccucccaaguagcuggaaauacaagcacaugccaccacgcccagcugauuuuguauuuuuaauagagacgggguuucaccauguuggccaggcuggucucaaacuccuggccucaagugauccacccaccucggucucccaaagugcugggauuacaggcgugagccaccacguccgaccugacaucauuagcuuuacugggggaggugggcaaaggcaggaucagccagguuggcacaggaggcugacgcaggucaggaagggaccuguggaggggaggcuguggcuggccagggacacuccagcagcgugguggcuccugggcuggaaagagaggcaagccugguggggccccagaagggaguguucaccggccacacugaccuggggcugccugcagggaacguggugaacggcaugaucgcccggcagaugguggacaugcucguggaauccucauccaauguggagaugauccucaaguucuucgacauguuccugaaacucaaggacauugugggcucugaagccuuccaggacuacguaacggauccccguggccucaucuccaagaaggacuuccagaaggugggugugggacaucgugugggcccaggacuugggugggguugccaagggccagccauacccuucuggcuggcugccucaggcaagagacaucucugcaagccucacuuuccuuguuuguaaaaugaggauaaaacaguccuuggguuauauguauucuguuuuauuucauuuuagagacaaggucuuucucuguugcccaggcuggagugcaguggcgugaucauagcucacugcagccuugaccuccuggcuuaagcaauccucccaccucagccuccugaguaguugggacgacgggugugugacaucaugccuggcuaauuuuuaaguuuauuuuuuguagagauguggucucacuacauuacccaggcuccucuugaacucuugggcuccaacaauucuccuaccuuggccucccaaagugcugggauuauaggcaugagccaccucgcucagcccccuuggguuauuuugaggaugaaaugcauuaacacagaugagaaccguuauuacuguuaucuuuauugauagucauaacauuaucauuauugugaauaggcaucaguuauuccaucaauaaacauuggcuggcuuucuucucuguguagggccuguagugacacuauugacgcaucaaugaccaagauagacacagcccgugcuuucauggguuuauagucuaaugggggaggcagucacuaacuagaccauuccaagucuaaauaaugagccugcuaggagggaagugcuggaacauccuuauucagaaacccacuccuccuccucuaaccaccucucccauccuaacucuccaucuuuucuucugagccucaguuuccuacucuguaaaauggggauaggauaaucacauuaaccacuaacuauuggcagugugcggugguucaugccuauaaucccagcaauuugggaggccgaggugggaggaucgcuugagcccaagaguucgagaucagccugggcaaccuagugaaacccuguaucuauaaaaauaaaaauaaaacaacuauuaacuauugugaggaugggcagugcgggcaguaccuggaauauggugaguccucaagagauguuagcugcuauuacuacucccugaucuuuaauguuaccauuuuguuaacuuuuuauuuugaaauaacuucagguuuauagagacguugcaagaacagcacauagaauuucugaauaccuuucacccacauugcccaaauguuuucuauuuacuauuuacuccaucaugauuucccuuuccuuuccuuuuuuuuuuuuuuuuuuuuuuuugagacggaguuuugcucuuguugcccaggcuggagugcaguggugcaaucucagcucagugcaaccuccgccuccuggguucaagcgauucuccugccucagccuccugaguagcugggauuacaggcacgcaccaccaugcccagcuaaauuuguguguguguguguguguguguguguguguguguguguguguguguguguuguauuuuuaguagagaugggauuucaccauguuggccaggcuggucuugaacuccuggccucaagugaucugccugccucggccucccaaagugcugggauuacaagcaugaaccaccucgccuagccaauuucccuuuacuuugaaacacuucagcguguaucuccugagaacaaauucauucuccuaccuaagcacaggacaauuaugcuaaucaggaaauuaacauuggcacaaugcugcuaucuaauccuagaccuuauucaguuucccuuguugaauaaauuucuuucgucaaugucuuuucuuugccaacccagaaccagggauuguauuuagguguucugucuguuuuccuccuucagucuggaacugugccugggucugucuuuaucuuuccugacauguuugaagaacgcaggcaaacuguuuuguaaaaugucguucaguguggguuugucugaguuuucaucauuaucagacuaggguuaugcaucuuuugcaggaauaucagagaagugauguguccucaguguaauguauuaggaggcacaugugguuucaucccauuacuguuuauuuucuuauuuauuuguuuuuagagucagagucuugcucuauugccccggcuggagugcagucaaacaauccuagcucacugcauccuugacccccugggcucaggcgauccuccugccucagccacccaaagugcugggauuacaggugugagucacugcaccuggccaaugucucuucccauuacuguuguuaacuuggauggcuugguuaacucgguguucaccaggggcuccacaaugaaguuacuguuauucccuuuggaaucaauaagugucucaugaggauauacuuugaggcuauguaaauauucugcuaacucuggggucaucauccauugaugauucuugccugaaacaauuauuccucuaguagcugacaaauggugguuuucucauuucgccguaugcuuuaccaucacuaggcaccauuuuacuguaagaaagaguguuuccuucuuguccauuucauuucauuuucucauucauccauucauuuauaucaguguggauucacggcuuuuuuuuuuuuuuuuuuuuuuuuuuuuuuuuuuuuuuugagacggaguuuugcucuuguugcccaggcuggagugcaaugguaugaucuuggcucacugcaaccuccgccuccuggguucagugauucuucugccucagccucccaagucgcugggauuacagguaugcaccaccaugccuggcuaauuuuguauuuuuaguagagacggggguuucaccauguuggucaggcuggucucgaacucccgaccucaagugauggucaggcugguuucaaauucccaaccucaagugauccgcccgccucagccucccagagugcugggauuacaggugugagccacugcaccuggcccauggcuucuuagucuauggguugcagcugugacuggccaucugcacuuagguaagcucaggguucccugaguuaaaaucaaagugccccaugccuuccaguugucccccaagagccucacugugucucucugcuucucagccacgccuugcaagagucaucugcccuugaucaucuguucucaccucccacuccuucccugauucggggcuugccggcuuccgucccugucaggcuccugaaacuccucugaccaagaucaucagugaccucuuuaccucugacuguccccucugacuugucaucuuggcagccuuugucacagcuggccuuuucguuucccuccccaacccugaggggcaaugccugcuucccugaaccugagccucacauccuucggacccugccucccagcugaucccuccuagccucuuacccuucacugugccugagcccuccaccuucaugaagagcucauaguuaccauauucucacucugugcccugcguauaaaugaauuugcucauuuaguccuuacagcaacccuacaugguaaaacauuuuuguuuuguuuugcuucuuugagacagggucuugcuuuaucagucagucuggagugcaguggcgugaucacaacucacuguagccuccaccucccaggcucaggugauccuccuaccuuagccucccaaguaacugggacuccaggugugugccaccacacccggcuacuuuuauuuauuuauuuauuuuagagacgggguuugacauguugcccuagcuggucuugaacuccaggacugaagcaaucagcccaccucaggcucccaaagugcugggauuaccagcauaagcuaccaugcccagcaggacugcuuuuuuuuuuuugagauggaggagucucacucugucaccaggcuggagugcagugaugugaucucggcucacugcaaacuccgcuuccuggguucaagcgauucuucugccuuagcuucccgaguagcuggacuacaggcaugcgccaccacacccagcuaauuuuuguauuuuuaguagagacgggcuucaccauguuggccaagguggucucgaucuccugaccucaugauccaccugccucggccucccaaagugcugggauuacaggcgugagccaccgcgccuggccaggauugcuuuuuauucccauuuuauggauguggaaacugaggcacagggagauuaaacggacaugcuuaaggucacccaucuuaauaagugacaagguuaggguuagaccucaggcggucuggccucagaguacacugccuucagauucaucuguuaaucuggucuaaucgauagucagugagcacuuccugggggcugggcccuggcugggggucucagcccuacucucgagccuggcagguuuagggagagagucugggguggcuacaagagaagcaaaaagcauuugcaggagcuaaaguacacaugauucacaauugaaaaugaguaaugaucucuccugacuggggcugcacagaucacaggguuuaaugucaccuaccugacauuuuacagcucaacaucuguuacacaaaguuauaaucugcaacugggaaaaguguauucauuuuauuuuuugaauauauaauuacucacgauuuuaaaaaucaaaauauaggcugggcacaguggcucacgccuguaaucucaacacuuugggaggccaaggcaggcagaucacuugaggucagaaguucaagaccagccugggcaacauggcgaaccuccccaucucuacuaaaaauacagaaauuagccaagcaugguggcaggugccuguaaucccggcuacucaggaggcuaaggcaggagaaucccuugagccugggaggcagagauugcagugagcugagaucacgccacugcacuccagccugggugacagagugugacuccauaucaaaaaaaaaaaaaaaaaaaucaaaauauagccaggugcuguggcucacaccaguaauuccagcacuuuaggaggccaaggcaggaggauugcuugaggccaggaguucaagaccagccuggacaauauagcaagaccccauugcuaaaaaaaaaaaaaucaaaaaauuagcuggauguggaggugugcaccuguagucccagcuccucuggaggcugacugagcugggaggauccuuugagcccagaaggucaaggcugcagugaaccaugauuguaccacugcacuccagccugggcaacagagcacaagacuuugucucaaaaaaacauuuaucaaaauacagcaaggcgugaagugagaagucuuacuccugcucuuuuccaauccacucuuccccacaucuaccaugguaaagcccuuucguuaguuucuuuuguauccuuccaucauuuuuuaaaugaaaauacaaacagauauuuuuguuuuucucguuuuguacauaauagguauaacaucacuggucugcauuauuuaauaacauauucuggagauauaggaagugucgucauucuuuuuuacagguguccaauauuccacgcuguguguauauuaugguuuauuugcuauuccuuguugauggacacuggcuuuauucccaauguuuugcuauacaacccauguugcagucagggcugucauggauaguugcacccauugugcacugcacaaggaugucauuuauaccacagacauuuuacauuuguacauguuuuacugcagaguuccagcagauggagggaaaugugcugaggaaggcuguaguauuugggccuaaagcaaugcuggcuauaacaauuacucuugcuacacuuugagaggcugaggcauguggaucaccugaggucaggaguucgagaccagccugaccaacacggugaaaccccaucucuacuaaaaauacgaaaaaauagcgggcaugguggcaugcaccuguaaucccagcugcuugggaggcugaggcagagaauugcuugaacccgggaguuagagguugcagugagcugagauugcgccacugcacuccugccugggcgacagaacaagacucagucucaaaagaaaaaaaaaauaaguagcauuguucuauaauuucccaaguucuucaugguugccagaguucuugacaguuuacaaaucacaucuucauugaugaaguacuuuguagauuucaaaacaucuacuauagcuuggaaggcccuuucugguguuugaaaucacauuuuauuuauuuauuuauuuaaauguuuaauuauauuaacagagaugaggucucccuauguugcccaggcuggucuugaacuccuggguuuaagggauccuccugccucagccucccaaagcgcugggauuacaggaaugagucaccucacccaacagaaaccacauuuuagguuacugauuuauuccuggucaguaaacagucuugagguuaucuucauuguuuuccuaucugcaaauuuuauuugucucuuaauuaaaacacuuccuuuuuaaagugucuuuacugaaauagaauguacauaccauaaaauccacccauuuaaaauguacaguucagugguuuauaguguguucacagaauuaugaagccaucccugcaaucuaauuuuagaacauuuuaaucauccuuugaaaacgaaccccauacccauuagcagucauuucccacuucccccaccccagcccccgguaaccacugaucuuucugccucuauagauuugccuauucugaacacugcauauaaaugguaucauaaaauauauauggucuuggccagacacggugggucacgccuguaaucccaguacuuugggagguccaagagaguggacuguuugaguccagguguuugagaagagccugggcaacauggcgaaacccugucuccacuaaaaauacaaaaaauuagccgagugugguggcacaugccuguaguccuagcuacuugcgaggcugaggugggaggaccgagaaguugaggucgcagugaguccugaacacaccacugcacuccacuccagccugagcaacagagugagacccugccucaaaaaaaaaaaaaaaaaaaugcaugugugugugcgcacguguguguguauguguguguggccuuaaaagacguuccuuuuauuuaacaaaccacaaugucaucacuccuaacccaaaauaaaacaguacaaauaaaaaagucacaguccuuuaaaucaucaaauaucuagugagugugcaaauuuccaaaucucauaacuuucauguaacuaucaggauuuuuuguagcuucuuuaaaucagaauccaaacaagggccacccauugcaauuggcugauacuuuuuaaaaucaucuuucaucucuugcuuccccucuauuaucuuuucuuuuuccuugcaauuuaucuccuggagauccaguccugcagaucuuuacuguccaacagaaauacaauaugagcaauauguauauuuuuaaauuuucuucuuuuuuuugagacagggucucacucuguuguccaggcuggagugcaguggggcaaucucagcucacuguaaccuccaccugucagguucaagugauucuccugccucagccuccugaguagcugggauuacaggcaugcgccaccacaccuggcuaauuuuuguauuuuuaguagagacaagguuucgccauguuggccaggguagucucaaacuccuggccuaaagugaucugcccuccucacccuccgaaagugcugggauuacaggcgugagucaccauaauuuuaaauuuucuaauagccauguuuuuuaaaaaguaaaaagaggaccggcaugguggcucgugccuguaaucccagcacuuugggaggccaaggcgggaggaucacuugaggccaggaguuugagccagccugcguaacacagcaaaacccuaucucuauaaaaacuuuaaaaaauaaccagguguaguagugcauaucuguagucccaguuacuggggaggcugaggcaggaggaucucuugaaccuuggagguuaaugcugcagugagccauguucauggcacuguacuucaaccugggcaacugagcaagacucuguuaaaaaaaaaaaaaaguaaaaugaaacacuacacauaaucuaguacacucaggauauuauuucaacauggaaucaauccuguuuauuuauuuauagagauggggucuugccauguugcccaggcuggucucaaacuccugugcucaagcaauccacccuccucagccacccaaggugcugggauuacaggcaagagccacugugccuggccauaaucaaucuaaaaaaugauuagcucgacauuuuucauucuuuuuucacacuaagucuaucaguggauagugcuguccuaguuguagagcuucccauagucuggaccugaccaaugcguccuuguggugucauuucauguguuccuguguccccuggguuuccuccaaagugggacucagccaaaguucgagcagauucagauuuggguguaaggaguuuuuuagccagaaccuuccuauguggggcuacuguauaccuccaccaggaggcaccuccuuuccagaugccagcagcuguuucugcucaacacucagacauauucauucauuagagauugcaaaauggcgauagucucauuucuuuuuuuuuuuuuuuuuuuugugacagagucucauucugucacccaggcuggagugcaguggcaugcucucggcucacugcaaccuccgccucccagguucaagcgauucuccugccucagccucccaaagugcugggauuauaggcaugagccacggcgcccagccucuuaguuuucaugaugcuuccuucacuugacaaaugaguaugaguaccuacugugugucaggcacugcccugguccugaagguacagcagugaacaaaacagagagcccacugugggggcugauaguccagugggaaggggcagaugcaaauaacgaaauacacgaaguaauugcagguuauaaucuguggucugaagggugugggagugagcagggugugguaagcccuguaaaccggcugguggcggaaggccuucugcaggaggggacagcgaagcugagaguugaaagauaccauaugacucagcgaggcuguggugucccaggcaaaggggacaguaaauggaaaggcugaaaaaugggaacaagagggacagagagcagccugggcaacauggcgaaaccaaacccugucccuacaaaaaauacaaaaauuagcuaggcaugguggccuaugccugaagucccagcuacuugggaggcugaggcaagagaaucacuugaacccaggagggggagguugcugugagccaagaucgcgucauugcacuccagccugggugacaagagcgaaauucugucucaaaaaaaagaaauaaaaauacaaaaauuagcuaggcaugguggugcaugccuguauucccagcuacucgggaggcugaggcaggagaaucgcuugaacccgggaggcggagguugcagugagccgagauugcaccacugcacuccagcaugggcaacagagugagacucucucaaaaauaaaauaaaauaauacaauaaaauauaaaauaaaauaaaauacuagccaggcacgaugacucaugccuguaaucucgauacuuugggaggcugaggugggaggaucgcuugagcccaggaguucaagaccagccuagaaaacauaaugagaccuugucucuacaaaaaaacuguuuaaaaaauuagcuggguaugguggugcaugccuguggucccaacuuggaaggcuaagacgggaggaucacuugagcccaggaggucgaggcuauggcaagccaugaucacuccauuacacuccagccuagguaguagagacagacuuugucucaaaaaauuaauaauaaaguaaaacaacuaaaagacuauaaguagacuguaacacaaagaaaggauaaaugccagagggaauggauaacgcauuaacccugaugugaguacguauugcaugccuauaucaaaauaguucaucuaccccauaaauaaauacaacuacuauguacccacaaaaaugaaaaauaaaaaggccuggcucaugccuguaauccuaacacuuugggaggccaaggcgggcagaucacuugagaucaggaguucaagaccagccuggccaacauggcgaaaccccaucucuacuaaaaauacaaaaauuagcuuggcgugguagcacaugccuguaaucucagcuacucagaagacugaggcaggagaaucgcuugaacccuggaggcagagguuucagugagccaagaucacgccacugcacuccagccugggugacagagcaagacucugucucaaaaaauaaaaauaauuuuuuaaaaaaauaguccaggugugguggcucacaccuguaauccuagcacuuugggaggcccaggcaggcagaucaccugaggucaggaguucaaggccagccuggccaacauggcgaaacccugucucuacuaaaaauacagaauuagccagugugguggcacacgccuguagucccagcuacucaggaggcugagacaggagaaucacuugaacccaggaggcggaggcugcagugagccaagaucgugccacugcacucuagccugggcaagacagagcaagacuccgucucaauaaguaaguaaguaaauaaauaaauaaagggaugggcaaugaaugaugacacagagagaucagcaaaucacaagagcaaagucuaggagugaauggaggugauagugucccaggcgccuguggagaggugggcuucuuuuuuuuuuuuuuuuuuuuuuugagacagggucucgcucuuauugcccaggcuaggugcaauggcacaaucuuggcucacugcaacauccgccucccagguucaagccauucuccugcuucagccucucaaguagcugggauuacaggcacgcaccaucaugccuaacuaauuuuuguauuuuuaguagagacgggguuucaccauguuguccaggcuggucucgaacuccugaccucaggugauccacccgccucggccucccaaaguccugggauuacaggcaugagccaccacaccuggccagagguggauuuuugagacagacagugucacacugcucaugauagagggguaggcaagcagacgaggugagggcagaaggugagggguuccggugugauuaugucuccaugcucugugguuucuagagcccuucaugauuugcaaagcauguuacucauuuagaaagcauuuugcaaaguucugggguuuuuacaaagcacuuuugagagccagaaaauuuugcuucuguucauaccccagagcaacauuucucacacugcauguugcuacccgucuggagguaaugaaauuaauuuagcaaugcguaacucgugaccagcaucuuuagaaauaaaauagaacacugcagagugugcuacacagcaaaggucagaauuaugucaugaaaccuuuuuuuuuuuuuuugagucacauuguaaaauguauucuuaugguugagugagugcggucaagaacauuuuaugcugcucuagagaaccucuugcaaaaaugcaugggcaaucagcacaagaauguucaagaaaaguguugucugaaagaaaucugugggugaacuuggugauuuaugcuuguaaucccaacacuuugggaggcggaggagggcaaaucaccugaguucaggaguuugggacaagccugggcaacauggcaaaaccccgucuacaaaaaaauacaaaaauucaccaggcacaguggcaugcaccuguaguccuagcuacucaggaggcugaagcacgagacucauuugacccugggagguggaggcugcaaugagcugagaucgugccacugcaccacuccagccugggugaaagagugagacccugucucagaaaaaaaaaacaaaaacaaaauacaaaucuggaagcaaccuacauuuccauuagcaggauaacagauaaagaguguuauggcugggcgcgguggcacacaccugucaccccugcacuuugggaggccgaggcggguggaucaccugaggacaggaguucgagaccagccuggccaacaugaugaaacccuaucucacuaaaaauacaaaaaauuagccaggugugguggcgggcaccuguaaucccagcugcucaggaggcugaggcaggagaaucacuugacccugggagguggagguugcagugagcugagaucaugccacugcacuccagccugggcgacaagagcgaaacuccgucucaaaaaaaaaaaaaaaaaaaaagagaaagaaaaagaaaaaaaagcaaguuucagcugaggugggaggaucccuugagcccaggaguuugagaccagccuuggcaacauagggagaccuuaucucuacaaaaaaaaauuaaaauuaaaauuagccagguguagcggugugugccuguagucccagcugcucuggaugcuggguacuugagcccggggguggggauggggacgagaggggaugucuugaggcuggguugagcugugauugcgccacugcacuccagccugggcgacacagcgagaccuugucuuaaaaaaaaaaaaaaaaagagagagaauugaggcucuccaggucaccccacugaccucccugcccgcccccaggccauggacagccagaagcaguucagcgguccagaaauccaguuccugcuuucgugcuccgaagcggaugagaacgaaaugaucaacugcgaagaguucgccaaccgcuuccaggagccagcacgcgacaucggcuucaacguggcggugcugcugaccaaccugucggagcaugugccgcaugacccucgccugcacaacuuccuggagcuggccgagagcauccuugaguacuuccgccccuaccugggccgcaucgagaucaugggcgcgucacgccgcaucgagcgcaucuacuucgagaucucagagaccaaccgcgcccagugggagaugccccaggucagggaacccgcgcgcgugcaagcucgccuccuggggcuucgggcaugcgggugcucacuuccugcacccucagaccccacgggggcugugcgugccucgcauaucugcccugcuccggcaagcccacgcccacccuuuuguacacauuucguccagcugcgcccuugcacaucccuggcucgccccuggccacuucuugcggaccuggcccacacaaggaugcacaccccuugggcaugaagcagggucaguguguccugacuguggcugcucacacgccaugcuuuccccuuacacccacacccugggagcucuggcaggcccuuauagcccugaugcagcccuacccacacucucaccuccucgaaccugcauggcgacacaccccuugcucaccuucccaguagcccccggcgugccgucucuugguccuggcccgcucaugcucacucuuguacacgcucgccuugggggcucuggggugcccuggcaugcugacccacccuucaccagucaucacguuugcccccagaugccuucugaaguccuagcauauguguaccccaacuuauucugggcccacacgugggugcacaccucuugcacacacacccugaggaugccaaugagcccucucagaacccuggcaugcuucauuuguucacuguccacuugcccucacuguagcccuggcacaaccaugcucacccaugcacacuugggccacggucucaggcucacccagaagagcccucagaccuacucucuaaucugacaugcccuaucucagcuccuccuaugcccagcccacaaaugcuugaacaucccucacacacucgcuugccccaaggguacacucacguggucccggcauguccccagcagagcuggcacaccuggcugacauaugguuccccuccccauucccucacacuccccacacgccccugacacacccucaccucauucucuugcacacacacuugcuuguuguuccucagaugccgccagguacuugcacaccccuucuugucucacacacauagcccgggagguuugcgcacccgucaccuccuucaugagugggcccuucauaugucuccucaggggacaccagcucaugcacgcgggcucaugucccacacagagcccuguccucauguucugggagccaguacacaaacccuuggcuccccuucccacauucaugccugccucacgcacacugcauaacugcaggccccucucacacucauacuccuccuguccccccacagagucccaggcccuugcacaccugccccgugugcccacguccaccgugcacacugagccucucgugguugcacacuuuuggcaucuucccaugccgccacgcccuccuuacuccugaucccucccuggcccccggugucuccucacauacuccgcaggaacccuugagaucuugcacacucaucugugccccucggggccccacugcauacacacccccaucuggcacacaagugguugcagcauccuggcacccaggauguccacacaucccugccucugcaggaagccccuguucaccacggcccuucccacucauucuuugcacgugcugggggagcucugcccuccucucuuccucugacccugcgugcuccccauacaaacacucuuugccuuagugcuauuccuccaaacacccgcuuccuucugcucaccccuucccauuccacuuuccccugcuucucaggcauccacguaugcccauguggccuuggagcaccuguggggcaguauaauaauagguaacacuacgguguuguuguuguuugagacagaguuucgcucuuguugaccaggcuggagugcaauggcacgaucucagcucacucaaccuccaccuccuggguucaagcgguuuuccugucucagccuccugaguagcugagauuacagccaugugcaaccaugcccaccuaauuuuuauauuuucaguagaggcgggguuuugccauguuggcaaggcuggucuugaacuccugaccucaggugauccgcccgccucggccucccaaaguguugggauuacaggugugcgccaccguggccugcccacuauacagcauuuaucaggcaccgggcgcuguucuaaucaugcagcaucuauuaacucauuuaacccucacaccaacccuauaauguagguccuauuaugcccauuuuacagaggggaaaacggagguccagagaguuaauucaaaaucacccagcuacucaguggcagaaucaggauuugaacccaggcaggcuggcugcagagccuuugccuuuaagcacuaugcuccuccucucaaggaagcuaaacacauccauucuggagccagcucucuggggguucgaauccuauaugugccaccuugucugugucaccugggcauguaacuuucugggccucccuguccucaucuauaaaaugggaagaaaacccgcuagcccuaggcuuguuugugaggauuaaaugaguuuuauggaaacugcuuguauggggccuggccuuauugaagcauuuacaggaguacccacagugagugcucucuauaaagcucucucuauagguuugcuauugauaaucaaaacaacaacuuggccaggcgcuguggcuccugccuguaaucccagcacuuugggaggccaaggccagaggauugcucgaggccaggaguucgacaccagccugaccaacacagacagacccugucucugcaaaaaaauuuuuuuuagaaauuagcaggccagucaugguggcuuaugccuguaaucccagcacuuugggagggugaggcgggcagaucacuugaggccaggaguuccagaucagccuggccaacauggcaaaacccugucucuacugaaaauucaaaaacucagcccagcaugguggcaggcgccuguaaucccagcuacucaggaggccgaggcauggggaucaugugaacccuggggacgaagguuacagugagacagcgucacuucauuccagccuaggagacagagcuagaucuugucuuuuuuuuuuuuuuucuugagacagacuuucacucuguugcccaggcuggagugcaguggcacgaucacagcucauggcaaccuccgccucccggguucaaguuauucuccuaccucagccucccgaguaacggauuacaggggugcgccaccacaccggcuaauuuuugcauuuuuaguagagacggggguuucaccauguuggccaggcuggucucgaacuccugaccccaagugaucugccagccucaguuucccaaagugcuaugauuacaggcggagccaccgcgcccagccugacccugucucaaaaacaaaauaccaacaaugcauuuagaacagcgccugccgcggugaccccuuguagcugccacugcgcugucgcugcuguccgagcccccgcugacggcgcccuauccugucugccgccccucgcuucaggugaaggaguccaagcgccaguucaucuucgacguggugaacgagggcggcgaggcugagaagauggagcucuucgugaguuucugcgaggacaccaucuucgagaugcagaucgccgcgcagaucucggagcccgagggcgagccggagaccgacgaggacgagggcgcgggcgcggcggaggcgggcgcggaaggcgcggaggagggcgcggcggggcucgagggcacggcggccacggcggcggcgggggcgacggcgcggguuguggcggccgcaggccgggcccugcgaggccucagcuaccgcagccugcggcggcgcgugcggcggcugcggcggcuuacggcccgcgaggcggccaccgcaguggcggcgcugcucugggcagcagugacgcgcgcuggggccgcuggcgcgggggcggcggcgggcgcgcugggccugcucuggggcucgcuguucggcggcggccugguggagggcgccaagaaggugacggugaccgagcuccuggcaggcaugcccgaccccaccagcgacgaggugcacggcgagcagccggccgggccgggcggagacgcagacggcgagggugccagcgagggcgcuggagacgccgcggagggcgcuggagacgaggaggaggcggugcacgaggccgggccgggcggugccgacggggcgguggccgugaccgaugggggccccuuccggcccgaaggggcuggcggucucggggacaugggggacacgacgccugcggaaccgcccacacccgagggcucucccauccucaagaggaaauugggggugagagagcaggcgggguuuugggguuuuggaaagaugggggauuggagggaggaagagagcccggcuggguggagacacacacagaggagagaacuggcuagggggaugggcacacgcacccacggaggacgcacccauggaggacgcacacggggacagcgggcgccgggcaagagagacgcucagagacagagggauacucagacccacagagaaagagacucagagauggagaccuggagaaagggccggggagagagagugcagggccggacagagugcagggccggacagagugcagggcccggagagguagagaaaaugauaccugcagagccagagagaguaagaaacccagagaccaaauuagagggcaggaaagaccaaaacuaagccaggcgcgguggcuuacaccugugaucccagcacuuugggaggccgaggcgggccgaucaccugaggucaggaguuugagaccauccuggccaccgugguggaaccccgucucuacuaaaaauauaaaaauuagccgggcaugguggugugcgccuguaaucccagcuacucgggaggcugaggcaggagaaucgcuugaacccgggaggcagagguugcagugagccaagauggugccacugcacuccagccugggcgacagagcgagacucugucucaaaaaaaaaaaaaaaaaaaaaaaaaaaaaggaaaagaaagaccaagacuaaaaaaagucccgagacagggucagggccacuaggaaaagacccucggagauacucguugugggaaugaaguacaccguggaggaagggaccccaaacauccucaggcccuuggugcugggaaugccuugggaauguggaggucaagguggugggaagcccuggggacaagcagagcugcacuuggagucagcccgacccugcgcagugcuuugggcaaagggcuucaccucgaugagccucaguuuccccucuguaaaacgggaaucauaaucugccucuuucugguggagggaaguguaaaacuuagauuacccaggggaaauaagagagaaaggagaugagaggagcaggcaggcagccugagaagcgcuuagggugaggacucagcccugaugcuugcccugucccuagguggauggaguggaggaggagcucccgccagagccagagcccgagccggaaccagagcuggagccggagaaagccgagugaguggccuuggggcugaggggccuagccccuaucacugccucccuccuagaguaggagccuccagaggucaggccccaaggcuguccuggccacccuguguccucggcaucacccagcccagacucaggcacggaggaggggcucugaguaaaagaaucaagaaauaaaugcuccaaccugggcaacauaaaaaaaaaauuaaaauuagccaagcauggugguguguggggaggcugaggugggaggaucacuugaccccuggagguggaggcugcagugagcccugaucgcagcauugcccuccagccugggugacagagcaagacccugugucgaaaaagaaaaaaaaauauggagagauagaaaaaugaaaacucccaucuaacugccaggccuucgcaugugcuuucccgcugccuggaacacaggcccccaugccuacucugagucuuucucauccuuuccaauucuccaggacaccugacccccuccuaaguugaggaggugucuccuccagauucccacaacccccugagcuuccuccaucccagccccgaccacucugggcugucacugccuggugucacugucacugccugucucccacauuggacuggagccccauaagggcaaguccugauuaucucaucaucccauguacccaguaccauccaaaccugggccaggcacagggcgggcccuuggugaaugguuuugaaugaaugaacucaugcauugccugcccaggcaccuccugaccucucucuguccugcccugcagugccgagaauggggagaaggaagaaguucccgagcccacaccagagccccccaagaagcaagcaccucccucacccccuccaaagaaggaggaagcuggaggcgaauucuggggagaacuggaggugcagagggugaaguuccugguaaggauccagccaggucaccugaaccuucuucuccccgggagccccaccucuggugcccaccucuccugcucaccuuguucuugaguucaucuguucaagcucgucucuaagaagaacccuagcuggggaaagggcagagguauccccagaccugcggacaggguagcauuuucagauggcccucacuugguuccuugucccuucccugcucacuauccuuauuccaaccuccauaccucuguucaucggggccacccacccacacuuccaccuccauccucuguccagagcuacauucagugaggccaccacucuggccuucccaccguggccuguucuuggcugucagcccuuacagucucagucccuccaccacucccagugcugcuguggaggucugagcucucccaauuccuggggaagcguucaucucauccaggccaggaagaaggguggguguugggaggcaggucccaggguucccuccauccugucuccccuccaggccuggcccgauaggagggggugagggaggcugggcacggugggucacaccuguaaucccagcaccuugggaggccgaggcaggcggaucgccugaggucaggaguucaagaccagacuggccaacauggugaaaccccaucucuacuaaaaauacaaaaaaaaaaaaaaaaaaaaauuagccagccauaguggugcaugccugcaauuccagcuacucaggaugcugaggcaugagaaucgcuugaacccaagaggcagaaguuucagugagccgagaucgugccacugcacuccagccugggcgacagagugagacucugccucaaacaaaguggugguggggggcgggggggcggugagggaaucauguggaacgaaggugguuccgucagaauuugugggaagaaugagggauggagggaaagguggagagaaagagggagagauggaagauguuccuggccgugcgagggggcucaugccuguaaguccaguacuuuggaaguccaagguaggaggaucacuggagcccaggaguuuggggcaagccagggcaacauagggagaucccugucucuacaaaagaauuuuuuuuuuuuuugagacggagucucgcucuguugcccagguuggagugcaguggcacaaucucggcucacugcaagcucugacuccuggguucacgccauucuccugccucagccucccgaguagcuaggacuacaggcgcccgccgccacgccuggcuaauuuuuuguauuuuuaguagaaacgggguuucaccguguuagccagaauggccuagaucugaccuugugauccacccgccuuggccucccaaagugcugggauuacaggcgugagccacugcaccuggccgaauauuuuuaaucuuuuuuuuuuuuuaauuacugcuccuugcagagcagggcuacccucuaggcagugcacccagaguagccaaaaauguuuuuuuaauuagcugggugaggugacacaugccuguggucccagcuguucaggaggcugaggcgggaggaucacuuaagcacaggagguugaggcagcagugagcuaugguugugucacuucacuccaaccugggugagaguaagaccuugacucaaaaaaaaaaaaaauucccuuucaucuucuguaaagcaggcagggcgacagguggggugaccucacucaggaagcagcauggccaaguggcuuggagcuuggacucuggaggcugacugcccggguucaaaucccaucucugccacucguugguuauguuaccuugagcaagacaccacuucccugagccucaguuuccucaucuguaaagugcgcauaacaguagugcccacuucacagggguguacugagaauuaaacaagcucaugcaaauaaaguucuuagcccagauguugguauaagcaagcacucaacaaauaggagguugaggccagccgagguggcucacaccuauaauccuagcacuuugggaggcugagguggguggaucaccugaggucaggaguuugagaccagccugaccaacauggugagaccccgucucuacugaaaauacaaaaacuaacugagugugguggugcauaccuguaaucccagcuacuuaggaggcugagucaugagaauuugaacccgguaggcagagguugcagugagccgagauggcgccacugcauucgagccugggugacagagugagaccuugucucaaaaauaaauaaauaggcuggacgugguggcucaagccuguaaucccagcacuuaggcugaggagggcggaucacgaggucaggaguuugagaucagccuggccaauauggugaaacccugucucuacuaaaaauacacaaauuagcugggcgugguggcacacgccuguagucccagcuacucgggaggcggcagcagaggaauugcuugaacccgggcggcagagguugcagugagccaagaucgcaccacugcacuccagccuggacgacagagcaagacucugucucaaaaauaauaauaauaauaauuaauaaauaaauaggagguuguaggaaagauauugagagcccagguacuuugauugcagguaaaugaugggaugaauucuccagggaagaggcugaucugugagcgcuuucucucuuuuucucuucucucucagaacuaccugucccggaacuuuuacacccugcgguuccuugcccucuucuuggcauuugccaucaacuucaucuugcuguuuuauaaggugcugguccugaagggcugggagggucaggcccuuuuccaugcugugggaugggaggcucagccccuaucagaauuucaggguuccuccacugaagggauaagguauugggcuuugggucguuaggaggguucaggcuggacaccuggauccugggaccccccuccaugggggugaguaggggauaucuggauccaucugggacagaagccugagugucugugggaguuagagcaggagcaggagcugaguucucugcucagcucggccacaugccaguccugugcgccugggugcaggcccucagcucuuggcaacacccacugauucuguuaagcaucuuugguuucacauaagcuaaacagaaguuugcagggaggaagaaaugggccacucacagaauggaaggaauggguuaagaaccaggccuccugaaggacaaagggacccuuggggucuugccaggggucuagauaacaggacaguaagguagacuagagagaucgaagcauggcuucugugggacccagaagucccacagugggacugcccacuggcgcaugacgauaggcaaggugcuuaccaucccugugccucaacucccucaucuguaaaauggaauaccucuuagagcuguggggauugaaagaggauaaggcaccaggcacaguggcucacgccuguaaucccagcacuuugggaggccgagguagguggauuaccugaaguccggaauucaagaccagccuggccacauggugaaaccccgucucuacuaaaaauacaaaaaaaaauuagccaggccugguggcgggcaccuguaauccaagcuaugcaggaggcugaggcaguagaaucccuugaacccaggaggcaaagguugcagugagccgagauugcaccacuacacuccagccuaggugacaagagugaaacuccguccaccccaccaaaaaaaagaggaugaguguguguaaggcaguuagagcaacaguaccuggcauauaaaaagcacuguguaaauguuuagcugcuacuaauuuucauguuaguguuaauauuagugggcagucucuuuagggcuccacuaucaagaugaaccaacucugucuucaguucugugccacucaguucaauaggcuaauucccaggucagagucugauuugcuagcuacagcccuaggcccaacccuugaucuugauugacagccacaccaagacuguaucugguauggucccaguccaaucucgggaauggaggcucaauuuugugagugggcucugcauguggcagacccacagaugaaucucuguccccauuucaggucucagacucuccaccaggggaggacgacauggaaggcucagcugcuggggaugugucaggugcaggcucugguggcagcucuggcuggggcuugggggccggagaggaggcagagggcgaugaggaugagaacaugguguacuacuuccuggaggaaagcacaggcuacauggaacccgcccugcggugucugagccuccugcauacacugguggccuuucucugcaucauuggcuauaauugucucaaggugggcccauggccaugguucuggggcaagggcuuauuggcugggugggggugggggcagugcuggagcacuggcuggggcugggggcccucaaagugguugggacagagggggccuaggguuggggugagggcuggggaacuggguacaggauuggggucuccagcaaggaugacaggggucuccaguaaggacgacauucagauugggaacggacacggcuuauagcugaggaaccagguucuggaccacugucuugauacuuugcuauugaacuagaguucuuugggcuuaaaacuuucauacaugcuauucccucugccugcaauacuuugcccugcuuccaccuccuugcaccugccuguuuuauucauccuucaguucugaguucagaccucccucccuugggaagccccagguggcaucaggcaccacuccugggcucccacagcuccccuguucucacauccuggcccgaucccucugccugugccccacccccauuccagcccugaccccuauaugccccuacaucccagcccugacaccccugccugugccucuccacugccagccccgacugcucugccugugccccccaauuccagcccugacucuucuaucuaugcccccuaucccggcccugaccccucuaucuaugcaccacauuccagcccugaccccccugccugugccucccccaucccugcccugaccccucugcccauguuccccacaucccagcccuaagcccucugccugggccucauuucuacccuuaucacugggaaagcacuucugauguggggucacacacagaccccagcaagaugucauggcuucugcugagacuaugguccagccaaggugccugacgcccaccuuuggccuccucccacuauccaggugccccugguaaucuuuaagcgggagaaggagcuggcccggaagcuggaguuugauggccuguacaucacggagcagccugaggacgaugacgugaaggggcagugggaccgacuggugcucaacacgccguaaggacccagcccccaccucaggguggcagcaggaggggaccuggguuuccacccaguccaggccuggaccccaaaaaacuaggguuucgguccgggcacgguggcucacaccuguaaucccggcacuuugggaggcuaaggcgggcggaucacgaggucaggaguuugagaccagccuggacaacauggugaaaucccgucucuacuaaaaguacaaaaauuagcugggcgugguggcgggcgccuguaaucccagcuacugggaaggcugaaucagaagaaucacuugaaccugggauguggaggaugcagugagccgagaucgcaccauuacacuccagccugggcaacaagagugaaauuccacccccuuccccccagacaaaaaaaaaaaaaccuaggguuucagucccugcaggcccugccucauucuccccaagucuuacucuuucuuuccauaaaagaggcacauuucccaugcauuacagcaucugugugggugagguuggcacacagagauuccuagacuugaggccuggagguuccuguucagugacucuggggugugagcccaggaacccguguuuuaaacccugucuccaggugugauucuuacucaggugcaaugagugcaaaauaaaaaaacauggccaggcacgauggcucaugccuguaaucccaacacuugggaggccaagguggcagaucacuugaggucaggaguucgagaccagccuagccaacauggugaaaccccaucucuacuaaaaauacaaaaauuagucucuacuaaaaauacaaaaaguaggcaugguggugggugccugugguccuagcuacuccggaggcugaggcaugagaaucacuuaaaccugcgagguggagguugcagugagccgagauugugccucugcacuccagccugggcaacagagcgagacuccaucugaaaaaaaaaaaaaaaaggaaaagaaaaagaaaggaaaaaaaaaaaagaaagaaaagaaaucauuaggggcccuaggggccgcacucaguggcucacgccuguaaucucagcacuuugggaggcugaggcaggaggaucccuugugcccaggaguucaagaccagccuggacaacauagagagaccuauaucuuuagaaaaaaaaaacuaaaaaguuagccagacaugcuagccuggcuagcgcaugccuguagucuuagcuguuugggaggcugaggcuggaggauggcgugagcccaggaguucuaggcugcagugagcuaugauuaugccacuguccuucagccugagugacagagcaagacccuaugucugggggccaaaaaaaaaacaaguaggaauuggaagugcaaugaaucaaagcacuucaaauaauugcaaauccgugaauucauaaucaaucaucgcuccacccucucaaaaaacaaaacucguggcugggcacaguggcucacaucuguaaucaauccuagcacuuugggaggccgaggcaggcggaucacgaggucaggagauccagaccauccuggcuaacauggugaaacccugucucuacuaaaaauacaaaaaaauuagcugggcguggcagugggugccuguagucacagcuacucgggaggcugaggcagaagaauggcgugaaccgaggaggcggagcuugcagugagcccagauggcaccacugcacuccagccugggcgacagagcgagacuccgucucaaaaaaaaaaaaaaaaaacucguuggccauauuugaggauguuagggcaucaauuugucacuuggaaaacuggugaauaaagggccagaaucaugaaauuaaaugaaaucaaccaguaugaggaagcaggcaguugcacuggaguuggugcugaguuaggcugcuguuuuggacuccuccccacccaucaccacgccagagccucuuuaucagagugccauucugaggucuuuuuugcacaucuggcucugaaugcaaauucucugccucauuuggggucuagcaaagauggcagugggguccccacuguucaagguuccuacaagaaaagcaguggagccaggcgcagguggcucacgccuguaaucccagcacuuugggaggccaaggcgggaggggggaucaccugaggucagaaguuugagaccagccuggccaacauggcaaaacccugucucuacuaaaaauacaaaaauuagccgggcgugguggugggcgccuguaaucccagcacuuugggaggccaaggcgggugggggcaucaccugaggucagaaguucaagaacagccuggccaacauggcaaaaccucgucucuacuaaaaauacgaaaauuagccgggcgugguggugggcgccuguaaucccagcuacucaggaggcugaggcaggagaaucgcuugaaccugggaggcaaaguuugcagugagcagauaucacaccacugcacuccagccugggcaacagagugagacuccaucucaaaaaaaaaggaaaaagaaaaacaguggaguuucagccaacccugucguggcugacagcucugaucccucuggcccuaacaucuuauacucacgcuuucucucucucucucugcaggucuuucccuagcaacuacugggacaaguuugucaagcgcaaggugagaggacauggaugcccuggguccuggauugggucccugccugccaccaggccaucacaggccugccaagcacuugcuuggugugugaccuugggcaagagguuuuuuugccuuucugaguagcaccucaguuuccccauggggagaugggcauaguaagcuugcuucccuuucuugaaugggcacauggaaagagcagagcaucaaggccaagcgugguggcucacgccuguaaucccagaacuuugggaggcugagauggauguaacacuugagcucaggaauuucacagcagccugggcaacauggcaaaaugccgucucuaccaaaaauacaaaaaauuagcacgguaccgcaugccuguagucccagcuacucaggaggcugaggugggaggaucgcuuaaccugggaggcagaaguugcagugagccaagauugcaccacugcacuacagccugggugaaagagugagaccucaucucaaaaaaaauaauaauaacaaaaaauaagaaagcauagcauagugccuggcacagagugaauacucaagaaauacugguugaggccaggagcaguggcacacgccuguaaucccagcacuuugggaggccgaggugggcagaucacuugaggucaggaguuugagaccagccuggacaacauggcaaaacugcaucucuacuaaaaacacaaaaauuagcugggcaccuguaaucccagcuacuugagagacugaggcaggagaaucacuugaacccgggcggcagaggcugcagugagccgagaucgcgccauugcauuccagccugggugacagagcgagacuccgucucaaaaaaagagagaaauacuaguugaaagagaggaaguuagcaauaugucuuaagcacacacacucuggaaccagauugccugcuuuucuuuuguuuuuuucuuugagacggagucucgcucuguuacccagucuggagugcaguggcacaaucucagcucacugcaaccuccaccucccggguucaagcgauucuccugccucagccucccgaguagcugggauuacaggcacccaccaccacgucuggcuaauuuuuguauuuuuaguagagacgggguuucgccaugugggccaggcugaucucgaacuccugaccucaggugauccacccgccucggccucccaaagugcugggauuacaggcacgagccaccgcgcccagccgauugccugccuuucuauuucuggcuuauugaccuuucuguaccucauacucaaagugggguaauaauacggccaacccuacaggguuguuguauuauguacuacaugagcaguaucuggcauauaggagaacacuagauauguuggcuguuacuauaauucguucacucauauuuacggagcaccuauuaugugccaggaacaguuuuagaaaccugggaucccguguuaaacaaaacagugauucugaccuucaaguuggaaagauagaugaugaacccaaguacaguaugucaguggugauaaaugcuguagaaaaaaacaaagugggcugggcacgguggcucacgccuguaaucccagcacuuugggaggccaaggagggcagaucacuugagguuaggaguucaagaccagccugaccaacacagagaaaccccgucccuacuaaaaauacaaaauuagccgggcaugguggugcaugccuguaaucccagcuacucagguggcugaggcaggagaaucgcuugaacccgggaggcacagguugcagugagcagagauggcgccacugcccuccagccugggugacagagggagacugucucaaaaaaaaaaaugcaccucccauuucucacucagaguuuggaguguccccagaacccccuugcaggccacgacacacacccacacuccagcugugucuacacagccugaugcucucuugugcagguccuggacaaacauggggacaucuacgggcgggagcggauugcugagcuacugggcauggaccuggccacacuagagaucacagcccacaaugagcgcaagcccaacccgccgccagggcugcugaccuggugagcccaggacaccccugcacaggccuggggcaugcaggggaggugacuggagucugacacucaagcaucucuccccacccccgcccccacaggcucauguccaucgaugucaaguaccagaucuggaaguucggggucaucuucacagacaacgugagcaggggcccacagacuggggagggacucugcagggguggggcguuaggaggguucccaacgucggguguuccugaccaaagaaugacuccugggacccugaguggcugugacccuaggguaucuucuuauccacacaaggcuccuuaucccccuagacaucuuauuaguauuauuauuacuauuuuuuuuuaaauagcugggauugggugugguggcucacgccuguacucccaacacuuugagaagccaaggcugguggaucacuggagcccagaguuugagaccagccugggcaauauagugagauccucucucuacagaaaauuuaaaaauuagcuggggcugggcgugcuggcuuacgccuguagucccagcacuuugggaggccgaggcaggcagaucacuugaggucaggaguucaagacaaaccuggcacugggcauggcagcaggugccuguaaucccagcuacucaggaggcugaggcaggagaauggcuugaauccaggagguggaggcugcagugagccaagaucgcaccacugcacuccagccugggcgacagaaugagaauccaucucaacaacaacaacaacaaaaacacaaaaaauuagccaggcagacaggcacaguggcucaggccuauaaucccagcacuuugggaggcggaggcagagguuugcuugagcucaaacguuuaagaccagcuugggcaacuuuuguagagacggugaaacccugucucuacaaacaauacaaaaauuagccaggcgugguggugcacaccuguagucccagccacucaacaagcugcggugggaggauggcuugagcccaggaggcagagguuucagugagcugcaugugcaccacugcacuccagcguggauaacagagcgagacccugucucuaacaaaaaacagagaguggccaggugcgguggcucaggccuguaaucccagcacuuuggguugggaggccgagguggguggaucacuugaggccaggaguuagagaccagccuggccaucauggugaaacccaucucuacuaaaaauacaaaaauuagcuggguguggugacccacgccuguggucccagcuacuuuggaggcuaaggcaggagaaucgcuugaacccgggaggcggagguugcagugagcugagauugcaacacugcacuccagccugggcaacagacuaagacuccaucucaaaaaaaaaaaaaaaaaaauuagcugggugugguuacccacaccuguggucucagcuacuuggcaggcuuagccuccuucacuugaaccugagaggcggagguugcagugagcugagauugcgccauagcauuccagccugggugacaagugugaaacuccaucucaaaaaaaaaaaaaaaaaaagacagaggaagagaugauggagucucgcuauguugcccagacuggucuucaacuccugaccucaagugaugcuccugccucagccccccaaagcacuggggauacaggcaugagccaccacacccggcccagaacauccuuuggcucccucagugugcccuuagauugccagauuauuuccuucuggagggggcucucaucuccccgcaggaugccuucucacccggaaugcccugauccuccauguacuccccaaacagagcuggcacccgacccccagggcacagcugacucucgaguggccccuacccuccagagugcuccucgugugucccugccuucccccugaccccuggcccugugugcccacaguccuuccuguaccugggcugguauauggugaugucccucuugggacacuacaacaacuucuucuuugcugcccaucuccuggacaucgccaugggggucaagacgcugcgcaccauccuguccucugucacccacaaugggaaacagguguggggaggaccuggcuguggggcgugggccagcagggaccagcguggcaguggguggugaagggauaagggccgggcagcugggcugaggaggggcaaggccaggugcgcugagccggggguguguggggcagcaagguagagccacagggacugaaccggggccaggacccagcaugggcaggguggggggagggcaagcccagggcggagcugaccuggccccauccugcccccagcuggugaugaccgugggccuucuggcgguggucgucuaccuguacaccgugguggccuucaacuucuuccgcaaguucuacaacaagagcgaggaugaggaugaaccugacaugaagugugaugacaugaugacggugagccccuccccuagcacucugggacccuuccuucucgcaucuguugaaggaguuaauaaugguaccuccaggccgggcguggugccuccagccugcaaucccagugcgucgggaggccgaggcgggacgauuacuugaguccaggaguuggaaaccagccugggcaacaaagcaaaaauccugucucuauaaaaaaaaauuuaaacguuagcuggguguuguguugugugccuggaggcuaaggcaagaggaucacuuggucccagcaguuugaggcuuuagugagcuacgaaugggccacuacacuccauccuggcagacagacagagacccuaucucuaaaaaaugaaaauaguaccuacaguuuggcaagcugaugcaugccaggcacauuuuuuuuuuuuuuuuuugagauggagucucacuguguugccaggcuagagugcaguggcgcaaucucagcucacugcaaccuccgcuuccuggguucaagugauucuccugccucagccucccaaguagcugggacuacaggcgcaugccaccacacccagauacuuuuuguauucuuaauuuucuuucuuucuuuuuuuuuugagacagagucuggcccaggcuggagugcaguggcgugaucucagcucacugcaagcuccgccucccggguucaugccauucuccugccucugccucccgaguagcugggacaacaggcgcccgccaccacgccuggcaaauuuuuuguauuuuuaguagagccgggguuucaccauguuagccaggauggucucgaucuccugaccuggugauccgcccgccugggccucccaaagugcugggauuacaggcaugagccacugcgcccggccaauuuuuguauucuuaguagagacggaguuucaccauguuggccaggauggucuccaucucugccugugccgucgugaucugcccaccucggccucccaaagugcugggauuacaggugugagccgccgcaccuggccaugucagauacuuugaacagugccaggcauaugagugcuccacaccucuucgccauuguuucaauauuauuugagcugagguuuuuuguuguuguuguuccugagacagagucucguucugucacccaggcuggagugcagugacaugaccucagcuuacugcaaccucugucucucagguucaagugauucuccugcguuagccuccugaguagcugggauuacaggcgcacacuaccacacccagcugauuuuuguauuuuuaguagagauggaggugggggggucucacaauguuggccaggcuugucucgaacuccugaccucaaaugauccacccaccucggccucccaaagugcugggauuacagaugugagcaacugcacccggccuuauuugagcuuuucaaacuauuauuauuggaaagguacucagggagcgugccccugccacuuaugagccgugugauuuuggggcaggcuacucaaccuccucccuaugcccugggggccucaccuguaaaaugaguguguaauaguaguugcuuuuaggacuaauaggugcucccuggcuaucgaagacuuaaaagacuuagaccauugccuugcacgguggcucaugccuguaaucccagcacuuuggggggcugaggggggcagauuaccugagguugggaguuugagaccggccugaccaacauggagaaaccccauaucuacuaaaaauacaaaauuagcugggcaugguggcgcaugccuguaaucccagcuacucgggaggcugagacaggagaaucacuugaacccgggagguggagguugccaugagccgagauugcgccacugcacuccagccuaggcaacgagagugaaacuccgucucaaaaaaaaggaaaaaaaaaaagacuuagacuagugccuggcacauccucaggauuauauagauguuagcuucuaucaucauuauccacaauuaaaaguuucacccaggccgggcgcagugacucacgccuguaaucccaacacugugggaggcugaggcaagaggauugcuugagcuuaggaguuugagguugcagugugcuaugacugcgccacugcacuccagccuggguaacacauugagacucugugucaaguuuaaaaaaaaguuucacccaagguauacccagcguucaaugcacauuuauauuuucucuucuauucuaauaauggugaucauaacccaaauugaugcgaacuuacuagagacacaggccacaauccacaauuaaaagaaucauuucugggguuuaucuccaaagauguccugcagucuggcuccguggguuccucccugcucucaggacaaaguccagcuccucaaccugacaucugaggcucuuccagacacggccucgcugcccacagccucguucucauuauagucacuuaucuuaguuuuuacucuaggaugacuguguucucucacauccuggggacacggaaagaacaaguguaugccgggcgcuguggcucacgcuuuuaaucccagcauuuugggaggccaaggcagguggaucaucugaggucaagaguuugagaccagucuggccaacguggugaaacccugucuccacuaaaaauacaaaaauuagugggaugugguggugggcgccuauaaucccagcuaccugggaggcugaggcaggagaaucucuugaaccccggaggcggagguugcagugagccgagaucacgccauugcacuccagccugggcaacaagagcaaaacuccaucucaaaaaaaaaaaaaaaagaaaaaaguacaaaaauuagcuggguggggugacacgcaccuguauucccgacuacucaggaggcugaggcaggagaaucucuugaacucggugguggaggucgcagugagccaauauugcaccacagcacuccagccugggcaacagagcaagacucugucucaaaaaaaaaaaaaaacauauguaaaguuguucccaaaugccagguagaccaugcucccuccccacccccacucagacccuucuuguggcuccccagcccacuguagauaaagucgaaucacccugccguggcuuacaaagccugggaagggcuggcccugccugggucuaaccgcaaacccucuugcuuuuugcuuucuagccgccugguccucuuucaguuccccuaggacuguguguuuucucccaauucaagcccuuugcaccugauguucucucuguccccuaccccaggccugacauacacacacaccccauucacuugauaccucaccuuuccacuuaaaugccacauccuacaggaagccccuugaccgcgggcugggccagggcccacagagccacaugcccaggcccugccucaucucucccugcucuccugcacaggagcucuauuuuccagccucacccaaccauuuucaguuccucacagcagcaggauguacucuuuccucacugauggcgaggcagcauguggccuucucugcugggaacacucucccaccaccccuccaccuaaggccuccuuuagguuucagcucacaccugccuccucuuccaggaagccucaccugaucaccuaggcuggaucagaugccuccagcgggcuguuaaagcuuccagugcuuccccuagcucaucccuggucacacugugccuccccaccccagccucgacccucugccugugccccucccauccucgcccucacccuucugccugugccccccuauccuggcccugaucccuacaccugugcccccccccacccaucccggcccucaucccuccgucugugccccccauccaucccggcccugaccccucugccugugccccacuauccuggcccuaaccucucagccuguacccuccauccuggcccugaccccucugccugugccccccacccaaccuggcccugacccuucugccuguaccccccauuccagcccugaccccucugccugugcccccccaugcuagcccugaccccucucccugugccccccuauccuggcccugaccccucugccugugccccccuuauccuggcccugauuccccugccagugccccccaucccagcccugaccccucugccugugccccccuuauccuggcccugaccccucugccugugccccccauccuggcccugaccccucugccugcgccccacacccaaccuggcccucaccccccugcccgugcuguuccugucacagcccugaccauuucuggcuguuggucccugucugaugccguaucugugagcccuuugagggcagggcccagggcugucucagucguuaccaugucuucagcccugccuaucccggggccuuggcugguacucagugaaugucgaaugaaugagugaccagugugcuccccucccucaguguuaccuguuucacauguacguggguguccgggcuggcggaggcauuggggacgagaucgaggaccccgcgggugacgaauacgagcucuacaggguggucuucgacaucaccuucuucuucuucgucaucgucauccuguuggccaucauccagggucagugcugggagugggcgcucagggcccggaggcaggcuagcuccauggcuaagaaugcaggcccaggauccagucggccugcauucauaccccaucucuaccucucgcuacugugagaccuugggcaagucaccucucggggccuccguuucuccaucugcaaaacgagggugucaaugguacuaaccucauagguugugaucaggauuaagucaguucauaggcgcucggugucuggcucauaugagugcucaauaaaggccugagauauauauauauauauauguuuauuuauauauauauguguuuauauauauuuauauauguguuuauauauauuuauauauaugugugugugucuauauauauauauguauaauuuuuuuuuugagagggagucucgcucuguugcccgggccagaguucaguggugcaaucuuggcucacugcaaccucuaccucccagguucaagcgauucuucugccucagccuccugauuagcugggacuacaggcacaugcuaccacacccagcuaauuuuuuuuauuuuuuuauuguuaguagugaggggguuucaccauguuggccaggcugcucuugaacuccucaccucagaugauccgcccaccucagccucccaaaguacugggauuacaggcgugagccaccgcacccggccaauaaaggccuaauacuaucuucuuaggaagcgagauuaggggugagauuagggaaaugggggauggagggcaagcccuggagguagguagcuggagaggggggagucugaaccaggucagaggucgggcacugacuuguguccugccaccccaggucugaucaucgacgcuuuuggugagcuccgagaccaacaagagcaagugaaggaggauauggagguaggucaugucugggggugacccagagggauuacgggauucagggggucaagugggccuccacucugaugucucuugccacucacagaccaagugcuucaucuguggaaucggcagugacuacuuugauacgacaccgcauggcuucgagacucacacgcuggaggagcacaaccuggccaauuacaugugagcagacacacuggccagucaggaggguggggggcauggcugccaauagccagcagugggguacuuagcuuuggccaguuaggaaaggggguguaguguccaugugggcagauucccugccagccaaucagaagguaaggguggggccccgcaagaugguucacaccuguaagcccagcacuuugggaggccaaguggggaggauuacuugaggccaggaguucgagaccagcuugggcaacauagcaagacuuccucucuacuauaaaugaaaaauaaaauaagguaagggugguucugacuugucuccugugguccucucacccucagguuuuuccugauguauuugauaaacaaggaugagacagaacacacgggucagguaaggggguguuaaugggaggacagugggcaggacguggagcccuuuaacauaaggccagucaguagguggcaguaaaaagcuccuaucaauaucaaggguuagggcugggggcugggcacggcggcucacgccuguaaucccaacacuuugggaggccaaggcggguggauuacuugaggucaggaguucaagaccagccuggccagcauggugaaauucagucucuacuaaaaaugcaaagauuagcagggcgugguugugcaugccuguaaucccagcuacuuggaaagcugaggugggagaaucgcuugaacccaggaggcagaaguugcagugagccaagaucaugccacuguacuccagccuaggugacagagcgauacuccaucucaaaaaaaauggguuugggcugggcguccuggcucacgccugcaauccuagcacuucgggaggccacagcgggagaauugcuugagaccagaaguucaagacagccuaggaacacagcgagacccuuucucuauuaaaaaauuagccaggggugguggugugcaccuguagucccagcuacucuggagacugagguggagaaucgcuugagccaggaggcuguagugagcugugauugucgccacugcacuccagccugggcaacagagcaacacccugucuaaaaauauauauauauauaugucucaaggguuugaagaugugaccaaugaacucuuucuauccccaauccuaggagucuuaugucuggaagauguaccaagagagauguugggauuucuucccagcuggugauuguuuccguaagcaguaugaggaccagcuuagcugacacacccccagcuggcccuccacccccaccucaagugccuuauucucacagcaagccccuuaguccccaagccccucccccuaaggcagcugggggagaggugaccuaguacuggaaaauaaaucugugcuacgccccccagca

SEQ ID NO: 191742 - RNA, 9166 nt, Homo sapiens
ugccgcgccuguagcacucccggaacuggaacuaggugccagacgguccggaggcgggggccacgucagcggggccacccagggcucgcggggucccggugggugccaugcggaggggcgcgcuucuggcgggcgccuuggccgcguacgccgcguaccuggugcugggcgcgcuguugguggcgcggcuggaggggccgcacgaagccaggcuccgagccgagcuggagacgcugcgggcgcagcugcuucagcgcagcccguguguggcugcccccgcccuggacgccuucguggagcgagugcuggcggccggacggcuggggcgggucgugcuugcuaacgcuucgggguccgccaacgccucggaccccgccugggacuucgccucugcucucuucuucgccagcacgcugaucaccaccguggguacguaagcgccucaccgcaaggcggcgaggacccgggauccccacuucauccuuaaccccuggggaccccggggcccucacgaauacccuuaucccaauccccucugggcuucggaucccccgaaaagaccccagugaggacccgggacccaggcucaugauaucugcucugcucggggagcccaaguccgagcccuuccuccuaaguaggaaacacccagcuccccucagaguaccuuugcagagaccagcugggaccccguuccucggucuuuuuuuuuuuucuuuucuuuuucuuuuuuugagacagggcuuacucugucgcccaggcuggagugcaguggcacgaucucggaucacggcagccuccgccucccgguuucaagcuauucuccugcuucagccugccgaguagcugggauuacaggcacauaccaccaugccuggcuaauuuuuguauuuucaguggagacggaguuucaccauguuggccaggcuggucccaaacuccugacuucaggugaucagcccgccucgcccucccaaauugcuggcauuacaggcuugagccacugcacugggacugcauuccccggucuuaauccucuuggugacccgggucuguccagcccccucuaagccuaggacuguccucagagaccuccagcaaggacccaggacacgccacccuccaagggagauccuugcccccucuggacccagaacucaaccaugccaggaccccugacuuuaucucuagucugggccugccacccuugccaugucuccugacccuccagauauguccuucugggaaaccccccuggagaaaccccaucucaaccuccuccugacccuggcgccuuagcgaggacccuaaaucuccagaccucucaggguguccucacuaaagaccucccucccaacagagauuccucagcaaggaccuggcaccgccaucugggacuccuggcccucuggaccugggccucugcuccagacugucaucugucuccuggccccauacuccccagcaggcaacucugaccccagacacaaaacccuucccuagguaccccaccccaucuugacaucuccccuauauggggucacucucaaugcaggauuuuccucccaauagggacaccaccuguucccucuggaccugggacucccaauucagcagccccagcuagggaugugucaaaaggacccaccguggagggaccccgaguuuugggaaacccugagaagccagacuugggaaaucucuuuguugccaggcucugcugcucccccagccccuucucagcucccagacuuccucuuuguuucuuuguuggggauuuguugaggagaggaggcuggugcaggguuagcccagacuccuaacucgcccucccggccaacaauagggggcagcuuuugcuuuugguccccuggcagcagagcugggugacuucucguuagcugaccuccccugggucugcccaugcugccagggcggccugaccugcuucugagcuucccugggucaugugcacgccuccuaccucuucccagauccuggcuucuaagaagucaucccuggcagggcagaugagggaagccagacacacgucaggcacagccuggcuacaucccugcucagccgcggcucauugccaggccucaguguccucccccauugcuaaaauggagauaauaacacuccccauuucccuguaauagcaguagccugacagaggacuugccaaugcaugcuuuaacucacuuaaucaucacaacagccuugugaggcaggcgccuuuauaggcuguauauuuuuagccauggaaaccgaagccuagagaaguuggguaacuuuccuaaggucacacagcaaagacggcauagaguagagauuuagucaaggccaucaggcucuagagucccaugcugcuagccaacacaccacacuacuuagaagaagggugcuguguguguuguaaaagaaaaaaauaugcuaacacuuguuaaaaauggaaaguuauugugguagaggagagaccauugcaaaggccagagagacugaacucaacugugaauauagcaaacacagcuggaguuuuauggcuaacaaguagaauaagggagucaguggauggaagaauacuaagaggagagacauucggguagggggauucuugcuaaacucagcuuaacaagauucuugcuaaagacaggccaaggacuuagauauugagaggggguggaugagggccaggcgcaguggcuuacgccuauaaucccagcacuuuggagggccgaggugggcagaucaccugagguuaggaguucgagaccagccugaccaacauggugaaaccccgucuacuaaaaauacaaaaaucaaccgagcauuguggcaggcaccuguaauuccagcuacucgggaggcugaggcaggagaaucacuugaaccugggaggcagagguugcaauaagcugagauugugccacugcacuccagccagggcaacagagugagacuccaucucaaaaaaacaaaaaacaggccgggcaaguuggcucacgccuggaaucccagcacuuugggaggcugaggcgggcggaucaccugagguuaggaguucgagaccagccuggccaacaugacgaaaccccaucucuacuaaaaauacaaaaauuagccaggcaugauagugcguggcuguaaucccagcuacuugggaggcugaggcaggaggaucacuugaaccugggaggcggagguugcagugagccgagaucucgccccugcacuccaggcugggcguuagagcaagacucugucucaaaacaaacaaacaaaaaagagugguggaugaggaauuugaucagauaucgggguggguggcuuguaggauucuugcuaaaacugggccuacuuaaggacucaggagucagacugaagugcggucaaggagggagucuuuguccgugcgaagcgcugguaauaacugauguuuauugaguuaauguugacuguuuucauagugggugaagccuugaaugcaucuggagaaguggaaaaccaauuaaacgugauucagagagaccucuucccacaaugccccucguuuggucauaggcccaaaucuuggcccuggaauugaucugggcagccuugcugcacuugaggcaggaggaagcggguaguccuacccggaacugggaaucggagagaggaagugagcauuacaauccuuguaacucuuuccacgcucuugcuaggcacuaugcccuaucccagccuaguaggauuacuaccacauuugaggaagggauuguuuuuuguuuuucagacagggucuugcucugucacccaggcuagagugcaguggcgcagccuugaccuccugggcuuaagugauccucccaccucagccuccugaguaguuggaaccacacgugcacgccacugcacccagcuaauuuuuuuauuuuuuauuuuuuguagaagguggucucccuauguugcucaggcuggucucaaacuacuccuaggcucaagcgguucuccugccuuggccucccaaagugcuggaauuacaggugugagccaccuugccuggccaggaagggauugcuuacgagcccauuuuugcagagagggaacugagccucagaggggagaagucaucuggccaaagucaugcagggaguaaauggcaaaacacuguuuuggacucuucucuuugaaauaguaacuugaggcucacaggccccaugcuuuucaaacucuaugauuugucuauuuauaaagaucucuuuuauuauuauuauuuuuuuuuacagagauagggucuugcuauguuacccaggcuggugucaaacuccugggcucaaguaauccucccacuuuggccucccaaagugcugggauuauaggaaugagccaccucacccagccuguuuauaaggauuucaugucauuugcaaaccugccaggcugcuggaguuuccccaucaaaaacccuuguauuaaugaggguugggggucauaagugauacaccucaaauuacaguugcuuaaauaagaaguguauuucuuguucacauuccagguagucaguccaagucguacugcauggucagagaccuaggcuccuucucagcaaaacccugguguuccugccuaacuccucugcgcaacuuccauucccaaggucgccuaaugguccaagauggcuguguagcuccagccuccaugucugugcuccagccagcaagaggagggaggaaagaagggagacuggcaucccucgcuccuuaaggacccuuccuggaaguugccugacucuuucaugaauaccucauuggccagagauuagucacagaaccacaccuggcucugcaagggaggagggaacguccugauuccaaaaggccauguauccagcuaaaacccagggggagccuuuuaaaauuauuauuauuguuauuauuuuuuaaaguagagauagggucuuccuauguuacccaggcuggucucaaauuccugggcucaagugauccucccaccuuagccuccuagagggcugggguuacaggugugaaccaccaugccuggcugggaucauuucuuuucccaaguuuuuuauuauaguaaaauacacauaacauaaaauguaccaucuuagucauuuuuaaggguacaguucugugacauuaaauacauucauauuguuaccaucaucaccuucaucuuuuuuuuuuuuaauagauacgaggcuggccaugccaugugggagauggaguuauugcucaacucaaaucacucuccaccauccaucucuaaaacuuuuuuuuuuuuuugagacggauucuugcucugucacccaggcuggaaugcaguagcacaaucuuggcucacugcaaccuccaccucccagguucaagugauucuucugccucagccugcugaguagcugggacuauaggcgugagccaccaugcccggcuaauuuuugcauuuuuaguagagacgggguuucaccauauuggucaggcuagucuugaacuccugaccucauaaucugcccgccuaggccucccaaagugcugggauuacagaccugagccaccacgccuggcccauugucucgcccauuuuagaauagggcaagcugaggcucagagccaggcaagagccugcacccuucauucuuuguuuugagaaguacugaucgagcgcccacagcagugaugaaacacgcagaaccuccugcuuugcugaacuggcagccuaugagaagacgguaaaccauagagcaugcuagaagguguuaagugcuaugggaaaaaaaaguguuggguaagaggauguuaccauuuagggugcucaagggaaagccucacugagaaggugacauuuggaugaagaagaccuggagaggagagaggggagcauucuuuggggaaggaacaaccagugcaauggcccuggggugggagcgugcugcccugguggacccuguggggcuucaugggucaugaugaggacucuuuccuuuuaccugagugagguggggccacagaggggcucugugcagggaaggggcaugacugaacucagguguuggcaggcucugcuggcugaacagauuguaggggcuggggauggggaagggagacccaggaggaggcugcugugguggacaggaccagggugggggccaugggacugggugggggagaaguaaguggguuuugggccuauuugaaaguugagauaauaggcuucacugacagauggagugcggcaugagugacgagggcgucagggaugaaggcaaggcucuuggccugagcgucgaaggacagaggugccaucaccugggacaggaggggauguggggagaggcagguuugggaugaagccauguguagguguggguguccgcagaccucucgcugcagguguugagugggcaggaggguuuucccuggcuggguccuggggaucagaucuguaacuccaacaccuuggaaggcaaaggugggaggaucacuagaguccaggagcucgagacuagccugggcaacauaguaggaccccaucucuacaaaaaaauuuaaaaucaacggggcgugcuggacaugccuguagucccagcuacuuaggaggaggcugaggugguaggaucacuuagguccaggaguucaagacugcaguaagcuaugauggcaccgcugcacuccagcccgggugacagagugacccccaucucuaaaaagaaaaagauuuacccuuuacucucuuuacuccccuaggcuauggguacacaacgccacugacugaugcgggcaaggccuucuccaucgccuuugcgcuccugggcgugccgaccaccaugcugcugcugaccgccucagcccagcgccugucacugcugcugacucacgugccccugucuuggcugagcaugcguuggggcugggacccccggcgggcggccugcuggcacuugguggcccuguugggggucguagugaccgucugcuuucuggugccggcugugaucuuugcccaccucgaggaggccuggagcuucuuggaugccuucuacuucugcuuuaucucucuguccaccaucggccugggcgacuacgugcccggggaggccccuggccagcccuaccgggcccucuacaaggugcuggucacaggugagcuggguggcuagggcagggcuuugaggaggaccuagcccugucccugggggaguuaaaggcucacagucccacucugggacuuccaaaagggauccaaccccacccugcaggguccaguagaacugcggccccgccuggaaaaucugagccccaggaugaccaacgccccuucuccgccuuuacagucuaccucuuccugggccugguggccauggugcuggugcugcagaccuuccgccacguguccgaccuccacggccucacggagcucauccugcugcccccuccgugcccugccaguuucaaugcggaugaggacgaucggguggacauccugggcccccagccggagucgcaccagcaacucucugccagcucccacaccgacuacgcuuccauccccagguagcuggggcagccucugccaggcuugggugugccuggccugggacugagggguccaggcgaccagagcuggcuguacaggaauguccacgagcacagcaggugaucuugaggccuugccguccaccgucucuccuuuguuucccagcaucuggcugggaugugaagggcagcacucccuguccccaugucccgggcuccacugggcaccaacauaaccuuguucucuguccuuucucucauccucuuuacacugugucucucuggcucucuggcauucucgcugccucugucuuucccucuugcugucucuguuucucauucucuuucauguuccgucugugucucucaauuaaccacucgucaacugcugauucuacugggcugugggcucagaccucauuucaggcaccagauuggucgcuacacccuggacaagugacugcccgucucugagccuugauuuccucagcugccaaaugggaagaauagaagaauuugccccuaaaccccuccugugugcuggcccugugcuagacagugcuggagacauaguuggggguggagaacugcccuuauggagcuugcaguccagugagguggacagaccuguccccagacagugauggcccaaaauggucaggacuuuaauggaggaggugagguguugaaagcacaggcagaguggucagggcugaagucggagaagcauagggacuaggcccaauccagccuggaaagucagggaggacuuccuagaggaagggacaucgaacuaagaccugaacuaugagaaauaggcaggaagaaguuguaccugacucauuuuucucaggugucuccagggagcaggacccauggagggaccccugguguaggccugggcgauagacucuuccucagcagccuggcaggcaggaaacagacauaggaccccagcccagaucugaauggcaugggaggugcugcccuuaaccaugacaccauuguaagagcuguccacauuuguauguugugcccuggaaucagccugguugagcucaaaucccaacuuagccacgucuggccuguguccuugggcagucacacuaccucucugauuuuguuuccuuaucuguaaaauggugaucaucauaauacaacuucaaaaggauuucaggcugagugugguggcucacgccuauacacccagcacuuuggaaggcugaggaaggaggaucgcuugaggccaggaguuugagacuagccuaggcaacacagugaggccuuaucucaacaacaaccacaaaaucuaaaaauuagcugggugugguggugcaugccugugauccuggcuacuucagaggcugagguggaaggaucacuugaggccaggaguuugaggcugcagugaguuaugauggcacugcugcacuccagccugcgggacagagugagacccugucugaaagaaagagagaaagaaagaaagaaagagagagaaagaaagaaagaaagaaagggaaagauggaaggaaggaaggaaaaagaaagagaaagagagagagagagaaagaaaaagaaagaaaaguaagaaagaaaaaagaaaaagaaagaaaaguaagaaagaa

SEQ ID NO: 191743 - RNA, 12246 nt, Homo sapiens
ucgguuggcgaggucacugcaggucagaggucacgagaucaaggaucuggaacccugaggugugcacagcgcugggaugccagguucggguaggaggccccuuggggggcgauucuuuaggaaauuccuuuagaagaaaacaacuugggacuggauagcgugcgauaugcagagaaaugcaacuuucauucauuugcaguuagcgauccgcccuucccugcuccccacccuuccguggcuccccaguacccgccugcugucgcccacacccuuaggacagcuucguggccccccgggagcgcagagggccaugccuaccgcucauuuaagaagcgaaccuguauugugcuguuggcccccuuuuccugucucuucaucuccgugagugugcuguguguuucauuuauucauucaaccuaacuugucucaacucccaugugucaggcccuguguugggauggagauguugugggagcccugaggaggcacaugacccagccuaggggugucagugaagcuuccuggaagaggauacuucuuuuucuuuuuuuuuuuuuuuugagaccuaguuuuguucuuguugccaaggcuggagugcaauggcgcgaucucaggucaccgcaaccuccgccucccggguucaagcgauucuccugccucagccucccaaguagcugggauuacaggcgcaggccaccacgcccggggugguauagacgggguuucuccauguuggucaagcuggucucaaacucccgaccucaggugauccgcccgccuaggccucccaaagugcugggauuacaggcgugagccaccgcacccggcauggaagaggauaauucugaucaugaaaaguuacccaggagaaggagauuuguagugagagggcaggcugggcgugcuggccuacaccuauaaucucagcacuuugggaggucgaggugggcgaaucacuuggggccaggaguuggagaccagcuuggguaacagcaaaauccuaucucuaauaaaaguacacaaaauuagccgggugugguggcgagcaccuguaaucccggcuacuugggagucugaggcuugagaaucacuugaacccaggaggcagagguugcacugaggcgagauugcaccagccugggcgacagagcaagacuucgccucaaaaaaaaaaaaaaaaaaaaaaaaagagggugauccaccugccuuggccucccaaagugcugggaucacaggcaugagucacggugcccagccaaccagccuggccaacaugaugaaaccccaucucuacuaaaaaugcaaaaaaauuagguugggcgcagugguucacaccuauaaucccaggauuuugggaggccgaggugggaggaucacgaggucaggaguucgagaccagccuggccaacauggugagaccccaucucuacuaaaaauagaaaauuuagcugggcgugguggugugcgccuguagucccagcuacucaggaggcugaagcagaagaauugcuugaaccugggagguggagggugcagugggccgagauuucaccacugcacuccagccugggugacagagugagacuccaucucaaaaaaaaaaaaaaaaaaaauuagccgggcgugguggcgcgcaccuguaauuccagcuacucgggcggcugaggcaggagaaucgcuugaacccaggaugcggagguugcagugagccaagauugcgccauugcacuccagccuaggcaacgagcgaaacaacgccucaagaaaagaaaaaaaagagagagagaaggaaaggcauuggaggccugugccaaguaaacaaguagacauaugaauauauauucagaaauuauugugagugcucagaagagaaaaagaaagcaccacauguuaugagaaggaaccagacgagguuagugcauuacagggaggagugaggaaggucucugcaaaggcaggggccucugugugauauugggaggugcugauggagggagguuguuccaggaugaaagcucugcauauucaaaagccagugggggcaaggagcuuggcagagucggggccugaaaggccauguggcuggcuggugcaugggauccccaggagagguugcaaaccauggugguuggcaggagugggucaugcagggccuagcaggccuuuggauuuuuuucagagcacagugaauagugaucuuaggcagaggaugacguggucuuauuuguauuuaaaaagaucacucugggccggguuagguggcucacgccuguaaucccagcacuuugggaggccgaggcgggcggaucaugaggucaggagaucaagcccauccuggcuaacacggugaaaccccgucucuacuaaaaauacaaaaaaauuagccgggcgugguggugggcgucuguagucccagcuacuugggaggcugaagcaagagaauggcgugaacccgggaggcggagcuugcagugagcugagaucacgccacugcacuccagccugggugacagugagacuccgucucaaaaaaaaaaaaaaaagaucacucugggucaggcacugguggcucacgccuguaaucccagcacuuugggaggccaaggcaggcagaucacuugagcucaggaguucgagaccagccugcccaaaauggugaaaccccaucucuacuaaaaauacaaaaauuaccugggcuugguggcgugcgccuauaauccuagcuacacaggaggcugaggcaggagaacugcuugaacccgggagguggagguuguggugagccgagaucgcaccauugcacuccagccugggugacaagagcgagaaucugucuaaaaaaaaaagaagaagaaguaggggaaagaaaagggaaguggggcuugcagagaggcuggggccagugcugcuugccuuggaauugaggagaccuggguccgucuucaggcuucgaauaauugagaggaaggguucgaggcuaguagcugaucaggagugacauggauggacugcuuucuguggggccaaggaguuuaugagugucacaacagcucugcaaggugggacaguuaacuccguuguguagaugagaacauccaggugcagagaaagucaugacguggauaauucgauuccucuccccauucccacugucaucugaucacucauucccugugccugcaauaguggguggcacauaguaggaucucagcagauauuugcaggguagcauugguuauugauuaggaacagaggcccuggaggcagagugcuggguucaaaucccgcccucccuauuuucuccaucucaguagagagcacucccauuugccucauuacucaaaccaggaucuauagagacaguauuggcucuucccacuucuuuuuuuuuuaaagagggccuugcugugucgcccaggcuggagugcaguggcaugaucuuggcacugcagccuugacaucccagguucaagcaguccucucaccucagccucuugaauagcugggacuacaggugcacgccaccaugcccugcuauuuuauauuuuguagagaugggguuucacuauguuggccaggcuggucuugaacugaguucaggugaucugccugucucagccucgcaaagugcugggauuauagacgugagacaccaugcccagccucuuaccacguuuuuuguuuuguuuuguuuuguuuuuuugagauggagucucgcucuguagcccaggcuggagugcaguggcgcgaucuuggcucacugcaaccuccaccuccccggucccgguucaagcaauucuccugccucagccuccggaguagcugggauuacaggcacgcaccaccaugcccagcucauuuuuguauuuuuaguagagaugggguuucaccauguuggccaggcuggucuugaauuucugaccuggugauccaccugccuuggccucccaaaaugcugggauuacaggcguaagccacugcgccuggccucuucccacuucuuaacacaccuccucugagcaccccucagcaaguccugucccuccuagcucugaaacugauccagaaauaacccauuccucuuuuacacccccaguccugucugccauggucucccaccuggaucaccccagcagccucucucccuucccugcccaccccucaucuguuccccacgugaggccacagggaccuuuuaaaaacuuuugaaaccuggcucucauacuaugacuuugggcaaaggccugagccucuuuagggcuugcuuuucucauauguaaaauggggaugaugauagcauuggcagcuggcagaaacagggugguugugaagaugagaugaguucauccacaggauuauuguaauauuuaucaggcacagcagggcuggacuccugcucugccacucacucaguuuggcccuuugcacaagucauuuuagcugucugggccuugguuuccacaccuguaaauugggaguggucauuuauucuguuuuuuguuuuuuguuuuuuuuuuuugagacagggucucacuguguugcccaggcuggagugcaguggugcagucucggcucacugcaaccuuugucucccaggcugaagcgauccucccaccuuggccucccgaguagcugggaccauaggcgugaaccaccacaccuagcuaaucuuucuauauuuuguagagauggggucucgccauguugcccaggcugccuuuauucauugaucagguuuuuaucaagugccuacucuaacccugugcaaggggcuggggacucagcugugaacgagaucaagauccccaccuugggggacucacaguugagugggggagacagugaacaaaauaagacagccagcaugucagcuagugccgaguucuauggauaucagugaagcagggcaggggguggggagugccaccaagggagguacgguuguagacaggauggcuggggaaggccucacugaacaaagcccuugaggaggagaggagggagcucugaggauguugggggaagagcguuccaagcagaggcacagcuggugcagcggccuugaggcaggcaccuuccuggugcauucagugagcauugggaggcgcagguggcuggagccaagucauugagggggagcauaggagauauggacagcggccuuguguaaaaggcuugguacaggauuuugugcccaauagcccccccuuccucucgcacauaguagcuuuugagauaaucaucaucauugauaucuggauggauggaugauaaguggaugggugggugggugaauggaugguuagauggauggaugaugauggauggauggaugauagauggguggauagaugaaugaguugguggauggauagauagcuuggugaguggauggauggauggauagauggaaagauaaaugcaucaguggauggauaguuggcuagauagguggguggauggguggauggauggguggguggguggauggaugaauggguagguggauggauggauggguggguggguggguggaugcaucauuagauggauaguuggcuagaugggugguggauggauggaugguuggauagguggauggauggauggauggauggguggauggaugaauggauggauugauggguggguggguagauggauagauggauagauggguggguggauggaugaauggauggauugaugggugggaggguggauggauggauggguggauggaugaauggauggacagaugaaugcaucaguggauggauaguuggcuagauggguggguggauggauggcuggauggauggauggaugaauggauggauggauggaugguuagauggauagauggauggaugggugggugagugggaggguggguagauggauagguggauggauggguggguagaugaauggaugcauagaugaauguaucaguggauggauaguuggcuagauggguggguugguggaugaauggcagagcuugcaccugccaguccaucugacaucaaagccagugucucuaauggugacaccacccuccucugcagcaggaggcagagcugugggaugaaugagguucgccaggucucccuuaccuauccuggguccccagcuccuucucacucucuucccuugcagccucgaagcggaggaucccugugucccagccgggcauggccgacccccaccagcuuuucgaugacacaaguucagcccagagccggggcuauggggcccagcgggcaccugguggccugaguuauccugcagccucucccacgccccaugcagccuuccuggcugacccgguguccaacauggccauggccuaugggagcagccuggccgcgcagggcaaggagcugguggauaagaacgugagugggcggggcuggugggaguggggggaugcacggggccacagggcuucagacuugagcucugccuccccagaucgaccgcuucauccccaucaccaagcucaaguauuacuuugcuguggacaccauguaugugggcagaaagcugggccugcuguucuuccccuaccuacaccaggucagcacccccaggggaaugugggucugcagugggccuguggggggcucaggggugggggcaggugcaugguggagccgggagauucgccucgagggaggagggccuguagcagggugggaggggccuggcucugaggguccugcccgucuccccauccccgcaggacugggaagugcaguaccaacaggacaccccgguggccccccgcuuugacgucaaugccccggaccucuacauuccagguuucacccucccccuacccugcacccuccucucucuuccgggccuauauggagcgggugugugggugccuggaggcccagggcaguucuuccucuggugaccagugucugugugucugucucccacagcaauggcuuucaucaccuacguuuugguggcuggucuugcgcuggggacccaggauagguaagggaggccuggggcaggccgaauaaggugggguuugggaggcccaugguuggucaggaaggucucaguuccaaggucucaguuccccuuucaggacagccccacuuugcucccaguuggcccaagauacagcccucagggucacugucagcaucacccucgccucuucccuguccuuccuacccacaugcauugcgucaccauccccugugcugggugacccuucuccauccacccuuccucuuggccucuacuaccagacccauccucauccucccucugucaucaccagcuccccacugcaccccuacuccagcagcagccaggaugguccugucugaggugcgggccuggcccacccugccccgcccugcuauccauggcucccaaucaagccccagcuccucagccuggcacugccccucccgcugcacgcuccggucuauuccuuuccuugggagggcuggcacugucuccuggggccuugucacaucaacuccccucugcccaggagcguguuccccuccacuacugccgaguaccugcacaucccugcuggcuccauuccaguaucaccuccuccgggaagccuuccugccccccaggcuagaucaggccccuccucuugcucacaucgcccuguucuuuuccuuuauggcacugaacacaucugucauuaacuaacuggugaggcccuggggauguggcagaggccaagggcuuugucccugaccagcuccuuccugcaggcuucagcucgguguccccucuccugggaagcccucucugacaccugucuccugacugucagcacagcccccugugacuccagcccugccugcucugggugucacugucuagggaugggucugccauccucucuggaugggauuuccgugggaauaggauagcgcgcacauccaucuuggucacugccagguguccagcccuacccaacacagagcuguccccagaugggugcuggggguggggggucugaaccagccaaccaaguggcggggcuuugugccugcagguucuccccagaccuccuggggcugcaagcgagcucagcccuggccuggcugacccuggaggugcuggccauccugcucagccucuaucuggucacugucaacaccgaccucaccaccaucgaccugguggccuucuugggcuacaaauaugucgggugaguacccccgcccuucacgccagccccagcccuugggccuuguccucacacagccuccucucccucccccaggaugauuggcgggguccucaugggccugcucuucgggaagauuggcuacuaccuggugcugggcuggugcugcguagccaucuuuguguucauggugagcugggcucggggcuggugaggcugaggcacaggugccccggaggcauccaggcauccaagcagaggaugucaggugugggguucagaccagagacacauugcugaacugaggagcccuggaguggcugcccggccuggggggucaggagggcuuccuggaagaggggguauccugagcccuggaagaggagacaccagccaggcugcuagaggcuggggauccccagcacacaggcuccaggcugggcucucacucucauuccacucuccuuacaugggagccuuccugccagaauuucccuggaaggagauucucuagagcccuucccacuggagucaggggugcuggugaagagcacuggggucugcaggcuggguggaccccaagcuuaguuggauccugggcaaaucacuuccuuucuuuaaauucaguuuccccuuuugccgggcgcgguggcucaugcuuguaaucccagcacuuugggaggccgaggcggucggaucacgaggucaggagaucaagaccauccuggcuaacacggugaaaccccaucucuacuaaaaauacaaaaaauuagcugggugugguggugugugccuguagucccagcuacucaggaggcugaggcaggagaaucgcuugaacccaggagguggagguugcagugagccgagaucgcacaccugcgcuccagccugggugacagagcgagacuccgucucaaaaaaaaauaaaaauaaaaaauaaacucaguuuccccuuuuguaaaauaggaugaugauacuugcaccucaaggugcugggaggauucacugugagcaugugagaagcagagggcagacugugguggcuggugggccagggcagagccuuggauaaacuuugacuuaagucucaucauuuaaaaguuuaggccaagcacgugacucacaucugugaucccagcacuuuggcaggcugaggcaggaggaucacuggaggccaggagcuugauaccagccuggacaacauagcaagaccccaucucuaaaaaaauauaaaaauuagccaggcauagcagugugcaccuguagucccagcuacucaggaggcugaggugggaggaucacuugagucugggagguugaggcugcaguaagcugaggucacgccacugcagucaagccuggcggacagggugagacccugacuuuuuuuuuuuuuuuuuuuuuuuuuuugugagacagagucucgcucugucgggaagcuggagugcaguggcgggaucuuggcucacugcaaccuccgccucuuggguucaggagcaagucuccugccucagccuccugaguagcagggacuacaggcacucaccaccacgcccagcuaauuuuuguauuuuuaguagagacgggguuucaucguguuggccaggauggucucaaucuccugaccucgugauccgcccgccuuggcuucccaaagugcugggauuacaggcgugagccaacgcaccaggccagagacccuguccuuuaauaaaaauaaagauagcauuucuggcgugucuucagaaauugccguguggccagcauaagggggggcagcauccugggccacgucucccacccccucaggccggguguccaccgggaagucccccuucacccgcuccaagaccuugccuggcauuugaguauggaaccuucucagauuuugcccacagggcccggggagaagcaaauccucaccauguuaggagguuuggggaaacugaggccccgggagcagaaaccugaggcugcagagggccagggacuuguccccagcugccuggggcuucuaggcagaggcuggaaguauguccgggcucucacucuggcccagagggcucaaggguaaaucccuugguuccucucucucuuucccacccagauccggacgcugcggcugaagaucuuggcagacgcagcagcugagggggucccggugcguggggcccggaaccagcugcgcauguaccugaccauggcgguggcggcggcgcagccuaugcucauguacuggcucaccuuccaccuggugcggugagcgcgcccgcugaaccucccgcugcugcugcugcugcugggggccacuguggccgccgaacucaucuccugccugcaggccccaagguccacccugucuggccacaggcaccgccuccaucccaugucccgcccagccccgcccccaacccaaggugcugagagaucuccagcugcacaggccaccgccccagggcguggccgcuguuacagaaacaauaaacccugaugggcauggcguggacagccucuccuuggccucgcgcacgaaugggcgggcccagcgcugggcagggggcagggagcuggggacgggccagaguaggcaccacgcugaccagucgcagaaggcagagaggaagguuuaaugagcccuguccagggcccuucaguggggagccuccuucuucuugcccuucuccuucuugcccuucuccuucuucuucacuuugggcuucuuggccuugcccgggaugcucucgugcugcuuggagccagcagcgugggacuguggggccgagggcagggaugggagagaagagaugguucugggcuggaagcgagacagggggaccacuccccgcacccuccccgccagccccagugcggggacgccucucuggggugcagggcacgugcuuggggacgcuggcgagagccccuuaccuucacauccguguccgaaucgcuggagcugcugcuggagucggaagagcugugguguccuugcuggauggaggugcggcagugaggcggcgccccuuacccagcccccugaaguuggaggccuaaggcaggacccuggggucaggggcaaccccagccuucccgccccuccgcagccggugaugaggcgacuuaccuuuggacccggaccugccccugccuccgaccggcccugaacuuuguggggacugagcuugggaucucccccguggcccgcccccacaccgggcuucugggaggugggcuccagggcuguggagagaaguugggugguuggugcaggcagcuucugggcuugaguccggcccccugcaccuccaguccacacuccccaggagcucaccugcucccaggucgaacuccauggcgguaagagaaguuggguccuaaggccaagggcgccugggcccugcagaggagcggagcagggggaggagcgcugagaccugcccguuggaggaaugcugagacgccccacccaaccucuguccugguccucagcccugacucauugcccggcaccacccaggauuuccucugugagaagugggggagauggacaggugacugcuuccgccagccuuggugccucaggggaggccgacugaggggggcucuguggauggcauucggggagcuacagguuucccccaaaagcucagaugcucguucuugaagagggaggugcugccccugccuuccugcguaccgcgacaauacagcuuccuccgcggcgcuuuaacacgcagggcgcugcugccaggggcgucccguguucuaacucgcucccacagccccuccggcuuggugagcagcgucugaggggugaggggcauagacuuggagccagccugcugcacuagaugccagcugugucacuuagcagcaaggugaccucagcaaaguuguuuuaccucugugccucaguuuccucaucuguaaauaacagcuacccaugggauugaugugaaagucagaggaguuaauuuccuagaauggugucuggcaugaaguacugauaauguguugguuuuuuaaaaaauaaaagguagguguuuuaggccagu

SEQ ID NO: 191744 - RNA, 22925 nt, Homo sapiens
uggggcugggagccgggcgccacuguggccgcugcuuuucugagggaaaagagcgcggagugggccagguuuugcaggccgggccaagguggagaaaagguuccuguggagccucaggccggugugcuuuuuuucccgggacugagcuucugcagcccugaggccuggaggcccgggcgguaguaacugugccggaccagguucgugggugcggccuguggugcaguuggagaccgaggccccgcgcauccucguccgcgcuucagccacuuaggcucggccguagcgaaaaggcccaagagggaagucagaggugaacgccccaggaugaagguccccugcaaaacgcugggaccuagauuuggggugggugucuggggucuaggaggacacgcuggacaguuccgaaaagacacaguggguggucccgggcgugggcaaccgggugcggaacuacagcguacccggagcugcgaacccagacgcgggugacugcugacccucugcccugucguuuccauuugugcaugcagguggcgguuaguuggggccagggaagcguggaggguggguuccaaucgagucaagaaaagccugggguguccugaacucugccugcuuccccagcccugccaguuuccagagaaggcgcuugagaaggagaaacgaaucgcugcugcucuucuaaaagccgguucccugugaguucgugcugcugcuuuguuucugugaaaugcauucgaguuccuuccguuuaaaauccugcuuaggaaugaucuauuuauucauugauuugggccuuaggauuucccuaccuaguuaacggcaggggaccuaauuaauagauuucccguuguuagugcccacuucaugcuguucuauaguuagacacaugguuaguuaacuguaggcugcaaauucaauuacucugugagcgcuguuuuucuaaggaucuugaugauauggaaauacccgugcuggagauuaauguucauacuuuguuuuuauuuguuuuuuaggguuuagauauguuuaaugguucugggguaggaguggagauuucuuuuuuuccaggaaauucaugaguggaaguuuuugguaccagccagaugugguuugaggucuggcagcaugaguuuauuuuggguauaucuuggaucgacugagggagguguaguguagugguuaagaauuucgagccuagauuaaguggaauugaauccugacugccacuuaaaucugaacgaguuuaagcaaucugugcuucaauuuccucagaauuguaauaguguauacuuuacgguguuguuuugaagauuacaugaauuaauauuugugaagcucuuaggagagugccuggcacauagugaguccuuaauucauacuagcuacugguauuaaaaugaugaugcucagucauuuccuaucagcuuuguguauuuccaagaccaaugcaaaugugaagguaauuaugauggaugcuugcaagcaggaaaaugagccagacccugcaguggaccagaacagggauugguaacauaaguccuuggacucuguuuaugagcuuucagggcaacaaagauauuuuaagauuauauacagaauuguuguauguauuuguaaaugguuaauuuuuucaguggagcgaggaagucuaucauuucaugguauuaucagaguuguauaagcuccaacaacauugauucucacugucuagaaaugaaauaacugguaaugacuuucgggauguucuuuuauaaaauuaauaucuagcaguauggaaaugguuaaaucacacuccaugugauggaauguuaugcaauaauaagaauuuuguuuauauuuagucauaagaaaaaaguauaauguaauauugagaaguauuguuguaaauaagaaucaucaagaaauuguuacauaugaaucuuguauacuacaauaaagguuuuuaaguuauuuugcaacaauguaauauuuaaauauuaaauugcuagguauuuaaugauuaguuauuuauuggagcugaggagggguaaaugcaaguuauuaaguagcugcugugaaaugagcauuuguuuuugucugcaguucuuacuggcucuuaaucacuuuggaaaugacaugaaccaggauuguaauccuucacagaacuauuucagggucuugaugagauacaauacucaggaacugguagaaauuauuuuuucagucacacugauuucccuguugucaccauuuaugcagggccuguuuaaucacaauuuucuuuuuucuuucuuuuuuuuuuuuuuuuugagacggaguuuucgauuuuguugcccggguuggagugcaaugccgaaaucucaguucacugcaaccgcugccucccggguucaagcgauucuccugccucagccucccaaguagcugggauuacaggugcccgccaccaugccaggcuaauuuuuuguauuuaguagagacgggguuucaccauguuggucaggcuggucuugaacuccuaaccucaagugauccaccugccucggccucccaaaguguugggauuacaggcgugagccaccgcaccuggcccacaauuuucuuaaugacuguaagguagccuaucuucccagucauuuaaaauuuuuuggaauagcuuuuuaaaauauuucugaugacagaauuaauacaagcuugugaaauauuaguaacuacggaaccuauaaagaaaauuaaaaugaucaauggucccaauguccagaaauaauaauuauuaauguuuuagagcauauuuucccaaaauauuucuacaagucugugugguuuugugugugguuuuauuuauuuauuuauuuuuuugagguggaguuucgcucuuguuucccaggcuggagugcaguggcgcgaucuuggcccacugcaaccuccgccucccggguucaagugauucuccugccucagucucccaaguagcugggauuacgggcaccugccaucacgcccagcuaauuuuuuguauuuuuaguagggacaggguuucacuauguugaccaagcuggucucgaacuccugaccucagacaauccaccugccucagccucccaaagugcugggauuacaggugugagccaccguacccggcuggugguuuucucucugaagaacaggcuaauacuaauugcaaauuuaaaagaaacuaagaccucuaguucuuaguuuaaaagaggaauucagugcucuuguggauuauaugacuccauggauguauggagaaaagugacaucccagugauccacuucugguuugacagaccuuccaaauauuuacaguucuucaaauuauggaaauuucaguuaaguugagauuuaaaucugauuuuaaaauuaauuuuaaaaucucagaauugaaauuuuaagaguuuuuuucaucuguucaagucuguuucccuuuaauggucuaaaaaaucuaaucauauauuguuuuguaaacuuuuuuuuucuuucaguguaucuugaauauuuuccuuuccuuaacuguuuucuaaaauuuagcauuuagugauuaccuuaguauuccauuuuauggauguuuuguaaauuuuuuaagaaaugacuuauuggacaggaauauuccaaacugcccaagcaauuccuucaggaggauuucuggcuccuaugacuugaucaacuuuucaccucagagucaugugaauuucagaguuaggcauauuuaggaauugacuuuugccaggugggauacagguauuugaaguauuugacuguauuucugaaggauugauuuuucauucuuagaauauaaaauagacagcugugcuauuuuuuuuuuuuuuuugagauggagucuugcucugucgcccaggcuagagugcaguggcgugaucucggcucacugcaaccuccgccucccggguucaagcaauucuccugccucagccucccaaguagcugggaccacaggcacaugccaccaugcucagguaauuuuuuguauuuuuaguagagaugggguuucaccguuuuagccaggauggccuugaucuccugaccucgugaucuacccgccuuggccucccaaaaugcugggauuacaggugugagccacugugcccggccagcugugcuauuuuauaccaggagcuucauccuucaauuacaugauucggggaaaugaauuaaugauaauuucuuagaaaacuaaacuuacaaaaaacaagaucauuuuaaucucagaaaaaaaagucauaugcaaaaaaggcaaaauaaccugaguauacugcauaguucaguugguaacaauguuuagucacaguaauguaaacugaauuuaaaaacugauuuacucugaaauagaauaaaaccauauugaggcugggugcaguggcucacaccuauaaucccaacacuuugggaggccgaggcugguggaucgaucacaugagcccaggaguucaagaccagccuggccaacaugacaaaaccccaucucuacaaaaaacacaaaaauuagcugggcgugguggugugugccuguaaucccagcuacucgggaggcugggacaggcagagaaucgguugaacccaggaggcggagguugcagugaguugagauugugccacugcacuccagccugggugacagagugaaacucugucucaaaaaaaaaaaaaaggaaaagaaaaucauauugaaaggacaaagggacugcaacuaugcauaugugggugggaguugaguagguaaaagacagcuaaaacuaugccucuuauaguaguaagugaauauguaaugauuacaacugaaaauucagaaguggaaauauuagcauguuuuuuaaauaccaaaaggaauggcuaauagagguaaaaauuacugccucuagauuuggaagauggggcagaguagcagggauggaacuguuggagcuuuuugugauauuccuugcauagcuguuuugaauuuuuguucagguauaagugauaaaaauuuuuaauuaaaaaauucaggccaggugcaguggcucaagccuguaaucccagaacuuugggagguggaggcagguggaucacuugaguccaggaguuugagagcaggcuaggcaacauagacugcaucgcgguaaaaaauagccaggguggugucaugugccuuuagucccagcuacucaggaggcugagguaggagggucgcuugagcccuggaaguggagguugcagugagcugagauccgagauugcacuuuagccugagcgacagagcaaaagccugccuaaaaaaaaaaaaaauguaaagauuccagggaagaacaaauaaagaucaccuaggacugggauaccaucaaguaaagguaacaauaaaauuuuauuccaauucacagaucauuuuauacacaugcauauacauguaugcauguguauguaguuuaccugccgaaauacaauuacauuacaaucauauuuucuaaccugucuucuucccccaacaauauguaguggccaucuucccaugacaucaaauaugaauuuuaucuucauuuuuaauggguguuuauuuuucuuuuuuuuuucuuuucuuucuuuuuuuuuuaagacgggguaucacucuauugcccaggcuggaguucaguggcaugaacggggcucacugcagccuugaccuccugggcucaggcgauccucccaccuugaccucccagggagcugggaccacaggugugcaccaccaugccccguuaauuuuuuguagagauggaguuuugccauguuggccaggcuggucuugaacuccuggacuuauuaagcggucaccugccuuggccucccaaagugcugggauuacaggugugagccacugcacucggcuguuuaauuuuccauugugugaaugcaugauaauuuauuugacauugcugaaggacauuuagguucuuuccagcuuuuuuggucccauuuuaaacacucuauccacauauuauuucauucuuuguacaucauaucauugaguauccauuuccccaacagcuuaguaacuaugaggugucauagcuuuuugaaaucugccaauccaguuccuucaauaugcucucuaguuacgaguagauuuugacugauaagcugauagguuauuucuuuuuccuauuuuguucuuuuuuuuuuuuuuuuuuaagagacagggucuuacuuugucacccaggcuggagugcaguggaaagaucauagcucacugcagcccugaacuccugggcucaagcaauucuccugccucagccucccaaguaacuagggauacaggcaggugccaacacacccagcuaauuuaaaaaaauuuuuuuguuguuagagacaguaucuuacuauguuguugaggcugguuuucaauuccuggcaucaagcaauccucccaucugggccucccaaagugcugggacuacaggcaugagccacugcacccagccuauuucuagcuucuagaacauuauccacacucaggcuucauaaauuuacuucucuaagucugaguaccaagaaagauugcuugguaauugagaucaugcaggcaauauugaugauccugaauaggaaaauaaggagcagagagcucugaguuaagccuuggggaagggaucccaaugugcaccugcaguuuugccauaauaaaggcugcuauauagccuuucuacagguguuuuauaccugugguucucaaaguguggcaucuggaccagcagcaucagcaucaccuggaaacuuuuuagaaaugcaaagucucaaguccaaucccagacguacugaaugccaaacucugggagugagaccuagcaaguuguguuuuaagaagcccucugggugauucugaugcauacuaaaguuugacuaccaaacuuugcugcccauuauaagcacccaugggaggaggagguaguuaaaaaaaaaauccuaaaucccacgucacacuaauuaaaucaguguguuuaagggugggagccaggcaacaguauauuuuaaagauauccaggugauuccaauuugagcaaaguuugggaaauucuugucuaugcuauuuuuugucuucauguuuggggaggccagccagauuccuaaggccaagaaggaaguuuugguuuagaugguguagccccuuuucagcugggaagguggggauggagggaggaggaucuguucaggacaggucugcacaacccauucuuugguccaaaccagcccgccuuggggucagagcuggggaccaacuggcagcccuccugcugaagugucuagacauaugcuuugaugccgcagagucucugcucuucaauuccuugugcagcugagcugauuucgcugugguuuuggggaggacaucuuugucuaaacuaccucuuaccuaucaaaacuugucuguguguugggggugggaguugcauauaggaauggagaaguaguaccaguuuuuaaaauuuggaaacucugaggcaguucucuucucaugauuuuacauguucuuucugcagcucuggugucuguggacccugcuucugaaguacaugaaccuugaggaaaauugaccaguucuagcaguucuaaaaucauggcucguguaaguuggaauuucucucuacuuuggaauucugucauuuuuuucagguuaugugaacauucucauuuguuauucugcaacuuucuaacagagccccauucaacagcuucuccccagucuuccccauuccagcacgggauggagccagccagauuccuaagugccccugucuucuccaucuguaucuguauuaguccauuuucacgcugcugauaaagacauuccugagacuggguaauuuauaaggaaaaagagguuuaauggacucacaguuccacauagcuggggagaccuuacaaucaugguggaaggugaaaggcaugucuuacaugguggcaggcaaagagugaaugaaugccaagagaaagaggaaaccccuuauaaaaucauuagaucccgugagacuuacucacugccaugaaaacaguauaggggcaacugcccccaugauugaauuaucucccaccggcucccucccacaacacaugggaauuaugggagcuacaauucaagaugagauuuggguggggacacagccaaauuguaccaguauccaugugugcauugaccaaaucauucagcaucucuugugugcuccuuaucugucuagagcagagauggggcagaaaugaaguuccuagaagugggcauuuuaucugaaauucucaggauuaaaauagcacuguccaaaauaauuguaauucaagcuacaaauauaauuuaaaauuuucuaguagucaaauuuuaaaaguguagacuaguaugcaaggucaaauauuuuaaauacuuuaguagucacauuaaaaaaaguaaaaagaaacacauguaguuuauuuuaaugucuuuuauuuaacccaauauggccaaaauauuauuucacaguguaaucaauauaaaagucauggucaggcccugacagugguggcucaugccuguaaucucaguacuuuggaauuggaaggcugaggcaggaggacuacuugagcagaggaguucgagacaaccuugagcaacuuaaugagaucccaucucuuaaaaaaacaaaacaaagcaaaacaaaacaaaacaaaacuggccagaugugguggcauaugccuguggucucagcaauuugggaaacugaggugggagaauugcuugaacccaggaguucgaggcugcagugagcuguaaucaauaaaugggcugugauugugccacgccauuccaaccuaggugacagagugagacccugccucaaaaccaagauaaaauaaagaauauauauauaaaucaucaauauguuuuaccuuguuuuuuugcuucuaaagucuucacuaucugguaucugguauauauuuuacauuuacagcacaugugaauuuggacuagucccaguucaagugcucaguauccacauauugcuaaacuagaauauugggcauugaagcagcuuuagauauuuuuuguaauguaaauucuaaauauaauauauuuaaaaguauagcuauaucuaaauauaaucacuauuaaguguaacauauccaucagauggaguacagcagucccucguuacccaagggggauacauuccaagacccccaguggaugccucaaaaccucagauaguauggaacccuauauuuaugauguuguuuugaucugauaaucagguaguauauacaauguugauaugcuggacaaagcauaucacaucccagguggggcggagugguuagugugagauuucgucaugcuacucagaauggcauggaguugaaaacuuaugaauuguuuauuucuggaauuuuuccauuuuauauuuuuggaccaugguugacuguggguaacugaaauugaggaaagcaaaaccaugaguaagggagaacuacuguaucaugcaguaaacuguaaauauuaaauaaagaaucuguuauaauaaaaaugcuaaugauacauuaugauaaaguuacaucuagaagacauuuuuaaguuuuaugcaaacuauacuuuuuaaaaauaggcauuuuacaguucauuuuuuggggagaauaccaucaauuauuauuauuuuuuaaaaaucuuuaaaggaaaagaagauagaguaaaucccauuuauugagaauuuuuuagguccuuugcaaguacuguuccuaugaaccuauuucaguuaauugaaaaauucugauaauuacccgaauaugucuggaaauaaauaaaauuaucuccuauuccauaguacguaggaaguuuuggccauagcaguggugggcaaacuagauacacuauaaaucuggcccacaagcuguagcuuguuuggaacagccugcaagcuaauuacauuuugaaauaauuguuacaaaaaaaaagaagaauguggaacagagaccauaugugguauacaaagccuaaaauauuggcccuuuacagaaaauguugccaaacccuggucuuuuguuuauagaaaucuucaagaacacauauucugcuucagucacacucacaucuuuauugccaccuucccacaucacaggcuuccagcccuagucuauucauuugauguaugaagugaacauguaucaucaaaacccuucuuccacuuuuuuuuucuuuuuuuuuuuugagacggagucucgcucugucgcucugucacccaggcuggagugcaguagcgcgaucucggcucacugcaagcuccgucuuccagguucacaccauucuccugccucaaccucccgaguagcugggacuacaggcgcccgccaccaugccuggcuaauuuuuuauauuuuuaguagagacgggguuucacuauguuggccaggauggucuugaucuccugaccucgugaucugccugccucggccucccaaagugcuggauuacaggugugagccaccgcgccggccuuuuuuuuugagacaaguucuugguauguugucuaggcuggucucaaacuccuggccucaagcaguccuccugcuucaggcucccaaagcuagaauuauaagcauugagccacuacacccagccaccuucuuccaucuucaaaauauuuucauuuaucuuacaaauaauacaugcguuuaucauuucaggauuuggugauguucagagauguggcuguagacuuuucucaggaagaaugggaaugccugaacucauaucagaggaauuuguacagagaugugauauuagagaacuauagcaacuuggugucacuggguaagccuagcauaucugugucagauaauuuagacauucacaggacugaauuucugggcugucuuuguuuuuuuccaaagacgaagucucgcugagucaccaggcugaagugcaguggcgcaaucuuggcuuacugcaaccucuaccuccuggguucaagcgauucuacugccucagccucccgaguagcugggacuacaggcgcacaccaccacacccagcuaauuuuuguauuuuaaguagagacgggguuucaccagguuggccgggauggucuugaucucuugaccucaugaucugcccaccucagccucccaaagugcugggauuacaggugugagccaccgcgucugggcugucuuucuaaaaacuagcuaaaugucugcuuugugcuuugacaguaaguaccacuauuaagcaccuucaucuuucuguauaauucagugaccguuauauuuuucuucgacuuuucuguuauuaccggucuuuaaugacagcuggauauaaauucuuagacacucauggcaaaaccauugucaaaacaaucugauuucauacugcuauggaugguccauguuauuuguaacucauuuacagugagaauaggaagacagaggugucuggcucuacauagcuauuaaaagagcuuuuacaguguaugugaugcuggguugaauugacaguuuguuaaaacucaaguggacaguauucaguuuccuacaacagacauauuuuaacugcuuugugauuaaguuuaaaauacaugaauuugcauuuaauauuguaugcauauccuggcaagaaacuuauuuuucuuuaaaaaaaaaaucaaaaaauagcaaauguaguaccucaugaacauauaugaugguuaacauguaccagguacucaucuaaacacuuacauuaaaucgaaucucacaacaaugcuauauauacgcauuacuguuaucccuuuuucacgucugagaaaaaugaggugcagagagauugaauuaguugcucuacugacaugggaaagagaggcaggauuugaaaccagugcuuucaacuauucuuuucucucaagagacagagccuguguaaguuuaaauuaaaauaaaaccaggucccuacuucuguguucuuguuuuuccuugugauccugaaguaacucuaugcuaugaauguuuuucaauccugauagucuucuuuguuuugaagccuuaaauaaauucuuuauuauauucuauuauuuauuuuuaagcaggauguucuauuucuaagccagaugugaucacccuauuggaacaagggaaagagcccuggaugguugugagggaugagaaaagaagauggacucuagguaagugcugaucaggcagaggucagccauuauggcauggccagaccugcugguugaggaggagacacaccccuuagaugucaauugugaagaagagaccugaaacuugggaagaaaauuuagaucuucucagcaugagccaucaaagacauuucauccauacuuccacuuaucacucguuucuuuuuuuuucuuuuuuuuuuuuuuuuuuugagacggagucucgcucugucgcccaggcuagagugcaguggcgcgaucucugcucacugcaagcuccgccucccggguucacgccauucuccugccucagccuccccaguagcugggaccacaggcaccugccaccaugccuggcuaauuuuuuugaauuuuuaguagagacgggguuucaccauguuagccaggauggucuugaucugaccucgugauccacccgccucggccucccaaagugcugggauuacaggcgugagccaccgcgccuggccucagucguuucuuuucuaucuuguuucccucccuuuucuuuccccuauuucaguagaggaaagcuuucugcccuagugauuccauuuuaccuguauuuugaaucuaaucccuuucuagcucaucuuuuauauuuugacuuuuauguauacauuuuuucauugcccauguucauggaguuuaaauuguaguggggagucacacaguaaacaaguaaauaaaaucaguaaauggauuacuaaaauauccugaaguaauuagguauuaugaagaaaagugaguaagguaaggauauggagaauuauaaugaaugaauagaguaauuuuagauggguuggucaggcuccaguuggccaaagaugggacuauuugaacgucauuacauauaaugacugcaguguauugcaaugcauaaaauacacuuaauuuuauaaauucuugauacuaacagcaaauuauucaucauugaaaguuacuagaaaacuaacauuuaaaaagcauaaauuaaaaggaaaagaagcauuuauccugccuuucuuauaagaauuauaugaauagguaguagauggagguauguuucucuuaauaaaaguguucagugaauaaaugaagaagaaaugauagaauauuaccauuguggaacccauaagaacuauuggauuuagauauugaauaucagugcugauagcaucaaagaaauagaggcaaucggguguuguuucuccuaaugaaagagcacgauaucaccuaugagguaacuuugccaacaaaagguccuaagucuuaucaagcaucuaaagccaauugccaacuuacgggaagaagacagaggacuauguucuacaccuugggaauguagugagccaaauucagaauaugggaaacuacaggaccaaaaacagguucuucaacaaauaaauuacaagggaaauaaauaaaugauaggaaaaccuauagauuaaaagagauguaaaagacacgucaacaguuguauucugugaacucuguuuggaugaguuauucuuuuuagguuguuuaaaauuuuaucagauggaaguguggacauugacuuuugaugauauuuaauaauucauuuuuuggguuuggauaaugguauugugguuauguguaaaagugcuuuuugagaugcaaacuuuguacacaugaaacgauguaauauccaagauuugcuucaaauaauacgaaggaaguagauugggaggugcguaggccaagauugggcaugggguuaaugcuggauacauggagauauuauuaugccguucugucuacuuuuugauauguuagaaaugcucuguuauaaagguuuuucauuuguuuguuuuagaguuacugagagauaaaaagaaaaugguggugaggcaaugaugaaaauaagguuaaacuauucuuuggaugaauuuugccauagaagggaagcagauacauaagaguacaaggaauauauuuuacgaugugaaauauuagaacauguuuauaggcuacgagaaugauuucaaagagaggaacauugaugaaguagagagagaggguaguuuuguaggcagcgaccuucaguagaugggaaggaguggaaccaauugaugaaguaaaaccacauauaugguaagaauucagacauagauugauuggagaauguggugaagagaauacauauuuuucuuucaguuguuucugguuccuuggugaaauggcaguaagauuaucgucugaaccugaggauuauucaguauuucauuggaauucaguauggauuaugcaguauuagaucaguguuaauuuucagaaguacaauuuuguggucauaggguuuuaacauuuucagaucucugauguuaauauaauuagaauugucuuggucauaaauauucuguauccuguauaaucuuguaucagccagaaaaaaaaggggugggggagacauuauaccucaggaaauagcauaccuccggggaugacaagauaauuugcucccuauuuuauuuuauuuuauuauuuuauuuuacuuuauuuuauuuuauuuuauuuuauuuugagacgagguuucuccauguugcccagacugguuucagacuccuggguucaugcaaucugucugccucggccugccagagugcuuguauuacaggugugagccaccacacccugccccuauuuuauuuuuaauuaaagcugaugcccuguaaauggaaauaacacuucuuucauuuugaucuaagauggacuaauauuuuguuuucacauuagcagugcuuacuagacuaaacucuuugauucaguagaauccaaacuaguauuuggcuuauuaauuuuauuaguuaauauuaaauuauauaguauuauauaauuaaauaauguuaauauuaaaauuaaaauauauacauauuuuacauacauguuuuuggagguagaacauuaaaauugucuaucauaguccaaucuuuugauguuuggcccagcauuuuguuucaguguaggucuagcccauucugucuugauuaaaguacuuaugaaacauaggcuauucuuucccauuucaacuucuuugaaguagaacaggaauguaaagauacuugugaagcaaucugagggcagaauucuugaauuuuuauguuuucugucuuuuacuauuuucucacccaugccuacguugacaaaaaugaaauguuuauguauagccaauacuacgaaacauccaacuuaguuuucauagaaauaauugucuuuaaacauuaauaauuuuaguugcuugcagcaguaagaacuguaauaggcaaacuugggaacaaacauggcuauuugguagcguacagcucagcuguguauauuauagaacagccuucuaacugagaauguucaaaauaccaagaucuugaucuggcuugucacuuaaguagggagccauauaugacaaucucaaguucaccuuaucaacacuggcaauuuuuuuuuuuuuaugaaaaccuucaaauuuuacaggauaaauuuuacaaccuauucuaauuugauuauuagugaauacagacauuuuguccuaauuuguuuaugcuuauauuuacuuuuccauugucuucucacuuccuuuauuccauuaccuuuuccauuguuuauuauuucuuaugccaauuuguaugggcuuaaauuucuuucuuuuaauuuuaguuuuucgagauuggggucucauuacauuggccaggcuggucuugacuuccuggccucaaauaauccuuccaccccaagugauccucccaccacagccuccccaaguaguuggggauuacaggugcgagccauggugcccaguuuguguggacuuuaaugcuauaaacaguaacacguucucacuuucuuaugaauguuuuagccuuuaauucgauuuuugacuggcuuuccuuuuagauuacugguuuuauuuuuaauuugcagguaaauccuuugaaaugagcaucuuauuucuuaaccuuuguauuaccuucauaacuacuuacuuauuuacuaccauuauuuagcuaauuaugaugcuuuuauuaauaucacuuauaucuuauuugucuuauugaggccauaaauggacuuuauccccaaaauucuagacaacugccauauuuuguauugcuuuuuuuggauggggagacagagaaagagacagagagagagaaacacgauuauauagcaguauuuucuguuccauucauuuaccugucccuggucacauuuuauccacagcauuuaaauuauuguugucuuuuacuaucuuuuuagcguauacuuuuuaaaaguaaacuuauugaaauauaaauauauacaaaaauauacagauaauuagugaauugucacagugaccacacccaucuaauuaguacacagauucagaaauagagcuuuacuaggauaccagaagccccucuugacuucuuucggucauuccuccccaccaagacuaaccacuguccugacaccaccauagauuauuaauuaucauuuuuuaacuuuauaaaaauggaauuguacaguauagauuguuguaugucuaguuuuguuuauucaccauuauguuuuugagauuagcccuugcugcauguaguuguaguuuguuaauucuuguuguuguauaguauugcgauguauuaauaugccaucauuuauuagcuguucuuccauugaugaacacuuggacucuuuccaguuuggguauauuacaaauaacguugcuuuaacccuaacucuaacccuaacccuaaagcaacauuauuuaaaauaccuuuuccuuuuugaagaguauugaauuccuauugcaaagauuuugagaacaggugcauuugcaaaaaacaucucuuugcucagaauuuuacuagccuuuuaccauaguauaaaccuguuguuacaccuggaaaaucacugaaauauucucuaggaaguacacaaauggcauuauggggacuuucaggaagauacggggaaccuguaacauagaugugcaaguuacguaaacucaaguaaagauaaauauuuagagacucuuauuaccuuggucgugaaagggggcaaaguucacuuaugauuaugcaaaguaggaauugaacugcaguggagguaucugcaaguguacaugaagaggcaauuggaaggaugaugaaguguaaagaaaucacuauuuuccauuuauauauuuuacugagauagcuuagauguacuuguuucccaucucuguaggaagugauaaaaagaauguuuaaucaguguaguaagguuuaagauuggaggcaggauaccauaugccauaauuguugacuaauuaugagaauuuaauucacaguuaauauguacuguggauuugcuauucacuggugagugaaaaauuguuucugcccuuggggaaguuuaagguaagaaaauaaagagaauaauaaguggagaaauuaaugaauaacaacccaguugagaaaaguguucagcaagaaauaaguagccaggcaugguggcucacaccuguaaucccagcacuuugggaggcugaggcgggcagaucacuugaggacaggaguucgagaucagccuggccaacauugugaaacugucucuacuaaaaauacaaaaauuagccaggugugguggcgggcacuuguaaucccaguuacuugggaggcugagacacgagaauugcuugaacccugggguagagauugcagugaaccgagaucaugccacugcacuucagcuugggcaacacagugagacucugucucaaaaaaaaaggaaagaaguaggcugggcgcgguggcugacgccuguaauucugacacuuugggaggccgaggcagguggaucacgaggucaggaguucaagaccagcuuggccaagauggugaaaccccaucucuacuaaaaauacagcgguggcacaugccuguaauccuaccuacuugggaggcucaggcaggagaaucacuugaacccagaaggcagagguugcaguaagccgagauugcgccauuccacuccagcuugggcaacaagagcgaaacucugucuuuaaaaaaaaaaaaaaaaagaaaaaaagaaaaaagaaagaagugacugggauagaaaacaaaggauauauauuacaugaagucagcagggaucauuuuucugauuuuuaaaaugaaaccugauggaugaaagaaacccaaccaugcaaacccaagucaggauuccugggagauuuaauagccagugaaaagcuccaaaaaguggaaagauugggucggaugugguggcucacgccuguaaucccagcacuuugggaggccgaggcaggcggaucacuugaggucaggaguucgagaccagccuggccaacauggugaaacccugucucuacuaaaaauacaaaaguuagccaaguaugguggcgcacuccuguaauuccagcuacuagggaggcugaggcaggagaauugcuugaaccugggaggcagagguuacagugagcugagaucgagccacugcacuacaaccugggcgacagagacuccgucucgaaaaaaaaaaaagaaaagaaagauugugacacauucuaggagcagaaaggaggcaggcaagugucauagggacauggacagcaaaggggacaguggcuugaguugauaccuuguguucgacagaguccauguuacuccugauaaaguauuugcucuguauucuaacugaaaagagaaauugaaaaauuuaaguggggagucucaaacuuugaucugcacccaaauaaccuggucuuaacucaucauuuucuuauuuccuuuuagcuucuuuuaaauuaccuauuuuagagauuuugagcccauuuacuucaauugggcuuucuuuuucuuuuuuuuuuuuuuuggucaccgauuucuauuauaaaguuuucguuuguuuauuuuguguagaacaggaaaauauguuuuggucuuguuuucuuucagauuuggaauccagauaugacacuaaaaaguuauuucaaggaaaggauauuuaugaaaugaacuuaucucaguggaagguaauggaaagaauuaaaagcuguggacuugaagaacaagaaaguccucaugagguguguuucaggcaagugacaaaaaccaccucugaaaaaaugccuacuuacagaaaacucacaucucuuccucuguaucagaaaagucauaacagagagaaacccuacgaauguggggaaugugggaaggcuuuuagaguacgacaacaacuuacuuuccaucaaagaauucauacuggugagaaacccuaugaauguaaagaauguggaaaagccuuuagacagugugcccaccucagucgacaucagagaauucauacuucugacaaacucuaugaauguaaaaaauguggaaagaucuucacauguggcucagaccuucgaguacaucagagaauucauauuggugagaagccguaugaauguaaagaaugugggaaagccuuuagaguuagaggacaacuuaaucuccaucaaaggauucacacgggugagaaacccuaugaauguaaagaaugugggaaggccuuuaggcaguaugcacaccuuacucgacaucagagacugaacauugcugagaagugcuaugaguguaaggaauguggucaggccuuucuguguaguacaggccuucgacuacaucacaaacuucauacuggagaaaaacccuaugaauguaaggaguguggaaaggccuuuagagugcggcagcaacuuacucuccaucagagaauucacacuggugagaagccuuaugauuguaaggaaugugggaagacuuucagucguggcuaucaucuaacucuccaucagagaauacauacuggugaaaagcccuaugaauguaaggaaugucagaaguucuuucgucguuacucagaacuuauuucacaucaggguauucacauuggagagaaaccuuaugaauguaaggaaugugggaaggcauuuaggcuguucucacagcuuacucaacaucagaguauucauuuuggugagaaacccuuuaaguguaaggaaugugagaagacuuuuagacugcuuucacaacuuacccaacaucaaaguauucauacuggugaaaagcccuaugacuguaaggaauguggaaaggccuuuagacuucauucaucacugauucaacaucagagaauucauucuggugagaaaccauacaaauguaaggaauguaaaaaggcauuuagacaacauucacaucuuacuuaccaucagcgaauucauaauguaacuuaauaauuauuagaacucuuccuuugcgaauuuuauguugagcauaggaaguacauucuagaggaaagguuuuugaacgugggaaucccuuuugcuucaugcucacaacuaagcauaggaaguuuuauuuaaaggaaagaauauguuaaugaacauauagaagccuuucaucaccuuugaaaccauguuaaacuuuaggaaauucauccuagaaaagaacuuuauuacaggacugaauguggaaaagcuuuugaucuuaccuauuauuaucuccauauucuuccaucuguguauauacacacgaagguugcuagggaaccacuucauucugaaaauguguaaaugaaaggaaagucauuuagucugcauuuccuguaggaacuguauuucagggcaaccagaaguuaaggagguaaaguucuucuuuauuagaaaauuccaggcuaaugaaugcagaaagaauaauagaaaauuauauuagaaaaacuauuguguaacacauaaugaaauaauggaucuaggcaugauucucuguacagguugacaccauucagugaagguugugaacuuuauagugaauagaugagacugacaacgucugaacccacucaucaucucaacuucacaaaaagcaagagaguaaaaauuacgugccuccuaaugugcuacaguaagauauacacaucuugccaaaaauauugaaccugaauuuaagccucaagagccaacucccaguuuagagaaaauucaaggaauggaagaguaaauuacaugacacaaaaaggagcaauuaaaucuaaaauaaggguaauucuacaagaggaaucaccugguuucccaaccaauaaaauggcauuuuaagaaauaagguggaacuccuagguauugacagacuugagacaucagucaaaugcaaugaaacagugguuuuuacuuagaucaugaguugaacaaacauguaaaagaagagauacuuaacaauaauugggagaauggaauauugacaauauuagauaauauuaagaaacuuuguuaugugugauaauagcauugugguuauguaaaaguguauuuguuagagauaauuucugaagucuauacacaggagaugauauaucuggaauguccuuuuguucauacaaaagaaaaaugaggaugaauaacaaguuuggcaaaaugaugguaaccuaagucuuggauacaugguuuuuauuuguuuuguuuuugcuauucuacuuuuguguauuuaaaauuuuccaugauguucuuuuaaagaucaaauuauccaugaaauuauagccaguuuaaaaugaauuauuuuaaaaaaaauuucuggcugggcccgguggcucaugccuguaaucccagcacuuugggaggccggugggcagaucaugaggucaggaguucgagaccagccugaccaucauggugaaaccucaucuccacuaaaaauacaaaaauuagccaggcguggucacaugcgccuguaaucccagcuacucgggcagcugagacaggagaaucacuugaacccaggaggcagagguugcagugagccgagaucacgccauugcacuccagccugggcaacaagagcaaaacucuaucucaaagaaaaaaagaaaauuucuacauauuaaaacuuguggauguugccaaagcucuacacauugggauuggaauauuaauuacacuauaaugacgauaauguauucaggaaguuaaaauguagguccacauuuuauuuaguugaccucucuaucucuauauuauaguacccaugguaugcaccuuuuuuuuuuuuuuuuuugagacggagucucgcucuuucgcccaggcuggcgugcaguggcacagucucggcucacugcaagcucugccucccggguucaagccauucuccucccucagacuuccgaguggcugggauuacaggcgcccgccaccacaccagguugauuuuuguauuuuuaguagagaugggguuucaccauguuggccaagcuggucucaacuccugaccucaggugauccaccugccuuggccucccaaggugcugggauuacaggcgugagccaccaugcccgacucucacuucauauguuuaaagaaugaguaaaagaaagcaauuacuacugcuaaaugugggaaauaauggacuagaccuguacuaauauaugguagucacuagcaaccuguugagcacuugaaauugaguuauugagcacugaaauguggcuaguccaaauucaaaugguguuuuuuuguaaaacacaagauucugaagacuuaguuauuuuaaaaaaguuaaguaucucaauuuuucauauugaguacauauugaaauaauauuuuagauauauugguucaaauaaaauacauuaaaaugaauaacacuuuuuuguuuuuaaaauuguuauaggaaaauuuauauauguagcucacguauuucuauugucagcgcuggcauaaacaauaaaaaguagacuugg

SEQ ID NO: 191745 - RNA, 10338 nt, Homo sapiens
cgggcgacagcagggccgcggugcaguguccgacccgagaguugcggccugagucaccggccccgcccuccggagccggacgcugcgggaggcccgggagcggcaguggaaccgacucccagaacuccggacgugugcggcgguaagcgcccggcccguacccccuccgcaccccgcaacuccgacuuuggcggcccccagacccggcgaaaccgugaagucucggccucaggagccccccagauccauggucucagauucgaacccucagaccuguucgaucuccuuuuaugccgucccggggacccuucuccacccucugucucaugauccaaaauacaggcccauagguuucagagauacccugugaauucuuccuugggguguccugaaccgcgaucguagaucugugcccccaguuccagcggggaaccccauuguccgggaacccagagcucacagccacgaucuuagacccgagcccacagagccagaggugacacuggaauccugccgcugggaauaccuaaauucucaagcccacauuugggauuuccuaaaccccgcccuggggcccuuuaggccguggauguuugcuccgcgcccaugaccugccaaggaccucuacauucaggcugggcucuggaucucacauucuagcgcccagacaugucgggaacgccuuacgccaacuugggguccccaccaagagaacccccaccagaucugcacccuccccuucacgcgugcacccaguccaggcucccucaagccccacgggugccuuuuagaccugaggagguugcaaaccugaucccccauaccugccccacccauccgcggacaacccgcccucgcaaacucagacccccacccggaggcuucagauuccucccagguccagcugccggaaaugcguguuugaagggagggugugggcucaggggcgaagcacccacugguccccuuuuuuccccccagcagugagucgcagccauguuccugguuaacucguucuugaagggcggcggcggcggcggcgggggaggcgggggccugggugggggccugggaaaugugcuuggaggccugaucagcggggccgggggcggcggcggcggcggcggcggcggcggcggugguggaggcggcgguggcgguggaacggccaugcgcauccuaggcggagucaucagcgccaucagguaaggcggagacuaucagaggggcggggccugggaaugggaggagccucagugaggcguggucugggaggggcguggucuaaaaauagaauaggauuaaccuggaggcuaaccuggguacaugaauuaggccggggaggccugguuugagaguucugcuguaaggggguggaccccagugaggcggauaucagucauugggggcggugcuugauaugggaguagucugauugugugggaccaggacaaugugguccugaggggacugauguggaguuuuggcggguggggcuuaugggucugggcucagccugcauuggcuaaccuggagaugaacguuaaaggugcggagccaaugcgucugagugacauuuuacggaaggggcuugacuuaugaguguggucagagguuuuagguggguuaaugaggaggugagcccaggaggaagcaagaccuaaugggguaggguaaauggcccagaaugggcugggcuugcugggaacuggcuggauuaauggagaaaaaugcccugguagggauagggcagguuggcuuaauuagccacggccacuuagcagugaucccuugaaggggcggggaccaauggcugggguaggauguugggaagacgggcauuuaggaagcgggccauggaguagggucuugggcagauggcaccugaggaggauaaggccuugggaagcuggggcagagccucuaugaagugagcccuccaaggggcggggucuuuugauucuacgugggauuuuuuagguuuaggguggccaagaugacugaaaucugccacuggguaggugugccuggcaggaggggagccucccaggggaccggucucuggguuuccucgagggugggguuggccugaggaagggagaagaggggcacgaccagggcaguguggauugggacagaugaggacaagaacaaaugaaaggcacagcaaccaaguaaggaagauaacggcuggggucuggagcguuggggcugaugguucuguagugcugcccguuggaggccccgccccuggcacuaaccccucccccuuaucucuucgcagcgaggcggcugcgcaguacaacccggagcccccgguaagcccccucugcaaccagacccccuucuccugccaaggccucuucgaggucccaucccuguuccuguagagaagccccaccuuccuccccuucuugugaaauuccucugccaguuccucccaugccgugucugcagcuucgccaugggucuuagccaugccccacauacgugcaccccauucacuaccaccccucauucuuuuccucaucaagcugcccagcccacucugacuuccccacccaggguaccuggguuuggggagccguccuggccggguuccccucccccugcucugagcucuccucccuuugcagcccccacgcacacauuacuccaacauugaggccaacgagagugaggagguccggcaguuccggagacucuuugcccagcuggcuggagauguaaguaaccuggggucccuggccccguccuaaccguuccaucccuucccuuguggcugcccuugcacacacacccuugaccaugacaaucccaguguucccauucuccaugacauucucagaccccuuucagucaccccugaccugccccuaacuuccgcccgcaggacauggaggucagcgccacagaacucaugaacauucucaauaagguugugacacgacguaagugaccgggguuaaggaauaggguagauucagaggcagaggggucagagaggauuugaccucuggccucugacuuucaaccuguuacccacagacccugaucugaagacugaugguuuuggcauugacacaugucgcagcaugguggccgugauggauguauccuugggggcagugugggagaggcccuggguggacagagaguuuuuugagaguauguuugggaagccaacauguagcuuucauauccacagauguggaaaugcauucaucagaacacagucaccugcagacauguggcgguaaaucauaacaaugccagcugucacagcuggcacuuuaauuauauaaagugaccgaaccgucauaaccacccuguuggacaggcacaauuauuauauuccauuuuacagaagaggaaacugaggcucaguuuccugaaagaagcagucauuugucucaaguuauagauaaaggucaggcaugguggcucaugccuguaaucccaacacuuugggaggcuaaggugggcagaucaccugaggucaggaguuugagaccagccuggccaacauggugaaaccccaucucuauuaaaaauacaaaaauuggccaggcacgguggcucacaccuguaaucccagcacuuugggaggccgaggcgggcggaucacgagaucaggagauugagaccauccuggcuaacacagugaaacccugucucuaccaaaaaaaaaaaaaaaauuagccgggcguaguggcgggcgccuguagucccagcuauucgggaggcugaagcaggagaauggcgugaacccgagaggaggagcuugcagugagccgagaucgcgccacugcacuccagccugggcgacagagccagacucugucucaaaaaauaaaauaaaaauaaaaauaaaaauaggccgggcgccguggcucacgccuguaaucccagcacuuugggaggccgaggcgggcggaucacgaggucaggagaucgagaccauccuggcuaacacggugaaacccugucucuacuaaaaauacaaaaaaauuagccgggugcaguggugagcgccuguagucccagcuacucgggaggcugaggcaggagaauggcgugaaccugggaggcggagcuuugcagugagccgagaucgcgccacugcacuccagccuaggcgacagagagagacuccgucucaaaaaaaaaaaaaaagaaaaaaaaagaaaaauaacaauaacaaaaauuagcugggcgugguggugcacgccuguagucccagcuacucgggagucccagcuacucaagcaggagaauugcuugaacccgggaggcggagguugcagugagcagagguuucgucacugcacuccagucuguggacucaggucuuuugggcuugagaacccacguuuauaacagccacaugcgcauauacacacacacacaccuaagagcacacccacauacgugaagguguaugaggcagugugcacagggacacacguguuaucuguacaugggccagccauuagcugaucuuggauacaugcauauuuuuauuuauuuuuguuuuaaaaaauauuuuauagagaaaagcuuucacuauauugaccuggcaagucucaaacuccagaccuuaagcaauccuuccgccuuggccucccaaaguguugggauuacaagcuugagacacugcgccuggccucaugcacauuuaacacauagggcaaacagacacauacauaauauacaugucauguaaucacagacauauugcauagagcaaagcaaucccaacucuaccucuuaaccagguuauugaaccgcucugugccucaguuucucucucuguaaaaugggugagugauaauggugauaccgaaucggaacuacauccaaaagguuuagcacaguguauagcgcauaguauguggucuguacacauuagcucuuaacuaugaucuuggguagaguuuucagcuuugaauguuuucuucucuggaaauaguccugguagaacuggugucccaaggauuuagugagaaagugauguuccugaguggacaucagguggauccugaguucaagcgauccaccugccuuggcuucccaaagugcugggauuacaggcaugaaccaccaugccuggucacacacuuguuuuucacauauccuaacauuuuuaugaaauugaguuacugucaagaauuuucuuuucuuucucuuuuuuuuuuuuuuuuuuugagacagagucucacucuguuucccaggcugaagugcgguggugccaucuuggcucacugcuaacuccaccuccuagguucaagcaguucuccucccucagccuccugaauagcugggauuacaggugugcgcuacuacagcuggccaauuuuuguauuuuuaguagagacgggauuucaucauguuggccaggcuggucucgaacuccugaccucaagugaaccgccugcuucggccucccaaagugcuggauugcaggcgggagccaccgugcguggccuauuaagaauuuucugaaugagcaauuaacaacucuucaggcaaggaauuuguacuuuagaguaguugaauauaauuccucaugguuauguuuaaagagaaucccuauuuagaaauguaagugacaauauguauggauaaaaugaaaaauaaaaccgcacaccaggugauaugacuaggaccaagcgggagcuggaguuucagcccuggcugcccugcuugcuguaucaccaucguguccacagugcaugugaugcaugcaucuggguguagcugucacucuucuuaacacccucccaccagagcgacaccacaggcaagcugggcuuugaggaauucaaguacuuguggaacaacaucaaaagguggcagguguguagaaaccucugaaaucccuggcacccagacccccaagccauggagacacuaugccccacaaugcucacuuggacccaaugucucuguccucacaggccauauacaaacaguucgacacugaccgaucagggaccauuugcaguagugaacucccaggugccuuugaggcagcagguauggcuggcagggacaugcuggggcugggagugggaugggugagaaaaccucuacucagcuggucugggccugacuccugggcaugggaguggguugggccauguggcccccgcaccugaaggacuacauccaucuuaggguuccaccugaaugagcaucucuauaacaugaucauccgacgcuacucagaugaaagugggaacauggauuuugacaacuucaucagcugcuuggucaggcuggacgccauguuccgugagugacaacccagcugucuuccuggguggggauuccuaugaccucuauggaccaaggucuccucuaagccugacuuugaggugggcgaugcuaggggcacaguggugauugaaucaguuccaguuucugcccucauggagcucacagucugguggaggagacacaaguccccagacagugacaguucagacuggugauggcugggagaggggaagcucagggcagagugauggguugugaugggggcagcacaggccgagggucuagggcucuggugaggggaagagugagcagagcgugcucagauugugcuuggggaagccuagagggcaaauccaauccaggaggaaccugaugcagcccaaggggucagggagggcucacuggagagggaacauugagaccugaggggaugaggagagaacuuagugagaagguagggaauacuguugcaggcugagggaacagccugugcaaaggccuagaagggaaagaagauggggcuucugaugcuuuuuguuagauuucuuucuuucuauuuuuuugagacagagucugcugcucuuguugcccaggcuggagugcaguggcaugaucauggcugacugcagccucaacuccuaggcuccagcaguccuccugccucagcuuaccgaauaccugggaguacaggcacacaccgccaugccuggcuaauuuuuaaaauuuuuuguagagacagggucuugcuauguugcccaggcuggucuugaacuccugggcuccagcaauccuccuaccucagccucccaaagcuuugguguuacaggcaugagccauugcauguggccuucugaguguuaguguacugaaugcugaagacauggcugggaaguggggauuacuguccuuauuuugugaaggaggaacuuaggauucaaggaggcaaauuuucaugcucauagucacccagcuaggaaguuguaaagccagaauuugaacuuggaucuaucugagaucugagcuaaguaagagaagguaggagcagugagcaugauuaggucaugcaggauugugggugccaaguuugggggugcucaaacucuaccagagacauuggggagccauggcagguucuaggcagagggaggacagggucagguuuggcuuuagaaagaucccuuggccucggcugggcacgguggcucacgccuguaaucccagcacuuugggaggccgaggagggcggaucacgaggucaggaguucgagaccauccuggcuaacacagugaaaccccaucucuacuaaaaauacaaaaaauuagccaggugugguggcgggcgccuguagucccagcuacuugggaggcugaggcgggagaauggcaugaacccaggaggcggagcuugcagugagcugagaucugccacugcacuccagccugggugacagaucgagacuccgucuuaaaaaaaaaaaaucccuuggccuccaggccgggugcaguggcuuaugccuguaaucccagcacucugggaggcugaggugggcguaaaaccugaggucaggaguucaagaccagccuggccaacauggcgaaaccccgcaucuacuaacgauacaaaaguuagccaggcgugggggcgugucuguagucccagcuacucaggagguuuagggagggagaauugcuugaacccaggaagcggagguugcagugagcagaggucaugccauugcacuccagccuccaaccugggugacaagagcgagauuccaucucaaaaaaaaaaaaagaaaaaaagaucccuuggccuccagagagcccacaaugcaugaaaaguaacagaggaaaagaagcagguaugugagauagcagggaggugaagggaguggacagacaagguugaugccacaagucacauaagaggggccaggaaauagccacuggaucuaccagcaagaaggcugauagucgggaggaucauuugaguccaggaguuugagaccagccugggcaauguaguaggacuccaucucuacaaaaaaaaaaaaauauauguauauagacauagccgggcaugguggcacaugccuguggucucaguugcucgggaggcugagguaggagaaucacuugagcccgggagggugaggcugcagugagcuaugaucuugccacuggacuccagccugggccacagagacaccgucuaaaaaaaaaaaaaaaagggcugggcaugguggcucacuccuguaaucccagcacuuugggaggccgaggugggcggaucaccugaugucaggaguuugagaccagccuggccaacauagugaaaccccgucucuacuaaaaauacaaaaaaauuagccaggcgugguggugcacgccuguagucccagcuacucaggaggcugaggcaggagaaucacuugaaccugggaggcaaagguugcagugagccaagaucgugccacugcacuccagccugggcaacagagugggacucugucucaaaaaaaaaaagaaagaaaggcagccagggugugcaggacgcuguggguauggacaccugaggguggugguaacugagcggagauaguguagucaucaugucuagauucccuguggguggggaacauggagucaaguuucagggcaggcguggggaccuaccuguaagacucuaggggcaggaaguagagugugcagagccucccucuaguagccuguuaggcuuagaacuggagaggauggagcauagaugucaguaggaggcuggggcugggcagaggugauaucaguacacagaggccauuauugaggaggguaacagauuggauuccaauccugauuucuucacuuucuugcuaugugaccuggggcauggccccucccuuccugccucauuucuuuuuuuccuguuuuuaauuuuuaguuuuuuuaaaaagcagagaugaggucucuguugcccagguuggucucgaacuccugggcggcucaagugauccucccaucuuggccuuccaaaguguugggauuauaggugugagccaccacgcccagccugugccucauuuuaaaaugacacuuaucucacagaguuggauuaaaucagccaauaccuggaaagcacuuuaccccaugcuuggcacacaguaaauacucagugaagugccagcugcuaugauugucaucccauguauuuguguaauguuauuaugccaaaaaccagucuccuuccuucccugccgccaaaccucugcaucuccuccuccaggugccuucaaaucucuugacaaagauggcacuggacaaauccaggugaacauccaggagguaaggacccccauauugggguaugggugccugggaggaccccaccccucagcccuucauaccagcucugagcugcaguccccuuccuccuauuuugccagccgucccugggugagggcaaaggggcuggugcucuugggguucccuguccucacucuccacccuccucuccccaguggcugcagcugacuauguauuccugaacuggagccccagacccgcccccucacugccuugcuauaggagucaccuggagccucggucucucccagggccgauccugucugcagucacaucuuuguggggccugcugacccacaagcuuuuguucucucaguacuuguuacccagcuucucaacauccagggcccaauuugcccugccuggaguucccccuggcucuaggacacucuaacaagcucuguccacgggucuccccauucccaccaggcccugcacacacccacuccguaaccucuccccuguaccugugccaagccuagcacuugugaugccuccaugccccgagggcccucucucaguucugggaggaugacuccagucccugcacgcccuggcacacccuucacgguugcuacccaggcggccaagcuccagaccgugccagacccaggugccccagugccuuugucuauauucugcucccagccugccaggcccaggaggaaauaaacaugccccaguugcugaucucua

SEQ ID NO: 191746 - RNA, 1131 nt, Homo sapiens
gggaaguagacauauccccaauuuuauucccuuuguccaacauuccgagagggaaggggcaaaugagucaauguugccccucaaaaccaucaaguaggggccuuugggggucuucaguugaucaaccagggugauagaccccuaccccuuccucaugguccuggcuugucacaauuaaugggggaaaguuuuccagaaggggauuccgggcuucucaccgcucaucagggcaccuucccaaaacguucucagcaaaaagucugcacuucucagaguuaaauacaggagaggggagacuccuugaggagccagaaguggguauguucucaggggucaagagaagggcgucucaggcucucccuguccaccgggggucguccuggcuccccguaccuucgggcaaguagcucuuggcuugacacuguccagcccgccagcgucccaggccgccccaagcccucaugggggaggagcaccgaccugucuccaagcaucggaaaaggcgggccucccuugccguccaucacggggcucucuaggcccccugcgucgccaaggaggagucucugacauccccaauucgucaagcuagucucuuaagaccucucaccuuaggcggguuccccaguccccccaugcagucaggcgagccuccuggcuccaccacgccaucgagcgaguucggcucuucgccugucaccguccgucggggcgggucuccggugcccccgugcugucguggggguuccuuggacugucgccgucgucaggcuggcaacccacgccgccaggcuccccggucggggcccgcgggcguacgaaggcgcccauggcgguggcguggcccgagcguagcagcugcagcuggcgccgcccgcggcgguacagguacucgaugcgcagcacgucggaccgcggcaggcccgcaugcugccggaacucugcccgcacucgcgccucggcgcccggcuucccacgcccggcgcgcagcagaucgcgguacaggcucagaaccugccucugcagccggcugugccggcucaugaccgcggcuaagcagagacgcucagcgaacgaccugcgaaccgcggagccgccacacagccagcaaaggccaaagggcaaagccac

SEQ ID NO: 191747 - RNA, 4985 nt, Homo sapiens
gggagagaggauaaauagcagcguggcuucccuggcuccucucugcauccuucccgaccuucccagcaauaugcaucuugcacgucuggucggcuccugcucccuccuucugcuacugggggcccugucuggaugggcggccagcgaugaccccauugagaaggucauugaagggaucaaccgagggcugagcaaugcagagagagaggugggcaaggcccuggauggcaucaacaguggaaucacgcaugccggaagggaaguggagaagguuuucaacggacuuagcaacauggggagccacaccggcaaggaguuggacaaaggcguccaggggcucaaccacggcauggacaagguugcccaugagaucaaccaugguauuggacaagcaggaaaggaagcagagaagcuuggccauggggucaacaacgcugcuggacagguugggaaggaggcagacaaacugauccaucaugggguccaucacggggccaaccaggcgggaagugaggcagggaaguuuggccagggagucgacaaugcugcagggcaggcuggaaaugaggcugggagguuuggccagggaguccaccaugcugcagggcaggccggaaaugaggcugggagguuuggccagggaguccaccaugcugcagggcaggccggaaaugaggcugggagauuuggccagggggcccaccauggucucagugagggcuggaaggagacagagaaguuuggccaggggauccaccaugcugccggucagguugggaaggaggcagagaaguuuggccagggggcccaccaugcugcggggcaggccggaaaugaggcagggagauuuggccaggggguccaccauggucucagugagggcuggaaggagacagagaaguuuggccaggggguccaccauacugcuggucagguugggaaggaggcagagaaguuuggccagggggcccaccaugcugcggggcaggccggaaaugaggcagggagauuuggccagggggcccaccaugcugcggggcaggccggaaaugaggcugggagguuuggccaggggguccaccauggucucagugagggcuggaaggagacagagaaguuuggccaggggguccaccaugcugccagucaguuugggaaggaaacagagaagcucggccaugggguccaccaugggguuaaugaggccuggaaggaagcagagaaguuuggccaggguguccaccaugcugccucgcagguggggaaggaggaagacagagugguccaaggccuccaucauggcguuagucaggcuggaagggaggcggggcaguuuggccacgacauucaccacacagcagggcaggcugggaaagagggagacauagcaguucaugguguccaaccugggguccacgaggccgggaaggaggcagggcaguuuggccagggaguucaccauacccuugaacaggccgggaaggaagcagacaaagcgguccaaggguuccacacugggguccaccaggcugggaaggaagcagagaaacuuggccaaggggucaaccaugcugcugaccaggcuggaaaggaaguggagaagcuuggccaaggugcccaccaugcugcuggccaggccgggaaggagcugcagaaugcucauaauggggucaaccaagccagcaaggaggccaaccagcugcugaauguaggugaacagggauggggagaugggggacagggggguugggggagggaaagguuaaaccccugggacauuuggcggggcggggggguccgcguagccuuuguuuggugaaagaagcuugggcagcuauaucacuggguuccucccccuuccccaucucccuuacaaaggagcugguggcagcuggucagauggggugagccaccuuaucugcaaagcacguaucagacaggguggcgggcacccugucccaccuucagggagcugcccuccugguuaagggggccucaaguggggcccaugaagcccuuccuggggaaugggaaacaguuccugagaucaagaucuaguauagugcaaagggacugaguguugacaaaaccugguuaggagagugagcaugaggaauagcuuucggagaugagccuuggccuguguaaucuuuguaacuacccucugauguggucaagaugaggcugcugacgcccugauucucagauaaggaaacaaaggcucagagagguuaggggacgugccaaaguccuguggcuagugcccagcuuuggcagagggcaggccaggguucucuuccccugcacugcccagccaggagagguuuucuggaagguuucucuuacccauuuauguagggggaacagaggccagguucaguggcucaugccuguuaaccccagcacuuugggaggccgaggcagguggaucacuugagcucaggaguucaagagcagccuggccaacauggugaaacccuaucucuacuaaaaauacaaaaauuagccaggugugguggcuggcgccucuaaucccaacuacucagaaggcugaggcaggagaaucccuugaacccgagaagcggaguuugcagugagcugagauugcaccauugcacuccagccugggcaacagagugagacucugucucaaaaaaaauaauaauaaaauaaaauauguagagggaacagagacuggaggcaggcaaauagcaccacucacaacagaacaggcaccaagaagggagcguggggagcaggagaggguggacuccugugcgcccucacucuccaggcuccaugagggguccuggaucugcaagaugugacuggcucagacgucgaaguccagagccacaucugccgccagacagagccagggauggguggguggggaggaacggcgcagcagaggagcgggcacggcaggcugcagggugccgcgagcagaggacggugcacuguaggauuuggggcuggcaacagcagccgggguugggggcacugcuggggugcauggcugagugucuggggcuggguuaaggacaaggaucaguggaguuagggaugcagcuagacagggcauagaaggguagauuugaggucagggcugagguuaaacuagguccugauauuguuugucacggguccucuaccuucccuuuccaccagccccuccuccaugacugagagcacuucauuaaggaaauuaaaaggggcuuuggggaggaaaaggcagcaggaggcagaaugcccacgcgagcacgggcuuuggguuuucuucuggacagugaggaggcaguggguuaagcugugccucccaccgcagccccagucacccuggaggggaccaggucccuggggaaaaggaacugggagacccuccgcguuugugggguuguaacaagagucugggcuuuguccacagggcaaccaucaaagcggaucuuccagccaucaaggaggggccacaaccacgccguuagccucugggguaagcgcggacucugggguaggggagaggaggccccugggaguucccuagcauggcugugggucagacgcuggagacugaccuucuuguccuugaauugcaggccucggucaacacgccuuucaucaaccuucccgcccuguggagggugagugccccauggugucucuuuucugcucugcguccugauagauacgcucaccccgaccccuucccggugucuguuuggacagcuccccgggcgggcagaccugcagccucugcaaagacccuccaaccugauacccaguccugggcuucccucucuccaccugcucccuccccuuugcacccugcccucaucuuuugggugccuuucauuuccaccaaggcaaacacaagcuggcagaaaagaccucccaggcccuggugccccugggagccagggagggaggaggggcugcugacuguucucauucccucucucuccuugucauuccucgauucccauuugcugacuggcuucccuccugucccaacccuccugcaaaugccuuugcuucaugcugggagggggagccugugucuuuguccucucccuggugcaaggucaccccagugcagaggcuccuauggaauccugguucccaguuggggcucaaaguaaacuccugacucucuuucuuuauuuuaauuuauugagacggagucucacucuaucucccaggcuggagugcaguggugcaaucucagcucgcugcaaccuccgucuucuggguucaagugauucuccuaucucagucuccugaguggcugggauuacaggugugcgccaacaugcccagcuaauuuuuguauuuuuaguagagacagggguuucaccauauuggccaggcuggucucgaacuccugaucucaagugauccccuccuuccucagccucccaaagugcugggauuacaggcguaagccacugcacccagccucuuuuugcacuuauuguaucugcugcccgagaccuggugcaggccagggugaggguguaucacggaggaggaaggcccacccuuguguaucccaggcuaugggggcggcagagcauccucucaggcuaaacacacgaggcuuguugguuccugcagaggccccagccccucugccuguggggacuggcuuccuuguguucuuaaguuuagaugcuaccuuccugaaacuuccccagaacauaacuccggggccagagcagccaguccccuugugcuucucccgaggggcggggcugaggucucgggucccgucaugacuguggacccuacauucaccccugcucuccuucucucuuccagagcgucgccaacaucaugcccuaaacuggcauccggccuugcugggagaauaaugucgccguugucacaucagcugacaugaccuggagggguugggggugggggacagguuucugaaaucccugaaggggguuguacugggauuugugaauaaacuugauacacua

SEQ ID NO: 191748 - RNA, 18193 nt, Homo sapiens
uucuuugaaguggcaucugagccauuuuuauugugagcucugucucccuggcagguuaauccacaccaguguguccaucucaaacccggaguccccagagucaaggggccgcugauacguacgucucccugugcaaugccucacuuccaaaggagaagccaggccaggacugggccccuuucuacuucguuucuguccuuuucugggcuuucccucagaggcagaaacugggcauaauauucgugaguggggaugucagaucagggguagagggccagagagauggagaagggaaggaaaaaugaugacgagcagaucccaggagggacacaagcagcuggggguggagauggccaguggccguggugggggcagggggaggugugcaugucagggcagguauuuagauggauuucuggguagcaaggagaguggaagagaacaggggcaggaguuuuggagguuugggguuacccucaccaaaaagacuggcucugagccaggcacaagguucuccgcagugagugugugugugugugugugcgugugugugugugugugcgcacaugcgcgcaggaggaagccauguggcggugucuggggaaacucggggacuucccuggcccccgcugcccccagugccucugcugcagcccauccagugucaauguuugaggaucacauaguccacauuuucuugugccugaggccgcuccccgaccccaaacuggaucagcucugaguaaugaauccccucaucuucuggaaaaucuggaaugacguucucauagucgcccugagaaaaccgcauggugguuagccuggccccacugucgccagccuccaccgccgcuuuucuccgcauucucuccuucauuccacccggggguccaaaagcccaggcggguguccucgugucaggaaacuggcuguggccggcauccaggaccuggagguaccugccuggcucuggccagcucugccggagcaaccgucuccaacacccaaccucugccaccacggaugccuacccaacuccuuccuaugugggacccaccacugaggccaggcccuguccccagccuuccacagccccucuggggagaccuggggagacccuccuuaccacuuggcgcuugugcaaugcugaauaagugaccgugucaucgcaguccgggggaggucucugcaucucugaggacucugcaucucugagagacagggcagauagacgaccacgcaugaagcaucucccacgaacucuccucccucucaacacccagagcccccaacagcaccccaaccucagccccuuauguaaaaccuguggccuccccagugcccaaagcucacaguaggagcucgugcaaaugugcguggagggaguaggcguggguguguaucaugaggucuugaucuuugugauaagaacggacugggcaugugugcugcugacuugaaggagcagguccacuucuggagacuggcccuuacccagaggcuuguugccgagugggaaugaggcagagcauguaucagggugccuggcaugggccuggcacaaagagggcaggcgggacagagcuuuuccucccgccucccucccagggugcagggucacccuccugguacccucaguacccaguucgugguauguucaucucgggaaagcgcagggugguguagcuaaugccaucuuccaucauuggauuguagcaucccagggagugggggccuucagagaggggggcccuucuaaccugggagggagacgaggaugaagugcuaaccaccuguuccccaacccucguccccuucccuggccucugacagcccaggucuccucagaggacauuuuauccccuuccuucaccuuguuuccccacucagcuucacagucugccucaugccuacccuuuuuuuuuuuuuuuuuuuuuuuuugaggcagagucucaguaugucacccaggcuggagugcaauggcgcaaucuuggcucacugcaaccucugccucccagguucaagcgauucuccugccucagccucccgaguagcuggaauuacaggcauggaccaucacgcccggcuaauuuuuaaaauauuuuuuguagagacaggguuucaccauguuggcuacgcuggucucgaacuccugaccucaggugauccaccugccucagccucccaaagugcugggauuacaggcaugagccaucgugcccagccccauccuaccuuuuuauuccucacaaagaagcucuggccgcuggaauucuccugaagccccugcuggcucuguguccucuuccaacugagaaauaaaggcacaugugugagggucagggacuccacaggcuggaggcuucgagauggagcaacuggacacgggccucugccaagggauagaggagguggugggggauggcaggagcucaccgucgcuggagcuugagcccacagauugccaggaugaggauggcgaggcaggacccgagucccacagccacucgccugccgauggucuccgggcuaucuggguggagaaaggagagaccuuaaucaacugaggggccagcucucccuggcagccuuugccuggaaggcauccuggacuucucucugcagccagacucguccuucuccccugcaugcgugcaggggugcagaggaagagggugacaacggccccugcuugcucugggccucccuuuaggaauaaggcacuaauucuccugaggagcugcuuuucccacagacguggcacgcccagagccugugacccgcacccgcauaaaugggugcagcucuucacggcaguauagcugugugaucagcucugaaagugcaccugucuuccacccagcaauuccacaugggaaugcaucuugcaacuguccuugcaggcgugcccaaaacaagaggcugcagaccuaggcccugaagagggcacugggaggaggauguaugcaaccuucauacgcgaggacuccauggccccaggaaaaagaggaggcucucaggcugucugcaaaggggauacccagggaacaaugguuuuauaugaugggaugugucuguuacauuuccagauaacauguuucagauguuuuccuuuggccuucggccgugcuggugaugguucccuagauugacugauugauugauugagacagagucucgcucuuucacccaggcuggagugcaguggugagaucuuggcucacugcaaccucugccucccggguucaagcgauucuccugccucagccucccgaguaguugggacuacaggugcgcgccaccacacccagcuaauuuuuguauuuuuaguagagaugggguuucaccauuggccaggcuggucuggaacuccuggccucaagugauccacccaccuuguggccucccaaagugcuuguggccacccacuuuggccucccaaagugcugggauuacaggcgugagccacugugccuggucagguucccucaauuuaaggccauguuuccaauuauuaaucugaaaaaguacaauaaauuaauuagguaucuuccauaugcuuucagacucuuuuuuguuguuguuauuguuuuguuuguucguuuuuaaaauuuuuuuugguauuuuuuguagagaugagauccugcuaugaggugugggcuauguugcccaggcuggucucaaacuccugggcucaagugauccucccaccauggccucucaaaguguugggauuacaggcaugaaccaccaugcccagccuccagacuuuagacacucuguguaugcauagauacagaacaauguccaaacaguauuauuacauggaaaaaagcaaagaaaauucccaggcaaagugugggcucugccucgucugugucaugaggaaggguauauaggcacagaccucugugugugaauugugcgugugaaaaauaccccuggaggagaugggaagacugugugcagugagaugggaagacugugugcagugaggaccuuugguggggaugagaguucucagggaucaagagugagccgcgucugucuuuccacuauuuacccuuucaugcuuacauuuuauuuuuuuaccaggugcuuguaugaucuguuuaaaaaccacucaaguuuacuacuguggaggccgaggcaggaguaucacuugagccuagggggucgaggcugcaggagcugagauugugccacugcacuccaaccugugcaacagggugagacccugucucaaaaaaaaaaaaaaaaaaucagccgggugcgguggcucacgccuguaaucccagcacuuuggaaggccgaggcgagcggaucacgaggucaggagacugagaccacggugaaaccacaucucuacuaaaaauacaaaaaauuagccgggcaugguggcaggcgccuguagucccagcuacucggggagcugaggcaggagaauggcgugaacccgggaggcagagcuugcagugagccgugaucacgccacugcacuccagccugggugacagaucgagacuccguuuaaaaaaaaaaucauuuacguuuuaaaagauaaaaacaaggagccugucagggcugagagagacagaguagucagagagagagagacagggacccaguaggagcucaggacuucuggaagguggagcagccugagaggggacccuagagggaggcaggagagacugcaggggagguagaaaaagagagacuggugacgcaggacaagacgacuccuccagcacagcggcagauggccuggagcaaggggugugaaugggaaaggggacagugagguggggaagaaggggccagcuggucuggaaggcuuuucgggaagucacuggaggagacagggccagagaggagcaugagaggaaacagggagaggcacaguggcucauggcucuaaucccagggcuuugggaagcugaggcagaagggucacuugaggucaggaguuugaaaccagccuggucaacauaguaagaccccaucucuacaaaaauguaaaaauuagccggaugugguggugcaugucuauagucccagcuacucaggaggcugaggcgaaaggauugcuugagcccaggaauuggaggcugcagugaggugucauuaugcgacugcacuccagccugggugacagaguaagaccuugucucuauaagaagaagaagaaggaaggagaaggagaagaaagaggaggaggagagggagaaagcagaagaagaagaagaaggaggaagaggaggaggaggggaagaagaggaggaggaaaagaaagagagaaagaaaggaaggaaggaaggaaggaaggaaggaaggaaggaaggaaggaaggacugaccaccaccaagaagaacaagagcaggaagaggccuuacaguagacggugagggugcugagaggcgaacggcccuugcccacacuguugguccccuggcaccaguaggcacccgagugcuggaccuucaccggcuccaaucucagcuucuggcugugguaggggaggcuuugguuauuccagucaaaccagguguagugggagacgggaggguuggcgucgcucucacaggucaggguugcacucuuccccuccaucacuuggucccccgggcucauggacacacgcagccuccugggugcaucugcauggcgggcagggggagggggugcgaagucacuaccaggcaggccacuggucccuucucugcuccacucccagccuccggcccucacucacacagcacuucaaguguccaggccuuggacgcugucuguccuauggaguuguucacccagcagcuguaacucccagcaucuucuggggagauggagucaaaauucagcuggcuuucuuuccccagaagccugccauuuuucucccagaagaacuggacuucuuugggguggcugcuugagaagucacauuggaggcugaccgaguuuccagagugaaucucggaaaggggcuugauuuuccggacccucacgucucggggggcaucuggagggcaagggucccaagcugaccucuccgcucccugucccuuuugcuguccccaggccuccccuccccuuggcccugacgccaggcuccugucccucaauucuguugaagacacuggcccaggcuccggccucguugccuucauccccucaucccagccgggccaccucccagaucccccugccuagcccagggacucacacuggacauucagggcgacaggggaggcccacgagcaccaacuauuacaagcugcgcaggcgaugguuguguugucccagccaacguuuuggaucuucagcaccccaagcgauggcuccucccaggcgccaugggguuuccauucauaccggguaacacugggguuacuggaauuguaguuacaggaaagggucacugugucuccuucucgaaucggcaugggguuuugaaucacuguggucaccuucuugggaggaucuggaagaaaaccagagaggugaguaaagaaaagccagcuguccacaguaccccuucccuccugcuuccucuucucccgcuaccugucccgggcaucugcacagguccuaaauuaaucaaaggggggcuugugcguccuuccugcaucugugugagaacagaaacccugcccuggcucucuggccuggcugugguuuggugcagggguucagggcacagcgcugaagccagacggcugcugagaggcgcacgggcaugggcugcaggucucaguuuacacgucugucaaaugggguccugaggccgggcaugguggcucacgcuuguaauuucagcacuuugggaggcugaggugggcagaucaccugaggucaggaguucgagaccuggccaacacagcaaaacccugucucuacuaaaaauuuuaaaaauuagcuaugcaugcuggugcaugucuguagucccagcuacucagguggucgaggcaagagaaucgcuugaacccgggagguggagguugcagugagccgagaucaagccacugcacuccagccugggcaacagagggagacuccaucuuaaaaacaagaggcagugcgggguggguggggggugaguccugagaguuccuaaccuccugggaauuguuucaagaaggaaaugagaugacucccuuagagcagaguguggcguguggcaaacacuccacaaacaucacuguggcugcuguggucacgcauccagcugucugagaugcucaggauuugggcaccccuguccuguuagcacauaugacaucucaggguccaaggaucgagcuuauguguucuuuuuguccugugcucuacaugguaacaagauucacuguguuaaaagggucuuacaauggagagguaaugagacaguuugccccaguucucauuaaaaauuucaagaucucucaagacucagccacugccuagggacgcuaagucucugugucccucauggaguccugguaucuugcaguuaauuauucuuuuuuuuuggagacagaaucucacucuacccaggcuagagugcagugacaugaucucagcucauugcaaccucugccuccuggguucaagcgauucuccugccucagccucccagguagguggauuucaggugccugccaccaugcccggcuaauuuuuuguauuuuuaguagagacaggguuucgccauguuggccaggcuggucucgaacuccugaccucaggugaucugcccaccuuggccucccaaagugcugggauuacaggcguaagccaccaugccuggccaauccauucuuuuuuuugagacaaggucucacucagucacccaggcuggagugcagcggcaugaucacaggcucacugcagccucuacuuccaggcucaggugauccucccaccucagccuccuggguagcugagacuacaggcaugcaugaccaugccaggcuaauuuuuuuuuguagagaugggguuuuaccauguugcccaggcugggcuugaacucguggccucaagugagcugccuaccuuggccucccaaagugcugggauuacaagugugagccacugugcccagcucacaccuauaaucccagucccagcauuuucuuuuucuuuuugagacccaggucuugcucugucacccaggcuagagugcaguagcaggaacauaguucagucugcagccuucacuuccugggcucaagugauucucccuccucagccuccccaguagcugggaccacaggcacgcaccaccaugcucagcuaauuuuuguauuuuuuuguagagaugguaucucgcuguguggcccaggcugguuucaaacuccuggguucaagagacccuccugccucagccuccuaaagagcugggauugcaggcgggagccaccgcaccuggccucauucauucaacaagcaucuacaggccgggugcgguggcucacgccucuaaucccagcacuuugggaggccgaggcggguggaucacgaggucaggagaucgagaccauccuggcuaacacggugaaaccccgucucuacuaaaaguacaaauaauuagccgggcgugguggcgggcgccugucaucccagcuacucaggaggcugagacaggagaauggcaugaacccgggaagguggagcuugcagugagccgagauugugccacugcacuccagccugggagacagagggagacuccaucucaaaaaaaacuaaaacacaaaaaaacaagcaucuaccaagcacccuccaugagccaggcccuaugcuaggagcugagacagcaguugugaacaggagacccuggcugcuccuugcucuugacuccaggaccccggaaugcccugcaccccaucugccuuccccguucccuguguccaucuucucucccuagaaccagaggcuccguggcuacucacacuggacauccagcucagcucccgggccccucuguccaguaccaagaauguuuucugccacacaggaauaagucccagcgugccaggggaggaucuuugggauguggacuuucuccucuguccuucccugcauuucuuucccauugugguaccacguguaauuuguuggaagaggauuggccagugacaugcaaagaaacucgacuugacuucccuccacagccggugaguggaggaucugaaccguggaagguuccggggcaucuggaagagggggcagaggcgaguggaggggugaggagagcacccccaaccugugcacacggccccgagagcccccguggcuccccucuccggguccaccccugcuaccucccugccuggccuguccccagcuccgaggggcucacacugcacuugcaggaacacuucuuccgaccuucccgggcccacgucauuggagaccugacagcaguacuucccacucugguccuuggucacuucgcgcagguuuagcgugaauguauucugcuucuucagcgaggucccauccuugagccaggauaccgucguguacuccggguugcugcugcugaccucgcaggucauggucacagagucccccucccucacuauggcaucacugggagugaccuugaucuccaacuucggggugucuggaggagcagaggggcagucggggagggggcggggaauccucagaggguggaggguguggaaagugcuuuuauucugacaaagccauggccugccagucccuucacccaggugauggucacagccuccuaacucggcucucagcuucccccucccacuuccucuacuucuuggucuccaccagcagcacgcaggguuccuaacaccaucuaccagaccucgccaauccugcuggaaaccacgagcggguucugugcuuugcauagaaucccaaacccucaccucagcccucgggauccagaguccugcuccaucuccugccuccuguccuaccauguggcccucagaggcggugaacuucagccucugagguccucccacccagcugcugccucaaagcuuugaaccugcccuucucuuucccugaaauccuccucucccaaauaugugccggccucagccacucccuccguuccagucagcuuaagugcucaccuucuuuuuuuuucuuuuuuugagauggagucucacucgucacccagguuggagugcaguggugcgaucucagcucacugcaagcuccgccuccuggguucaugucauucuccugccuuggccucccaaguagcugggacuacaggcgccugccaucaugccuggcuaauuuuuuguauuuuuacuagagaugggguuucaccauguuagccaggauggucucgaucuccugaccuugugauccccccgccucggccuuccaaagugcuaggauuacaggcgugagccaccgcacccggccuaagugcucaccuucuuagagaggucucucuccaucacuccccucucucggccuuauuuuuuuccuaacacacauaucacuaccuacaauaguguuguauauuucuuuguuaacauugcuuuguuccagauucuaaugucuuggcucaugcucuguauuucuuugguaauccauuuguugucugucucuuucacugcagcgcuggcuccgcguggggcaagaguuuugcucacugcugcacccugcccaccgccccaugccccccauuggcagccguaauaaggccugguaccuaguagguucaugauacguauuuauugaaugaaugaggcacaagauaaugaugcgaaaaaaauccccaccaagaggggaacaaaaagaccuaaccagauaauccccaauucaugucauggcuugaggauggaccauuuuauucuguuaggcuagagcaaaucuuuuucccgaaacaccagggcugacaaggcggcgugaccagggcuggaggaugccgccgucugugcaggcuucccccugcccugggugcaugcccccugcggggcuggggagaaggugacacagaccuugcccuucccacaggcaugccggggagacucacgcuucacguucagcugcaccgugucauuggagaggaacuucccaucugcauccugaagcuggcaggucacaaucuucccauggugacuccacuguggggagaacuugagcucgcuccgggugaagacagacuugauggucaaggaggucgaggugacagcagccugccucauuggaacccccucuaggagccacugcaauuggaucggauacccauagcaggagaaauucagcaagcaggucagagugacuuccugggacucuugaauuucuggagggagcuggauaugagguggaaaaggccuuucugcaaaagaacagagcccgugcaggagccugggggacugaggacgugagcguacaccuggcuuuagauguccugucccaaaucaccccucaggaaccccuugccacuucauuccaccucucuccaguccugcuuuguuuuuuuguuguuauuguuguuguuguuguguuguuguuuuuuugagauggaguuucccucugucacccaggcuggagugcaguggcgcgaucuuggcucgcuguaaccucuaccuccccaguucaagugauccuccugccucagccucccgaguagcugggauuacaggugcccaccaccacacccagcuaauuuuucuguauuucuaguagagacaggguuucgccauguuggccaggcuggucuugaacuccugaccucaagugauccucccgccuuggccucccaaagugcugggauuacagguguaagccaccacacccggccucuuuuuuucuuuagagacagggucuugcuuugucacccaggcuggagugcaguggcgcaauccuagcucacuguagccucaaccuccuaggcucaagcaauccucucaccucagcccccugaguaacugggacuacaggcaugugccaccacaccuagcuaguuuuuuaaacauuuuguagagacagggucuugccauguuacccaggcuggucucaaacuccugggcucaaacgauccuccgaucucagccucccaaagugcugggguuacaggcgggaaccacugcacccaacgcaguccugcuuuucuccacuuugaaucacuuuugcucacccgaaauccccucugaaaggccuugaccacacuaagccuccuugggaacugugaucuacuuuucuuucaugcucauugccggaugucugcuuucugaaugauugcaaaguucuauucccaccaccucaccaccucuuuuuuuuuuuuuuuuuuuuuugagacagagucucgcucugucgcccggacuggaguguaguggcgugaucucagcucacugcaagcuccaccuuccggguucacgccauucuccugccucagccuccugaguagcugggacuacaggcgccugccaccacgccuggcuaacuuuuugcauuuuuaguagagacaggguuucacuguguuagucaggauggucucgaucuccugaccuugugauccgccugccucggccucccaaaguucugggauuacaggcgugagccaccgugcccggccuauucccaccaccucuaagugaauuuuaucaguuuaguucacggacuuuucagcuuugacaaacuuguguuacuuucauggcuuccuucaguauugcagccauccacgcaccgcauuccuuuaguggagugggucugugugcacccagccucagcucuccccaaggcuggaccaccuccuucagacagcggggucugaaguugcauugcucaccccaaauuuaaggcugcucagaacugcccauccgggaaacgguguggaacggagugaccacacucccuguggcaggggccccccacaccuguguuugaugggucaaagccaccccuacaugugcagugcuauaacugaaccuauguuauaaaaauuauaagauguucguuuuacuucuuuucuuuucucuuuguccuuuccuuccuccaugcaugauuaguuacauuuggucauuucaguagcagguaaccauuaauucacucauaauuguuuaacuuacauccugacucccuggcagcugccugcaagauaaaugaacuugucucucuuucaaagaacaaugauccuuaggucacacagaccuccuugaugacauccagaaauuugaugagccgaggggcacaacagcuuugacgaucgggaggucaccuccugcacaccuacuuuacucauaaaagcccccacuaacgcucaaagucaggucagauuugagaguuucucucuucuguccccuugcuuuggcuaaauuaaauaauccuaucucagcuucuaagcacugaggugucaguguuuggcugacuacgcaucgggagcucaaaccuggccuuugggguucaacaacagugucaucugaccuugaagagcucaugagaacuugccaugaacauuaacaugcugggagauuucacuggaaaaucuagauuuccaucgucucuugaaaaaucagaagaucaggccgggugcggugacucaugccuguaauccuaaugcuuugagagguugaagcaggaggauugcuugaggccaggaguucaagaccagccuggcaacauagcaagacccauuucuacaacaaauuaaaaaguuagcugggcaugguggcaugcaccugugauccuagcuacuuuggaggugggaggauugcuugaacccgggagaucaaggcugcagugagcugagaucgcgccacugcacuccagccugggugaugacagugcgagacccugucucauaaaaagggaaaggaaggggaaggggaaaagaagaggaaaaaaaguaaaacaaacauuuuaugauuuuuauaacacaggcucaguuauggcacugcacauguagggguggauuugacccaucaaacacaggucuggggccucugcccuagggagugugguuacuccguuccacacccaguuuccucuauagggagcucugagcagcccuaaguuuggggugagcgaugcagcuucagaccccaaugucugaagggggcgguccagccugggggagagcugaggcugguuacaugcagacccaccccacuaaaggaaugcggugcuuggaugguuccaguacuaaggccaaacacgaguuugucacaaaagcugaaaaauacauggugagaaagaaagagggaaagaucaggagauccgauaacuuuggaauccaggucccagaggggcaggaacugagggucagaugggacauccgaggucccgcagcucugucuagugcugcugcaucgccaucgucauccgcuggcguccccugccugagcucugcaggaagcucgguuugugagcucugugccaggagucagguauuuccugccucccacucaccccugcccagagcagaggacccgcuccccgaaggccuuaccagagacauugagguguauucguuccauccauuucucagucuuggacuccauccucagccccagcugaccacugucauugaggugcaccggguggauacucagugugcaguucuuauucuugucucccaggaauugcacccuuuucugcucagaaggaaccuucccauccuuugugcuuucauagagucuugucccaucaaacuucgagguguucuuguuauacucaggauuguggaacaggaugaagcuuuccaggucaccaucuagggcucuguaggugcaggggauccagacgcaggcccccucccaggcguagaggguuucagggugcucaaaaacccauuuacuugagucagagaaagccaaguauucuagaacucaccacagugaucagaaagcauuacuaagggggcaugagagccuucuuuuaaaaguuauuuuuuauuuuaaaauuuguuuaauuuuuuauucuuuuuagagauaggggucuugcuauguuguccaagcuggccuugaacuccugaccucaagugauccucccaccucagccucacaaagugcugagauuucaggcaugagccacugcacccagcagagagcuuucuaaagacuaaagaauucccucugaagauagugggagaaauacagagauacacaaagacagcaggaugcaaugagagaaguguauguauauaugggaaacauauauauuuguauguacauuuaucuauacacaccgcugcccccacccuacccuauguugacgccucucugccugggucuuuccuccuccuccagugcccacugacaucccagaaccccaguacuagcccaggccacaguccuuacccaggagcaggagccaggggccgaggagaugcauggugucgugucugggugcaagccugagcaggggagaguuugucuuugagccaucuggccgcuuacuucuuccacguggcuuuucuugcucacccacugagcuccgacccuuccccuggauccgggaggaccgggucugguugcauuauggggauguggcauuugggaugcucacggaguucuuucuuuuuuuuugagacagagucuugcucugucucccaggcuagagugcaguggugugaucuccgcucacugcaaccucugcuucccaggcucaagcguuucucuggccucagccccccaaguagcuggguaaaggcaggugccaccacgccuggcugauuuuuguauuuucaguagagaugggguuucaccauguuggccuggcuggucuugaacuccugaucucaggugaucugccagccuuggccucccaaagugcuggcacuacaggugugagccaccacuccuggccgggaguuuuuucugagugugcugcaccucuccuucaaacugagagcccugcgggggcagccucucucucuucccagaacuccuuccuuucuuccuuccuuccucccuugcuugcuuuuucccauccauccauucauccaucucuaauuuuauaaacuuccugccuggcucacaggcuuugaguggcaccagaccacugagugcuuugaaugccaggccccggguaacguggagcucucucuggugcuacucaucaaggauuauacucagggacagacauggucaaaacuugguuugaaagaccagguaaaaaggaauucuaaaaccaguaacaaaguaugggugagccaggcgcaguggcucacaccuguaaucccaauacuuugggaugccaaggcaggcagaucacuugaggucaggaguucaagaccagccuggccaacauggcaaaaccccaucuuuacucaaaaugcaaaaaauuagccaggcgugguggcguacaccuguaaucccagauacucaugaggcugaggcaggagaauugcuugaacccgggaaguagaaguuggaaugagccgagaucaugcaacugcacuccagccugggcgacagggcaagacccugucucaaaaagauaaaaaauaaacuaaaaauguacagagcuggucaaacaaaaccuaucuguggguuagguucugcaacuguugcccaucuuucuuucuuucucugcagugagcuuguccucuaccaucccugaccucugcauagaguuauauuuacauagaguuaaauuuaagucccaauuuacaugaucauggcccuccgugcuggcccccggggacccugaaggaugugacagcagagugugucuccggucucagcaccaacccaagccccucccacucaccugccaacauuucacacgcaucaauguuccucucucugucuguuuaucuccucgggccacauggcucaugccaaaggcugcuggguaucuguucaugggugugcggaaagcuaagcugcuugccgacagcaggaagggggucuggccugggcuaagcaugaauuuggggugcagggucugaagcugaggcagauuccccaggcagagcugacaucagccccgcagguacucaucaugucacaugcaaaaaacaucuucaaggucacauacacuugagaaaggcaggguaaaagaguuaaguaagauucuuuuuuuuucuuuugagacagagucucauucuucugucgcccaggcugaagugcaguggugugaucucaguucacugcauccucugccuccaggguucaagugauucuccugccucagccuccugaguagcugggacuauaggcaugugccaccacacccgucugauuuguuuguuuguuuguuuguuuuaguagagaugggguuucaccauguuggccaggcugguuucaaacuccugaccucaggugauccccccaacuuggccucccaaagugcugagaugacaggcgugagccaccgcaccuggcuuaaguaagauucuuuacugcaggacuuuaaaaaccuuucaguaaacucuaucuacaccauuaaucucuagacauggggauuagaguauaguauaauacauuguccauacuucuuuggccaugggaucuauuuuacauguuccauaaaaaacuuagcaggguugcagagccagaguucuuugaaauccccuuaagguuaccuaagggguaacaagggcuguggcaaggacuagacuccguucccugcagccaacacuugccuccaggagccgggccauugucccuccucugccagcacccuccagccacaaccugcucugggacgggcuggagcaucccagcaugagugggagaugggcgccuccagagcaggacugugugcugccucaaggagcuccaggagucucuggagcacaggaguagggccccaggcccgggaauuggaaggcugagggugggguggagguuagggacagcaguuauuaugcacagaggcucaggacagggccaugcuguccagaccuccucaguccaggccuguugagggccuugcagaaccuuggggcugaccucccuggcuccuucuucccuccugggcauccaauaaccuacccuacucucagaagacucagcaggccuggcaaggaggaugcucaagacaggggucugucuacaaccuguuguaacaccgguaagagagagccagggagguccccacuguguucccagcucugggagguaugccuggcccauaacugcuguuccguaauaacuugcuuguugaaugcaaaauaaaagcaaaaugauuuuuaccuguuuccgcgugucuucccucuucagggacccuggcagcaucugagagcaaaaggagaagu

SEQ ID NO: 191749 - RNA, 21770 nt, Homo sapiens
uuggauguaaacauuuguuuuaauuuauauuaauaaaaggaaaugcucuacuuaaacaauaauucaucugggucuucuuguauaauacaaaauucuuccaugggagucugaugauuugggggccagcaacucuucucacauguguaaacuagaauuguuccaaauuccacagaaagaccugaaaaauaccacauauucaggcuuccagcaaaaagaguuaugagacugauguuacuaaaaggaaugauuuuaccuuauaagcugaaaaaguaauuagguaaagcaaaaacagugcuuacugcuuucagcuauaacagaaucacagucuauccuauaauaagugaauauugauaacaaaaaagcaaaauuaauuuaaaguggcaggaaaauauacuuuaaaaauaaacaaaaauuucagcaaguguucauuauaacugucuagcuaucugauguugaaaaucuauauuaaucuacaugguucaugugauauacauagcuuuuggcuaggugcgguggcucacaacugugaucccugcacuuugggaggccgacggggaaggacagcuugagcccagccuaggcaacauagugagacaccugucucuacaaaaaacaaaacaaacaaacaaacaaacaaaauauauauauaucucauauagccugggcaacacagugagacuuuacuaaaaaaaaaaaaauucacuggguguaacggugcacaccuguagucccagcuacucagaggagacuaaggcagaaggaucacuugagcccaggagauaaaggcugcaauaagcuaugauugcaccaccguacucuggcccgggugauagagcgagacccugucuuaaaaaaaaaaaaaaaaagaagagagaaauauauaucauaggacacacuacugccgagaaaggauaaggauucaggcaaaaaauauaaaauaaacccuaagaguuuacagaaaauuaucaaugaauaaagccauuaaaaaaagauaccaagaaaacauaagcaauaagaacuccugauauuagaacagaaaagcaggagucaagaggaugacguaggcaaugauuugcagcagcaaaggagaaauacauuguuuaaaaauguaugcauuggcugggcacagcacauuggcucaugcuuguaaucccagcacauugggaggcugugguauauggaucaccugaggucaggaguucaagaccagccuggccaacauggugaaaccccgucucuacuaacaauacaaaaaauuagcugggcguggugguaggcaccuguaaucccagcuacuugggaggcugaggcaggagaauugcuugaaccugggaggcacagguugcagugagaagagauugugccacugcacuccagccugggcaacagagugagacucugucucaaaaaaaaaaaaaaaaaugaaaaaauggcagaguuuaacugguauaugacauuccucuaggagcaucugacugguaagggaaaagcgccucaagugagcaagucuacaacuccaguaaacacacugcgcaugcggccucucccaagugcuggagggccacuaugcauguggacagcccaccccaagggaagaaacaagagaaguaacccaagacccaggaaguauaaaaccccaagucaaaggucaaauggacacuugaaucucucagguugccugcuuggcccucuuccaacuauauuuacuuccuuucguucuugcucuaaaacuuuuuaguaaguuuucacuccugcucuaaaauuugcuucggucucuccucugucuuaugugccucggucaaauucuuucuucggaggaggcaagaacugagguugcuacagaccccuacagauucaccgcugcuaacaguauuguggcaaaaauguuagucacaaagggggaaaaaaucagaccacccucauaccucuacaaagcuacauuccaugcaaaagacauuucuauaugagugaaaaaucucagagacuagaaugcccauaagcccuuccagaaaaauauauuucccagugagacugaaccaccaagaaaugacaggaggcaccagggcaaagggcuggcagggcuuucacugucagaagacaacacaggggucuauacaagguucugaaaagagaaagugggauuuaaaaauuuuauacauggguugccccucaaauaugaagccacauuaccaugcacaaucugaagcaagauaccucugagcccuccuuaaagcuauuacuugagaaaauccagcuacugcaaaaagaaucaaaauaaaacaggaauaaaaaagcucacucuaagaguggugauaaacacugaauccauuuacacauagaacuaaggcuauccaaauagcugugauaauuaugauacuggccaggcgcgguggcucaugccuguaaaucccagcacuuugggaggucgagguggacggaucacuugaggucaggaguucaagaccagccaacauggcgaaaccccgucucuauuaaaaauacaacauuagcagggcgugguggugggcgccuguaaucccagcuacucaagaggcugaggcaggagaaucgcuugaaccugggaggcagagguugcaaugagccgagauagugccacuguacuccaggcugggcgacagagugaggcuccaucucaaaaaaaaaaaaaaaaaaaaagauacuggguccaggcacgguggcucaugccuauaauccaagcacuuugggaugccgaggcaggucgggagcuugaggucaggaguuugagaccagccuggccaacaacagugaaaccuguuucuaccaaaaauauaaaaaauuagcugggugugguggugggcaccuguaaucccagcuacucaggaggcugaggcaggagaaucacuugaaccugggaggcagagguugcagugagccgagauagcaccauugcacuccaaccugggugaaacuccgucucaaaaaacaaaaaagauacugaaauauuucaagguaggaauaggguauaaauuuccuuaucuacuaugguaaggagccagaugcauacuaucuaaaacugaaacacagaaagaauguuauuuucuguuaauagcagaagcaccuuucagaaacuugggccucuuagguaaagaaccuauuaccaaaaguccaggccaggcguggcagcucacgccuguaaucccagcacuuugggaggcugaggugggcggaucacaaggucaggagaucaacaccauccuggcuaacacagugaaaccccgucucuacuaaaaauacaaaaaaaaauuagcugggcuugguugcgggcgccuguagucccagcuccuugggaggcugaggcaggagaauggcaugaacccgggaggcggagcuugcagugagcugagauuaugccacugcacuccagccugggcgacagagcaagacuccgucucaagaaaaaagaaggaaaaaaaaaaaaauccaguaacugcuucacuuauacuuaacauuccuucuguuaauuuguacaaaaauuuguucuaagacuuuuaauuaccauauuagugaauuuuccuauuuuaggaaaauuauuuucgucuagccauccauacauucaucugacuugcuauuugucuuuaugucaaaaaugauuguuggaauaaugguuauuaacauugauaauaguuuuaauuucuggccaggcaugguucaugcuuguaaucacuuugggaggccaaggcgggaggaucgcuugagucuaggaguucgagaccagccugggcaacaugacgcaaccuugucucuacaaaaaauacaaaaauuccauccuggccaacacagugaaacccuaucacuacuaaaaauacaaaaacuagccgggcgugguggcgggcaccuguaaucccagcuacuagggaggcugagggaggggaauugcuagaccccgggagcuggagguugcagugagccaagaacgugccacugcacuccagccugggcgacagagagagacuccaucucaauaaauaaaucaaucaauaaauauuaaaaaaaaaaaaaaaagacuggcuggauuauaaauuucuuuuuuuuuuuuugagacagagucuccucacucugucgccaggcuggaguagaguggugcgaucuuggcucacugcaaccucuaccuccuggguucaagcgauucccugccucaaccucccaaggagcugggacuacaggcacgugccaccacgcccagcuaauuuuuuauauuauaguagagacaggguuucaccacauuggccaggauggccucgaucuccugaccuugugauccacccgccuuggccucccaaagugcugggauuacaggcaugagccaccacaccuggccuaaauuucuuaaaauaauuuuuuaauucccaaauuuucuguaauuugcuuaugauauuuuauaaguaaacaaaagguuuuucauuuauuuaaaaauaaugccagaaauccacaaacucaaauuaauaaagggcuucucaccuaaauuagcacucuugagcaugcugaccagugcuggcauaagcugaaacucaaauauccuuuggccuccacacuggcugcaggcugggagcucggugacuucugauguagggcaggucaaaaagaguggcucuccacuccaggaauaccuaggacaaggaaacaaagaaccccgaaucagagccacacaagucgcauucuagcaucuaaggccaugcuuugcaaccuuucuuuguuucuugcagaaaucucccagaggcccaaaaaccuagcaccauggcuguaaagcauagcaagauaucuggaaaucuugucaguguucgauucaaagucucaaaggcacuaaagucaauguucaacugaaucuagguaaagcugcaacaaaguccagacucagcuccacugcagauuaaauggaaucagcccuccacaucacuggccuuacagaggaaagggcaugccuuagagaagaaguccccaacccccaggccauggacccccaggccauggaccaguacugguugguagccuauuaggaauagggccaugcagcaggaggugagcaacagccaagcgagcauuaccaccugaucuccaccucccgucguaucagcagcauuagauucucauaggagcgcaaauccuauugugaacugcacaugcaagggaucuagguugugugcuccuucugagaaucuaaagccuuaugaucugaggugaacaguuucaucccaaaaccaugccccacaucccccaccucagucugugaaaaaauugccuuccaugaaccagucccugaugccaaaaagguuggggaccucugccuuagagggaggaaacauucacuucaguuuuuggguuuuuuuuuuuuuuuuuuagauaaagccuuuuucuguugcccaggcuggagugcaguggcacaaucacagcucacugcagccuugacccccugggcucaagcaauccucuuaccucagccuccugaguagcugggaacacagaggcgcaucaccauacccagcuaguuuuuaaaaaaaaaauuuguagagacagggucuugcuauaaugcccagacuggucucaaacuccuggccucaagugauccucccaccucagccucccaaagugcugugauuacaggugugagccaccacauccagcucacuucaauauuacuguuguucgauauguaauuucugguaaaucauuuuaaaaguuacuaaacaugcaaagaagcaggaaaauuuaccccauaaagaaaguuaaugcaaggagacccauggacaagaugauaaauuuaucagacaaaaacuuuaaaauaccaguaaugaauauguaaaaaaaaaaaaccaaaaaaaaaaccuaguggacaagguaggccggguaccguggcucaggccuguaaucucagcacuuugggaggcugaggcgggugaaucacucgaggacaggaguucgagaucagcuuggccaacauggugaaaccccaucuccacuaaaacuacaaaaauuagccgggcguaguggcaggugccuguaaucccagcugugggggaggcugaggccgcggcugcagaaucgcuuaaaccugggaggcagagguugcagugaacugagauugcuccacugcacuccagccuggaugauagagcaagacucugucucgaauaauaauaauaauacaaaaauuagccagacauaguguaauaauacaaaaauuagccagacauaguggugcacgccuguggucccagcuacuuuggagaguguggcaggaggaucacuugagcucaggagucugaggcugcggugagccaugacugcaccacugcauuccagccuacgcaagcaacagaacaagacccaaucucuuaaaaaaaaaaaaaaaaaaaaagcaacauaaagaguuaaaaauaaaagacaaaaaaggaacaaaauaguaaacuaaaaauacucaaagucacugacaagcagguuaaauaaaaggaauacagagacaaaaacaaaaaaaccccaccaaauggaaagucagguguggugacagaugccuauaacccuagcacuuugagaagcugagaggcugaggugagggaacugcuugaguccaggaguucaagaccagccuaggccacauagugagacacccaucucuuuaaaaaaaaaaaaaaggaaauggaggaaaaaacaauaacagaauaaaauuaacccaacaugguggggugcgguggcucaugccuguaaucccagcauuuugggaggccaaggcaggcgggucaccugaggucaaaaguuugauaccagccuggccaacauagcgaaaccugucucuacuacaaaaaauuagccaggcaugguggugcgcaccaguaaucccagcuacucaggaggcugaggcaggagaaucguugaaccugggaggcagagguugcagugagccaagaucgugccacugcacuccagccugggcaacagagcaagacuccgucucaagaaaaaaaaaacaaaaaacaaaaaacaauuaacccaacaauaccaaugauuacauuaaagggacugcauauuccguguuaaaaaaaccauaacuguuaaguugaacuugaucaaaauuuaaagccaucugucagaaucuguuugagugcuaaaaaaaauuaaauugaaaaaggacuuguacucuugaccauaugaagaauuccuacaacucaguaacacaaacaauauggugagagauuugaaugacacauuauccaagaugauauacagagauggaaaacaagcacuugaaaugaugcucaacaucauuugccauuuggggaaaugcaaauuaaagccacaauaaaaugccacuacacaccuucuuaaauggcuaaaauuaaaaacugaacaucccaagcauuagcaaagauauacaggaaguagaauucuuaaaaacugcuagugggaauagaaauggcauaaccacuuuggaaaacuggccuguuucuuaacaaguuaaacaugcauaucccauauaauacaaccguucuauuccuagguaucuacccccccaaaaucagaacaugucuuacaaagagauguaaacaaauguucacagcagcuuuauuuauaauagccaaacacuggaaauaacccaaauauccaucaacugguaaauguauaguggcacauccauacaauggaauacgacacagcggucaaaaggaaugaacuauugauacaugcaauaagaaugaaucuugaaguauucuaagugaauaaaaccagaccaaaaaaaaaaaguauaucccauaugaccuuauauacuuucacaggaaaugcacuaaggugcaacagaaagaugauuggcgguugccuggggacuaggggagcagcacaggacaggguaggcaagaacuugcgaagaaguaugaggaaacuccuggcagagaggaauauguuuacugucuugacuguugugauuucagggguguauauggaugucaacuuaucaaagugcacacuguaaaaauauacgcagucuguuguaugucaauuguaucucaauaaagcugcugaaaaauaaauguaaacagacacacuucacuacagaagauacacagaugucaaaugaguauauggaaagaugcacaacaucauuuguuauuaggaaaaugcaaauucaaaccacaaggaaauaccaccaccaccaccuacuagaauggcuacauuuaaaagacugacgauauuuuuaaaaccaccaccaggcuagguuucucaaugucaacuauucuuauacucccuguauuuuaguauuugcauauuuaguucuuauuucauuaaggaaaaauucccaauuuuaucuuugaauaguuucugauccaucuauugcguucucuauuuuggacaccaauucuccucauaguaaauauauuuaucaacccuucaaagauaccaucuucucucugaaugcuuucucuuuuucuucugcauucacuggauuagcucaagucuuuccucuauaccaguacuuugaucuuuagccaagucuauuauguuccuuaacuuuuuuuuucuuuuuuuuuuugagacaaagccuugcucucucgcccaggcuggagugcaauggcgcagucucggucgacugcaaccuccgccugccagguucaagcaauucuucugccucagccucccgaauagcugggacuacaggcacccgccaccacacccagcuaauuuuuguauuuuuaguagagacaggguuucaccauauuggccaggcugaucuggaacuccugacuuugugaucugccugccuuggccucccaaagugcugggauuacaggcuuaagccaccacacccggccaguguuccuuauauucuauauguauuagauauguaaugucauggggcuugguuucuuuagcaauucaauuuccgauucauacauaguuacuuuauuuucucaccuuugagcucuuguuuuauggaauccauucuuaugaaguucuuauacauuuugaagcaucugcugggacugaugugcuccuuggauuauauuuuauuuuauuuuauuuuuugagacagagucucacucugucacccaggcuggagugcaguggcacgaucucggcugauugcaaccuccaccucccagguucaagcgauucuccugccuuagucuccugaacagcugggacuauaggcacccaccaccacgcccggcuaauuuuuguauuuuuaguagagacaggguuucaccauguuggcuggaauggucucgaucuacugaccucgugauccacccgccucggccucccaaaguguugggauuacuggcgugagccaccgaguccagcuggauuauauuuucuggcagacuugguucuugagccuuuucuauguucucuucauuuccuuaacuguucuugccacaguaugauuaccuggguggcaugcuauuuuucaucuagcucacaccuaaagggggcaacucaguuaagaccaucuauuugcucugaaaugucugcagagguucucauugauuuccuguccaucucauaugaggccuguuuuccucucucuaagaguacuguccauuuccucuacauuucuguaggugguaaaagaggaaacuggggugaggagauaguucuucugggacuggaugcaaucuuuauuagaauaccugggcuuugcuuuuuccucugagacaguguaaaaugcuguauguugagaaagaucccacucgaauggaggcgaaauugcucuuaacuuuccaaucauugcucugacucauggaacaaaggaauguugcuucugagaggcaauccccguccuuuccuacaccaccuccccaccacacccaguucuucagccaacagcuggguccaccauccuccacauuaggagaugcaaacucuccuccugugugcuuccuuccagacauaauauuauuaacugaaaauucuuaggccgggcaugguggcucacaccugccaucccagcacuuucagaggcugagguggguggaucaccagaagucgggaguucgagaccauccuggccaacauggugaaaccucaucucuaauaaaaauacaaaaauuagccggguauguuggcacaugccuguagucccagcuacucaggaggcugagacaggagaauugcuugaacccagaaaauggagguugcagugagcugagaucguaccauugcucuccagccugggggacagagacagauuccguuuccgaaaaaagaaaauucuuuguggacucaucaguauauuuuaggcaggugagagaaaaggccuguggaauuagaacuugcacuuaaccaugccggaaauuucuguaccuuucucugcaaagauaacuuaguuacauaagugaauaaauauauauguuaaacacucaagaacucuacuagacauuuauggauauuauauccugggcuaucacuuugaguuuuaugguacuaagcccuuuuccuuuguucagugcugauacaagggaauuucuuuuuuaauauuuauuuuauuuggccugauuuuuagcuuuuagauucacugugguagguaucggggaaaaagaccauuugagcuaauucugcccacuuugucuggaccuguuuuuacuauguggcuauuuuuauaaauuauaccugcuggguaugucauuuccucugaggccuuucugauagccuaccuaaaauagcucuauuuuuuccucauuuaucacuuaugggaaucauacagguuuguuuuuaaucucccccacuagucacaguggcucaagccuguaacuccagcacuuugggaggcugaagcgggcagaucauuugaagucaggaguucgauaccagccugaccaacaugguaaaacuccgucuccacuaaaaauacaaaaaguagucaggcgugguggcgcuguaauccuagauacucgggaggcugaggcaggagacucuuaaacuugggaggcggagauugcagugagccaggaucacgucacugcacuccagccuggguggcagggcgagacuccaucccagaaaaauaaaaauaaauuaaaaaauaaaaauaaauauaugggccaagggucguggcugaugccgguaaucccaucacuuuggaaggccguggcaggaggaucacuugaggccaggaguuugagagcagacugggcaacaugaucagaucccaucucuacaaaauacauuuuuuaaaaauuagccaaacaugguggcacacuccuguaguucuagcuacuugggaggaucgauugagcccaagagguaguuguuacagugagcaaugaucacgccacugcacuccaggguggacaacagacugagacccucucucuaaaaaaauauuuuuuuaauaauaauaauaguccaggcacaguggcucaugccuguaauccuagaacaaacucugggaagccaaggcagguggauggcuugaacccagaaguuuggaaccagccuggccaacauggugaaauaccauuucuaaaaaaauauacaaaaauuaguugggcauggugguacaugccuguagucccagcuacuugggaggcugaagugggaggaucacuugagcccaggaggucaaggugcacugagcuaugauugaucacaccacugcacuccagccugagcaacagagcaagacccugcccccaaaaaaaaaaaaaaaaaaaaaaaaaaaagccaggcaugguggcucacacuuguaucucagaacuuugggaggcugaggugggcagauuacgugaggccagcaguucgagaccagucuggccaacauggugaaaccccaucucuacuaaaauacaaaaaaaucagcugggcaggguggcgggcaccuguaaucccagcuacuugggaggcugaggcaggagaauggcuuaaacccaagagguggagguugcauugagccaagaucacgccacuacacuccagccugggcgacagagcgcgacucccucucaaagaaaaaaaaaaauuaaauaauaauaauaauaaaggcuaugagaacauggacuucaucugugccguuucuugcuauaucugcagcaccuacaaauaccagcaacuggcaugcagaauagacuucguaaguauuuguuagacaagugagugcacuuuaccuuacugaauccuccuacacauccuauaaaguagguauuagguccuauaaagcagguauuagguucucucuugguuuggggaauacuguagguuuugcuuuucucauauuuuccuguguuuuccaaacuaauauguauuccuuuauaaucaaggaaaacaauaaaaggaacugugccuuuuuuuaccucaaaaucugcuccugacaagcagcaauucgcuucaugaauuuguaaaacgucugaucuccacuuuuaauuauggucuucucauauuuuucaucaccaucauuaggaaggcuaaaaacagaagcagaaaacacuuuugaaugucuauauccagaaaauuacagcauuugcaagacaaaacaagauaauuuucuuuuaaaaaauuuuaucagggcaggcgcaguggcucacgccuguaaucucagcacuuugggaggccgaggcaggcagaucacaaggucaggagaucgagaccauccuggccaacauggugaaaccccaucucuacuaaaaaaugcaaaaaauuggcugggcaugguggcuugcgccuauagucccagcuacucagcaggcugaggcagaggaaaucgcuugaacccgggaagcggaaguugcagugagccgagaucgugccaugccacuacacuccagccuggugacagaaugagacuccaucucaaaaaaaaaaaaaaaaaaaaaaucaaucacgccuuuaaucccagcacuuugggaggccgaggugagcagaucaccugaggucaggagcuugaaaccagccuggccaacaucuugaaaccccaucucuaauaaaaguacaaaaaauuagccaggcgugguggcgggcgccuguaaucccagcuccuugggaggcugaggcaggagaaucacuugaacccaggagauggagguugcagugagccaagauugcgcuauugcacuccagccugggcaagaagagugaaacuccgucucaaaaaaaaauuucucaggccagugcagugggcucacgccuguaaucccagcacuuugggaggccgaggcaggcggaucacuugagcucaggaguucaaaaccauccugggcaaucuggcagaaccuugucucuacaaaaaaauacaaaaauuagcugggcaugguggcaugcaccuguggucccggcuauuccagaggcaaggcuguggugagccgugagcacaccauugcacuacagccuggauaacagugugagacccugucucaaaaagaaaaaaaaaaaaaaacugucaaaguuaaaaaacuguaaaacugucaaguaauuuuuuuuuuuuuuugagagggagucucccucugucacccaggcuggagugcaauggugcaaucuuggcucacugcaaccuccaccuccuggguucaagcaauucuccugccucagccuccugaguagcugggauugcaagugugcgccaacacguccagcuaauuuuuguauuuuuaguaaagacaagguuucaccacgucggccaggcuggucuccaacuccugaccucaagugauccaucucggccucccaaagugcuggaauuauaggagugagccaccgcacucagccaaaaacugucaaguaaauauuuuugauauuuaaauuguguacauguagcucugcaguucccugcccaacccuucucccaagccauuuucaacucuugaguaauuauuuacaauuuaaaaagucgcagggcacaguggcucacaccuguaaucucaacacuuuggaaggccgaggcagguggaucacgaggucaaaagaucgagaccauccuggccaacauggugaaacccugucucuacuaaaaauacaaaaauuagcugggcauggugguaugcacuuguaauccuagcuauucaggaggcuaagggaggagaauugcuuaaaccugggagguggagguugcaaugagcugagauugagccacuguacuccagccuggcaacagagcgagauucugucucaaauauauauauuuucauauauauuuuuuaauauauauauuuuauuauuuauuuuauauauauauauauauauauguauuuuucaucugggugcgguggcucacgccugcaaucccagcacuuugggaggccaaggagagugggucacuugagguuaggaguuugagaccagccuggccaacauggugaagccccaucucuacuaaaaauacaaaaauuaaccgggugugguggcggguaccuguaaucccagcuacuugggaggcugaggcaggaggaucauuugaaacugggagcuggagguugcagugagccauuaucacaccgcuguacuccagccugggugacaaagugagacucugucucaaaaaaaccaaaaauuuuuuuaauuagcugaguuugguggcacacaccuguagucccagcuauggggaaagcugaggccagaggauccccugaggccaggaguuugaggcugcaguaaaccaugagcaggcugggcgugguggcuaauaccuguaaucccggcacuuugggaggucgaggugggcggaucacguggggccagaacuccaagaagagcccggccaguauggcaaaagcccaucucuacuaaaaagaaaauacaaaaauuagcugggugaaguggcgcacgccuauggucccagcuacucgggaggcugagacaugagagcugcuuaagccggcgagggagagguugcagugagccgagaacgugccacugcacuccaaccugggcaacagagcaagacugucucaaaaaaaaaaaaaaaaggccauaaccacaccacaccacugcaguucagccugggaaacaaagcaagaucccaucucuaaaaaaaaaaaaaaaaaaaagaagaauacucuagucugaagaaacccaccaaaaauaagcaaauacauaaaaacuuaagaaauuaaaaaauaaaaaauccugccgggcgcgguggcucacaccuguaaucccggcacuuugggaggccaaggcagguggaucacgaggucaagagauugagacuauccuggucaacauggugaaaccccgucucuacuaauaauacaaaaauuagcugggugugguggcgcgcaccuguagucccagcuacuugggaggcugaggcaagaaaauugcuugaacccaggaaggggagguugcagugagccgagaucgcaccacugcacuccagccuggcaagagagcccauaucacacacacacaaaaauaaauaaauaaauaaauaaauaaauaaauaaaaaauaaaaaguccuuauaaccaucaauucuauuaaggauuauuuucaaacaccaacaugucuucaugcauuccccuucaucauuauucugaaaaagccuacaaaugaaacaguucugguaaagaaccaggccauuucuccaaauauucuauuguaauuuuuuuauucuaauaguaaaaaaugcugggugcaguggcuaaaacaaauuuuuaggccaggcacaauggcucacgccuguaaucccagcacuuugggaggcugagguggguggaucaccugaggucaggaguucgagaccagccugaccaacauagugaaaccccaucucuacuaaaaauacaaaaauuagcugggcaugguggcacauggcuauaaucccagcuacuugggaggcugagguaggagaacugcuuaaaccugagagguggagguugcagugagccgagaucgugccauugcacuccagccuggguaacaacagcgaaacucaaaaaauuuuaauuggucagacaugguggugugcaccuguacucccagcuacuugggaaacuaagauagauugccugagcccaggaguucaaggcugcaugagcuuugaucacaccaauucacuccagcgugggugacagagugagacccugucucucucagucaaucaauaagcaaaaaugaucauucuuaccucuuuagagagcuuugguuuauaaagccuuucaagaucuacccucucgcuuaacucucaaaaaaucaugggaugaaacagagaacagagauaucaccaucacucucauuuuacagaauugaggaucugaaagcaucucugagguccugggccaguucuggagccacagccaagagucaauaaacaaauggcguuuuucuuuuccuuuuuccauuuuuucaccccaaucuuauuaucccagaucaaaugguaguuuucuaacuugccugucucugcuauaaagacauauuagaaauauaaaagaaaauuuaagagucagugaacgcgucuucuauaaauacuugccaucucuaacuucuguuuguucaucuucacuuucuuaacggcaauuauaaauagagcaggguuuucaagcuaacucaaguuggcugauaaggaagugaagcaaaaagguccuacauacaaguucugccugaaaguuuccccagguccuguggugaaacugaaggguaacucuuguggcugcuucccaauccagucaccucucaaccucagcagcacacauccucaccuuugggaaagcaacugauccauggcaaugccuucucucugcugauagucccucagaaggcugugggcaugauccagguugacaaagucccuguaaucauccucaucugcaacacagauguaguagggcaggaagagcggcagcccaggaggcacaggaugggcagcacccaggacagcauccugcaggcggaggucuuggagccgagcaguccagucuacgucuuuggcacugcuggcaucauucccaaaauccaagguaaacuguggugaaggccccuccucaguaucacuuccccagucaucagcaccuucacaccaguccucagcugcaaggcuguuucccuguuucuggaaaaauacucagugaaugagguccgagcacauuugggagguuuauucuaauccuucggcuccagccacccaccgccgcgccuuccagagggagccuucacaccauccccuuccccucugguacacuccaaucaaacuuucuagacccuauguacucaaaagcacguuggaggugacuuaaaauacuugucuuuccuuuuuggggugagugugacagauauaguacagggguuauucaaccauccguuccaauaucuuucuguugugcuucauguauugcaggaacugaaaagaaagaacuaccuuucccagaccccuuagcagcuaggguuucagauaugauuaggggucugcuaaucaggucuacuagagagaaacaugaacuugagacagagugaaguagaaagaaagaccacauagcaaaagguagccauuguguagacacagacagaacaaggcuuuggagccaacgguucgguggcaaagacagccucuaguucaccagaucacaccuaagcuuccugacagcaggagagguggcauagcagcuccuucacggccaguucugaggugugauucuggagggcauuccuggagccuccuccuucagccuauccacuuacuaaaaaccucacuccuguguuaagucugucucagcuuaaaagccaggcaugguggcacgugcccguaauccagcuacucaggaggcugaggcaggagaaucgcuugaacccgggaggcggagguugcagugagccaagaucacaccacugcacuccagccugggugacagagcgacacucggucucaaaaaaaaaaagaaaaagcaacagcacuuuucuaauuaucugcaccugaacccugacaaauauaggcaaacaccacugucuucaacuuuuuauuuaaguacugcuaauacuaugccuagcaaacaucaagaacugggugcaggccgggcccagugucucacgccuguaaucccagcauuuugggagguugaggugggcggacuguuugaguccaggaguucaagaacagccugggcaacaugacaaaaucccaucuauacaaaaaauaugaaaaucagcugggcaugguggcacgugccuguaaucccaucuacucaggaggcugacgugggagaauggcuugggcccaagaggcagagaucaugccacugcacuccagccugggugaccagaaugcaaccccaucucaaaaaacaaacaaacaaacaaacaaacucaguguauauauaaagacacauuuacagucaaagggaggcuaaauuguguucugcagcuaccaacuugccugccuuuucaauaaauucagauuucaucuuaugaaauguguuaauacauauauagcucucauaaaguauauuuacuauaaagacacguauacauuaucacauacaaccacauauauguacacacccauauauauucccaaacaggaaaaucaguaaacugugugucucaagaccuucaguguaaguuuaaaaaaacuacuauauauacaauggaauauuuuucacccuuaaaaaaaaaaaggaaauucugucauuugugacaacauggauggaacuggagaacauuuugcuaagggaaauaagccagacacaaagacaaaugcugcauguauucacuuauauguggaaucuaaaacaaccucaaagaaguagagaguagaguggugguuaaagaaaucuggaguggccaggugugguggcucacgccuguaaucccagcaccucaggaagccaaggcggguggaucacgagguaaagagaucgacaccauccuggcuacacggugaaaccccaucucuacuaaaaauacaaaaauuagcugggcaugguggugugugccuguagucccagguacucaggaggcugaggcaggagaauugcucgaaccugggaggcggaggcugcagugagccaagauugugcuacugcacuccggccuggcaacaaagcgaaacuccaucucaaagaaaaaaaaaaaucuggagugagccgggcaugguggcucacgccuguaaucccagcacuuugggaggccgaggcggguggguugccugaggucaggaguucaagaccagccuggccaacauggugaaacccuuucucuacuaaaaauauaaaaauuagcugggcgugguggcgagugccuguaaucccagcuacuagggaggcugaggcaggcaggauaagcgcuugcauccgggagguggagguugcagugagcugagauugugccauugcacuccagcaugggcaacaagagcgaaacucggucucaaaaaaaaaaaaaaaaaaaaaaaggaagaaagaaaccuggagcgggaagaauaaggagaugacggucaaagaauacaaaaccucaguuauucaggaggaauguggguuuuuuuuaaguucuacugcacagcaugaauauaguuaauaauagaguauuguggcugggcacaggggcucaagccuguaaucccagcacuuugggaggccgagguggguggaugacaaggucacgagaucaauaccauccuggcuaacauggugaaacccugucucuacuaaaaauuuaaaaaaaugaaaaaauuagcuggccgugguggcgggcgccuguggucccagcuacucuggaggcugaggcagaauggugugaacccaggagguggagcuugcagugagcagagacggcgccacugcacuccagccugggcaacagagcaagacuccgucucaaaaaaaaaaaaaaauaagaguauuguguaucuccaaauugcuagaggaaauuucaaauguucucacaagauguuaaguauuugaggugaugaaugcauuaacuagcuucauuuaauuauuccacaugauauucaugaaucauagccaucacuuuauaccucauaaauuuauacauuauuauaaacugucaauuuacaguuaaaaaaaaaaguugaagaaauccaggaggaagucuccaucucccuuuuguuuuuuuggcaggggacagggucuggcuuuguggcccaggccggagugcaguggcacaaguguaggucacugcagccucaaccuccuagacucaagcaauccuccuaccucagccuccugaguagcuggcacuacaguugcguggccaucaugccuggcuaauuuguuuacuuuuuauagagacgauguuuugcuauguugcccagacugcucucccaacguuuuuuuuuucuuuuguuuuguuuuguuuuguuuuuacggagucugucacccacgcuggagugcaguggcaugaucucagcucacugcaaucucugucucccggguucaagcgauucuccugccucaaccucccuuguagcugggauuacaggugucugccaccaugcccggcuaauuuuuuguuuuuguuuuuaauagagacgggguuucgccauguuggccaggcuggucucgaacuucugaccucaggagauccgcccgccucggccucccaaagugcugggauuacaggcguaagccaccgcgcccagccuggucuccaacuucugagcucaagcaauccucccacuucagccucucaaaaaacggugggaucacaggcgugagccaccaugcugggccuccaucuccuuuuaacaaaggaguuagaaaauaaaaauaaaguaaaauagaagaaaaaaaaaacucucacaaaaccuuaagaaaggccgggcgcgguggcucaugccuguaaucccagcacuuugggaggccgaggcggguggaucaccugaggucggcaguucgagaccagccugaccaccauggcgaaaccccgucucuauuaaaaauacaaaauuagccgggcgugguggcauaugccuguaaucccagcuacuagggaggcugaggcaggagaaucgcuugaaccugggaggcggagguugcggugagccgagaucgcgccauugcacuccagccugggcgacagagcgaaacuccgucucaaaaaaaaaaaaaaaaaaaaacuuuacgaaaauagcauuuuaugguucuucagaaaagcaaaaaacacuccaguguacuucaaagaacacggcuuuaaagucugccccaaacuauucucuggaaaauauccucaaaugacagaaaaacaauaacaugccaaucacaaccuuuaccugagcguccugcgccucucucucuggcaccugcaggcacugggagcggaacaccuuccagcuucggggugaagacaaagggccgugagggcugcaccccgacuccagcccgccggcccgccccagcccgcuggaaaggacaccccuggagcagcucugggacuuccccgccuaccugcgcgcaccgccggugcuacagccggggcaggcgcacgcgaacacgugcagcagacggugaaacggggagccuuccagcgggcaauacaccugcacgaccagagcgagcggcugcccgcagcgcugacacacgggccugggcgcagccacggugggcagagcauccugaggggacagaggaggcgcucagaccccgacuccccccaggaccucgcccacucccuccgcacccuucagcagcacccaucgaccccagcuccggcacccgcccucaccggaaugccgcccagcuugcuagcaguccaggcacccggcccuguggggcugccgugcaccggcgcaucucgaaggcccagcagcaccggcuucagaacggccgccauggccgccgggcgaccaggugaaaacgcaaacua

SEQ ID NO: 191750 - RNA, 101016 nt, Homo sapiens
gacguaacuuccgguguacacagccgguccaaggcggugcgcugggggccggggcgcgucgcaggugaggagcgggcgcggcgggcgcaggcgggggcuggcgggcggggucgggcggugggcggugggcagcggggccgcgggccgcagccagggcagacggcgagacgggcccgcggggcgccgcuccgcucggggccgcagggcgcggggccgugggcucccgccccuugcccgcccgcuguggaggacgccgggcuuugcgggcgcuggccggccgacggaagcccggaggggccuccuggcgcgaacccgggaccugggggcgcgucggagacucggcggccgcggcaccgcaggggcgggucggcgcccgucaggcggggaaaggggacgcucccucgguucgccggggcccgggaggucgcgcuggcgccaggacccgcucccggaagcccgcggagggagggcggccugcuggcggcagggguccgcuggggcuagccggggaggcggcccucacgccaucccggggcugccgggcgggcugcgcgcaccuucccggcggcgccaggcugccgaggaacgcgcuuuuccggcccugcggagccagcuggcgcauugggcccgaggggaggguccgcggggaccgggagggccggggcugagcguggaggacccgagcccgagggacgagcgcagagucaggggugugucuuucugcgccgcgcggugcgaggaaagaagcgugccugguuggcaugauaagaauuuuguuuagacuuuuuagaaauuuuccagagacucagcuuugggggccuccaguuugaaaauaccuuguucuggucccucauccccauuauaaaagcaguuaauucuccuuuccuggcaaaacacucaagacgacacaaaaagucuuaagguagaaaaugacagucaucugccagucuaccauucagugacaaccacugcuaacauuuuggugauaaucaauaaauacagauagguauuguuauuuuuauggacuuuacaguaugugauuuaaccaccgaugagcauugagauaguuuccaauuugucacaagauaaacaauucugccggaaggauuuguuugauauggucuuuuuuuuuuuuuuuuaauaagagacuguugcccaggcuggucucaaaacuucuggccucaagcgacccucacgccuucgccuuccaaaguguugggauuacaagugugagauauuacaccuggucugauuguuaucuuagaauaaauuuacaaauggggucaaagguaacuuuauuuguuuuuuuuugagacagucucccucugucacccaggcuggagugcaguggcgggaucuagauuaacugcaaccuuagccucccggguucgagcgauucuccugcuuuagucucccgaguagcugagauuacaggcacccaccacgcccggcuaauuuuuguauuuuuaguagagacaggguuucgcccaguugaccagguuggucucgaacuccugaccucaggugauccgccuggcucggcguuccaaagugcugggauuauaggcgugagccaccguguccggccguaacguucaauuuuuaagaauacauaguauuuguuuuccuuugacauauuuggacaauuuuucugucucuuugucauaaaaaaaaauuccagccuggcgcgauggcucaugccuguaaucccagcacuuugggaggccgaggcgggcggaucacuugaggucaggaguucuagaccagccuggccaacguggugaaacccggauucaacuaaaaaaauacaaaaaaacacauuagccaagcaugguggcgcgcuccuguagucccagcuacuugggaggcugaggcaggagaaucgcuugagcccaggaggcgaagguugcagugagccgaggucgugccacugcgcuccagccugggcaacagagugagacuccaucucaaaaaaaaaaaaaaagaaauucauguuugcgucucaucguuucaugguuuuauuuuuuugccuuuagucuaccuaaaauucauucuugguuuaaaauaugaaauauuuuguaaauggcuagucaguuccagauuuauugaauaauauguaagcuuuaucauuuuaucauauuuuagacuaaaaguucuaaguguauguuuguaagggcuacuuacaaaguucauauuuacauuuugugugugcuuagauguuuucaagugucuuuaaaaaucacaguauuuucuuuucacaguaucuucacaauauuuuguuuuaaaaagaaaucauuuuccaauacaaguacagggaauauuucauguuugagauuuuuuuuuucuuuuuaaagcaaaaaguuuaguuuauugccguuucauuugcuuucuugcugacaagauaacaaacuccauaugaagaguucagguuuguuguggcaacuuuucaguguggcauuugagauucuaaucuuccucuauuuuugcacacaaauacguagguuggcauuggagaccaagauagaaaaguucucagauucccuuggcaagccuagauuuuucaaucuaaaauuaucuccagauguuuggaagaccauguuuuaagcauccuuuuuuuuuuuuuuaagcaaauugcacaugauucugugaaaauuuuaguaaauguuuguucuguugaaaaccuauagccuaauacaucaggauccaugugucaagugggucuuccaagucuauaggaaauaauuguuucugaaagcuagcaggcugggauaucacauggguuggguguccacucucuuuuuuuuugagucggagucucccucuguccccgaggcuggagugcaguggcgcaaucuuggcuuacugcaaccuccaccucccagguucaagcaauucuucugccucagccucccuaggagcugggaucacaguugugagccaccaccccuggcuaaucacucuuuuuuccuccuguaacuuuguccuuagugaaaaaugaugaucuuccuagguaggcaaaaaaauguugguuuagauaaggaauugauuuguuuuggaguuauugaaaagcagguugccguuuucucugaaguguaaguucacagagagccugaauguuguguuuggauuaaggaaaaacagcaacagguugugcuugugcuucaaaugucuuuaacucuacugaaacugcccucuugaggguccccuaacugaugcaugcaguggccauugcuuaauuauuuuccuugacuuugaucucagguauuuggcauggugagcuauucuuucuugcucucgugaaucucccauugauuggccuucuuuuuucuuuuucuuuuuuuucuuuuuuuuuuuuuugagacagagucuugcucuguugcccagacuggagugcaguggcucggucucagcucacugcaaccucuggcuccaggguucaaacgagucuccugccucagccucccgaguagcugggauuacaggucugcgccaccacccccagcaaauuuuuguauuuuuaauagagaugggguuucaccauguuggccaggcuggucuugaacuccugaccucaaaagugcugggauuacaggcgugagacaccacgcuuggccuugauuggccuucuugacuuggaacuaguguggucauuuccugaaaucugugacugcacuuucucauuugucuuuacugcuucucuucauacaucuaccuuggggcauuuucugaagccuaguuuuguaccucuuacccccgcuccaaaacauauuccuucccacuuauccaguauaugaguccuggguagagaaccaccucauuuccuuaccucugccaccacuuagugacccccgacucagaguuuucugcaggucaauucuuuuucuccuguucaguaaccccuggacauguuccugaggccaugcuuucuccaggugaagaaaauaucacuucuggccgggcgcaguggcucacgccuguaaucccagcacuuugggaggccgaggugagcggaucacgaggucaggagaccgagaccaucuuggcuaacauggugaaaccccaucucuacuaaaaaaaaaauauuaaaaaauuagccggacauggcgaugggcgccuguagucccagcuacucaggaggcugagguaggagaauggugugaaccugggaggcggagcuugcagugagcugagaucgugccacugcacuccagccugggcgacagaguaagacuccgucucaaaaaaaaaaagaaaagaaaauaucacuucuuugcgaggacaaggugagaggauuacaugcucucaggaguuggagaccagccugggcaacauagugagaccucugucucuuaaaaaaaugaauuuuaggucuggcacaggggcucaugccugugaucccagaaguuugggaggccaaggugggaggauugcuugagaucagccuaggcaacauagugagacuccaaaauuaucuagguguggugguccaugccuauaauuccagcuacuugggaggcugaggccggaggauugcuugagccuaggagguuaaggauucagugaacugugauugugccacugcacuccagcccaagcaacagagcgagacccugucucaaaauaaauaaguaaauaaauaaauaaauaaauaucacuuaucaagguguccuguccuuccugacucuuaagguucuuaccagccggugaaucacaucuuccuucuugauauggauuguauuugccauuugcuuucuaucccuacaccucgauuuagacuuuguaccuuuucuuaagggauuucaggcuuaacgugguccuacucuggaugugaaagaggagacccagugaauuuacucaagaauugaguuagcucacauuuauggaguaccuacaguacagcccaguuacuuuacuggaagaucagaauacagagcuggacagcacauccugggaagaaugccaaauaagcaauugucauaaaguauuauaagugccuagaaggggagucaccaaguaaccucucccagguuucagagaucuugcgugucuuauuuacugcuuugaucuccagggccuagaacacagugcguggaaaugaugaaguuuuuuuuguuuguuuguuuguuuguuuuguauuucauucaguuuaaugaggggacaugaggagccaggggcagaaugauaugguuaggcuguguccucacccaaaucucaucuugaauuguaguucccauaauccccacauguggugggaaggaccuaaugggagguaauuuaaucauaugagcaguuucccccaugcuaugcuugugauagugagcaacuucucacaagaucugauggcuuuauaaggggcuucccccuucacuugggucucauucuucuugcugcugccaugugaagaaggacguguuugcuuccccuucugccaugaauauguuuucugaggccucccagcccuggggaacugugaaucaauuaagccucuuuccuuuauaaauuaccuagucuugggcauuuccccauagcagggugagaacagacuaauaaaccuuauuuuaagaaauugccacagccaccccaaccuuuagcacccacacucugaucaauuagcagccaucaacaucacggcaagacccucugccaacaaaaaguuuaccacuugcugaagaugcagaugaucauuagcauuuuuuaguaaugaaguauuuuuaaauuaagguaugugcauuguuuuugugacaaugcgauugcauacuuaacagacuacaauauaguguaaauauaacuuuuauauguacaggaaaauaaaaaacaucaugugacuugcuucauugcgauauucacuuucuugaaaugaucuggaaugacaccugcaauaucuccaagauaagccuauaauaucuuuuccugauaauuuuggcuauauacuucuugaucaccuuuucuaugacaaggauuugguaauaucauuuuuuuauuuuuauuuuauuauuauacuuuaaguuuuaggguacaugugcacaaugugcagguuaguuacauauguauacaugugccaugcuggugugcugcacccacuaacucgucguuuagcauuaaugaaguauuuguugaaggaaugaaugaucaucugagaaugaaaucagaaaaaaugucauacacauuagcuaucuauagaaaagauauaagucaaaagauauuucguaaauguaguuugaagaaucucagggaaaacuuuaaauucaaccaaacugacccagcuauaaccccaggaaggcaugcauggaauguguuuguagcuggaaagcuuaaacuuaauuuuguauccucagaagaaauacuuguguuucugggagaggauugggacagugucuggaaauugggguggcggguccaagagaggaauuacgugguguguguguagcacucucugggggccugaccagaggagcagugcagcguucccuccacaaagccaucugcacuaacacacagaugggcgugucccuguuguugccucuggcugcaagggucucucccuugcuuagcgucuguccucccaguaccaucugaguagaagauagcugcacguggagauuucuugguaaggagagaaugugagugguugagggcucugcaucuaagcugcuuggaucagauccuggucuugggaugcuggcuaaucuuucaguuuucugauuuguagaauggggauaauaguagcaccuuucucuuaguguugcagugagggcucugagcgugcuacccggcaccugugauaaguauucaaugacaguauuagcucucguugguauucauaaaguaguaacuggccucugguucauacaucaguuuucuuugagcuuagauagccuaaauaauuaauccccauggaacugcuugcuucugggugcauugaauaagcugauaaacagacacugggaaguaaugacagauaagcucuuccuacacugcucauccagggaauccagccugcaguucucaggggagacuucuggagaaggcuguucuugagcugaguacugugggaaaaaguaaguccagugccacagcaagaggggaggacucuugggcaggggcaugacacguccaaagguguggaggugagagcaagcaugagguauuugagcugcaggagauugaggguagagucuggacagguaugaauaaggaguagagggaaaugacauuggaaagugggagcaguccuugaaauaacuaauaacaaugucuaacugggcacuaacagcacuucagguccugugcugaguccuucgacucacugcgcuaaccagguuugaugcugagagcuuugucuacauugcauuguuuaauccucacaacaacccuuugauguagguacuuaccucugguauguguggcaucaugucacaugucaccugguaggucucccugccuuuuuuuuugaaauggaaucuugcucugucacccuggcuggaaggcaguggcaggaucucgacuuacugcaaccucugccucccuggguucaagcgauucuucugccucagccucccgaguagcuaggacuacaggugagugccaccaugccuggcuaauuuuuguauuuguaauagaggcgggguuucaccauauuggccaggcuggucuugaacuccuuaccuugugauccgcccaccuuggucucccaaagugcugggauuacaggagugagccaccaugcccagcugcugcuuuuuuuuuuuuuuuuuuuuuuuuuuuugaggcggagucucucucucacccaggcuggaaugcaguagugcgaucucagcucauugcaaccuccaccuccugggucgaagcaauucuccugccuuggccucccaaguagcugggauuacaggcaugcgucaccacgcccagcuaauuuuuguauuuuuaguagagaugggguuucaccauauuggcuaggcuggucuggaacuccugaccucaggugauccgccugccuuggccucccaaggugcugggauuguaggcgugagucaccucgccuggccucugcuucuugauucagccugcacauggcugccaagauaacucccagugucuuauauauguuuaaaagcuuuuugugauccuguuuccugaugaaguccaagcacacuaagauccucugacuucaugaaaaaccacgaaguuaaaauguaaaaauauuuauaucuuagaauuuaauaaaaacaggacaggugcagauguggaucaagcucagagaaaucagugaaagaagcaagguacagaacaauguauguuugcccauuuguguuuuucuaauuuuaaaaaauuucuccacuuuugaaguaauaugagcucauuuguuuaaaaaaauauauauaggccaggcaugguggcucacgccuguaaucccagcacuuugagaggcugaggcgggcggaucaccugagguccagaguuugagaccagccugacaacauggugaaaccccaccucuacuaaaaauacaaaaauuaacugggcaugguggcgggugccuguaaucccagcuguccaggaggcugcagcaggagaauugcuugaaccugggagguggagguugcagugagccaagaucgugccacugcacuccagccugggugacagagcaagauuccaucucaaaaaauaaauaaauaaaaauaaaauaaauaaugucucccucucucgauagagagauagauagauagauagauagauagauagauagauauacaugaaauagguuuauaagugcagaaauaauuuauggaaugauagaaaagaaacagugguuguuuuugggaugagaccccagaaaaccaggcuguuaggcugaguuagcuuuuucuuugcauaccauuuuguauggugugaauuuuuuucccuguguauauguauuuucuuuuuuuucuuuuuuuuuuuuugagacagagucuugcucuguugccuaggcuggagugaaguggugcaaucuuggcucacugcaaccuccgccuccuggguucaagcgauucuccugccucagccuccugaguagcugggauuacaggugcccgccacuacgucuggcuaauuuuuguauuuuuaauagagacaggguuucaccauguuggccauguuggccagguuggucucgaacuccugaccucaagugauccauccaccucggccucccaaagugcugggauuacaggcgcgagucaccgcacccggucuauguuuucauuuuaacaauaacuuuuaaaauaaaugucuaugauggacauggcuguuguguagagugaauguagcauggagguuaagagugaggacugugcaaggcggcuuggguucaaggccugccccugccuugaccucaguuuaccuccucugaaaauggggagguaguaauaccugccuccugggguuguagugaggcauuacugaguuaauauuuguaaaguccuuggaacaguucccaggagguauguguuugucgucgucucuguugcucugucccugugcuaugcaugaccguaaguguaaagauguguccagccucugucucugaugcucccaguucauuuggaaagggagagcaugcagcuaaugacagagacagcagaggcugcaggagucagaaaggcuccuugggaacugagguggcccaagaugguuucaucaaaaugaugguuguuaaauauggguaauuucuagagggaaaauaacacaaagggacuuuuuccauguugugugucccagccagccugaggcaggcagaggagucagaaacaggacaagagcuuugaggaggccugaaauuuggacgugucaugugaugacaugucuuuuuuuuuuuggagggggggacggagucuugcucuguugcccaggcuagaaugcaguggcaugaucucagcucacugcaagcucugccuccccgguucacgccauucuccugccucagccuccugaguagcugggacuacaggugcccgccaccaugccuggcuaauuuuuuguauuuuuaguagagacgggguuucacuguguuagccaggauggucuugaucuccugaccuugugauccgcccaccucggccucccaaagugcugggauuauaggugugagccaccacgcccggcuggcaugucauuguuauauggcagaguuuuucuuggcauauaugagacaaugauaugauuuguaaauggugacaucuuugacucagugaagugugguugcucugccuugauguuuggaauggcuaugagguguucugugugacguauuuaacaauccucguaaugcagggcacgugggaauaaccaguguugccagugaguguucuugacgcaggccucuacauuaaccgugagucuguucuaggauucgugccuagauagaauauugcuuuucuuucuuuuuuuuaagucauuuugauuauguuccuugugucugggccacugucaguuaaguguguuuucaaauuggcaguggcaaagaaucauaaugggaagauuuuugaaaguggaauuagagcaagauauuaccugaaaaaaaaucugauuuucuuacuaaaaaugauuuugggauuaaguacuagugagaugcuaauuauggccaggaaaccuggaaauaacucgcaucuucccucaccccacccccgguccccgagguggauauauguucaugggaacagaguuuggggaaagcuggcuuggcucccagacuugggugccgcaggcucuggugaccuaggcaggaagaggcggaagugguuccucucaccagccacaaggaccugugcugcuccugggugucaaggugggagagaaugcgcuacauccuugugcuugagucacuuuguaauguacuuuguaauuccaggugaugccccuccucaacugugucccuucuguuccugccuuuggcuugggguugaaagaggagggaguggugggcacggaaaugggaggagccaugaccucuuuccccuccagcgcauagggcauuacuucuuuuaguuuguugccuggacuugggaguugggcccagagcugcaggaagguaaguuuuauuucugaaaguuguuuuaacuuacagauuuuggggguucgagggaguuuguuuucgacuaguagaagacaagaauuaagaauugcaguggaagaugaaaugcuaucuucuuacuaauccacgcccucuuucagagcaguagcuuucauuuacggagacugaggguauggcagaggcugugcuuuauggauuuaauccucagcaguacugaggcacaagaguuaggcgacuugcucaaaguuaguaagugccauuuauucagcugauauuuacuaagagcaggaauucacaucuagaucagucugauucccauacccguaccaguaacuacugcauuuuggaagugcgucguuuccaugaaguuucuuuguauuggagcaucuaccugaaaggcaagggccugagcauuuucuccuuuucccuuauuaacgguaagcuccuugagagcaagcauuaugucugucucuucaccacugcauccuggguuccuggagcagugcuaugcacuuaggagaaccuuagugaauguuugaguaugugaaggcucauggcgcagauaaguggcagagccagaagccagccuggaggugaaccacugcgggccugcucucuggggcugucuucccugccuagcgaguggauggugaggaaucaccuagaauuuucucauuucuuaauguuugaccugaugaaauauugggaagaaugagcuuccuggcugugacucugauuuucuguuguuuuuuuugagacaggagucucgcuuugucacccaggcugaagugcaguggcgcaaucucggcucacugcaaccucuaucuccgggguucaagcgauuccccugccucagccuccugaguagcugggacuguaggcgcaugccaccaugcccagcuaauguuuguauuuuuaguagagaugggguuucaccauguuggccaggauggucuugaucucuucaccucggccucccaaagugcuggaauuacaggugugagccauugcaucaggcaacuuucuggucuuuuugagggaugggaagguuugcuggguaugcaaaauuggagucaguguucucagcuuggaagagauguuauaauuuauugauagaauuuuuuauggaugccuuaaauucucagaaaugauuuugaaucuuaaguuuaucuaaaauuuauauaauccuucuccauagugagaaaaaaauuucuaaauuauaguucgauuuaccuauuuauauauaagcuucuggauaaauacuuguuuuuuuuuccuccauuugagguuaauuuuggauagguuccauagugcaaaguuguuaagaguggcaguauagaauuuuuaaguuuucuugggccagacaugguaguuuaugcuuguaaucccagcacuuugaagggccgaggcgggaggaucgcuugaggccaggaguucgagaccaaccugaacaucacagcgaaaccccaucuucugcagaaaaauuuaaaaauuacccaggcaugguggugugugccuguaguuccagcuacuugggaggcugaggugggaaguugccugagcccgggagaucaaggcugcagugagccgcgaucacacaacugcaguacucuagccuuggcaacagagcaagagacuguaaggucucacugcagccucaaucucccuggcugaaaccauccuccuaccucagccucccaaguagcugggacuacagauauaugccagcacacugggcuaauuuuuuuuuguuuacuuuuuaguagagucgaagucuugcuauguugcccaggcuggucuugagcuccugagcucaagcaguccuccuaccuuggccucccaaagugcugggauuacagguaugagccaccgugcccagccaagacccugucuuuaaaaaaauaaguaaaaacaaaaacaaaaaauagaauuuuaagucuucuuaaauaacuuucuaauggacacaauuaguuuucaguaauccaaccuuuuuuuuagaaguuuugaaaacuuuuuuuuggauaccugggcuuuugcacauuguaccacacuguaacaaaaauaaaccgcagguuucuaacugguguagacuguugauuuuuuuuuuuaacaaauuagguuugaauaaauuauauaauugcuuugugguuuuuuuguuuuuuuuuuuuugauggagucucgcucuguugcccaggcuggagugcagugggguaaucuuggcucacugcaaccccugccucccagguucaagcaauucuccugccucagccuccugaguagcugggauuacaggcaccugccaccauaccuggcuaauuuuuguauuuuuaguagagacgggguuucaccauguuggccaggcuggucucgaacucuugaccucgugauccacccgccuuggccucccaaagugcugggauuagaggcgugaaccacugcacguggugcuuuguguuuuuuuuuuuuuaaaucuacuuagaaauaaauuauuuucacccccugauuuacacuugaauuuccacuagcaacacaauuuguugucacaaauguuuucauaguacuugggcacauuugaugcagaaauuuuuaaugguccaagacuauuuuaguugauagaugaaaccuuccuuuuaccugaacaaacuuuuucggaaguuuaggagccagcuuuguucauccuuuggugauagguggugguuuguauguguuuguagacaaaacuuuccuuggcggggauuugccccuuuuuucguuguuucuucuuccuuugaagaucucuguuuaacaaagauuuuuuuuuuggcucacaguguuccuguaauagaauuccuucaagaguucuaauacuaguuuuguuuuguuuugauggcagcagguuuugagagugagcuuuugacuucauaagaagacuaaaacaacagucuuagaguacaguuaaguccauuuguuaccagaaaaucagacagacagcuaggucuguccucaucaggaccaaguaauacuggauuuuuuuuuuucauuaaauguucacuauuuuucuuuguaugaaauugaggccagguauagugacucacaccuguaaucccagcacuuugggaggucgaggugggaggguugcuugaguccaggaguuugagacuggccugggcaacacagugagacuccgucucuuaaaagaagaaagaaaaaagaaauugaauauguggugauuacuacccguuucauuuacuuuuuuacuuauuaacguagugacuguuuaaaaaaaguuacgcauugaucuuccuguuccuuccccaccaaaaauaaaagcaaaaacaacaagccaccccucaaaugaaacaaaauuaagccuguucuuuaucuauauuacuacuuagcacauuugaccuauuuuuuuaaaaccucuguuauuuugaaaguaaauuuuggcucuguugaccuugcgguuagaaaaguuguucuucugcuuaaaugaaaugaucaguuguuuguagauuaccaaauauaaaagcucuucagaaccgcuaaugauaaguugcuuuggcuucauagaggaacgccaugguuuguggugguaaauuguuacagagcaaaugucaguaccagaggcggucauggaucaccacguggaagcagguuguucccacaugagauugguagcgagccggugcugcaucugucuccuuucccacugcauccugggugccuggagccucacaggguugacccguguuggggguggggaugguuguagaagccucuuuauuuuuacuugugauagauucuggcacugauuagaauguuuauucaguaguuuuuuuccuauccgccugaguuuucauagcucaguauaggauaacaugggcuucggauuuugucaaccaaucaauuauauaguagcucuuuuguuuuguuuuuaaaauuuauuucuauuuauguauuuauuuauuuauuuugagagaggcccuugcuguguuacccaggcuggagugcaguggcaugaucauagcucacugcaaccaugaacaccugggcccaagugauccuccugccuuggccgucugaaguguuaggauuacagugugagccaccagaccugaccuuuguuuuguuuuaguagcuaccucuugacuagaaaaauaguuuaaucuuggccuccuuaaaaccuuuucauugauauuuuuuacucugcuagaacaguucaguuuuugcaugucuucaagugaacaugcuuuaguauuaauuccauggaagccauuucuguagaauaggcuaguguccaguuuuguccaguuuuccuuuuggagcagugucucaggcacagaaauagucugggcuugguggaccccaccccaaagugucacuucuuuuccucuggccuugcucuccaugcccgccuuucucuucugauguuuuaaugauacccucccugcucggugauuuguguucaggaagcuaggcagugauuacuuuuguuucugcuuugugaacuuccucccccacuuccuauuuuuaccgcaguugcacaggaaaugaggcggcuccuggcuggcugcugcuaagcagugauuuuagguggcagaggacaaggccucagggccugagccauuuaaggcauuuuccaccuuaaucuuuucacuaccuucuuccucuaggagucauaggaacaugauuuugugauuggguugaggugacaucauguccucagccuuguggguggagacagggguugcuguuuaguuggaggacagcacuuuugugaaggaagugagggcuuuuuucagcaguaacaauguggguggaaugucguggcccuguggccucugcagcuugagggaagguuaaguugaagggacaggcccuguugcagguaaggauagggagguggauucugguuacucucuagagggccuugacuggcagcuugaagugagcugaggagccuagucugcucucucagaucuuugaggggggccucagccucuauggcacccuccuuccucugaacccauggcauuuguuuucuaaacgacuuauuuagcauuuaucagucucuuuuuugaugaugccucuucuuagcuuauggacccguuauagcuuaauuuauggagaaaguuuguaucaucuccccagaaagaaguaacuuguuauacauuaguuaacuugaauauggaaggugcucaaagcauuaguuuaucggagauucuuaagagcugcacuguugacauuuugggguagauaauucuuuguaggggcugucuugugcauuaugggauguucagcagcacuucuggccucuacccacuggaugcuacccacuagcacuugcccagggugacaaccaaaacaucucuagacauugccagauguugguagggcagagaaggacacaaaauuauacuuuuccccacuuguugagaaccacuguguuaaagaauugaauuacuaauuacuaacuuauaaaauggaauaaaguagaauguuugguucccugggauuaaagccauuuguuaguuucuauuuucauaucugacauucucauaauucuuaguuugcuacuuagaguaugcugugcucuaucagcuucagcuaguguucagguauaccuucugugcacuuucuuuuuuuuuuuuuuuuuuuuuuagaugaagucucacucuguugcccaggcuagagugcuguggcgugaucuuggcucacugcaaccucugucucccggguucaagcgauucuccugucucagccucccuaguagcugggacuacaggugugugccaccacacccaacuaacuuuuuguauuuuuaguagagacaggguuucaccauguuggccaggcuggucucgaucuccugaccucgucauccacccgccucggccuuccagagugcugggauuacaggugugagccaccacgcccggccccuucugugcacuuucauugaaagaacuaggagcugggcgcgguggcucaugucuguaguaccagcauuuugggagccgaggcagaaggauugcuugagcccaggaguuugagaccagccugggcaauguagagagaccccaucucuacaaaaaaucaaaaaauaaaaauuagcugagcuacuuaggaggcugaggugggagguucacuugagggaggucaaagcugcagugagcuaugaucgugccacugugcucuagccuggggcauggagcaagucucaaaaacaaaaacaaaaacaaaaacaaaaaaacuagggccugagccuuuggcaggcuggcuucuuguccucauagaaggcauucugucagcuucugugccuugauauugcuugcucuggaagucaauuuccuuggaagcugaguagugcaaggguaaggaggaaaugagaaacauuuaggauauaauaauaauagguaacauuuauggagcaguugcuguagaagaggcacuguggugaacaggauugacaggauugaaaggacaggcuagacaacaggacggggaccaucuggaauaacaccuuaaguuuggguuaaaaguugguugugccuuugaccaagcaaggcaguaaauauagcaggaggagugggaaauagaaaggugacaggguaaaacuuuuuuugaaacauagucuugcucuguugcccaggcuggagugcagugaugcaaucuuggcucacugcaacaucugccuccuggguucaagugauucccagauagcugggaucacaggcgcccaccaccaugcccggcuaauuuuuguauuuuuaguagagacaggguuuugccauguuggucaggcuggucucaaacuccugaccucagguaauccacccaccuuggccucccaaagugcugggauuacaggcgugagcuaccgugcccuggccaugaaaggguaaaacuugaagacccugcagagaugucuccugggucugguccuuggagagggaggucuugacuggagaguugaauuugggaaucaucagcagugauacggaguaugaucuccuagagagaggucacuuuucauugcuccagcucagcuucucaucaguuccaagaagcuggaagccuuaaccaucuucuaggagugguaagcagagugccauggucuggauauuugacagaggugggauggugcaagaauggagagcucaaccuguggcagcagauugccaugucccagaccuagcuguguggugaccacuaccuuagccauguggugagaacaugaagaacucacuucaucuuauuagaugccucaccuaccuuauggggucauugugauaaccuuguaauuugauaacacggccaggugugauggcuuacgccuguaaucccagcacuuugggaggccaaggagguuggaucacuugaggucaggaguucgagaccagucuggcuaacauggugaaaacugucucgacuaaaaacacaaaaauuagccaggugugugacgcacaccuguacucccagcuacuugggaggcugaggcuggucaaucacuugaacccaggagauggagauugcagugagccgagauugugccacuguacuccagccugggcuuaacagagcaagauccugucuugaaaauaaauaaauaaauaugauaacaugugaagugcauagcacagugccuggcucuuacccacaguuaaugucagcuguuucaagauauuugauaucuaaagcuccaaguauaaugcuuggcacgucauagacacuuagugacugguccauuucuuuggggaguacuuauguggacguggcaugucuucacuagcuuauuuauuuauuuuaagcagaaccuuauuucuagcaucuaacuacugccuccgugguuggcaagggugacuucaugaauguuguaaaggaauaccauuaaauaaguacugaggacaaacuaauaauucaacaaauauuuguuaaauguuuacaucaugcuuagcacccuuggauguuuugaaugagcucagggguccuggggguuggaggugacagggaaacacagagcaaaccggcaguugugaucuagcauguuaugcuucaguagaguuaauguuaagguggggcuaaaaacaggguguuacggcagcagaggaaccccucgcucagucugucaaagugguuucucagaagaagugaugccuaaguuagacauccaagaggaaugagagugagccaagagagcuuuccagacaguagaaaugaaauguguggccagguggcgagaaggaagauggcacauguaggaagugggugguguuggggcgguguaagaaaauugggaaggguaauggagagccauaguggauuuuaagcgcagaguggugugaucacauugauucuagaguagucacacagcauccagaggggaguagcccaggcauuuggaagaucacucaggaggcgccuccauaauucaggcaggagguaaaaacaguagcuuugguacggcagugaagauagaaggaaaaggacuugagagauacuaagaaggcaggaaggggccgggcaugguggcucauaccuguaaucccagcauuuugggaggccgcggcggguggaucaccugagguugggaguucgagaucagccugaccaauauggagaaaccccgucuguacuaaaaauacaaaauuagccggguguugugguguaugccuguaaucccagcuacucaggaggcugaggcaggagaaucgcuugaacccaggaggcggagguugcagugagcuuagaucgcaccauugcacuccagucugggcaacuagagcgaaacuccgucucaagaaggcaggaaggauaagacugugauuaauuggaugugaaggagagugaagaguagaggauaacucccagguuucugccuuguucaaguaggcagauggugaugucauuugccaagacugggaaggcauauugaaagacuuggaagauuugguuuuggacuuuugauuuugggaccuguccacuaggcaguugaauauuuggguucuggagcacaggacaaagaucugggcuagagggauggauuugggaaucuucccagaaggaauauguugcucuuagaaacagagagggcauagcacuuaaggucuaucagaggaggaguagcucaaaggggcaacuaagaauggccagagagguaugaggagagccagcacuaagcgucuuuucguguuagcagcuuacagaguugcuucacuuuguaaugugguaacagauagagggagcuaaaaaaguagaguucuaaggaacguccgagcaaagcacugaauuuuccaggcauuuucucuugccuggauagauauuuuaaauuuaugaauguugagaauaaaauucuucaaagcauuuuucuagagugcauuucuaaauacgguuugagucagucugaacugacuaaaaacauggaaaugguugggcuuugaacuucauagacaauaacuucacuaaucugccuaaagaauuuccuguagugucuccacauuaucaaggguagauauuuggauuugcauuuuuguggauuggagaggacagaacauuuucuguguuuuuuuuuuuuuccucagaagagggaauuguuuaggaaugauucaucuuuauauuuuuuguaacagcuuuauugaaauauaauucacauaccauacaguuuauccauuuaaaguauauaaauuggugguuuuuaguauguucauaguuaugcaaccaucaucaauuuuagaauauuuucaucacucugcaaauaaaccauauacccauuagcagucaucccuuauuucccccauuccacacccccacccccagccuuaggcaaccauuaauugacuuuuuguuucaauggauuuacguaauugguacaguucauauuaagggaacuuugggucugguuucuuucacuuagcauaauguuuucaagguucauccauguaucaguacuuuauuccuuuucauggcugaauaauauuccauuguacaguuauacuacauuuuguuuguccauuugucaauugauagacauuugaguuguuuccaguuuuugguauuaugauaauacugcuccaaacguucaucugcauguugguuuguagacauguuuuucauuucucuuggauauauauaccuaggaguaaaauuucuugguugugugguaauuuuauguuuaaccauuugaggaacugccacuguguuuuccaacaugucuguaccauuuuguauuacccugagcaguauaugaggauuccaaauucucuaacauuuugucaacacuuguuauugucuguuugauuauaguaauccuagugguugcgaagagguaucucauugugauuuugauuugcauuucccugauaguuagugauguugacugucuuuucauaugcuuauuggcauaucaucuuuggaggguucaucuauauuuguguuuuguuuguuuuuuuuucuuuagagauggagucuugcucugucuuccagacuggugugcaguggugccaucuuggcucacugcagccuauguuuccuagguucaagcaguucuccugccucagcuuccugaguagcugggauuacaggugugcgccaccacgcccagcuaauuuuuuauuuuugguagagaugggguuucgccauguugaccaggcuggucucaugcuccugaccucaggugaucugccugccucggccucccaaagugcugggauuacaggggugagcaccugugcccagcccauccauauuugaucaucaguuuuggcaagguaaauuaaguugcaaaaccugaaacuuuaaaggaacaaacauaacacauuugauuguagaaaugagggaaaaagaguguguguggguauguguguuuauguacauauguguauauguacaguggaagaugccauaaacagauuuguaaaaguuaaaggacaggcuccccagagaaauagccagugugcuccauccacaucaagccugagugugagagaguucuggauaauccuguuaccuggcugugacuuuggaaguggagaccaugaucucugccuucucccucauaucaucugucuuaaggucacagauaccgcagccacugccagguuuccacaagccagucaccuuucagguggagaaguagcuugcuauagcagccaguuucucgaguuugcgcgacagugccacuggaacaauggcucauucaugucagauuuccagagaguugggcagcacacuugugagaauccagcugugaacaagccauugcugucuuuaggagcuuaugugccaggugguaaaguguacauaugcaaauaaaaugguaagaugauugcaaguugucaugaagauaagacagcauuguaggggugaggugacccuagauuagacagguuggcugcagaaggcuucucugaggguguaacacuuguuuugagagcuaaaggaugaacgggaggagcaucaugaguaggagggaggcaggagcuuucuggauagaggcagcagcguguguaaagagcuuggggcacuagaagaacuggaagauaaauggugugacugcagaaugaugagugagacucaggaggcacgacaugaggcuggagaggugggcagggcugugcaggucucaguaaggaguuugauuuuauucaaagugccagggaccauuggauauaaauucuucauaaacugcaugcagaagagagauuaaaagguuggcagaaaggaauaaaaaugaaacuggaggaccaagcugguaaaaauugcccccaagggucuaucagaauccuaacucacuuagaccaauaagaucagugguuacuuaugaacaauacguuugaaaagaccuaugaaaaaacacgugaaauuuggaguuucucugucucucauguuuccuguaaguaauucgcuagauauagagacucgauuagauuuugauucaguauuuuaggcaaaaauauuuuuugggugguacuguguacuuccuauuuugucacaaugauaggcauauaauuauauguuuaguuccccacuuuaaugaugcuaaaauuaauuagugaguucagguguuaugccugauuccuucaucauaaacuucuccaucaaguuucaccaaaucauuuuaacagugauuaauaaucauuggcuagauacacuauuucauuagaguugcaaaauaauaguuuuccuagcauuucuucuuuauuuauuggcuaauuuucuuugauuaagcacuuuccuaaauggaguauucaaaaaaaaacuauauaaacaggaaaagcaggauaaaugcuugauuucaccccccccccccacccccagcaguuuucagaacaauagcuuggugccuuaacaccuccacagagagaugaccaauggaauuuuucuuaauaucauuauugacucacuuuuuuuauugugguagaauaugcauaacacaaaauuuacaguuuuaaccauuuuuauuauacauuucaguggcauaaguacauuaacaauguugugcagccaucaccaccauccaucuccagaacuuuuucaacaucccaaacugaaagucuuggccaggcaugguggcucaugccuguaaacccagcacuuugggaggcugaagcggguggaucaccugaggucagaaguuugagaccagccuggccaacauggugaaacccugucucugcuaaaaauacaaaaauuagccagaugugguggcauaagccugcagucccagcuacuugggaggcugaggcacgagaauugcuugaacccaggaggcagagguuacaguaaaccgaaauugugccacuaguacuccagccugggugacagagcaagacuccaucucaaaaaaaaaaaaaaaaaaaaaaagucuugccuauuaaacaguaacuccccauuuuccccuucucucagcuccugggcacaaccucucuucuacuuuuugucccuaaaaauuugacuauuuuaggcaccccauauauauggaaucacacaguauuuguccuuuagugucuggcaucuuagcagaguaucuccaagguucauccauguuggagcauguuauuagaauuuccuucauuaauuuuuuuuuuuuauugacagggucucugucacccaggcuggagugcaguggugcagucaagcuuacugcagccucagaugccuggguucaagugauccucaugccucagccucccaaguagcuggaacuacaagugugcaccauaaugccaagcuaauuuuuaaauuuuuuguagagacagggucucgccauguugcccaggcuagucucaaacuggccucaagcgaucuuccuaccucagccucccaaagugcuaggauuacaggcaugagccacugcuuccagccuuucuuccuuuuuaauacuaaauaauaguccauuguauggauauaccacauuuguuuaucuauucaucuuccauggacauuugaauuguuuccaccuuuugacuauuaugaauaaugcuucggugaacaugggugaagaaauaccugcucacguccuugcuuucaguucuuuuggguagaugcacagaaguggauuuccugaaucacaugguaauucuauguuuaauuuuuuaaggaagcaccauacuguuuuccacaguggcugcacuauuuuauauucccacuagcaauacacaaggcuuccaauuucuccauguccuugccagcacuuuuuguuuuguuuuguuuuugagacagugucucgcucuccgucccaggcuggaguucaguggcccauugcgaucucggcucacugcaaccugugcuucccgggcucaggugauccucccaccucagccucccaaguagcugggaccacgccuggcuauuuuuuuuuuuauuuuuaguagagacgagguuucuccauguugcccaggcuggcaguggccagcacuuauuuucuguguuuuguuuauuuuaauauuagccauccuaauaggguaugaagugguaucucacugugguuuugauuugcauuuuccaaguuauauuauucccuaguuguacugucuguucuugccuuacuguaaagaaauacuugagacuggguaauuuauaaacaaaagugguuuaauuggccgggcgcgguggcucacgccuguaaucccagcacuuugggaggccgaggcgggcggaucacgaggucaggagauugagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaagugguuuaauuggcuguacaggaaguauggcagcaucugcuccuggggaggccuuagggagcuuuuauugguggcagaaggcaaagcggagcaggcaucuuaaauggcaggagccaggaccgagagagagaagggaggugcugcccacuuuuaaacaaccaggucucaugagaacccacucacuauugaguacaaaggggaaaauccaccacaugauccagucaccuccucccaggcuccaccuccaacauugggaauuacuauucaacaugagauuuguguggggacacagauuuaagcuauaucacuagugauuagugauguugagcaucuuuucaugugcuuauuagcuguucgcauauuucuuggggcaaaagucuauucaaguccuuugcccauuuaaaaauuggauuuuuguguuugaguuguaggaguucuuuauauauucuggauauuaauuccuuuucccauaugugauuuauaaauauuuucaucuauggauugcuuuuugcuuguaauguccuuugaugccuaaaaguuuugauuuugaaguccaguuuaucuguuuuuuguugccugugcuuuucguguccuauccaagaaauuauugcuaagucugaacucaguaauuuuuauauauuuaaugauuuucaccccuaaaugguuauucuuuuugaugcuuaaguugucccauuauugaucguuaauggcacuuauuuuucggguuuucuaggugcuuuugacaugagccuaguaguguuauaugaguucccugcuuucuggcuuuacaagaaguccggggcuuaucggaaaaauuucugaucccagauccagaaucagccauuucuuuaacuaguucugauucuuuuuggugggaaaugguauuaagggcauucauuacaauuaagauguaaauuccaguagguuuuuuuuuuuuuuuaguagaacuaggaaauacauacuuuuuggaaagaaaaagauacaccaugauuucagacugauuuacuuccaauucaaaugaaggauuaaaggauuuuuauaucuuugauuuuauauuugucuuuucucauuuguugacaguaacaccagagggguccagucaaaacacgauuuuauugauugaccgauugauggagaccaccucacucugucgcccaggcuggaguauaguggcgccauguuggcucacugcagccuccaccaccugggcucaagugauccuuccaccucagccucaucaguagcugggacuacagggaugcacuaccaugucuggauaauuuuguuuguuuguuuguuuugagauggagucucacucugucacccaggcuggagugcaguggugugaucucagcucacugcaaccucugccucccggguucaagugauuuuccugccucagccucccugguagcugggacuacagacgccugccacuaugccuggcuaauuuuuguauuuuuaguagagacgugguuucaccauauuggccaggcuggucucaaaccccugaccuugugaucugccugccucugccucccaaagugcuaggauuacagucaugagccacugcaccuggccaauuuuguuuguguguuauagagauggggucucacuguguugcccaggcuggucuugaacucuaaagcauuccuccugcuuuggccucccaaagugaugggauuacagaugugaagcacuacaccuggccgaaacacaauuuuaaacuugaaauaauucuucucuguguggcugugccacuaauuugguaaauaauauagauucauuugucuuuuguuucauuuuuagggauauuuuucuuuuuuauauuugcuuuuugcuuauauauuuacguaguucuaaagauaaaaccauaaguaagauagauugaaagaagucuggcuuuccuccuugucuuuguucuucucuauacguuguagguaaacaucuuuguugguuuuugguuuauucucccauggcuuauuuuaaaagcuacaagcgugugugucuguguguuucuguauucccuauaccuuacuucauucccauuuuauuucuucucguuuuuaucuuggcaaucauauuucuuauuuccaagaauucauuguugauuucuacuuccuuuaugauuuguuugcuuuugguuuuuuuuucuccccccgagauggagucuugcucuguugccuagagcuggaaugcaauagugcgaucucggcucacugcaaccuccgccuccuggguucaagcaauucuccugccuuggccuccugaguagcugggauuacaggcgcacgccaccacaccaggcuaauuuuuguauuuuuaguagagacgggguuucaccaugcuggccaggcuggucuugaacuccugaccuugugaucugccugccuuggccucccaaagugcucggauuacaggcgugagccaccgugcccagcccugcuuuuaaggaugcacuaucuuuccaacacugucugaggaauaccagucagaauuucuuuucagguguuuuuucugggaccuaaaauauguauuucuucugaggucugaucaccuuuucaucuuaguuguccuuuuuuguccuuuugguuuuccuucacugucuggugauccuuaucaaugaagaacuggguuguucauauagguaauuugcaggaggucccucuguuuuucaauaguccucuugccuuagugagaguuggcugauugaggaaugggaaguacagaugaaaucagguugauuaacugguuucccacuccugauuucucuaccugcugauucaaagcugggcauuuauccagcuccuccaggaaaaagggcucugccucucuguucucuuuuggcccugcauguuguaaaaaguggccagcuuugcucuggucugucuuguaauauaguuuccucugcuuucucuccauccucuagaagauggccugcaguuaaauagacuguggcccucagaccuucucauuacuguuuugcugagauucccuugugaaugucuuuauuguuaugucacugggauuuggggaggauggagagguaagugcacuugccuguuuagccugucguuuugaaaugaaacuccuuuugucaucccauuucugacaguaggacugcuugccacucucuuuucucuguugguuuaaggacugaaguggaucuaaaauuauucucuguauucacaaaucauagcuaucaaucuuuagucagaugggaaaacuuaauuaauuaauucagggacuaaauuucucuuuauagcugcauaguccauguaaguagaaguuaguuaucaaugaagugugugaugcuuccugcccugcgauugguagauuucuauuugguucaaggauuggguaacuuuucaagaccuuuccuguuugucagugacuuuuuuccagagaagcagaaauaacaaggccugcuuccuuugcuugcuuugugggaaugauaauaucaucaucaucaaacauuuagugcuuaauaugugccagacaucauucuaagugcuuuauauguauaaacccauuuaacucaauaacagugguuacuauuauccuuauuuuauagaugaugagacaggcagagagagguuaaggaacuugcucaaggucaagcugauccugacagccaagaucucacccuauuagucagacgcccagggccauucucuucuucacuucaaucgucuuaucuuucuaaagggaagugcuucaagagauuuucuuaggauggcugaccacuuuucaugucuugucaaccauagguauaagaaaauccucuaauacugagucuucaucuaguuucuuucuuucuuucuuuuuuuuuuuuuuuuuuugagacggagucucacucugucacccaggcuggagugcaguggcaugaucucggcucacugcaagcuccgccucccagguucaugccauucuccugccucagccucccaaguagcugggacuacaggcgcccgccaccauaccuggcuaacuuuuuguauuuuaguagagacgggguuucaccguguuagccaggauggucuggaucuccugaccucgugauccgcccgccucagccucccaaagugcuggaagugcugggauuacaggcccggcuuucuuuuuuuuuuuuuuuuuuuuuuugagacagucucacucagucacccaggcuagagugcgguggugcaaucucggcuuacugcaaccuccaccucccaagcgauucuccugccucagccucccaaguagcugaaauuaccggcaugugcuaccacgcucggcuaauuuuuguauuuuuaguagagacaggguuucacuguguuggccagacuggucucaaacuccuggccucaagugaucugcccgucucagccucccaaaguacugggauuacaggcaugagccaccaugucuggccuucguguaguuucaagcauguccuuuauugccugaaauagaaaucgcugaugacucuaauuguagaaaugaauauuuuaaaugauauaauuauggcugaauucaguuuuaaucuguggagaacuuuugcaaauuauguugaaaagauguuacuuaaaauguucuuuucugcuauguauuugauuuuuuaaguagcauuaaaacuuaagaguacaugacaaaucucacaagucuuggcuacacuaacuucugaggucuuucacaaugcguauuuauuuccaugcagcaugaauaguggauucauaaauggugaauguuuucccagugaaaauucuuuuuaagaaaauacggaaaagaaauguccuuaaaugguuugaacauauuuuagccugacaggcagauaaauaugaggguggagaagcaugugaaaaacauuuagacagcauuaagaagaauuuuauuaaaauaaugauaauaauaauaauuagcugggcacgguggcauaugccuguagucccagcuacuggggaggcugcaguaggaggaucaucugagcccaggaggcagagguuacagugagccgagaucacgccacugcacuccagccugggugacagagccagacccagucucaauaaauaaauaaaaacagaaauaaaauaauaaaauccagguguucgugugugugugugugucugugugugcauuuucaacauuuuguuucagaaauguucaaucauauacaacauuggagcaagugauaugaugcaccucauguacccaucaccuaacuuccaacaguauuuugucaggggauauuaugaucacugccaugaagacaaaugcuuagguagguauuaccaccuucucuguacauuguuucuuggcaaaaugucauuugaaaaugauagaacucgggcaggcaugauggcucauggcuguaaucccaacacuuugggaggcugaggcaggcggaucacuuugaggucaggaguuugagaccagccuggccaacguggugacacccugucucuacuaagaauacaaaaauuaaucaggcgugguaucgggcaccuguaaugccagcuacucaggaggcugaggcaugagaauugccugaacccaggagguagagguugcagugagccgagaucgcaccacugcacuccagccugggcaacagagugagacuucaucucaaaaaaagaaaaaagaaaaugauagaucuugaauguauuucaguuccaugaccuuuuuuuuuuguuuguuucaucguguuagcuaggauggucucgaucucuugaccucgugauccagcugccucggccucccaaagugcugggauuauaggcgugagccacugugaccagccaguuccaugacauuuuaaaaaaauucaacacuaucuaguuuugauuacaacaaagaucugcacaggaacaccagaucuguuaagaauuagcgaaaacuaguuuacauguuuugaauguuuuuucucucugcuuggguaggaaccccaggcgugacugugauacuugagcagucuuguuagaagcaauuauguuacaaacagaacuuuucauugaucuguguaaccagccccuugguucucagaaaaagaguuguggccaggcacaguggcacacgccuguaaucccagcacucuggaaagccgagacagguggauugcuugagcuuaacagccagagacuggugaaacccuguuucaaaacaaacaaacaaacaaaacaaaacaaaaaaacuuauuuaucacuuuggaagggaggugccuuucuguauuauuauuauuuuuugagacggagucucgcucuguugcccaggcuggagugcaguggcaugauuucggcucacugcaagcucugccucccggguucaugccauucuccugccucagucucccgaguagcugggacuacaggugcaucccaccacaccuggcuaauuuuuuguauuuuuaguagagacaggguuucaccguguuagccaggauggucucgaucuccugaccucuugaucuguccacuuuggccucccaaagugcugggauuacaggugugagccaccgugcccagccaaccuuucuguauucuuuuuuuuuuuuuuugagacggagucuggcucugucgcccaggcuggagugcaguggcaccgggaucacgccauucuccugccucagccuucccaguagcugggacuacaggcgcccgcuaccacgccgggcuaauguucuguauuuuuaguagggaugggguuucaucguguuagccaggauggucucgaucuccugaccucgugauccgcccgccucggccucccaaagugcugggauuacaggcgugagccaccauguccggccuuuguguauucuugaauacacaggaauauuggugagaaucccugaguugcacuacagucggcaucaucaggcguccucauucuuguggcugucagcagauuuucaguggacccccaguuuggcucucaaauuauagcauacaucagaaucaucuggggaacuuguuaaaaaaguguauucuccaaaaaauuagucgggcaugguggcgggcgccuguagucccagcuacucaggaggcugaggcaggagaauggcgugaacccagggggcggagcuugcagugagccgagauugcgccacugcacuccagccugggagacagagcaagacugucucaaaaaaaaaaaaaaaaaaaguguauucucugcuucucucccaaagauugauucguuagauuuggauugcaucccaguaaucaguauuuaaauagucauuccaggaagggugcuauccugauucuaguaucagagaaggaaguccuuaaaagccauuguugguuuucacuggcugcuacuagguuuuuuuguuguuguuuguuuagagacaagaucucacuauuuugcccagacuggacucgaaguccuggacucaagugacccuccugcuuuggccucccaaagugcugggacugcagaugggcaccacuguguccagcccucauccuaguuuuacuaagguugguagguggugaaaaaaauugcuaaaaauguuuucauccuuuaacaugcucagugaguguuaugacaaccccacauagacuuuuacugccuacagacagauuuacugucacagagguugucuuaguucaggcugcuuugacaaaguacuauagacuggguagcuuauaaacaacagaagcuuauuucucacaguuccaaagucuggagguuuaagaucagggugccagcacugucagguucucaugagaacccucuuucgggaugcagacugcugacuuaccauguucucauauggcagaaagagagugaacuggccucuuuuuauaagggcacuaaucucauuuaugauggcugcacccucaugaccuaaauaccuuccaaaggcccuaccuccagauaccaucacaaugggaauuagauuucaacauaugcauuuuuggggaaacauucaguccguaacacaggugcacccuuaguugugggcaauucaguucugaugcuguggucugaugaccacacccugacaacauaggugcauaguggguaguaugauugcaaaggaucucguguuuuucucugugguuccacuaaauucuuuaguccaagccuuaggccuccccugcuuggucaccuguuggaccaacacuagguacaggaagugcaggaagcucaguuuacaaaaagucaucuggugcuuccagcuguauguagcuuccucugaaagaaaaggaagcguggggaguguagaaagcaguuaguucuucaccugaggcugcaguuccaaaacugaauggaaacugugguguuugggaaguguguuugacuaaaguuuccuuuccucaauuucucaaaggaaacugugacucuucccccaccaucuuccaccccuucaguuuccauacauacaagaaagaaugauguccuggagcaaccucuggagaacaacuguggggccuccccauuacaaaacagccuccccugugugcaaucagaauugcuuucgucugggcagaaccauacaacacacagcugggcuguguggagagcuguggccgacuguagggcuugcccgcuagucuguauuuuccccuacauuucucuaccucucauauaguggaauugguaccacgcaaccaccucuggccuuugaugguggccuuugacaugcaaccaccucaaagccaaagggcuuugaagggaggugaugugugucacuuucagugggaaguauuaaagaguggguaugaguuuugacuuucuuuuucugugcuagggcaaccaugggagacauaaguucuaguagugucccuguaagcugaagaagggcugcuagacccacagugaauuuuugugaacaagaaguaaucugggcugggcgccuuggcucaugccuguaaucccagcacuuugggaggccgaggcagucggaucaguugaggccaggaguucgagaccagccuagccaacauggugaaacccuguuucuaccaaaaauacaaaaauuggcugggcaugguggugugugccugugaucucccagcuacucaggaggcugagguaggagaauugcuugaacccaggaggugaagguugcagugagccaagauugcaccacugcacuccagccugggcaacagagcaagacuccgucucaaaaacaaaaaguaaaucugguugggcauggcggcucacgccuauaaucccagcacuuugggaggcugaggcaggaaucaguugaggucaggaguuugagaccagccugcgcaacauggugaaacccuaucucuaccaaaaauacaaaaauuagcugggcuuggugaugcaugccuguaguuccagcuacuguggaggcugaggcaagagaaucacuugagcucaggagcucaagaccagguagguugcagugagccaggaucucaccucugcacuccagccugagugacagagcaagauuccaucuccaaggccaggcaugguggcucaugccuguaaucccagcacuuugggaggccgaggugggcggaucacaaggucagaagaucgagaccaucuggccaacauggugaaaucccgucuccacuaaauauacaaaaauuagcugggugugguggcgcgugucuguuaucccagcuacucaggaggcugaggcaggagaaucgcuugaacccaggaggcagagguugcagugcgccaagaucaugccacugcacuccagccuggugacagagcuagacucugucucaaaaaaaaaaauaaaaaaaaguaaauauuagguuaagccauuuauuucaggauuuguuacugcagcauagcuugaucugucugccaguuugaaguucugagagucaagauaccugaguuugauucugagacuacauguggucuagugcaagaccuuuaauguccugaauccccuuuuuaauauauaaauugaaggguuuaaguuagaugaucaugaagggccuuuuuggcacuuaacauucacagaugcuggauggcagcacucaaaugcagauguuccuugacuuaugaugggaguuuauguccugauaaaccucucauaaguugaaaauauccuaaguugaaaauguaaggaccgggcgcaguggcugaugccuguaauuccagcacuuugggaggcugaggcaggaggaucgcuugagcucaggagcucaagaccagccuggggaacauggugaaacccagcucuauaaaaaauacaaaaauuaacugggcguggugcuguaugccuguagccccagcuacucaggaggcugaggugggaggauggcuugagcccaggaggcggagcuugcagugaaccaagauugcaccacuguacuccagccugggugacagagccagacccugucucaaaaaaaaaagaagaaaagaaaaugcauuuaauauuccuaauguaccaaacgucauagcuuagccuugccuaccugaaaugugcuaagaggacuucacuuuagccugcaguuuggcaaaaucaucuaccacaaagccuuuuuuucucucucucucucuuagagacaggguuuuacucuguuacccaggcuggaguacaagggcacaauuacagaucacuguaaccucaaacuccuggguucaaaugaugcucccaccucagucucugaaauagcugggacuauaggugaccuggcuaauuugaaaaauuuuuuuguagagguggggucuuucuguguugcccgggcuggucuugaacuccuggccucaaaugaucuuuccagcuuggccucccaaagcguugagauuacuguuguaagccaccaugcccagcuacaaagucuauuuugugauaaaguuauaaagaaauuuggaucaaaacucaaaacuugaaguauaguuucuacugaaagcauauugcuuuuuuuuuuuuuuuuuuuuuuuuuuuuuuuuuuuuuuuuuuuuuuuuuugagacagagucucacucugucacccaggcuggaguguaguggugugaucuugguucacugcaaccuccgccucccagguucaagcgauuauccugccuuagccucccagguagcugggauuacaggugccugccacaaugcccgacuaauuuuuguauuuuuuaguagauacgagcuuucaccauguuggccaggcuggucucaaacuccugaccucaggugauccacccaccucagccucccaaagugcugggaucacaggugugagccaccgcgcccagccgcauauugcuuuuuuaccauuguaaaguagcaaaacuguaagucaagccauuguaagucaggaaccacgugcacacuuuucugauugauguacaaaaaggagacuaagucuggcacuaaagucaucccuggaaaacuuauuuauuauuauuaguuuuugcuauuaaaugagaaguuaguuaugugaagaaagugacaaagaugaaguaauacuuuuuuaaaaauuaguuuuauugagauauaauucacauaauuaguuuauuuggcucaugguucugggaaguccaaggucauggcauuggcaucuggugagggccuucuuacugcaucaccccaaggcgaaagguggaaggacaggagagcucaagagagcaagagaugguugaacuucuguaacagauucacucucacaauaaauuaaaccacuccugugauaaugccauuaaucuauucaggaggacaagagccuucaugaccuaaucaucucuuacaggucucacgucuauacacuauugcacuggggauuaaguuuccaauacaagaacuuuggaugacauuucaagccauagcaaccacuauuuaacuucagaacauuuucaucacuccccagaaaagcuguacacauuagcaaggacuccucauuccauaaaucuacuuuuuuuuuuuuuuuugagacagagucucacucucucgcccaggcuggaguacaguggcaccaucuuggcucacugcacccuucaccuccagguucaagugauucuucugccucagccuccuaaauagcugggauuacaggcaugugccaccauaccuggcuaauuuuuuuuguauuuuuaguagagacgggguuuuaccauguuggccaggcuggucucaaaugccuggccucaagugaucugccccccuuggccucccaaaguguugggauuacaggcgugagccaccgcacccgcccagaucuacuuuuuuaucuguguagauugccuauucuagacauuucauaucaguagacucauacaauaggagucuccuugucuggcuucuuucacuuagcacaguguuuuuaagguucguccauauuguagcauuuaucagaaccucauuccuuuuuauaguugaauaaauaauccauuauaugucuguacuacauuuguuuauucauuugucaguugauaagcaauugggucguuacuacuuuugacuauuaugaauaaugcugcuaugaacauuugugugcagguuuuuguuuggacauauuucuucguuucucuuggguauauacauaggaaugaaauugcuggguuaugugguaacacuauauuuagcauuuugaggaccugccaaacuguuccauaguagcuaucccauuuuacuuuauuuuuuuuuugagacagcgucucacucuguuacccaggcuggagcacaguggcacgauuucggcucauugcaaccucugccuccugguucaaccaauucuccugccucagccuccugaauaguugggauuacaggcaugugccaccacacccagcuaaauuuuuuuuuuuuuuuugagucucgcuccaucacccaggguggaaugcaguggcgugaucucggcucacugcaaggcuccgccuuccggguucaugccauucuccugccucagccucccaagucacccagcuaauuuuuguauuuuuuaguagaaacaggguuuugccauguugccaggcugguuucugaccccugaccucaaaugauccucccgccucugccucccaaagugcugggauuacagucaugagcuacugaauucggcccauuuuacaauccuauaugcaauguaugaguguuuugauguuuccacaucuucaucaauacuuguuacugucuuucuuacugaaguaaucaguuuugauaaagcagccauauggcaaacuaaacagugaagagauuuuuacaugcauauuagcuuaaguugcucucuaaacaguuguaguguguauuggcguauuuauaaaaauuugcacugugagcuuagcacuaaaguaaauguuaaugacuaauaacauaauucuucaacuuguuuagcuuuuggaaaauuuuucauuucaaaaaugaagcacucuugaagggaaaaaaaggaguaaauaaaaaaugaguuguuugauccucucucucuugauucaccagauguaauuguucucuuggagcauuuuuuuuuuuuuaaagacagauucucuguuuuccaggcuggagugcaguggugugaucaugguucacugcagccucaacuuuucaggcucaagugauccucccaccuuagccucccgaguagcugggaccacaggugcacaccaucaugcccgguuaauuuuuguauguuuuuguagagacaggguuucgccauguugcccaggcugguugaacuucugggcucaagugaucugccugcuuuggccucccaaagugcuaggauuacagguaugagccacuuugcccaaccucuugaagcauaaacauauaaacacacacacacacacacacacacacacauauuucuuuuuuuuuuuuuuuuuuuuuuuuuugagacggagccuuacucugucacccaggcuggagugcaguggugcgaucucagcucacugcaaccuccgccucucagguuggagugauucuccugccucagccucccgaguagcugggauuauaggcacgcgucacuacaccuggcuuauuuuuguauuuuuuaguagaaaugggguuuccuucuguuggccaggcuggucucuaacuccugaccucucaggugauccaucugccucagccucccaaagugcugggauuacaggugucagccacugugcccgguugcauaaacuuauuuuuauaaauuaugugcuucuaaauuaucagguggacugugccuuacauguauaggcuugaguaggcugagcaugguggcucacaccuauaaucccaacacuuuuagaggccaagguaggaagauggcuuggggucacgaguucaaggccagcguggacaacauagugagacccugucucuacaaaaaaaaaaaaagaaaauuaggugggcaugguggugcaugccugagguccuggccccugaggaggcugagguggaggauugcuugagcccagaaggucaaggcugcaaugagccaugauuguaugacuauacuccaguuugggugacagagagagaccccaucucuaaaagcaaaaaaaaaaagugaaauaaaauaaaaaaucguugcuaucuuuuauuaauauucuguuuugggagacauuauucuuauauuuuccucacacuuuuuaaaugugguuucuuuuaguucuuugaacauacuuaaauugacuuaaacucuugucuguuaaguccaauaucugggcuucccuugggaagaguuuucuauuguuguuuuuucccuuuauaugggcuauauucuuuuguuucuuugcauaucuuccaauuuuuuguugaaaacuggacauuuuauuuuauuauuauuuucagacagagucucucucugucgcccaggcuggaguacaguggugugauccaagcaauucucaugccucaacugccugaguagcugggacuaugggugggcagcaacacaccuggcuaauuuuuuuuguauucuuaguagagacaggguuucaccauguuggccaagcuggccuugaaccccugaccucaggugauuugcccaccucggccucccaaagcacugggauuacaggcuugagccacuguggccagccaacuggacauuuuuaaugacauaauguggcaacucugaaaaucagauucuccucccucuccagaugagcucuaagucagguaaaauacagagauauuugcaaaugggguauuuuggggaaccaccagacagguuaaauaaugccaauuuccugggaaugguacuuugaaggagcuguagcccaguucugcuuccucugguaacugccagucuucuggucuucaauguggaugcagcugguaguuuucaaggcuauuauggagcuggagagcuaggaaugggacucagucaaguuaaaaugcuacaaaacucacuguucuuaccaggauucagcuauuuaucuuugauaaauuauccccaguuugcuaaaagccuauuuccagaguucugaaaaaggugauucuauuauuuugccaauuuuucauuguuuuuauguaguagagaauuuuggucagggaaaguccuuauucugccauuuuugaugauacucuuucccuccccuuuuuaggcuuuuauuuucaugaaucuuguaucucuugguguuuuguuuuguuuuguuuuguuuuguuuucgagacagggucuuguuuugucacccaggcuagagugcagugguguaaucauggcccacugcagcuuaaaacuccugggcucaagugauacugcucccucagccucccaaguagcagagacuacaggugcacaccaccaugaccagcuaauuuuuuaaauuuuuuguagagauggggucuugcucuguuguucagacuagucucaaauuccuggccucaagcgauccucuugucucagccuuucaaagugcugggauuacaggcuugagccacuacacccagccuaauuuuuguauaugaugugaggucgggguccagauucauuuuuucauguggauauuuaguugucccaucaccauuuauugaagagacuguucuuuccccacuggauguuuuuggcauccuggucuaaaaucaguugacuguagauguauggguuuauuucuggacuucuaauucuacuccauugauuuauacaucuuuccuuaugccaguauuucacugcuuugguuacuauagcuuuauaguagauuuugaaaucaggaaauauuacuuuuacaacauuuuuucuuucaguauuuguuuuagucauccuggaucccucgcuuuuuuuuuuucuugcgucaguuuguuuguacaaauagcacaggaggauccccgccccaugcagacggcagcccgagggggucgcagcaguccuucuguucucacauuuguagacagagauaucuacucugaagccuuuguaggggccugggcaccuuugggagcuugagcuggaacugaagcuggagcugcagucugggcgcugauuugauccuuggccuuggccuuuagccggcacagccugagucccuuggcagugcgggcacgagcacacuucccaagcuuggggugggcaauguaggcaagucgaucgagcuuguggcugacacccuuugggaucuugggcuuaaccuccuugggcuuuacgagggccuugauagccucggcacgugcacucauggccuuggcauuguuggccugcaucuucuugaggcccuucuugugcuucuuggcaaagugcauguuccucaggaaccugggguccauccacuuaagagauuuguaucuuugugaucgggguuucuugauagcauuucugugccauuuucgggacugguugugugugguaugguucuuggacuuggcccugucuguaccuuaagccgcagcucccgaagcaccuagaacuggaacccucacauuuuuauaugauuuuagggcuuuguuuuauuuuuggggacagagucuugcaguguugcccaggcugcucuuagacuccugggcucaagugauguucucaccuuggccaccucuaaguaccuaggacagcaggcaugcacuaccacuccuggcuuccaaaugaauuuuggggucagcuugcccauuucuguagaaaagguaauugaaauuuugaggccggcaugguggcucacgccuguaauuccagcacuuugggaggccgagguggguggaucacuugaggccaggaguuugagaccggccuggccaauauggcgaaaccucaucucuacuaaaaauacaaaaaauuagccaggcacugugacgcgcaccuguaaucccagcuacuugggaggcugaggcaggagaaucacuugaacucuggagguggagguugcagugagcugagauugugccacugcacuccagacugggcgacagagcacaacucugucucaaaaaaaaaaauauuuugauaaaaauuguguugaaucuguagaugaauuuggugaaauaguauaacuuuaagcauuauaaguuucauuuagagaaaguuuggaaguauguaaagugaaaaagaguuuaauguuugugguuuuuuaauuagguaagcauauaggucucacuuggucuuccagaucugucaaaggaaugggggcaggcucuccuagagccagaggcagccgcgguagaggaacuaggaagcuggugcaccacugaacaaagauagaguguuucucagggcugcauaagacacucacuguggccaacucaggugaagguuuuccuucagaggccacagagucuccacgggaacagccugccccgcuucagcauuccuguagagugcuucuguuguauaucagaaucuauaaauuguggagcacucggguggggauagaugugauugccuuauuugucaugaauuugaaaaaagaaaacauuuuggaacacauuuuuuacaaguagccauuugauauuuguuucuugaaaaguuuaugagauuuuuuuuaaagagcucaaauuuuguugaacauagagccauaaauaaugguuguuuuauugacuuuauauguuauguguuuguauccacaguguccuucucaucucuugccuuuguaaccuaccuaauuccuguguugccaacacaaucauagaaauacaaaggaauuaugguaauuggccauaagugacgaaguaugaguuacauuuaauuauauauucaaaaaaggaaaauagaaaaccugguuaucaauaaguagacgaaacuauauaccaccauuacauagguugcaguugaauauguggucaagcacgguggcucaugccuguaaucucagcauuuugggcugaggcgggaggaucacuugagcucaggaguuugagaccagccugggcaacauggcgaaaccucgucucuacaaaaaauacaaaaauuaaccaagcauggugguacaucuguagucccagcugcuccggagacugaggcaggaggauugcuugggccuaggaguucgaggcuguaguaagccaaggucaugccacugcacucuagccuggguaacacagugagacucugucucaaaaaaaaaaaaaaguuggccaggcgcaguggcucaggccuguaaucccagcacuuugggaggccgagacggguggaucaccugaggucaggaguucgagaccagccuggccagcauggugaaaccccaucucuacuaaaaguacaaaaauuagccaggcauggugggcgcuuguaaucccagcuacucaggaggcugaggcaggagaaucacuggaaccugggaggcggagguuguggugagcugagaccacgccacugcacuccagccugggcaacagcaagacuccaucucaaaaaaaauaauaauaauaaguuaaauaugugguaaaugugacuuucagugaaacguauuugaacuuuuguuugggagagcagaugguuucaagcaaauguuauuccugauuuuagcuuuaugagaagagucacaguauuccgcuguuguagguaucagaaacuacaaccagcgauauccagauucugcuauuugaaccuauccagagucagggguucuaagaagccacccaaggugugaaacugguauaccuugccaggcucccgcucugcacacccagagggaaacugguaccggagugaggauuggaagaaucgugucuguaaaccgccugccagccacucccuucuccaggcucuguuucugcacccugcacuuaagcccagcuugguauccgacugucccguccuacuuugggaccuuugccguggugguccuuuaccuugugagucccaccugucccuuuugcacuuguccaaaccuauccuacaaucaaggccuaccucagaagaauauuuuuuucguaacaaccuuuuugauuucccuugcccuuugcccaucucugccuuugcugaugccccauaaaguuuaugagugcugugugugucaacagcccucaccauaaucugaguacucaugugauccuccugaagcuugugagcucuucaaagaggaaaggagaaaaugcugaacguggauccaggcccuguucaacgugccagccucagcuuugaaggggccagucuagaaucauacuuuuuugguugcauuguuuuuguauuacuacuugaggaauuuucuaacagucaucauuucauaguucagugcucacuauuguaccugcuccucuaagguuauaauaugauuucuuauucauuuguagcccaccuguguggauaauagcaucacaggaguuauuguccagaauuacuguagccuuccucacuuuaucuuauuuuuccccccgacaggaaaggacuuagaagccuuacaaauacaucugugcauucuugcuucagacuuuacaacugagggccagcccagucuggaagcaucucuuauuaauguuacaaggaaaccgcuaccucagcaaacaaaaggaauggaggaggagacuuacaacaaacgccauuuaaaaaaaaaagaaaaacuuguuuucaggaaacauuagaggaaauuuggagaauuucagcauugcauagaagcagccuuacagguaaacggauuugacgggcaggcucugucaaaauucugcagaaguuugaucuuccuucuuaaggacuuugugugaaguaauucuuuacugcuuuuaaauugcuguugaucagcuucuggguuuuuggguucuaacuuuuuuggguauauugaagacacaguguauuacauuauauuacauuuuuaaacguuaaguuauuuuucugccauuguaaauacaaguaucaaaauauucuugcaaagaaguaaacauuuuucucagcaagcauauccuuuuaguaagagaguggaaugcuaaacaguucuuauccagcauuuuggacaucuuuuauuuuuugucagagauccugucuacacugaaaauauuaauuauauaaaccuguugucucucaccucuacauuggaucacauggucaccugccucauggaaaugccuuuuuuaaaacuucgauuugcagaacuccacuauuuuuauaccuagcuacaguuuugagaaagaagaaucagaacccugacccacuuacgguugcugggacaauucccccucccgcauguauugcugcagugcccaggacaguaaaauggacuacaagcggcgcuuccugcuuggcggguccaagcagaaggugcagcagcaccagcaauacccgaugccugagcugggccgagcacugagugcuccccuggcauccacggccaccacugccccccugggcagucugaccgcugcaggcagcugccaccaugccaugccccacacuacuccuaucgccgacauccagcagggcaucuccaaguaucuggaugcccugaacgucuucugccgugccaguacuuuccucacagaucucuucagcacuguguucaggaacucucacuacucaaaggcagccacacagcucaaagaugugcaggagcaugucauggaagcagccagucggcugaccucggccauaaagccugagaucgccaagaugcuaauggaacuuagugcuggggcugcaaauuuuacggaucagaaggaauucagucuccaggacauugagguagaguaucuuuugugucauacuuguguaggaaaauauacuacaaagguaagugagaauauugucuuaaguuuuuuuccaaaucacuguaauaguagccuuuguccucuugcuguugguacucugucuuuguaaaaaaugugugcgugccagguucugaauugcuuucauaucaaauucaguagguuaaggguaggugugguggcuguaaccccagcacuuugggaggccaaggcgggaagaucgcuugagcucaggaguuugaggcaucauagugagaccuugucucuacaaaaacuaaaaaaauuaauuagcugggugugguggugugcaccuguuggauagauuuuaaaaauuacuuuuagcuguucagagaguuaaucuggcauuaguuuuuccauccuucuacauccagaagcccugacuacuccagaagcccagaagcugaggugggaggauugcuugagcccaggaguuugaggcugcagugagccgugauugcacugcuguacuccagccuggacggcagagugagaccaugucucaaaaaaaaaaaaaaaaaaaaaaaaagaaaaauuauuaaacaaaccagccaauauuuuauauuguugucuuucaaauuuucaagucagaaccuaauuuucaaauaccguacugguaaaaguuauuagugaguacugagaauucuaaauacgauuaugagcuuuauuuguggauuuuuuuuuuuuuuuugagacggaguccugcuccgucgcccaggcuggagugcgguggcacgaucucggcucacugcaagguccgccuccuggguucaugccauucuccugccucagccucccuaguagcugggacuacaggcacccgccaccucacccggcuaauuuuuucguauuuuuaguagagaugggguuucaccauguuagccaggauggucucgaucuccugaccuugugaucugcccgccuuggucucccaaaguguugggauuacaggugugagccacugcgcccagccuuuuuuuuuuuuuuuuuuuuuuuuuuuaagucaguuucgcucuuguugcccaggcuggagugcaauagugcaaucuuggcucacugcaaccuccaccucccgaguucaagugauucuucugccucagccuccugaguagcugggauuacaggcaugcgccaccaugcccggcuaauuuuguauuuuuaguagagacgggguuucaccauguuggucagacuagggucucaaacucgcaacuucaggugauccgcccgccucagccucccaaagugcugggauuacaggcaggagccaccgcgcccagccguuuuuuuuuuuuuuuuuuuugagacggagucucacucugucacacaagcuggaguguaguggcacgaucucagcuuacugcaacaucgccucccagguucaagcaauucucugccucagccucccgaguagcugggauuacaggcgcccaccaccacacccggcuaacuuuuuguauuuuuaguagagacaggguuucaccaucuuggccaggccggucucgaacuccuaaccucaagugauccaccugccucagcgucccaaaguguugggauuacaggugugagccacccugccuguccuguggauuuuuauuauauugaaucuuugguuuuuagagagucccacacguuuauagaauaauuuuuccaauucuaaauucacaguugcuaauauucagauguauuugagucuucuucaguacauuucuuggggucuuugauaguuuuuuuuuuuuuuuuuuuuuuuuaaaagacagagucucucucugucgcccaagcugaagugcaguggcacuaucucggcucacugcaaccucugccuccuggguucuagcaguucuccugccucagccuccugaguagcugggacuacaggcucacgcagccauacccagcuaauuuuuuguauuuuaguagagauggguuuucaccguguugcccaggcuggugucaaacuccugagcuuaggcaauccacccaccucauccuuccaaagugcuaggauuacaggugugagccaccacacccagccucuuugauaguuaaaaugaaauauuauucuuuuagggcucuagauuacaauguaagauuagaauacaaguuucauucaaaguaaagaugaccuuuuuucuugucuuauuuuaggaaaugauuuauucaacuuugaucucuuauauucguuugauagauuuuaaaaauuacuuuuagcuguucagagaguuaaucugacauuaguuuuuccauccuucuacauccaggugaaguucuuggauaugagauccuaggaaggagaauguuccuuaccccauccugggguuaagaucaccagucuuuugggucggaucugauuauuuaggugccugaauaagcuaacuaacacugcuuuggguuaaccaaaaaaagaacuugacuuuuaaguaacacaacuaauuuuuacuguguuuaaaagugauuuugaaggaauuuccaagaagaacuuagaguuauuucuuaagagacacagcaucauugguauaaaucaggguuuaucaagcuuuuucuaugaagggcagacagaaauuuuaggcuucauggaccacauguggucucucucacauauucuuuguuuuuguuuuuguuuugagacgaaguuucaucuuguagcccaggcuggagugcaauggcgugaucucggcucacugcagccuccgcugcccggguucaagcaauucucuugccucagccucccgaguagguaggauuacaggcgcccaccaccaugucuggcuaauuuuuguauuuuuaguagagauaggguuucaccgugugggucaggcuggucucaaacuccugaccucaagugagccacccaccucagacucccaaagugcugggauuuacagguguaagccaccgcucccggccuuguuuuuauuuuuauuuuuuacaauccuuuaaaaauguaaaagucagcuuuacuuugugggcccaucuauucuauggaugggguuuggccgauggguucuaguuugcugcaccugcugguauaaguguauagucacuuccuugggucagggucauucuacuuuggaucuaucuuuguaauuuuuuuuuuuuuuuagacagagucuugcucuguugcccaggcuggagugcauuggcgaucucagcucacugcaaccucugccuccuggguugaagcaauucuuaugucucagccucccaaguagcugggauuacaggcaugugccaacacacccagcaaauuuuuguauuuuuaguagagacaggguuucgccauguuggccaggcuggucucaaacucauggccucaaaaugcugggaucacaggcgugggccaccgugcucggccaucuuuguaauuuuuuuuuuuuuuuuuuugagacggagucuugcucuguugcccgggcuagagugcaguggcguggucuuggcucacagcagccucugucuccuggguuaaagcgauucuugugccucagccucccaaguagcugggacugcaggcacgugccaccacaccuggcuaauuuuuuuuguauuuuuaguagagacggguuucaccauguugacuaggcuggucucaaacuccugaccucaagugauccaccuaccucggccuuccaaaguguuggaauuacagagguuagccaccacgcccagccaucuuuguaauuucuaauuguuucuaugaucauauuuuauacccagggauacugucauuuuaaaguguguauaaaauggcuugucauaauuuuauuuuuauuuuuauuuuuuauuuauuuauuuauuuuuuugagacagagucuugcucugucgcccaggcuggagugcaguggcgugaucucggcucacugcaagcucugccucccagguucacgcuguucuccugccucagccucccgaguagcuuggacugcaggcgcccgccaccacgcccggcuaauuuuuuuguauuuuuaguagaaacgggguuucaccauguuaaccaggauggucuugaucuccugaccucgggauccgcccgucucggccucccaaagugcugggauuacaggcgugagccaccgugcccggcgggcuugucauaauuuuguuuaaaaauucaacacauaaaaaagcaugccuuuacuucucaaaagaaacguaagcagugaaacuucuacuuuccuuuagcaccucauuccuuuccccagaagugaccauuaguaacugguuguuguaugccauuccagacuaccgucuguacaugcauggauauguacagaugugugcagcuuugacuuuuacauaaagaaccacguuguucauccaccauugugccuggucacugcuugauagagauauggcaagacaauaguuaggaacacuuuguccucuccuagaaaguguugaacaaucuuagacucugacagcugucaccccaugaugacauagcgcucuuagcuuuauucaggacuucaggcaagagugguuugaaauauaaggccaaaggcuuuuauuuuaaccugagcauuacugagcucuucuucaggacaugcuugcagguauuggaggaaacagagcuugaccugcagggcccuuugcuuuccaacccuggagggcaagugcgccuguugcccagggcaggacaauuagagaagauaaccagcugugagcaguaggggcuugguaagccgcuggggcacagcaguaccugcuuuguuucuucugcuuuccugggacuggcauugaccacugaagcugagaacgggaaauacuuauuguuguaguuuggaauuuugacuuggcuuuccacauugaaaugcugauuagauaguuggaauacuaccauguuuuuuuguacauaaugggcugaacaggcuuucccagacgagucuggaaacuaaguauuugguggguuuuccaauuuaugcgucuauucugaguuucaaacagcugacuuacaagugaauuucuaaaugugauugccaagcauaggcccgcagacuucacguuucacuuuuuccccagagcaauauuuguuguuucuggaauuuauguacugccaggggauuuagccauaggccaauaagggucucucucagaauuuucagcaacucagaugaaauggcuaggcauuuggauuuuuuccuuuugguuuuuuaaggauuuuuauaagcaaggcccugagagucacuuugacauucaucccuggggaaagaggucuguggccuaacauugccaggcaaggccucuacucaggagcucaguccaggacugugggugagaaaagcucuggauucgagaguauucaaauauuugaccauuuaagaguuaggacaaaggaugauccuguccccuugccauguggccagugcaugugugcaguguucccaggugcuucugacuuacagccaaguuugggcugugguuauugauugacagauacugaugccuuuguccaggaauggugguugcugacugugugcucugccacccugccuuggaaccagcagggcauaugugaguccuguccagucuauacucaccagugacuuugccccuuagcccgagugguucacccucacagucucucuguuagagaagugaguugugacuaugggguuucacuagcugacuagugccugugacacugguacaucagccuaggaagucaguuacugggcacagagucagaagaccuggguuuggaaggugacaucuaucacuuaaauaaaauuacuuuuucaguggaaguguacauaaauaaaagaaucaaagugacuugugauuugugcauucauuccacagauauuuauuguaugccuuguuucugccugauacuacuccagcaugucgauugcaguagugaacaugacagaaaucucucccuucauguagcuagaagggaguuucgaucuuagagaagguaguuagaaaagguaccacugagaaggugacauucgaguaaaggccugaaagggaugagagagcaagccuguuggcccagaaaagaggauuccaggcggagggagcgccgagcacagagucccagaggcaggagccagccuggaguguuggaagagcaggaaagaaccugcuguggcuaaaacagagugaauggaagggagagaagcaggggugaggucagaaggguaaagaggggccacucuggugucuguucugaguagccagguaggaggcaaggugagguacaccucugaagggcaggggaugggagggcagcaggcugggcccugccauucuuuuguagugagcagcgaugccacuucuccccuugccuucuucauacuggguagcuccagggcucugguuuuacguuggguccucaguguugagagguguugguccucuauguaggcaguccaggaacccagggcagccauggggcucccaggaguuguaugucucuaaggagacuguauuuuauaaauuccagcauuuuuauugacuuuucaaguauuuaccaucuugugaauaagcagccagacuuauauguauauauacguauuauauauauauaugccagacauauauauaaaauauguauuuuuuauauauguauguauauauauacacauacgcacacacauacauauauauacuuauauauacauauauacuuauauauacauacuuauauauacauauauacuuauauauacauauauacuuauauauacauauauacuuauauauauacuauauauacauauauacuuauauauacuauauauacauauauaguauauauauacuauaaaauauauauacuauaaaaaaaaaauauauauauauauuuuuuuuuuuuuuuagagauuaggccuugccauauugcccaggcuagccucgaacucuugggcucaagcaguccuccagccucagcuucccgcguaucugagacugcguagcugagacuacaaguauguaucacugggccuggcucucaaaucuuuacacaguugcaucuuggcuuucaguuugacacaacaacaaauuucuuuuguauacuaugugauuaccugugaauauguuugaaauaauuuaucugugagugcugacugacucuuaauuaaggaccuuaauucagguauauuaacauuuauuuuggauagauauauaccagaaauauuguagaguaacaauaauggaaaauauuagaagcugguuucaaaaauacgauuugcauuaaccuuaauggaauugaaugugcauccuguuccuuuuuuuuuuuuuuuuuuuuuugcccuaaagguaaaaguaaguguuacuuguuuugacugguagaucuucuguaacagauuauggaguaaauauuuccuaaugguaugugccagaugaaaguucauauugcugcugcuaaucagaaacugaaguucaccucauaaaaagcuuguaugaauccaguuuugaaacuugcuaauuucaggucaguguuuuuggcuuacuuuuuugcugaggugaaucugcuauuaccuaaauugucuucagacuuuagccuguagaggaagcuguacuuaauuaagcagcuggaauuugggugauucuguaaauuugcauuguggucaacaaacaugauuuaccaucugucuagcccauucuacguggguggaagccaccaaggccauugggcaucugucacuguggagggacuggacccuuugacuuugauuugucaagacaagcaugugcaaccaacucauuauucugauaaaugcuaauuaaaaggagaaaaguaaggaaauaagcaaauuuccugcuuuuccaguagaaacuguuuuucaugguaaccaaauagcccuaauggaugagagaaaaaucuccacuuugcagacugugaucaauucggugacucaaccaguggccaacaguggaggaugaaaccauuuguuggaagguugcugaggaaccgcauuugggagaaucaggccuuccgcacccaaaucucauugaucagccuuagugucauggaaauggagacaggucaucacgucuccugaugugcugcagcaagaaccgcacaacacaucuaauauuaauaauauucuacuucucccucuuuaaaaaaaaaaacaaacccugaaauaaucuaaucaagcuucuaaaaugaauccagucuacaggaaaugugggguguagugacgcaaguuaugcaauaccacgagaaggcaaccagacaaauucacaauguggcauauccuguaauaaguugaccugauuuguucaacaagucaguagcauuaaaagaaauuacacagaauguacuguucuagauuaaaagaguuaagcaauauaacaaccaaauaaaauuaccuuuuugggguugagguucaaaccaaauguaaaacauaauuuuuaaaagauaaguugggaagcuugaacacauacugagucuugguugauugggauuuacuucaaaaaaagaaaaaagauggggaaggauagaugguaaaagcauggcaaaauguuaauggaauugaaacuuuuaauuuuuuuguagagacaggaucuugcuguguugcccaggcugugagcccaggucucaaacuccugggcucaagugauccucccaccucagccucccacaacacggggauuauaggcuugaaccacugugccuggccauaggauugaaguguuuugauggguacaugggggcuuguuauguucugcuuuuguguacguuuggaccuuuuccaaguuugcaaaaagugagagagaaauucaggaauguauuaaagacguaauauaucagaguacccaauaaauaacuccauuucauggagggcuuuucgcaugugaaguggucuucuaacagaaaggggagcauuauugaguaguuagaaaacccaagguguagggaugaagagaaaagcagguguucuucaaaaaaaaugaagagaguaaaagugaaucaaaggagaaaaugggaacagagaaaagaccgucucugaaagugggaggccagcagcaggugggagucaaggaaagaaugaaauguugcuaauuuuggggacuagugauugaauggcaauguugcugucuuuuuagagaguaggauuuaaaauuuugaguugcugaaaaggcuugcgugaugugcuagaaaaauuagguuuggugggcagauuagaaggaaacaaauaggagaguucauggaauauaauuucagauagaacuggcuuuccugaauuaauuuuuugguucuagucagcuuaggagaucucacaggauuggauaauggccuguucuggcagccucccuccucuuuacaaaccaggaaccugagcacccauaaaacagcauuugccugaaguccuucugaggccagcccauguauggguuauguguccuaugugucugcugccuccccacugccucgggccagugcagucuagugcagaggggcuuguuggcagaggccaucccccugugagaacaggcugucuugccccucugcuaauggugaaauguccagagccaggaaaucagaaauagcgugauguagaggcaccccugagcacccuugcucgcacuagggccccuccugaguaggcccagccaccuggccugccuuccucuucucccagcugagccacccacccuccucgauaaauacacaugagcuagcugcaagcauugcacagaugacaaggacaauaaaagcacuccaggacugguaggccagauaaauaaauagacuggcacuaggugugaugagugcugugaugcagauggaaaauagccugaagucuguugauucggcaaaacuuucaacugcuccucuccccgcacccagcucacugugccagggccagcccucauaccagaaccuccuaccuaacugagagcgcaucugagcaggggcagggcagagagcccaguaggcccuggggagagugaggagauacugguaguugccucugaauauccaaucucuuuuuucuuuuuuccuuucuucuuucuuucuuuaccuucuuucugcccccgcccccccgcaagacaggguuucacuuuguugcccaggguggagugcaguggaacaaucacaguucacugcagccugaacuccugggcucaagcaauccuccugucucagcuucccaacuaucugggucuacaggugcaugccaccacacccagcuaaacuguauuuuuuuguagaguugggguuccauuacauugcccaagcugccauuuuuucuuaguaacaaacucucauuuuguuuuccauacuguaccuggaauaaggacuacaccucuuaguuccuuaaagcugggaguggucacuugaauaagaucugguucaugacgguguaacuagaaguacugcaugagauuagugggauaucuccuuaaggggaaauuggugcucccuccuccuccaauuuucuaccgucuccagugcgugcagaaugacugauggccauuuaaccauuuauaaucgugaagucaccuagaaauaggagccucgcaugagugugccgagcagaaagcuaggaagugggcuccuugugaugcccuggcgucuccauuccaacccugguccaucugcucuggauuuguuuuaccuuagaaaaaaauaaacauaauuuuuuuuucuuuuccccccucugagauguaguuucgcucuuguuguccaggcuggaguacaguggugcgaucucggcucacugcaaccucugccuccuggguuuaggcgacucuccugccucagccucccaaguaggugggauuacaggcgugugccaccacacccagcuaauuuuugcauuuuuaguagagaugggguuucaccauguuggucaggcuggucucaaacuccugaccucaggugaucccccugcccuggccucccaaagugcugggauuacaggcaugagccaccacacccggcaacauaguucuuauuuaagccacuguauugguuuuggguuugauuuuuuuuuaauuaaaaauuauuauuauuauuuuuauuuuuacuguagagauggagucucacuguguugcccaggcuggucucaaacuccugggcuuaagcgauccuccugucugggccuccuaaagugcugggauuacaggugugagccaccaugccuggccuguuucuguuuuuguuuuuguuuuguuauauguagauaaaccugauucuaauuaaguggaagcaggaagacuaguuaaggggcuauuagagcagucuaaaugagggaugauaguaguuuggaauagaaggguagcagacgugacuagaaguaguuauguguauuuuuacugugguaaaauauauguaacauaaauuuugccauuuuaaccauuguuaaguguucaguaguauuaaguacacuuacauuguugugcaagcaucaccaucauccaucucuagaacuuucuuaucuucccaaacugaaacucuguaccugcucaacaauaacuccugguugcccucuccucccagcuccuggcaacgaacauucuuucuaccucuauaaauuugacuacucuaggaaccucguauaaauggaaucauagaauauuuguccuuuugugacaaguguguuucacuuagcauaaugucuuuaaggcucauucauguuguagcucgcaucagaauuuccuucuuuuuaaaggcuguggccgggcgcgguggcucaugccuguaaucccagcacuuugggaggcugagguggguggaucaccugaggucacgaguuugagaccagccuggccaacauggugaaaccccaucuguaguaaaaauacaaaaauuagcugggcaugauggugaaugccuguagucccaguuacucaggaggcugaggcaggagaaucgcuugaaccugggaggcugagguugcagugagccaagaucgugccauugcacuccagccugagcaacaaaagugaaacuccgucucagaaaaauaaaaauaaaaauaauaaauaaauaaaggcugauaaauauuuuagcaguuguauuuugcaugguuuaugacaugcgcaccugggucacucacucccugguagugcuauuuacugagauggggaguaguggggaagaguaaguucagauaauaggucugugaugccuauuagauaucccaugggugauuucuacaggauaguugcauacacaaaucuggaguugaggguugagguccagaacuuggagacccucagucaguagacagauguaaagcuagagaacugaaggaggucaucaaggaagagcguagcuggagaaugaguaaacccuggggcacucccacauuuacagucagaagaugaauaggaagccgcccaggagucugaaacuggaacagcuggagagcuaggaaggaaaugaagcaagggugaugcugcugaggggaggugaggccuccucuccaccccauuccaagauuugccaugguuacaccacuuggaacacugugcagauacagccggcugggagugucccugucagauggggauauugggaucccugucucagugcggcaacaugggaggcaucuagugcgacagagcggccucacccaagugaugugucaugaugaggauaauguucauggagacugauuuccauuugccaguucccuguuugucuuuguaaucaguuuaucaauaguauucuugauggaagugacaaauuuuaacaaaaaguacacucaugugaacaaaaagaauuuucugaccucugaugggcucuugaggccauauaucaggauaacuuaaauauguuuuuaucucugcccacaauguaaacuuguuuauggagaaaacuugcauuuuguuuuuauuuauuuuuugaaacggagucucgcucuuucucccaggcuggagugcagugaugugaucuuggcucacugcaaccucugccucccagguucaagcaauucuccugccucagccucccgaguaguuggaaucacaggcaugcaccaccacgcccggcugauuuuuguauuuuuuguagagacaggguuucaccauguugacuaggcuggucuugaacuccugaccucaagugauccacccgccucaaccucccaaagugcugggauuacaggcaugagccaccgugcccggccaaaacuugcauuuugaaugggaaaaauuacucaagaguaauuaacguggacucaguuaucuugaguggccuuucauuuuuucccuggaugauauuuuguaauuauuauuauuagguaugcuaagguuuauagcaguguagcugcuauaaauauaaauauagaaauguaaaacuuccuguguguauugauaugguaacagauuuuuaauauauuuuggaaagcaaacuauaaacacacaaucuacuuuuugcaaaaaaaaaucuauagguacaaauaugggcuguuuaguaaucguacaaucaaugguuauaccuauuuaggaauauuuagaacuauuuguauguuuguauagcuaaucuuuuccccccugauuuauugauggugaguauuacugauacaaaaaguuuugugcaccacagugcuuugcccaugaaauaugagcucagaaacugccugugcuguuauuuucaccagcagugaagcagcgugucugggggcagaauguacucuugucugaauuauuagcauuugguguugguucugccacccuugggccugagcuugcuuucucccucguuuguucuaaacauagcauggcaccuuuuguauccuguagguuauugcugacugcaaggagacuuuguuguucuuuaguuaguuuuuuacauauuaguuucaguaagccuguuucuuacauuuuucuacuguagcauaaucuuuguaaguacuuucuauagcccaggcauggucugcugcauucucugugucucuggggaugcauuuaggucuuugugucacauucugguguguagcucauuauguaaugacucgaaugaucaucagaacaaaagauaccucauuaagaacaagguugaggacacuaggaaccuaauguaacauuuaagguauaaaugaguauugaagagaaagaaaugauugaaugcuuuggaauuucuaauacaagcacccaucuuguaccuacuuacacuggacuuuuaaagugaucggaaauaaaugguuguaugagaguuuuacuuguuccucauucuaaagggauaugaaaaagaugaacuugaguucaugaaguugagcagaacaaugaacuuagugauaaauuauuuguauugaugugaaaaucacaccauguuuugggaaaugggguggacuugggcacuccauaguuccaaccacaugcagguauuauaggcugagucaggccugagccuagaagaggaauaacugcaacuaaacuuugaaauauuccaggaaagcagaguugacauguagguugaucugcaacaacuacagugguauagaaaggguggucuuggcugggcgcaguggcucacgccuguaaucccagcacuuugggaggccaaggcggguggaucaugagaucaggagaucaagaccauccuggcuaacacggugaaacccugucucuacuaaaaauacaaaaaauuagccuggcgugguggugggugccuguagucccagcuacuugggaggcugaggcaggagaauggcaugaacccgcgaggcaaagcuugcagugagccaagauugugccacugcacuccagccugggcaacagagcaagacucugucucaaaaaaaaaaaaaaaaaaaaaaggguaguuuuuuggugcuccaaaugggaaggccuuaaauuaaaaucuguuuuacaaucugaauaaaauauaaauaucaucaaaaagaaaagguauucugguuauguacaugaauacaacauccuuagcagcagauguugugugugugcaagggaauaggaagguaaagaugcacccuucuccuccaccaucaaggguugcuagaaaacaggcucucauucaguagaccccgauagcugucuguaauccauagcuccuucucugauuaguauuuauccacuauuguggcuucauucuggaucuugucauagguagaaagaguagccuggugguuagcaacacaguuuucggagucaaacagaccuggugucagaucccuacuuauuaccugcuugacauugagcaaguuucuuuaucucuguaaacuucaguguuaucauccguaaaaugggugaauugcucacaccccacagggaugguucaccaaacauaaggugcuugguauuuaaacacucaauaaaugguagcuguugauagagcuucacuggcauuuuaaacuuaaaaaccugccuuuggccacucugcucauccacuccccagcuucccccauguguucugcaauuugacugaaccacacaguccaggaaacuuucuccaugugaaggagaaaauagcuuuccacagcccuggggucacacucucccaaacuuaugucaggaagacgcccaaagacuggcucauuccugggucaaggagaguggggucuguuucaggagaggagcugagcuaagaccugagauccucggaggggaaaggugggcagaggcaggcuggagguugagcucuguacucucucaagagaagguggugguuaugcaucuguuacucuggguaaauuuuuagagcagauaucugaugaaacagcuguuuccaagguccagcguuaaccauugguuugauuggcuuugaauaaguuauuuacaacacagauauuuuguuacaaucauaauuuguaugacugaguuggucuccaggcauccuggguaggagagggagguguacaguagcugagcuguuguccucauuccuuauuuauaggaaagaagcuuagguuaaaugacucauccaaggucaaacacauccuaagugguggagacaacacagacaaugccuuuuaaacugaccugugucucuucccccacuccuuccuacagcaggguucugcccuccuuacugccaccccacagcaagagggcuuccuccaccucauucuccccaggggugauggccuugucagagagcauccuguucuugaucugggggcccuccuucaggccuucagccauuccucagaacuuugccccuuaguaggggaggggacaggguagcucucccuuugcccucggucauuuccuugaggagccuuuuccuucccauccgucuguguuccuuucccagcagcacccggccuugcauaucuguucauugccuguugucuuccccauuagaaugucgcccuggcgagagcagggacuugcucauucucuuuccaguaguguucccagcucuuugugcuuggugcauaucaggcauccccaucuuauauauuuauugagagaaugaaugacuaaguuguguccaucagagcugugagagugugaacccagagcuaauggagcauggcgucuucccuuuuuccuccuccuccagcuucccauagcugccaaggugcugaggaaggagugggaggaauaguuugugucccugaggagccggcucacucccccucccugugucugcaguggguggggagauugaggaaacccucagccuacaccaguuaagguggaguuccugucacaugcaagccgaugccaguuuagagucugcugaaggcaguggggcacacaggugaagggcauggacacuugagucaggugacugguccaccacaugcagauugugucccguugacaaaauuuuguagccuuucuaugccuugaucuuguugucuaugaagggaggaugaccucauagggugguuccugggauugaaugcgcuagcccaugugacucuccagcauuggucagguacaggcugugugcuccacuaaagcugucugugugcucuacaggacuaaauagcugcugcuuauucuacuccuggcaccugucuaacuggccuaggugcgcugccuucgugucccucacccugcccagucuagcacagagcacugggggaagggcucugaaggaggugugaguggaagcccaggaguuuggggggcuucagccugugaugucgguuguuguucccucuggagggcaagugcuuuggugugagauuugugugcgguuuuuuguuugcuuuaguuugguccuggugauuuccacagggugaggagggauucggagauaauaagugucuugcugggaacuggcuugccccugcuucuccaagaagaaacagcucugacucuugggaacugagagggcguguggcaaagguagaugcugaggcgaggcaaggcgagagguccacaugcgugccacaaggcagagaguccacgugugcaccugaggggagaggaagguugagucuuacugugugcugcucaagggacaggacagugcaugggcacugugcuggauuuugguuccuuguaaaaagcaauggcuauaguucccugaccuucaccacuugcgugaggcagugggcugagggccggcugugaguaggcucucucagguccacuccugcucagcugggugaauugcaaacucaauaaaguaaguuguugugaauaaguaaucugcauaagccaaagaaauauaaaauaucuuccacaaaaaauuauuagggagcaggauaaaagagcugcaaaagguuuuuguugguauuauugccaaaucugaugugggcaaaacaacuaugagaaauuaggaaaaaaugucaauaaucuggaagguuuguggucaaguugcuuuguaaguggccaguuuuugcccuguguuaaagaggaaauaaggccgggcaugggagcucaugccuguaaucccagcccuuugggaggccgaggcagguggaucaccugaggucaggaauucaagaccagccuggccaacauggugaaaccccgucuccacuaaaaauacaaaaauuagccgggugugauagugcaccgaggucagagaaucgcuuaaacccaggauguggagguugcagugagccgagaucacgccacugcacuccagccugggugacagagcgagacuccauuucaaaaaaaaaagauaaauaagaaaugauagagaacacauuguaacugugguuuaugcaagaaaguaacagggaggagcagcaaaggagcugucagaacagccuuagcccauaccagaaggcugccagagaaaugcacaaucauaucugaaaauguuuguggcacauaguauauauuuaguauacaucuuauuauaauuacauauucauguguauaguauuuuuuaaguuaauuuccuacuuggacuauuagcaaccaaucacugauauauaucagguuaauggguuucuacuguacucaugaguggagcuguccauuauauuuucuugacuccuggaagacuggucugucagcuuuguuuccuaagacuggaaugaugacauacaacuauguuaauaacuauguuaacacuccuacuaaaauaaccgguauauuuggauuccauuuucaacggaaugucuuauggucaaacuggccuucuuucagauuuuuaguugcaugguuuuuccuuuaccuucugaauacuguauggacguaauugcuguuguggauggcugugguucagcaggagcucaaagacaccagaaguggugugaguccagauauaggggguggagacaggauuggggguuacuuggugggaaaugggaagaauuauuucaaccuugggccuuguuauuugauggaaauguuuugacuuccaggcaucagucaccgagguccaaacacaaaaacaaaggcagauccuucugaagcaugguggccuuuuaacuuuguaugauuuuggauuuccaguuaacuauugcuucuauucaaguuggucauugaaaauuuacugcgcgaauccaacagcaacccacaaccuaaacaucccuggcugucuuguuuucacagguguuggggcgauguuuccugacuguggugcaaguccauuuccaguuuuugacucaugcguuacagaagguccagccgguggcucacucuugcuuugcugaggucaucgugccagaaaaaaagaacagcggcaguggcggcggcuuaucuggcaugggccacacaccugaaguagaggaagcugugcgguccuggcggggggcugcugagguaacccuggcuuuggggagauuggugccuguguucaaauaggagaggcuccagagggccuuugccuguugauucucaaaacagccauuucauuuagaaauguacauuuuaaacuguuaucauuggcuuguucauucauuuaacagugaacaucuuugugaaugcccacuuugugccaggcaugugccaggcacuaggaugacaaccucuacucacagccuccugggagaauaggcuuacaaaaacagggcuaaggggccaggauggagauaugcgggagccagaggaagggagggcccugucucugaacgguagugcugcaggaaagcuucuaagaugggggaccagugagaagaggcuggcacccaagucaggaaagacgggguggagcugucuggggaggguaaguggccagccaggcagcgaggcaggcgagcaggaguguuuggcagacggaugggaugacaggcuccaaagauacaaccacagcagggcgagagcucaguggacacagggaauuuuguguuuuuuguuagucaaaucauucccuauagaagugcuuggaaucuuuguaacuuuuuaaauucuuuaaguuuuucuuuuucuuuuucuuuuuuuuuuuugagacagggucuugcucuguugcccaggcugaagugcagugcugcgaucaagucucacuacagccuguaccuccgggcucaagagauacucccaccucagccucuuccaaguagcugggacuacaggcucaugccaccaugucuagcuuauuauuauuauuauuacuuuuuuuuuuuuuuuuuugguagagaugaagucucacuauguuguccagguuggucuugagcuacugggcucaagcgauccacccaccucugccucccaaagugcugggauuacaggcauuagccacugcacccagacaagauucuuuuuuuuuuuuuuuuuuuuuuuugagacggagucucgcucugucccccaagcuggagugcaguggcgugaucucagcucacugcaagcucugccucccagguucacgccauucuccugccucggccucccgaguagcugggacuacaggcgcccgccaccaagcccggcuaauuuuuuuuuuuuuuuuuuuuuuuuuuguauuuuuaguagagacaggguuucaucguguuagccaggguggucucaaucucuugaccucgugaucugccugccuuggccucccaaagugcugggauuacagauuuggacaagauucuuaauuggucuaacucugccuagauccucauuugucagugcuuuacaugugauuucagcaguucuccaguaugcuuuaugugacuucaugaaguuuuuuuuuuugagacggggucucacucugucgcccaggcuggagugcaguggcacgaucuuggcucacugcaaccuccgccugccggguucaaacaauucucugccucagccucccaaguagcugggauuacaggcgcccgccaccaugcccggcuaauuuuuguauuuuagccccagcuaauuuuuguauuuuuaguagaggcaggguuucaccgucuuggccaggcuggucuugaacuccugaccuugugauccacccaccuuggccucugaaagugcugggauuacaggcgugagccacugcacugggccaacaugaagucuuuuaucccuuggaagaucagcuauuucccagcacagcagauauguuuauaaaaucuagccaucaugcaagagcuagacugagugguuggcucccuaguggauagagagcgcaguggugugggaugguauggcauggucaucagggauaaugugaaggagaauugugggauucuccucucguggugacaaccucaugacuaaauggugggcugcagggagccgcuccgguggggggauucuagccuagcgcaggguugcuuuccuagucacucugguguggcauucucuauuccuuuuccacagccagaagaauuuaagcuuaaauaaaaggcaaucaaaaacagcucugaaaaagucuguuuuaaggagacuuugccuauaaucagugacauuucuuuugggagacagaguuucgcucuuguugcccaggauggaguauaauggcgugaucuuggcuuacugcaaccucugccucccagauucaagccauucuccugccucagccucccgaguagcugggauuacaggcgcgcaccacgacgccuggcuaauuuuuguauuuuuaguagagauaagguuucaccauguuggccugacuggucuugaacuccugaccucaggugauccaccugccuuguccuuccaaaaugcugggauuacaggugugagccaccaugccuggccauuagugacauuucuuguaggcauuuuaauacuuauuucuuuccaguaugagaaauaaaaaauaaaucuuagaaguugagacuuuaggacuuacugcuccauuuuacagaguaaaagauaauuuucuuuuuuuugagacggagucuugcuccuucgcccaggcuggagugcaguggcgcaaucucggcucacuguacccucugccucccggguucaagcaauucuccugccucagccuccucaguagcugggauuauaggcacccgccaccacgcccagcuaauuuuuguauuuuuaguagagaugggguuucgccauguuggccaggauggucucaaacuccugaccucaggugaucuaccugacucggccucccaaagugcugggauuacaggugugagucacccaccugggccaaaagauaauuuuuuuaaacuaucccagcaggcaaacacagauuaaaagauaauuuaugguuagcaauauagugauucauuaaauaaugucuaguucaaaucauuccauaauuaacuuggcaaaguauuucuuuucuuuuuuuuuuuuuuuuuuuuuuuuuuugagguggagucucgcuguugcccaggcuggagugcaguggugcgauguuggcucacugcaggcuccgccccccgggguucacgccauucuccugccucagccucccgcguagcugggacuacaggugccugccaucucaccuggcuaauuuuuuguauuuuuaguagagacaggguuucacuguguuagccaggauggucucgaucuccugaccccguggucugcccgccucagccucccaaagugcugggauuacaggcgugagccacggcgcccggccuaguauuucauuuuauguuuuggaaauuuucuuuaauaaaauuuucaaaacaugauuuuucacauguuaauauuguccagucucuaguuuuauuauuucaauuucaugccauuugcugcauuguugucauuucuuuuuaauuuucacuguuuucuugcauguuuuggucugucuuucaugcuaaagacuuccuagggcuuucuuucuguucaucagaaaggcccuggaaugcuaauuggaggcugugugugggggugggaccuguuagcuuuauuguagauggcuaagcccugagguccagaccugcaccuuguugccuugucaugugacuuuacaacccucgguguccuccuggcugcugggccccagccuccugacuguucagcucacacacgugaaccuaacaccugccuugguccccugcuccaucuucuagacaacucaugcugaggaccagcccacaggaggaggccuccgaguucucucuugacgucuucaccuugaccuuuuuugccaccauuuuagucuguccaggccuuucugcccuuucuacauucccuuugcuuucagccagugaugccacccccuacuacacugagcaaauagaaucucccugauggcagcccuucuuccucauguggccaagccaccaccacuccugccaucccucuucacaaccaucuuuucuuccuuccccugccucaugacagcagaggaggugcccucuccuccuguccaggcuugccccgugcuggccuugcccccauccucgagggcccagcuucuguggugcgaccuaguguuuucucucccucauccucagccuguucccaccaguacacaaagaugcuucccacagaaaaguccacucugcccugcccuguuucucugcucuuuucucagccaacuucuuggaguaguugucuaccuuuuuuucaccuuucauucauucuaaaaaauuacuauuuuauuuuuacugcaccuuguggcuccuuacugcuccuggcacaccccguggacaguuuacucagaguagucuaaaaaguaauuauuauugaaguauuucaggcacauagaacauuucacacccaucaguguaucuuccuuuuagcugccugccauauuugcucaugccuguuacauauuuuuaacagaaaaauaucaccagugcacuuuuuuuuuuuuuuuuuugagacugggucuugcucuguugcccaggcuggagugcgguagugaucacagcuuacugcaaucuugaccuccucggcucaagcaauccuccugaguagcucagacuauaggcaugcaccaccaugcuuggcuaauuauuuauuuuauuuuacuuuuuauuuauuuuuuuaaagacagggucuugcuauguucccaggccggucccaagcuccuaggcuccugcacccggucuguaaaugcacuugaaucccuuuuguaccucuccacuuucuuauucaucccuuugucucuagagauaaccucuguugaauuugaagcgugugauccuugugcauauuuuaauauuuuuuccguauaugaauguaucuauacauaagguauuauuuuacacagucugaaacuuuauauacauaaugucauucagcuugcugaaaucuggcuuccacuccuauacaagaacaugccuucucuuaucaaggucauuggugccuucuuccauguuuucaaauccagggaacccuuucaacaacuuucagcagcucacagcaguguggagaauauuccuccuuggaaauacucucagcuugugacauccaagaaccaaccuuucuuuccucuugggucauccuuucuucaucuaguuuacuggcuucuccuuccucaacacaauuucugaaugugaguuucuccaggcucaguucuagcugcccuucucccuagggguucuccauccagucuugggacugaaaaaccaccuguguccuuggagggggcucaaaugugugugaucagugagcagcccacuuccugugggcuucaggccccugagcucagcugcuaccgggggucucacagguggcucaggcguagccucucuccacucaccuguuccucccuagacccucucuaugcuagugaguggugccaucccacacuggcuucacuugagaaaccugagauuuauccuucagcauuuccgucaugucuacacccaguccaauccuuaagaaaacccggcaguucccaccuccaaaaucuuaucccagaucuguccccuucuuccacguccuucaucgcuacccuuguucagggaaucguuacuucuccccucccugucuugcucgccuucauuuuaaaauuggaugaugucgcuucucauuuccuuaggguagcauguggaccccucagcacgaccugccuagaccugccuagucuggcuccugccuugauggccagccuuaucaguggccacccugcccucgcucacugggcucuaguuccuuggaugugucuuucuuuguuaccuuggauccucggccuguuucacggacccgucuguaggucuugacaccccccaccccaccccacacacaugcaauuccauucacgaccuucuccucuaauucucacccuaagugcugcuuucugggugucuaggacauucccugguauaguccucuguuuguuucccgcaguguuuuuucuccauuuauaauucuguguuuucuuuguucaccuuuuuggcccugaggcucucagcuccaggaagguaaggagcagcuuugugcuucagcacguaccuaacauaccaccuugugagcuaaauauuugacugaaagauucuuagaaagagucaaacaguuuuaaacugugagacucuuaggcuucaggcaaugguguuuacauacaguuugugaaaccaaagcuuuggaacuuuacggcauuauagcugcuagucauuuuccuguagucugcaaguuuuguaaauauuacaacuccuacacuggcccagcagaacaaaagcuaacugcuaaaaaauguuacuugguucacagaauugcaacaaaaauagaaaucuaaaaacaguucaucuggaaucccaucuaauaaaucaaauauauauuuuucuguauucucuucuuguccugauccauguaucuguuuucugcauuuaaucguaaaaugacagagauuaguuucuccuuuucuaucuugcuuaucuacucuucauaaacauauguagugacugaauaauaaauauuuacuuuucugugcagauuucaaaagcucuguuuuucuguuaauaugccaauguauauuuuuccuguuauguauucauguggucuuuuccuucacugaauaggaaugccaaccauguauguucuuccuuuuuuuuuuuauucuggaaacuccaaguaccaauauucuagguaaccugucuuuuuaaagcaggaaaguuaaaaaugucugaguauauacacacauauauauguguguauauacauauauauauaacaaauaacaaguagguaagucuuuuuuccaggguuccuaaaauaaagggagauuucggccgggcucgguggcucaagccaguaaucccagcacuucgggaggccgagguggguggaucaccugaggucaggaguucgaggccagccugaccaacaucaugaaaccuugucucuacuaaaaauacaaaacucaaccaggcgcaguggugggugccuguaaucccagcuacucgggaggcugaggcaggagaaucgcuugaacucgggaggcggagguugcaaugagcugagauagcgccacuacacuccagccagggugacagaguaagaccuugucucaaaauaaaauaaaauaaaauaaaauaaaauaauaaaauaaaaaauaaagggaaauuuccuuucucuucaggaugguuaauuaggcuuucaaaauuugggcugcucacuuugcaauacaaacaaucuagaacuucuaguuuauuugcuuagaugguuuauugcugcauuuuacuugaggggguuuuucuuguuguuguuauuguuggucuaauguugcuagaacuguaccacccucuuuuaccuaccaguuacuauauauguuacaggcgacaucuagacuaagagaaagaggcugugaugguugccuggcaggaauugaaguucaacaacucuuuuguucucaaagugcagcaauuccugagcaccagcuaaaagaacugaacauaaaaaucgacagugcuuugcaaguaaguuuuucagaacugacauacugauuuccacgggauagaaacaagggagggaguuaaaguugugauguugaaucaauuagaaaggguuauagaguaguaauugaccuuuuaauagcuauagaaauuuaagauuucuauuuccauugaacuuugucaucuuauaauuugcuuuacgaucuugauuguuaaaaauaauuuauuuccaggcauauaagauagcucuggaaagcuuaggacacugugaauaugcaaugaaagccggcuuccaccugaauccaaaggcgauugaagcaaguuugcagguacacuuuuccuuccuaaagcucuggggaccuauggcgcugcuccugcagucuagugugaaccaaguguuuugacagaugagcgaugggucaccucuccucuuccauccaugccuuuuccagggcugcugcagcgaggcggaagcccagcagacggggcggaggcagacacccccgcagcccaugcagugugagcuccccaccgucccugugcagauaggaucgcacuuccugaagggcgucuccuuuaaugagucggccgccgacaaucugaaacuuaagacgguagcuuuccaugggguuccagcaaaugagugugaacuugaaaauagaguucuuaagagaaauguaaaggcuugcgaaggauguagauuaaaaaaaaaauggggccgggcgugguggcucacgccuguaauccuagcacuuugggaggcgggcggaucaccugaggucaggaguuugagaccagccugaucaacauggugaaacccuguuucugcuaaaaauaaaaaaucagccggguacgguggcacgcaccuguagucccagcuguucgggaagcugaggcuggagaauugcuugaacccaugagguggagauggcagugagcugagauugcgccauugcacuccaaccugggcgacaagcaaaacucugucuuaaaaaaaaaaaaaaaaaauuaaaaagcagaccuacggagacuuuaaucagacauuugccaagcaaguuuucguuuuguuuuguuuuguuuuuuugagacggaguuuuacucucucguccaggcuagaguacaguggugugaucuaucucagcucacugcaaccuucaccuccuggguucaagcaauccuccugccucacccucccaaguagcugggacuacaagcaugugccaccaagccuggcuaauuuuuguauuuuuaguagagacgggguuuuacuguguuggccaggauggugucgaacuccugaccucagcugauccacccuacuuggccuccaaaaguccugggauuacaggcaugagccaccgaccugggccuaggcaguuuuauucauaauuuuauucagauguuuaacagaaaggguuugaaaguacacuauaagauauuguuuaugauuaaugucucucaguggacuuguaugaauuaaauaagaagagagauguuguuauaaugcugcagugauaacgauuauuuguggaacaucauguguuccagucauugugccaggugcuccacaucauugucucacuuaaugcucacccaugagguaggggugcugcccuuuggcccaccugccacaugggaacugauacccaaggucacacagcuagaaaguagaagagcuggaauuugagcuuauguaaucuguuuccagagccugaacaccugacuacuuggucauccaaaauaaaauugagauuuuaauuaguauuuacuuguaucagaugauuuuguuucccuauuuggagggauucagaauuucagaauuccucaaccaguucacaucaguagauugcuaaauaauuuugugcuaguauagaaauaccuguguauauuaucgcauauguauccauaucuagucauuuacucuauggggcugagaaaaucucugagagugauugaugauaauuacuaaggaaauuaaaauggcauaauuaggguguauuuaaaaugcucuucuugagccaggcgugguggcucaugccuguaaucccagcacuuugggaggccgaggugggcagaucaccugaggucaggaguucaagaccagccugggcaacauggcaaaacugcaucuguacuaaaaauacaaaaauuagcuggguauaguggcaggcaccuauaauccuagcuacucaggaggcugaggcagaagaauugcuugaacccaggagguggagguugcagugagcugagauugugccagugcacuccagccuaggcaaacagagcaaggcuccaucucaaaaaagaaaaaaaaaaaaugcucuuuucccaggaguucaagacuagccugggcaacauagcaagacuccacgucuacaaaaaauuuaaaaauuagcugagugugguggugugcaccuaccuguguggucccagcuacuggggaggcuugaagcaggagaaucacauaagccugaggggucuaggcugcagugagccauguucgugccaccggacugcagcuuggacgauagaaaaauacauaaauaaaaugcucuucucuugaggaugauuguauaaaugcauuuuuacaaauuuuagaaccuugcauggcuuugucuugaggugugaacucucuucuuaucaaucuauagcauacaauguuacagcugaugaaggaggcaggcugcuauaauggaaucacauccagggaugauuuuccugugacugaagugcugaaccagguuugcccuuccacauggcgaggugccugcaagacggcggugcagcugcuguuuggccaggcuggacuggugagugagcgugggugguggaugauagguagaauaccaagauguuucaagcaugugaggauguggugcagacacaugugugaaaauauugaauaauuuaaaaaguuauuuggugcuguggaauuuagaccaggcagguagacaagguaaaggaagagcagcauuuaaaaaucucuuuaaaaagaaaaaccagauugauaauauauauuugcagggaaccuaguugcaaaaugaugcuaugggcuuugcuuauuuuaagaaaaaaaccauuacagucugggccccauggcucaugccuguagucccagcacuuuggcaggaggauugcuuaagucuaggaguuugaaaucagccugggcaacauagugagacccugccucuuuuuuuuuuuuuuuuuuuuuugugugugugugugugacagacucuugcucugucgcccaggcugcagugcaguggcgcaaucucaacucgccgccuucugggcucaagugauucuccugccucagccucccaaguagcugagaugguaggcacccgccaccacaucuggcuaauuuuuuuuuuuuuuuugagauggagucucgcuguguugcacaggcuggagugcaguggcgugaucucagcucaccacaaccucugccucccggguucaaaugauucuccucccucggcuucccgaguagcugggacuacaggcacgcaccaccaugccuggcuaauuuuuguauuuuuuaguagagaugggguuucacuguguuggccaggcuggucucgaacuccugaccucgugaucugccugcuuaggcaucccaaagugcuggaauuacaggcaugagccaccacacccggcccuuaaaaaaaaaagaaaaaaacauuacauuaguaacaaguugacagggccacuugaucuagccccuauucuggagcuacauuggaugucuguugcucaaacaucccaugcuucuuccugucccaggccugugcucuugauaccccuuuuaucugaaaauacucuucucucugauuaucauguaggucacuccuuaucuucuugguguuagcuccaaaaucaccuccuccaagaggccucccuugaccacagugguauaaguaguacccccauccagucacuguauaccgcugcuguuuaucucuuucuuagcaauaaaguaacaucaacuaaaaaguaaugauuuguucauuucaucuuucagagaaaaaaaaaacuuugcccagaguugggugggucaggagaucaacaucugaaaucaccauuuagcuuuuuguuugcaucacugacccauagaaucuuacguauuugaucucccuuucuaguaaacgacuacuuuucaaaaacauaugguggcagggcgugguggcucacaccuguaaucccaacacuuugggaggccgaggcaggcagaucaccugaggucaggaguucaagaccagccuggccaauauggcgaaaccucgucucuaaaaauacaaaaauuauccaggcgugguggcgggcaccuguaaucccagcuacucgagaggcuuaagcacaagaaucacuugaacccaggagucagagguugcagugagccgagauugugccacugcacuccagccugggucauagaguaagauccagucuuuaaaaaaaaaaaaaaaggauauggcauuucagucagagguuggaaggaccuaauuagagauuaagaaaauuaaagaacuuguuuuuuagucugguuccuacuuuauucacaaaaagagcuauugaggguauacugucguuuuguuucaagcggguuagggcucagguggcccagcucacaguggggcugucuuguggaggcucagaugagggcuuguucacaguaaugagucacauuuccuuugggaucuuuuccucaguauagggaccuccaaaagaaguaguaaaccagagaugccuugcugaagcguggaagagcccauuggcuuuaguauaucgauccauauucccagagaccauuuagcugaaacugcaaggaccaugccaaugaguuccccugaaaggaguaugcaaaauaaggccaaaaggcacaaaggcuguuuugagaaaacacuguagauuaaaaaaaaaaaaaaguuccauguuauucagagagcagaaacuucuuccuaguuccuugcgucuugauuguaggacacauuucugugugacuuuagguuaugguucuggggaugggaggagagaggaaacaccugugugguccaacaauggcuauuccuuugacaggaaguuuuuuccaaaggucauugcagaucagcuaugggaacucuguuuaaaccagugaaagcuggcuccauuagaagcugaauuuggaguaugauacacaacucuguacaguuuuaccccuucugaaauauuacagauuugguuuuaaaauauuuuaugauuuuuuaaaacauucuuuuaguuauuugaaaauauauucaucacuuugucaaacucuagauuacauaggauacucuuaucaccuaucuaguauuaaagacucuuccuggaaauaagaggaaaucauucaaagaaggguuaguucuuccucuguccugaaguaauucaguuuuuauugaugguugaggauaagauaaucuuuaaaaaaguuucauccacuucugggcgugucaugacaaaugggcuuaucugaagcauugguuugacuuuuuuguuuguuuguuuguuugagauggagucuuggucuguugcucaggcuggagugcaguggcgcaaucucggcucacugcaaccucugccuccuggguucaagcuauucuccugccucagccuccugaguagcuuggacugcaggaucaccacacccagcuacuuuuuguauuuuuaguggagacgggguuucaccauguuggccaggguggucucaaacuccugaccucaagugaucacuugccuaaaucucccaaagugcugggauuacaggcgugagccacugcacccagucugguuugacuuucagugacacuuuuacuucuuuuaagugcauaaaguaaaaaauacuaagauaaaggacgcaaauuaauuccuaauuaacauauuuauaguuuggaaaaagugcuagaggugcuugccaguucaauuuaauuccaugcccagaaugugguuucuguuuauugaaauguucuuaguuuuggucaucuguuacuacuugcuguugucuucacggggcccugacuggccuuggcauaacuaggcugcuaggggaauaguucuuagagagucauuuuauguauuggauuuuauucugauuuguuuucucucugaaagcugguuguuauuuguuuuuuuuuuuuuuuuucgaucuuagguggugguugacacagcacagauugagaauaaagaagccuaugccccccagaucaguuuagaaggcucuagaaucgugguucaagucccauccacaugguaacgugccucuuacuuucaccggagccuaagcucugacugacguuugcacaucuuugaaaugauggccuuguuuugaacaaugcccaugcuagcugacgcaacaagucuugcugcaugugcagguuuaugggcagcagugguauguuaguggcaugugucaugauuauuggucugugaugaggaagccaagaggucugaaaaauggucucauugaccauaauguaacuaaaauguuauauacucuuggaucauaaugagcaguauuaucuuuguuacugagucuacagcauuuaaacauaguauaucauuuucucuaagucacccaguguucacuaaagcccaguagagaacauagaauuccuucuccucuguuccaacuacaauccugaugaucuugagcucauguugugacacacccagugucuuuacaaaucuugggacagucauuuuuagauauuauauuuguaacacuuauaauagauaaaagauuauucuuaauuuauuuuuuuuuaaaaaaagcuccuacaaaucagaagaaaaugggcaagggacaugaacagcuaagucagaaaagaagacauaugaucaacaaauagauuaagaaaauguaauggccaagugcggugacucacaccuguaauccuagcacuuugggaggccaaggcgggcagaucgccugaggucagaaguuugagaccagccugcccaauguggugaaaccccaucucuacuaaaaauacaaaaacuauccaggcaugguggugggugccuguaauuccagcuaaucaggaagcugaggcacaagaauugcuugaacccaggaggcggagguugcagagagcugagauugcacuauugcacuccagccugggcaauagagcaaaacuaucucaaaaaaaaaaaaaaagaaaaaagaaaauguauaacuucaccuaaaaaucagagacaaaguaaagaaaccauauggggccaggugggguggcucacaccuguaauuccagcacuuuggaaggccgaggcggccagaucuccugaggucaggaguuccagaccagccuggccaacauggugaaacccugucucuacuaaaaguacaaaaauuagccgggcgugguggcaugcaccuauaaucccagcuuaaggcaggagaaccgcuugagccugggagacagagguugcagugagccgagaucgugccacugcacuccagccugggugacagagcgagacuccgucuccaagaaaaaaaaaaaaaccguuaugaugucauuuugcccagaauauuguuaaauuguuuuagaauaacaauacuaaauauagugacaauacuaguuugagccagacugugaaacaggcaaagagguuguugaguagagacuaaauacaaccuuucuggagggcaauuuaguauauuagaagccuaaaauaagggauaugaccucaacaauuccacaguuucaccucuagaaauuuaucuuugugauauguauucacauucagcuauaaggaugaguaucauagcuuuauuaauaaacaggaaaaacuaagcauauauuggaagguauuugcuauuaaaaugguaaucugcaugaauauuuagcuauaagagaaaauauuuaaaucauuuaaguaggcagagauacuaaggaacaaagaggugcuguuggugccuauguggacuaaaaugguaguuggguaaggcauacaaguuguauuuaaaccauuuguucuuuuuuuucgagacagaaucucggucugucgcccaggcuggagugcaguggcgcaaucucggcucacugcagccucuuccgccuggguuccagugauucuccugccucagcuuccuggguagcugggauuacaggcgcaugccacuacgcccagcuaauuuuuguacuuuuaguagagacaggguuuugccauguuggccaggcuggucuugaacuccugaccucaggugauccaccugcuucggccucccaaagugcuagguuuacaggcgugagucaccgcgcccggcucauuuguucuugaaauguaagaguauaauaguagauucugucaaaaguguuuagagucuaugaauauauuuaaguaaauguuggcaguucacuuuguguccuaaaaccucccuucuauaaguacucugccaccaaaaaguucuuuuauuuuuuuaaauuauuauuauuauuuuuuuuuugguagagacaagaucucaugcugucccccagacugcagugcagugguguggucauggcuuacuguagccuugaacuccugggcucaagcaaucaucccacccuggccucccaaguaggcgggacuacaggcaugugccaucaugccuggcuaauuuuuaaguuuuuuguagagauggagucucacuauauuagccaggauggucugggacuccugggcucaagcgaucccccugccuuggccucccaaagugcugggauugcaggcgugagcuacuguaccuggcccaaaauuuuaaguuaauuguaggguggcauacuguguccugaaauuaaugguaauuuauacacauauuuucauuucuaucaaacaguaaaccagaggcucacuuucuguaagauuuuuguguuacuaaauucuuuuuuuuucuuuuguagucaguguucugcugaaauguguuccugaauuuuuuuuuuuuuuuuugagauaguuucguucuuguugcccacacuggagugcaaugguguugucucggcucacugcaaccuccaccuccuggguucaaaugauuuuccugccucagcuuccugaguagcugggauuacaggcaccugccugcaugcccagcuaauaacuuuuguguuuuuaguagagauggguuucacuauguuggccaggcuggucucaaacuccugaccucggguaauccacccaucuuggccucccaaagugcugggauuacaggcgugagccacugcacccaacccugaauucuuaaauuuuuccaauucaggcugucauuggaaaauguuaaaacuuaaucagaauucucauuuugaagaguuugaacuuuuggauaguugggugaauauaaacagucagugcaaaaauggcuaacacuugaguuuguuuugaaaacucucccugugggguugauuucauuuguaacucauugcacccccgcaaaaaacaccuuguagacugugauuucuuguagaggugcccucugcugggugcuuuugguaauuuugcaaaauuuuaguucuguuuuuuuuuuuuuuuuucaaauuacaaaauacuguaugugcuuguugggaagaacacaaacagaaaugauugcuuuacuccaccuggagaaaaaggauauugcuauccauccaugcuuuguuucaccaaauauuuacugaacacuuacuguguaccagacacuguucugggcucugggaauuuaauuaugagcaagacacacagggucccugccccucauaaaccaacuugagaauagagaagggggagacagcuguuaaguauaagagaugaguucagacacaggcaggcguaugauggaaaugagaggagagugccauuauaugauagagaauaaguaggauagagauucgggggagacuuuuagacgagucagucuggaagagggucugaggaugugacauuggauuugagaggagccugucaugcagagagccgauggggaacacacuucaggcagaaagaaugccagugcagaggccucaggagugacccagcauggaaggagaugugcuagguggugaugaggaugggaaguuguagacgucaagacuugcagggcccuugaaggaauuggguuuuuaucuaagaacagguagaggguuuuaggcaagucuuggugauuugucaacagaauggguuuagccacuuaagggcauuuuauugaucagcucaaggcugaugaauaaaauaaaaaugccaguuuguugauuguugauuuuucagaaagauuaauuaucaucaccaggagcuguaguacucuuuucuacauggccaacaaaugcucuccuagugggcaaacaugugacaagccaagucacaaccagacuuggcuugggaacaagagcaaauguguccugauuaucagugauuccagauggagagaauugggugcacugaaccuugggcaggcucagcugccaagauucucucugaggaguccaaggucuagcugggcacuagcagagcuugcguuguuguucacccuuuccaggcuucugagccuggccggcucucauuucauucucugauauauuucuucccaagucaaagucauguuagggaguacugcuaccuccuugagugacuuuguaaguguugaguucaccauuuagcuuccagagugcccaggaucuggcagacaucaucuuccuaguagaccuaugcugcucagacuguuuucccucucagaaaagggcucuuggccagaccaaguggcucacacccguaauccuagcacuuugggaggcugaggcaggaggaucaccugagcucaggaguuuaggaccagccugggcaacauagcgagaccccaucucuacaaaaaaauuaaaacauuagccaggugcgguggcacacgccuguaguuccagcuacuuaggaggcugacaugggaagaucgcuugagcccaggaggucgaggauaacagugagcuuugaucacaccacugcacuccagccuugaggauagaguaggacucugucucgaaaaaagguuggggggcucuugguguagguacccugaauggacgguggagacccaaaugaugagaagcaguuggccauaccaaaaucucaggaaagagaaauucgggcaaaggcagcagcaagagcaaagguccugagguguggacaaacccauccagggaggaagagaaggccucacagcugggacaagguugaggggcugggcacagagggcuuugagggcuguggugaggguuuagauuuuauuucaaucacgaugauaucccauugaagaguuuuaagcaggggagugaugugcucugauuggcacuacaggaagcucacucuggccccuauaugaaggaugggcuuuggagguacaggaguagagaaaaagaggccaggugagagcuugguccugagacccaggaguggugguuuccugaagcaggggguucauaaacaagguggcgagaagugcuuagauucuggauguguuuuauaagaagagcugucaggauucacugauggauugcaugcaagaugugagggaacuagagaggguguguaaguuuugggguagacaguuguguuguucacuuauuggagaagucggcaggaaucagagugucugagcuagcacagaccgcacagguuaagggcucagccccacaaggcuacuccccacuucagaugccauccacaagucccagguugucacccgacuucuaaccaaucggcuauaaguuggggguucccaaaaccuccagguuugauauuuugcuauaauggcucacagaacucaguaaaacauuuaauuauauuuaagguuuauuauaaaggauauuauagcagauacagauuaacagccaggugaagaggugcauagcgugaaguguuugggauggggcuccaagccuccaugcccuugccagcuaugcccugugcccagcaccuuaguguguucaccagcguggaagcucucagaacccgauggucugaugauuuuuauggaggcuucaucauauaagcaagucaucuuauuagaacaaaagacacuaucaccuaggaaaucucaaggguuuuaggagcucuguaucaggaacuggaggcagagaccaaauauauauucugauaucaugagaccucagaccuuuuugcuuccuacuccucuuguggggcagugaguuccaggaucagcccuguuguucucuccauguucuuacaguuacugaauuuuugcugggcgccagagguacauaaaaguuguagccuuuucuaugagaccugcuugagacaccuuugcagagaaaugcagccaagacuaaugcagccuaaucuaugccuaggugccugaaagaagacccugcuaccaugucccugcugcagagaagccuugauccugagaagacccugggucuaguggacgugcucuacacagcugugcuggaccuaaaccgcuggagggcuggaagguuggugucugugguuugcauuagaugcauaccgagggacagugugacuaugcacaguuucaugugugcuugugucauugauaguauacgguauuguaaagaaggcaguaaggacuuuuuaguaacuuuuauuuucagaauaauuuaaaaccugcagcaaaguggcaagaauaauacaaagaacugcuccaugcccuguaccagauuccccuauuugcuaacuuuuuugccuuccuuuauuuugucauuugagaggaaguccaucaagaggacuuuuaacucaacucauauucuccuuaugaauuaagaacagagaaauguuuagaaaauuugcuuaugucuuuuagaauuuuuuuucuuuuucaaucaguucucucagguugaacuugagaaauguguauacaucugguaguggccuuaaacaucuagccauggccccucucccuuuuucuuuucuuuucuuuucuuuucuuuucuuuucugucuuggucuuugucuuuggucuugucaucuugucuuuuuaggaucuggcucuguugcccagccaggcuggaguguagugguacaaucucagcucacugcaauauugcucuccauccaugcuauccaucccauccaucccccagcuccugggcucaagucauccuccuaccucagccuuccgaguagcugggauuacagguguacgcccagcuaauuuuuguauuuuucaugaagaugggguuucgcuguguuggccaggcugguaucaaacuccugaccucaagugccugccucggccucccaaagugcugggauuacaggcgugagccaccaugcccaaccuuuucucccuuucuuaacucaugaguacacaaaggccagaauagugaagugacuuuuccagggucacacagccuucaccugccucagcuccugccccaugcccuuucgcucuuuagggcuccauuuuaguaugggaaaaaugugcucaggaaacuuugaaagucacagccaucuguugggacaacguuggcacauaguaucccugcauccccccaccaccucccucugcuuuguggaguuguccauugucccucugcugcauuugcguggcuguagccccuguccuccaggcacaaaucuagcuucugcaaguugcauccccacaucuagccaugcuuuccccuccugugccaccauuagaggauuucacugaaucacacuccucaggccagaauccuagcagaacuuccaguccugcguuagacacuguagauuucauacucuccaaaccccuggguguucauuuauauauaaaauaagugaacccgauaccaaccugagagguuuuucuugcucucaacgccauucuuaaauacaaagagguccauuuuauuauuuuauauauuugucuuuuuuuuuuuuaaacaaauuucuguuuaaauagggagcaagcuuuacccugcauacagauccagcugcaaagggagaucugugauuuuggcaaccaggcugaccugccuucuggaaauggaaacaaaucuucagguggccugcagaagacauucuccaaacugacaucccgguucaccaagaaagcuucauguaccagcuccagcagcagcacaaauuauuccauccaaaauaccccuuccaaaaacaucuucauagcuggauguuccgaagagaaggccaaaaugccuggcaauauugauacaagguuacaaagcauuuugaacauugguaauuuccccaggacuacagacccuucacagucagcucagaauuccaguaauacaguggccaauggcuuucucauggagaggcgugagaacuuccugcauggagaugacggcaaggaugagaaggguaugaacuuaccaacugaucaggaaaugcaagaggugauagauuuucucucgggcuuuaacaugggccagucacaucagggcucuccguuggugacaaggcauaauucugcugccacagccauggugacugagcagaaggcaggagccaugcaaccacagcagccgucacugccugugcccccuccaccacgggcaccccaggcuggggcacacacaccucugacaccccagccgggacuggcaccucagcagcaguccccaaagcagcaacaaccucaaguccaauacuaccaacaccuacuccagcccauuggaccgcagcagcccccgccccagccucgggcaccugggaaauggguacauggcucaucccagcagccagcgcaggcuguuggagcaggucugucuccucuuggucaguggccuggcauaucugaucucaguucugacuuguacagcuugggucuggugagcagcuauauggauaaugugaugucagagguucugggacagaagccgcagggaccuagaaauaacaccuggcccaaccgugaccaaagugauggagucuuuggaaugcugggagagauucugccuuuugauccugcagguaugugaggccucccaucccucgcccagugucaacagcaaaugcaacugccgaggucuucccagggccugucugcugcagccuuacuugugaaggugaaaucauuuaaucccccuuuacgacccuuucucacuguggaggcaaguauggggcagaucuaccaagaugggaaacaguggugagaaaggggcugagaacaugaguggacuauuuuucuuacuuuauagagaacagaacugaggcuaagagagguuacuugaacagcucaaagucccauaguucaaguaggcuccagucuaggccugccuacucccggcagccaaggucagcagcccuuuguggggugcuuuuuuccugauuauauaaccuguucuuugcgaugcuuuuuuuuuuugccuaaacucuaggaccuaugacaggugacagacacccuccugccuucauagaauacagcuucuccugggcuagacaaugaaaauaccaccagagucaucuuaaaaaauuagagaaggaauuuacaaacaagaacaaacuaggaggaggaauuaagggggaaaagccaaaaauaaguaaauuagaaagaaaaauagaguagaaauugcaaauaacucuaaaggaucuuuggaagaccaauaaaauguauaagccaauuuauucuaagcuugauuaagggagaacaaagagaaacaaaauuaggaaauagaaaggauacauuaaaagcgcuuuaguggcucaugccuguaaucccaguacuuugagaggcuaaggcuggaggaucacuugaggccaggaguucgagaccagccuggucaacaucacaaaacccucaucucuacuaaaaauuaaacaaaauuagcugggugugguggugcuuaggaagcugaggcgguaggaucccuugaccccaggauuuugaggcugcagugagcuaugaucaugccacuacaccccagccuggcugacagagagaaacccugucucaaaaaaaagccacuuuaagacaguaccaucuaagacuuaauagcaauacauuuggaaauucagcagaaaauggauucuuuccuagcaaaauaggcauuacaaaauuauaccaagaaguggaaaaccuggccaggcaugaugucucaugccuguaauuuccagcacuuuggaaggcugagguaggcagauugccugaggccaggaguucaagaccaguuuggccaacauagugaaacccccaucucuacaaaaaauaaaaaauuagcugggugugguggcacaugccuguagucccagcuccuugggaggcugaggugggaagaucgcuugagcucaggagguugaggcugcagugagccaugaucacaccacagcagcccagccugggcaacaaaguaagacucugucucuaaaaaauaaguaaauacauaaaaaauaaaaaagacuaucuacuaaaagcuaauagcaaauagugccuuauauaaugaaacaaaaaucauuucaguuaauaucaggaaucagacaagggcgacuguuaucaccuguagcauguaacuuugucuuggacuucacagcaaaugcagcaagacaaaaagcaauaaaauaaguggucuaagcuuuggaaaaugauaaauuaagcagcacaucuuuuugcugauaauagaauugaaccccccccacaaaaaaaaccaucuaaaauuaguaagagaauuugguaacauagguacaugcaaacuuuuuucucuaauuuagcaaaaggcauacacagaaguagaaaauguauuucauucacaggggaguacugugaaauguuacaaauaaguauagcaaauacuuguacaaguaaaucaccaccauaagaggacacuccaggccgggcgcuguggcucacgccuguaaucccagcacuuugggaggccgaggcgggcggaucacgaggucaggagaucgagaccaucccggcuaaaacggugaaaccccgucucuacuaaaaauacaaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaagaggacacuccuugcugaaacacccagcauuuguuacaggagggaaguuaaugcugggguuaacacuccuuucucuuuuuuuuugagacagagucucacguuguugcccaggcuggagcgcaguggcgcgauccccacuuacuugcaaccucugccuccugggcucaaaugauucuccugccucagcuuccugaguagcugggacuacaggugccugccaccacacccagcuaauuuuuuuuuuuuuuuauacggagucucgcucuaccgccccgaggcuggagugcaguggcgcgaucucggcucaccgcaagcuccgccucccgaguucacgccauucuccugccucagccuccugaguagcuaggacuacaggcgcacgcuaccaugcccaacuaauuuuuuguauuuuucauagagacgggguuucacuguguuaggcaggauggucucuaucuccugaccucgugauccgcccaccucggccucccaaagugcugggauuacaggcaugagccaccgcgcccauagagaugggguuuugccauguuggccaggcuggucuugaccuccugaccucaggugauccacccaccucagccuccuaaagugcugggauuacaggcaugagccacugcaucugaccauugcucaugucuucugaaaauucuucaugccgcugcucuugcuguuuugugcuugcuccccuuggguggauggauguaggaaacccuugugccugcaacccugggccacaagaaggguaaacaccuccauccugcuaagaaacagcaagcccacuggcugccacccacuggugugggcacagugcguuuucucaguugaucauagaugguguguacauuuuuugacugucauauaacuaaauccagaguauaaacaguauuugucagaauugugucauauuugaggccgggugcaguggcucaugccuguagucucagcacuuugagaggcugaggccagcggauugcuugaggccaggaguucaagaccagccuggccaacauggcgaaaccccgucucuaccaaaaauacaaaaaaauuagccaggugugguggcacacaccuguagucccaaccacuugggaggcugaggcacgagaauuacuugaacccaggaggcagagguugcagugagcugagaucacgccacugcacuccggcuuggauaacagagugagacuuugucuaaaaaaagauuuauuuuuaauaaaugaauaagaauguuaucauauuugaccucugaguccuggauaccucuucugucuguagacuacaaauccuacucuuucccuucuggguguuccuuucugcaccugaaguccaugguguaguuuucuacagaccuugccccgagggcauaagaucugcauagcccuugaugcagauuaaggaggggcaccccucuggacagaaucagagggcgccaucuaguggccccgucuagauaggcaaaaucagugcgggauggggaacgggagacaggccagcaugacugaaaucaucuugugacagugcccuaaggauaaguugauaaugggauugugcccuaguaucuucccuaauuuuaagcuaaaaaaugcauugcugagucacauuugauuuaugaugcauggaugcuuuccugccauauguuuuuuuugacacuuucuguaaacgccaucugugcuuuucucccauuuguacugcccuguauauccccguucagcauugccaguguuuccagccaccucuuaaagcauucugaaguuucauuuuauucuuugccacacuuaagauguucagauggaaugagcaaaucuccugucaauagccaggaaaauacuagaucaaacuuuagcuuaagugggaucagcauauaaccucuaucuggcugaccccaaugcuuugaugcuuuguuaacguucagguuaucaguuggccaaagucaucaucugauuuucgaaguuguuagcuaaugacucuaggcuacauacagagcaccaagacaauggacuuuuuuugaguuggaguuuugcucuugucacccaggccggagugcaauagcgcgaucuuggcucccugcaaccuccgccucccagguucaagugauucuccugucucagccuccugaguagcuuggauuacaggugccugccacuacguccagcuaauuuuugguauuuuuaguagagacgggguuucaccauguuggccuggcuggucucgaacuccugaccucagguaauccaccugccuuggccucccaaagugcugggauuacaggugugagccaccaagcccagcccaguuuuguuuuguuuuguuuuuaaagacagggucuagcucugucucucaggcuggagugcaguggcgcaaucuuggcucacugcaaccuccacuuccugggcccaagugauccccccaccucagccucccaaguagcugugacuacgggugcacaccaccacacccaacuaauuuuuuuuuuuuuuuugagacagagucucacucuuucgcccagacuggagugcaguggcacgaucucagcucacugcgaccucugccgccuggguucaagugauuguccugccucagcuucccgaguagcugggauuacaggcgccugccaccgaacccagcuaauuuuuguauuuuuaguaguggugacaggguuucaccaucuuggucagacuggucuugaacucuugaccucgugauccacccaccucagccucccaaagugcugggauuacaggcgugagccaccgcgccuggcccacacccagcuaauuuuuguagagaugagguuuugccguguuggccaggcuagucucgaacuucugggcucaagcgaucugcccaccucaggcucccaaaaugcuaggauuacaggagugagccacugugccuggcugaugcuggaaauuuuuuaaguaauuaguauuugucuuuaaaaucuagucguagggaaaucaaaccauuuuucucucuuuuuguuucuuucacacuuagccugccucuauccuaggcauagcccuucaugacagcccuggcacacaccaugccucagcccuaggugcggcaagucccaucuccccacagcagggugcugggcacagccuacagcccacgcuguggggcacaagccuggcagcuccucacugccuuucauugcaugugugaccagcacguuagcaaagcguagggaaggaccaagaggccaguuuguccccaaacccgguuuauuccuuugucccaaugcagugggcucagacccagaguuugcacgcuauguggcaggagugagccaggcgaugcagcagaagcggcaggcccagcacggucgccggccaggcaacccccggggcaacuggccgccuauggaugacgcgcaucggaccuggcccuuccccgaguucuucacagaagggugagugcuggguacuucagggaaucugagcuugagacccaggugucccccgaggggccugugagaagagaggcuccuugccugugugcauucuuuucaggcaguucaauuccaagcccccaugugagagagugacaugggaugaaaucuuuaggggucagagucauguggcugacuguuagaugccaaguagugugauguaucccugugaacgugccauugguauacauucaugauuuucaaaacagacucuucagcccuagacaaggcucuuacaugauggugcuugugaggugaaggcauguuucacacggccuuuauacugaacugaguguggcugcgaagcccacgugauuuauggaacgcugucauuauagccuaugaaaagcaaaaguguacaauugagauucuaguauauugagagaauugcaaauuuuuauuguaaagacaacuggggauuuuuuuauaucccauauugcuacaugguuaauaaaucuggaugacuaaagaccagcucaacuuuuuguuuuuucuuauuuuuaaauuuuuuuuuuuacuuaaaaauuuuuuuucuuucaacuuuuaaguucagggguacaugugcaggaugugcagguuuguugcaaagguuaaugugugccauggugguuugcugcacagaucaucccgucaccuagguauuaagcccagcauccauuagcuauucuuccccaugcucucccucccuugcuuuuucuaaaacaaauuucauauacaaaccauaggcuucuuagaggaauaaagggaauugaugaauauguauuacuuuugaaauaaggcaaaggaggaaaaccucacguuuuaagaagggagagacaagagaccacuauuugguuaugggaugaaugcaggguaaggacugcccuuucagggugggguggcgggugguggggcugcaggaggcccuggcccagcuucucucucuggcuuucagggauggccugcacgguggcuggucgggugcucagggagacucugccagcucgagugaugagacauccucagccaacggggacagcuuguucuccauguuuucagggccugaccucguugcugcugucaagcagagaagguaugaagggauuucuaaaccaagguggggagagaagggcaugugaaugcaacccauggcucacucccugggaaagccaggagcccagucaccuccagucucccugugugagaggaggggcucuuccagcaaugccuggcugaagccucugaagagcaccugcaggaggcgguuuccacaaggaagagccggccucaucuugugcagaucaauuugggagacgggguggccggugcuggucugugccuugcaggaggcacccauuucugugggaagagcaggccuuugguugcgaguucuaaucuggacucaccaacaggcucugcaacccuagacaaggggcuggcccucaauuacccuccaucucuuuauuaaagauggauaaaaugaccucugaauggcguuucaaaguugggaaaaguaguaauuagcuuucaaaaguagucacaaaaauuaaaaugggcucugaacugagaggagagcuugguuagaaauaaguagagaaacugcuguggauaugagaaagcaaggucaggguggcagacuaaggaccaugggcaggaguagagggcacgcagggcucccaggcacucgaagccaugcuguagagcagagugggaggccggguuacuuggucccugcuggacaggccaggcucugucagauaggcaguggggagcggguaggugaagacagaaugguacuugcacagaauaguaguggggugggggguggcauugaccaaucacgagcacacauucagaugcuuucuguccacacuuguagucccagcuacucgggaggcugaggugggaggaucacuugagccugggaaguugaggcuacagugagcuguguuugugccacugcacucuagccugggcaacagaguuagacccugucucaaaaaucaaacaaaaaaucaugucagguuaggcuaggugcucugaaggaaaauaaagcaggguaugaggguaguaaaugcagagaacagguggauguucuauuuccagcacuuagucaaugaggcuucugaugagcagagagcugaacaaagugcggcagcaacugguggggaaucggcaguggggugugggugagguaggaagagucaaggaugacacgcaaguuuucugccugaguuucugugaagggcgccaugaacugaggugcuaagccugcaggaggagcaaguuugaaccggggguggaguuugagacuuuucuuucagacauaugacugauucgacuucuaagaagucacaucuggcaccaucucugcagagacuguugucugcaugcaggagugcuggcucugaucuggccacauccugccuuuuucauucaaccuuguaacagacuuucaugugauuaguaaaacgaaugggcuuuaagucacauauccuuagugcuuggaaacaguaucucucucuuuuuuuguuuuuuugagacggagucucgcucuguugcccaggcuggagugcaguggcgcggucuuagcucacugcaagcuccgccuuccggguucacgccauucuccugccucagccucccaaguagcugggacuacaggcgcccaccaccaugcccggcuaauuuuuuguauuuuuaguagagacaggguuucaccauguuagccaggauggucuugaucuccugaccucgugauccaccuaccucggccucccaaaguguugggauuaaaggcgugagccaccgcacccggccggaaacaguaucucuuaaauaaauuaacaaaaagccggccggacucgguggcucacaccugcaaucccaguacuuugggaggcuuaggcgggcagaucaccugaggucaggaguucgagaucagccuggccaacauggugaaaccccaucucuacuaaaaauacaaaaauuagcugggcaugguggcacgcaccuguaaucccagcuacucgggacgcugaggcacaagaauugcuugaaccugggaugcagaguuugcaaugagcugagaucaugccacugcacuccagccugggaaacagugagacucagucucaaaaaaaaaaaaaaaaauaaaauaauaauaauaauaauaauaaagccaaagaagguggacucagcagcugaguaaaccagugccugucuuugccugccaccuccacccccagcuccuccaccugcacuggcagugcaggagcgccgucauucacugcuggcuccccuuagccgccuuuaugccauugacccaggcaggccuccuccccuccuagaaccagggccuggagaugcuggagccuagcacuaguguguacccuacaggugggcugggcaggaagccaagcaaucacugcccugagcucuugguucuugcaggaaacacagcaguggagagcaagacaccagcacgcugcccucaccaccucuccucaccacgguggaggaugugaaccagguauucaggcaggcucugugggcacagacuugggcuagcuuccacagcugcaguuuucagagggccucaaaguaaugagggaucuucuuuguggugauuaauuuuguguaaaugauuagccaccucagcugacucagagccacaggaagcucuacggcugugcuguccagugugauagccauucaccacauguggcuauguaaauuuaaauacaaauaaaaauucaggccgggugugguggcugaugccuguaaucccagugcuuugggaggccaaggcagaaggauggcuugaggccaggaguucuugaccagcccagguaauauagacacugucucugcaaaaaaauuaaaagaucagcuaggcaugguggcacaugccuguaguccuagcugcccaggaggcugaggcaggaggauggcuugaacccaggaauuugagauuacaguaagcuaugauugcaccauugcacuccagccugggugacagagcgagacugccucuaaaauacuuuuuaaaaacaaucagccgggcgcaguggcgacgccuguaaucccagcacuuugggaggccaaggcggguggaucacgaacgaggucaggagaucgagacuauccuggcuaacacggugaaaucccaucucuacuaaaaauacaaaaauuagccaggcaugguggcaugcgcuuguaauccgagcuacucagaaggcugagacaggagaaucgcuugaaccccggaggcagagguugcagugagccgagaucguaccacugcacuccagccugggcgagagacagacugcaucucaaaaaaaaaaaaaaaaaguuccuuuccucaguuugcacuagucacauguggcgaguggcuaccauacuagaccguauaggcacagaacauggcuaucauugcaagaaguucuguuggacaggggugugggagugaguggggcucucacccggcuuccuaggagggaauaagggccaggcaucuggggaggugggaaaugaugauacauugcccgaaaugccacuaagaacucucuuuuguuucucaggauaacaaaaccaaaacguggccacccaaagcacccuggcagcacccuuccccgcuucccagcacgcugcccagccccagcgcaccacucuaugcagucaccagcccuggcagccaguggaacgacaccaugcagaugcugcaguccccagugugggccgcaaccaacgacugcagugccgcugccuucuccuaugugcagaccccaccccagcccccacccccaccagcacacaaggcagcacccaagggcuucaaggccuucccugggaagggugagcgcaggccagccuaucugccccaguacugaccccaggccagccagccugccugccugccugccugcccgcccagagcuguggggaugaguguccccaccccagggccacuuagcugacaccagccccucagaggaccagugcgccccaucccagggaggguuccuuggggacaagggugguuggcagcuccaagccuuuaaaccuggcuucugaaacgauggcaucagagcccuggagagccagcuggagacacaggcgucuggccuucaggggcuugcuagggaaccugcaugccuaguaagcgccacaggugacucugaugcaggcgccacagccacacuugaagaaacacagcucuuggguuuuuaguccugcuguguguugggaagacaucaggccugaaagcugagggcauaacugaccauuuuuuggaaacccucuccucccuccuccacaccuugagugaugaccacaccaaucacuguauuuuauagcuuuuuuuuucauguagguuuuuaguuaaaacaucuccugccuaaaaugcauugaauauuuuaagauaacagauauacuggcuggagguuuguuuaacacuaucuauauuuaagcuuauacaaaaugggcaaaauauagaauauuugugauuggaagcagucaccugggguuucuggggguggacaguuccucgccacccagcagcacccugggacugcggccuuucccagcuuuauugaagcagaaugguggaacuugugccggagguacacugcugaaggugcguggcgguggaccagccagcugcuguccaugugcagagcaaggcugcaccugcugcccuucgauccuuccacacauggccaggacacugccacaauccucgggguguggucaaggggcacucagagacaccugcacuagaaauugcauugacauugugagcuggcucagaagacaaaccaauuaagauguagauagaaauuaauuuaaggucuuuucuuaaaaaaaaaauccaccucauuuucaguuaacaugugccauuaaauagauaacauccuguggauuuagggauauuuuccagccagaauggauccagaagaauugaauggugcuuaaauugagaaauaauaauaaauauaucuauauagaauagacauaucccacuguauauuaauugagguuacagaaaguucuuuauauaaaacuuauuuaaauuuuucauauuucaucuuugaaaaagucugagaaaaauccauaauauuuucugguaugaaaguuugacaguauuaauauuuuuuuuauauuuucuuaaaucauuaaaccauuuuaauauauguuaacuacuaauaaaugguuuauucuuucuaacuccauauaagcuuuuccagcaaagauuguaauaacacauuuauguucucguuuuucuacagauauaaguaaauuuauauauaaaaauaccaaaaagaggcugggcgugguggcucacgccuguaaucccagcacuuugggaggccgaggcagguggaucaccuaaggucaggaguucgagaccagccuggccaauauggugaaaccccaucucuacuaaaaauacaaaaauuagccgggugugguggcgugcgccuguagucccagcuacucgggaggcugaagcagaagaaucgcuugaacccgggaggcggagguuacagugagcugagauugugccacugcacuccagccugggugacagagugagauuccgucucaacaagaaaaaaaaaaaagaauauauauauauguauguauguauguauguaaacacacacacuaauuugagaggacccguagggugucugagcccagccaccugaguuuuuaguacuguguugucaggcucuucccaggccucagguguugucuuuugugcuguguggggaugcauugcugccuguauuuaugaucuuuugccgugguucugagcauucaccucaccauguuuacaaagaacuguuuuguauauagacauuuucaggcacgugcuuugcaccaacccugcguggcucuugucuguguuagcugucacggugugcacacuaaucucuguuaaaguugucuauggcuguucuacuuguaagauaguuuucuauuuccuucaguaauguguccacaguacccuguauuucgaguuccauuauacugaaguacucauguuuuaauagugccucuccaaaggccucaccuuggacagaggucaauccuugaugcuccagcacaggugacgucacuaauugucacuuuccaguuuguuuuucucuauuaaggaagacauuuucuaauugcaucuccaugggcugugagacugugugaagccguuuguguggucuccauguaggugcuguguucccggcaccgccuugcucugaacacugguaauuccaggugcugcgcuuggcagaggggucucgccaaagcgcaugugugugcaugugugaacguguguguccuuugcaugguugggcgugggugccuugcuagggcaucagcaggacauuguguguauaguuacaaugcuuccaaacuggaacucuacauuuuguaucuuuuaaagcuccuauaaguaaaauaacuauuggcuuuauuaaaaauauacauuuaauaaua

SEQ ID NO: 191751 - RNA, 57069 nt, Homo sapiens
ugaucucagaaguauuuuauuuacacacaggaggggaaggaaggggcuuuuagcuuucccuaaacaucugcaacaauaacucaaucuuagaaauaaaguaacugauuuauaguuauuacagggaauacaaacauuauaauuccgcucuuccauuuaaaagauuccuuucauuauguuccuacugaaacagaauguuacuauuuaaagagaaagaacuuugacgagcauuuuuuauugaacaguuuuauucuguuuuagaauaaaaacuuugcuuuaauauuguaagggguacugcagguaugccaugcugccaguuauugcuggggcacaaaacgccccagucagugauucggagggcugggaaaacgcauaaacucauaauuucagagcaaguagaacuaguauuuacaguuuucuuucuugaaauuggcccgggacaucuccaacagucuacacauguauugccaugguacuugcucugaugcucugaaugccucggaacuguguucaauaucaugauuuguggguccucuaaaagguuuuguuguuaacaugcaagcaaacagcacugaacaauauugucuaaacuauggcugccaaguacuggaucuucauaaugaaaccaaauuacaaaacacugccuuguagagcuauacaaaagauauaaaaugaaaauaaaaaaugucaaccagccuuaaauauuccaauucuccuacagugcaguuucuauaucuuuaucacuacugaauguuuuaaggagaaaguuaagaaaacaaucaaaauauuagauaaaaauauuuaaaucuuuggauccuuuuauuccauggccuucauaaaaacacaaaaguggccagauuuuucccacuagagcuuaaaauaucaaaaagauucacuaguaauuuauaauuagcaaugaacucuauacugagucaucugugggucaucauaggcccaaggaccaguguugccguguguuacaggcuaccaaaauaauuucuagcacucugaauccucuugaaauaugauggaaugagucaagguaucaugacuaaauuccaggcauaauaggaaaaacagguucauugaugccuaguuuuaaaguccuacaaaaggggggaagauuacuuauuugaaaauacagcuaaguacauucucaucugugauuauuuacauuuguauacugaaaauaucgauuaucuggacagauccugugauaugccauuugcuacaaaaugaaguucuuacaaugagcaugaauaauuaauccuuuuuagauaaugaaauaauguaucaaaucuucauuuauguuccaaacauuaaaaaacaaaaucaaaaauguuaagccuggaaaacuaagaaaaaaagacccacccauaaggcugcugcucagcacaucaacuucugcaaggacacaguauguuugcugacuuuaaaauguuuauucuuuaaaaaauuaguugcuuuuuauacagcuauacaaaguucuuaauguuucuuuggcaauggaauauaauggaauuuuacaacuauauaaaaaaguuaccuuugccuaagaaacaguauuuacuguguguacauaguugacugacaaaauucucuaccauccagcacccuaauuaauugacgaaauaagcuaccucauauuacaggauuccccaaaagaaaggaggaaaaagacacacacauacacacacacacacacacacacacacacacacacacacaaccuucuguggcucaaaacacaguaucacggcccuaucugcaggcaacuugcaauugccaaauacaauuuagugauaaaaaaaaaaaaccuuucagugaugaaaaaauacuuguuaagucccacugaaguacugcuuuaguuuaacuauacauaagaaauuacuuaaccuucugcuauuccaaauauauuuaaugcucauguuuuaagaugagccuuccacccccaaaaguaacugcauuuuaucuuugaaauuaagcggaaaaacaaacaaaaaacaaaaacccagugcuggugacaaauguacagcgaauucacuucuucauucuuugcaaagacugaaaucaauguucaggaccaugaagagcuagaaauucaccuauuuucagagacuuguuuguagacuaugcagcaacuuuguugucuuucuaaaaaagaaaaaaaaauuuagcucauguuccaaauuauugguguauuauuuucuuuuuacuuugcucaaguuuauuuuaaauuaucuuuaaauauacucccccacuuuuacuuucauagaaaaaccugucucacucauuuccacgaaacuccuucuauaacuuccauacucaguaguaccucauuguugacugcaucuuccagucaguagagguuaaugcaguggugaaccccaccccaaaauacaggcauacuuccucaucuuugguuguucucccuaauaauuuuuuaaaagcagugauaggacuuaaacccucaacucaauagucaaacucaucaaauacaacugucaacauacuuugaaacaaguuucauaaaauccccaagucuuugaugucuuuacuaagcaauaaaauacccagucaguauaacauuucucuccaaaauuucaugccaggaggaagcaaugguuuaaaaaucaauuuuacaaggauaacucuuaaaucugaaauaagcucugaaaaguagaaagcugacuggggaauuuuuaaaaaguaaccagugaggaagcaauaaaaaucucaagauuuccagagagacugacccuaaacuaaaggccuguacaaagggcuggagccaagggcuuuuauuuuccucuagaccagcugcuaccauauaccugguuuuuacugcugauucucaccccaacuguuagaaacagacauuuccuaggugagacuuaacuucaucuguguauacaacaccaaaacauuugcaccccguuauuaaacugaaauacauaugguauggcauaaguugacagcaaugagcuacaagaugaaccugcugucccccacaaagccaaccuucacaccucccaaaguauuuguuuuuuuuaccuuucagaaagcaguacgaucaauccagaccuuuuaggguccaaaagcugugguuuucugaaagguaaaaaaaaaaaaaaaaaaaaaaagagaaagagauggggacaggagagggagaaaggagaaaaugaaagggggagaggagagagagcauuaugcugagucauucagacaccuuguugucuuugaaccccaucugaggaaacacagaugugauuuuuaucacccaccaugguggcuuaaccucccugacagcagcauauaaaacaggagcugguuacauuauuauugcuaguccugauuuccauucucaccucaaaaaagaaugggcggugggagggggaaaacaccauacaaccaaacuuaccauaagguuauauuucuuucuuuucuuuuuuuuuuuugagacaggccucgcucugucacccaggcuggagugcaguggugcgaucauggcucacugcagccuugaccucccagguucaacugauccuccugccuuagccuccugaguagcugggacuacaggcaugugccaccacuccagcuaauuuuuaaacuuuuuuauagagauagggacuccuuauguugcccaugcuguccuugaauuccugggcuuaagcaauccugcccuggccucccaaaaugcugguauuacauguguacaccauugcacuggccuauauuuacaauauuacccuuaaggaaaaucaggccacaagucaagagagugaguuuuggauuuguuagcuuguaccucaaucaugacaauuaacuucuugggguccuuaguuuccuuaucaucuaaugugagugugguagcguagagauucuaguuuggcugauucuuuuaaggauucuaaaacuuuaugauuuuaucuuuacccauguuuucauuaaacaaccaagcucauuuaugcuuacccccaaaccacaaugacucaugcuaauauagcacaaaaaauaaagccaacucauuucaugaaggcugcagaaaugucauccauguccaucucugggaggaaguguuagauguuucagauacaaguuuaaucuucagugguaaaucuccuuuaugugacagugaucacucaccauuuucuaccuuuaaaggugccaggugaaaugauuuuaugauuuaggagguguagggcugcuggguucggggcucuaguggcagaugaaaggauuauucaacucuggaaugaacaaucaaaggcuagcuacauugacagaccuuuggucucacugaaggcuggaguggcaaauuccuaaucaacaugacaagcaauuacuucaagcccacuauggcuccauguugagcugaguguugucauggaaagaaaaguagaauacauauucacuaaagccaagagguucucaucuagcuggugaugcagaacaaaacuaaauacaaaaaauagggaaugucaguguauuuaaaaugugugccaaagaaagcagauagccacaggucagaagaggaggaaaucaguguaggaaggaagagaagacagagcaaaacuugggcaaggcuguaaaggauaagugaaaggggggaccugacuuuuagcuaugucugucucccaccaaaauguaaacaucaaaagggcugggccuacaucggucagcaccaaugcucaacauagugccuggcauaucugaagaauucuguauauuugguaaaugaauggggauggaguuggaaucaagcacaauguguaugugagauaaccaugaggcagcuugcuugaaucagauagguuaaaggguaaugaggaaugaggccaaauauaucaagugggauccucacacaauuaagaagagcagggacuacaaugucacaacugagccuccuaaacacugggccaugccugaggguucgcugaguccaucacuccuggcaacaccuaagcagaggcuggacuaucugucaaggauacaggagcguagacaaagaugcauggagguaacuaugacaaugcauuuucaauucugcaauauaugugauacgaguuuuacaaaaggcucaaaaugauaaacagugugacauggugucaaaaaaauguuuguauuaguaaccacauggagcacacacaguuacugcauggaagguuuguuuuuuccuuuuuuugagacggagucuugcucugucgcccaggcuggaguacaguggcgugaucucggcucacugcaaccucugccucccagguucaaugauucuccugccucagccucccgaguagcugggauuacaggugugugccaccacgcccggcuaauuuuuuuuauguuuuugguagagacgggguuucaccauguuagccaggcuggucucgaacuccugaccucaggugauccgcccaccucagccucccaaagugcugggauuauaggugugagccaccacgcccagcugagauuguaacaguuagaacaucccuggggugggauggaugcccuugggaagaguaagcucccagccccuauaagagauacugcagaagagguuuauguuuuaaccaggucagaccucucagauguuuuccaacucugaaaguuuaaugaucuuuaaaagguguuauuucagaauaaauggugcaacucuuuauucacaaaugucaaaaccaagggucugaaaggucauacuaguaacuacugcuauuauucucaucuggauccaagucuaauuuaaauguacuuuuucucagaccaagcugacucaauguggucuucaacaaggaguugucacagguuguucaaaauguagcugaucugccuuaaagugggguaaagagagacgaaggucugaagcccaacugguggguuaccaugguaguugacagggacaucucaaaggaauaaauggcaacaggccacaaucauggauaccucuagugccugggcaguauaccaugagccaacauggaacacugggaggaggcagagcugagaugacaggagagaaggaagaugaugagaucagucugaggaagguuaagcugacagcaaacagugcagauagagaugcggugcagaaacacauaggguccaggacaggcuuacaaaagggaggauggaacaagcaccauggcacaccuauaaacccagcacuuugggaagcugaggugagaggaucgcuuaagcccaggaguucaagaccagccuggacaacauagugagagugggacccagugucuacaaaaaaaauuaaaaauuagcugggcaugguggugcaugccuguagucccagcuacauaggaggcugaggugggaggacugccugagccugggagguugaggcugcagugacuuaugaucaugccauugcacuccagucugggugacacagcaagacccugacacccuccaccccccaaaaaaaagaaugaagaguauuaaaaaauuaggaagaguauaaauugaaaaccuagaagaguauuuuaaagacuaggaagaaagaccccaaauugggugguuggucagugucaaauauugcagaggaguuaauggcaaauaaaauauuugugaaaauacuacugcugaauucuguaagcaaggugucacuggcaaacuuaagggcaguaacagugauaagcgagggcuauucuggaguuccuaagacagauucuccuagcugggaaggugauuuugcaagucagaagucccgcaacuacauaaggccaccaacggcuggauggcauaagcuggugacuugaguauaauuuuuggcagucuuggcugugauggcacaauaucaaaagcauuaaaauuaauagagcagguccaaaagccacuaauacugaucucuuuccagagagaucucaacaauggccaguuuuaaguacugggcaauggaacuccugcuaacaggucuuucuguuuccagcugccuguugcuauuacaaguggaacucuuuacaagauuuugguccuuucuguuauagcccuuccucuccacuacuucuaaaaucaauaaacuaagauaguuuacuguuaacugagauaguuacuaugcugacuuaauuuacagacaccugucaaaagcuacauuauacacauaaggcuacuauacagaguuacagaauucucuagcaguagcuccugaaggccaauauaucgaaacauuuucaauuucauggugaaaggagaaaaccagggaaaauguagugaauuuucaacaaaaccaaauuaagaguacugacucaggaaacaacuugcugggcucaacacccagcaccaucacuuacuagcuaugugaccuuucgcaaguuacuuaauaucucuauacccauuuccucacuuguaaaauggggauaauaauagaaccuaccucacagaguugaugugcaguuuaaauaaguuaauauguaaaaaaauauuuaaaacaaugucuuguuacuugguaaauacuauauaaauguuaacugcuauuaaauguuaaagcuugcccuuccauucugggaguaugugcuuccuagauagacucuuuggguguuaaaaguauauucuguuaacaugaaauaaaggugauacuauacugucuuuuuuuguauaaugucuuuauauauacaucugaaucacguauauccucuacugaaaagucaaaauggaaguuauucuaauguccucaaaacaauucacccaaaacaaaaacaaguaaaaauguuuugagucuuguaaaaugcaugucaaccccaaagaauuuauuaacaguaacacuuacccuauauucaaaauccgcaaacucccggcccccacgaccuccucugaauccaccgcgaaauccucgaggggcagugaagguaccaccucugccaccaccacgcccucugccaccacggaaaccaagaccuccucugccucuguaucccccacggccacgguuuggacgaagugggauuccaaauguuucagcauuuaaucuucuuucuucagcccagguuggucuccguucucuauuauaaaagcaaauaaucuucagcauaucagguuuaaaagaauaucccucagccaaaauaugcagugcuacucccaaauuaagccuaaguaauuacuaaagcuaauuagaaauaagcaucuuggcuaggcgugauggcucacgccuguaaucccagcacuuugggaggccgagggggcggaucgccugaagucaggaguucgagacuagccuggccaaaauggugaaacucauucucuaccaaaaauacaaaaaauagcugggcaugguggcaggugccuguaaucccagcuacuugggggguugaggcaggagaaucaccugaaccugggagguggagguugcagugagucgagaucgagccacugcacuacagucugggugacaagagcgaaacuccaucucaaaaaaaaaaaaaaaaaagcaucuuaucuaaguuaucacgaguuguucauggcauaugaguucaauauguuccuguaauauucuguuaaacuucaugugaacacaugacugacauuaguuucuugcaaauacaccugauaaacauaguaacagcuccaaaauaauggaaauucagauauaaugagauugguaauugacuucgcuuuccacucagccccaagggaaaagaagguaaagucagacagggaggccuugucuugggaagcuaggagauggaaggugggcccuuagguccccauuauguuccuggcccaaucuauggacccgauaccaaguaacccaagaaguaucugaauuauugcugcugucauccagccaaucgugggacucagaauuauguccauccauguuuauauugaagcaaacaacugccaccagagggcaccaaacuucagccaggaaaaggacaaggacaaugacaauuuggauugggcaggagaaccucuagaacuguuaguuccucacacuggguccuuuaauuaaccucucaauaauuugccaauuuucuggacccacauuuacuacaaucuggcaguuuuaugguaccagcaaacuucaaaguagauuagcacuucgguucuggcuucauuugaacuguaacauacaggggugaaaaaaagguccuacuuagacauuaccuaaaugcuuguuuuaauugcuaauauucaaauaugaauauauccuuaaacaaaaguauaugguuauuucuucuuuugaaugaauaauuuagaacuuuaguauauauuuucuuuuagcaaauaaaacauuaaaaaaucaauuauggccaggugugguggcucacgccuguaauccuaguacuuugggaggcugaucuugaggccaggaguucacgauuagccugggcaacauagcgagacccccaucucuacaaaaaaaugaaaaaaauuagccggguggggugguguacaacuguaguccccuuuacugaggcugagaugggaggauugcuugaggucaggagcuugagacuacagugagcugugacugcacugcugcucuccagccugaguaacagaguaagacugucucaaaacaaaacaaaacaauuaugguaguauucauuaaaccucgugaauuuacaugaaaccauuuuacacuucaaucaauaucauaagauaaaagaacagcuuaaaaacuguaccuauugucaucacaagaaauauuaucaaagaaggauuuaguuuugucauaauagcaauuagguccaaguggaucuucuucaucggcauuuccuucacuguuuuggguaucaacuccugagucuccuuuaucuucaccauuuacaggcuucuccuguuucucaaguuuaucuucuaagaacaaaagcacauaucagaaaagucaagacagcuaaucugaauuacauaaaaacaccuaaucugagaaacaucuguaauucacagaucaaauaagauuauuuucugaaaagaaaaaucaaagcuuaccuuuuaauuuaaguuuauuaugaaacucucugucaaucucuuccuuguugaauugugcauuugcacuuucaaagucaaagucuuucucaaauuucauuggcccaucucgccgaauaccaaaucuuccccugccaccccgaugacccccacgcccucuccuuggagcugaaggagcaccuggagcuaugauaauaaagaauauauacaaaggacauucaauauguaauagcugguuuagcacagauguugcuauugugcucuuuagauucaacagucaacaacagaaaugcuuacaggucucucuauauauuuuauuguauuuguauuuuuuauacaaaauaaaaaauuaaguuucacuaauauuuaauauguagacugagaauagcucacacaaaauuucuaaacauuuguauuuauggaguccacacucacauguguuacugacagaguauacagccaggcaaguguggaggcuucugcacuaaauuaauguaugcuccuugaggucaggggcuuuguuuuccuuacugcuauauccccaacaccggcaaacugaagugccagacacacaguggguucucaaaauguagaaagccuuuuauggaaagaauaacaggaaccaagauuuauaguaagaaaaauaaacacuaaucggcacaaauugcaagaaaauagguguuauuuccacaucacagauaaaaaacagacaagcaccaauccuuacugacucaaaacacuuccuacuccaucuuuacugugucucuccagauggcucuauauuauucaagccuuccuguaucuacacauucucucuccucuauaacacaguaaaauuucagccaaucauaagagacaugauaaagcaauacaaagcagcauaauuuauagugaaaaacgugggaacccaaauauccaacacaagaaaaaugacuaacaagaaaaaaacagaggaagaauauuugauguuaacugaaaaacgcagaacagaaaccaguaugaguuuaaugaucacaauugcgugaaaugcuccacacauacugacaaggaugagaagugacuacaggguaacaagauagguuugcgcuguuugcugagguuuggcaaacugccuggguuugagaaaacaaaccacaaaaccccacagcagcauauccagacauaaaucuagauaaguaggauguuugaaacauucaccucuacuauuaaaaaugccucggccacaagccagaauuacaccaugauccuucugucuuaaaaaaaaauauuuuggggccaggcgcgguggcucacgccuguaaccccagcacuuugggaggccggggcgggcggaucacgaggucaggagcucgagaccagccugaccaacaaggugaaaccccaucucuacuaaaaauacagaaacauuagccaggcgugguggcguaugccuguaaucccaccuacccaggaggcugaggcaggagaauggcuugaacccgggaggcaaaggcugcagugagcagagaucgcaccacuacacuccagccugggugacagagcgagauucuaucuccagggggaaaaaaaaaaaaaaaaaaaaagguuuuggguauagaugucugugucuguaaaaucuacaaaaaaaaucgggaagaauaugcacuguucuguuaaugaaccucuuugguggggugaguuuugaagggcaaugaaagauaguauggcaguuauuuuauuuugggaggggagcucucucuuuuucugaauaaaaaggguaaaauauaaugagucaaauuaaacaaaauucuguauuccauggcauauguagucccagcuacucaggagggugaggcaggagaauggcaugaacccgggcgguggagguugcagugagcugagaucgugccccacugcacuccagccugggugacagagguugacucugucucaaaaaaaaaaaaaaaaaaaaaaaaaacacgggggggggggauauaaaaauauauauauauauaaauguagagaagaguacauauacaucuaaaaauaucauaucuagauuucuaaaauuaagugaaagaucauuuuucaaucauuuucuaaauaagguagauuauacauucccuuuuuaauuuagaagaguuguaaaauuauaauuuauuuuccauuaauaaauuugaaaauauuaauaaaaugaaugauuuuagaauguuauauauuacaaaacagauaaagaaaauauaaaaccuuauuaaaucaauaaucauaaaagaaaacuacagcucuuaaacaacugauucaaaaacaggaucugggcucaauuuuuuuuuuuuuuuuuuuuugacagacucucgcucuguugcccaggcuggagugcagugguacgaucuuggcucacuacaaccucgccucccggguucaagugauucuccugccucagccucccgagcagcugggacuacaggcgugugccaccacacccagcuaauuuuucuauuuuuaguagagacaggguuucaccguauggccaggcugaucucaaacuccugaccucgugaccugcccgccucggcgucccaaagugcugagauuacaggugugagccaccgugccuggccucugggcuuaauuuuaaugaggaaacguuucaaacuuguaacaugaagaaaauuccauucccaaaggcauagaaaacaaugaaaaccaauuuuauaauccuaacuugaaacugacacaaaacauaaaaaccacaaaaguagaagccauaggaaaauguaaauauaaacgaacaaauccuucuagcaggaaauacucaagaacauauuaaaagauaacugccuggcugggugcgguggcucacgccuauaaucccaauacuucgggaggcugagguggguggaaaauaaggucaggaguuugaggccagccuggccaacauggcaaagcccuguuucuacuaaaaauacaaaaauuagcuggguaugguggcacgcggcuguaaucccagcuacuagggaggcugaggcaggagaauuacuugaacccgggaggcggaggcugccgugagcugagaucacaccacugcacuacagccuggguaacaagagugaaacuccaucucagaaaaaaaaaggccuaccacuaaguagaauuuuuuuccagaaaaguaaaauuuuuuuuuuuuugagacagagucuggcucugucgccuaggcuggagugcaguggagcaaucucggcucacugcaagcuccaccuccccaguucacgccauucuccugccucagccuccugaguagcugggacuacaggcgcccgccacugcgcccggcuaauuuuuuguauuuuuaguggagacgggguuucaccauguuagccaggcuggucucgagcuccugaccucgugauccgcccgccccggccucccaaagugcuggaauuacaggcgugagccacugugccgggcccagaaaaguaaaauuuuaaaaaaucuuuuuauuuuaaaguaauuauagaaaagaaaaauugaaaaacuaguucagagucgucccuugugcccaucacccaacuucccaaacuccaacagucacaucuuauauaauuaugguacauuaucgaaaccaagaaaccgacacaggcacaaucuaauuaacuaaacuacagaccuugcucagaugucaccaguuuguacauguacucauuuuuugguaugucuuuaugcauaguucuaugauguucuaccauauauagauuugcaaaacuaccaccacaaucaagauaaaggacuguucugucaccacagugacacuccccugugcuccuccuuuacagucacaacccccgccuuucauuuuuuuauaguaauuauguaucauauauuuaaaauauucucccuguugagaagcauagaauaugacuuuuagauccaagaacuuaccuacuugucucuuguuaucauuucugaguugcucauuuucuggccuugaaacuuuguguacuucagcuacagaagaagacaugcaaagugccaaaucaacucaggguacaucaucaaaaacuuccauaguuagaaaugcaaacaaacaaaccaaaaaacccaaaacaaagccugugcaaugcccaaaaaacuauacccacaccaccaccacuuugagucaaauuugaaagaccaaacauucuaucauauucaguuuaauuuucugggaucauucacaugaaguaaauccuucuaaugaaaauaaagugaguggaaaacauugaucagucaauuaaggaacaguaaacagcuaaaguucuaccucgccugugcuccugauucucuccugccuuuuggcuggcagauggcaaaggccugguugauacaggacuccuucucccaacagcugcuggagcagguaagugggcugaggcggucugcacugcuuguuccaugguugggcuuuuucucaaagggucuaacugagggcuugagcgaccuaaaauguaaccaaaagauaacaaacuacccuauuggggauuucaaaauaaucuagacccuaaaaaaaauuguccagaguuuuauuucuaucaauucaaacccuuagcacaaauuugaauuaauccacuuaucagaccagauauuaagaaugguauccuuagugggcuugucauuagguuaaaaauaaaaaauaauaauaauuuaaaaaaaaacuucaacagcuucaaaacaacucccucccccucacaauuuuaucuguuauuucuacuuaguggaagaguuuacaucaaaaaaaaaaaaaaaaauugcugccagguacgagauucccuagaauuauccuacaaauuaucauguuguagucaggucaaacacaggcuuucgccaaugacaaccauaagacuauggugacuuguuuuaaucuuucuuaguacuuucuguagaugacuaaaacaauaccuuuacaucuaucuacagguauuaacuccauuaaauuucuauuauaagaaaguaaagggccgggcgcaguggcauaugccuguaauccuaguccuuugggaggcugaagcaggaggaucgcuugagcccaggauuucaagaccagccuaggcaacauggcgaaacccugucucuacugaaaauacaaaaauuagccaggcgugguggcgcgugccuguguucccagcuacucaggaggcugagaugggauagcuugaacccgggaggcagaagcugcagugagccgagauugugccacugcacucuagccuaggugacagagcaaggcccugucucauaaauaaauaaauaaauaaauaaauaaauaaauaaaguaaaagaacuacaaaguuagauaggugaaguucuuuaaugcuuuaggggcuuggguaauuaaacauaaaaacuaaaaggccagcaaaaaaacaaacaaacaaaaccaaaaaacaaacaaaaaaaacccuucagauaauuacacaguagccauacucauuccuugccuuuuaaaagaucucuuggcaaguuuuugcuuaauaugggguuuggcugggcgcgguugcucacaccuauaaucccagcaauuugggaggcugagaugggcagaucgcuugagcucaggaguucgagaccagccugaacaacauggcgaaagccugucucuacaaaaaaaauacaaaaauuagccaggugugguggcacaugccuguaaccccagcuacucagggggcugaaguggguggauugcuugagccugggaggcagagguuguagugagccgagaucgguccacugcauccagccugggugacaaaacuagacucugucucaaaaaauacaaauauaaaagagccaaaacaaaaaaugggguuuguacuuauacauuauauuuuuccuuuuaugaggucgccuggucacagcaugaacugaagaauguaacaucgggugcucccaucaugcuuucuguccugauaauguuugcuguacaucucugcuuaggcacucacaucucauaauuauuccaaaauauaauguuuugcuuaaaaaaaaugcucauuucacguaaaaaaaucccccaaauaugcugcaaauguuacuguccaucugugcauauuugcaggugucaaacaacuggugagugcugacaaugcauuauuauguaccuagaugauucagggauaauuuauuaguaauauuuccccaauuuaugauuaucuaaaguaugcacuuacaaaugugcaauaccauuucagccauuaauggcaaaguuagccaaauaaaugaucauuuaucaaaacccagaaaccgacacaggcacaaucuacuuaacauuucaaaauuaaguuaccacuaauagaagcauuacaauuuuuccacuggauuauaaugggaaaucaugguuuauguaaguuuuggccuaugaaaaaaacauuuuauaaucacuuauaaaacacauuuuguuuuuuguuuuuuagggacaggauagggucuuguucuguugcucuggcuggagugcaguggcgcaaucacagcucgcugcaacuucuaacuccugggacccaaugaucuuccugccucagccucuugaguagcuaggacuauagaugugcgcuaccacaccuugcuaauuuuuuuuauuucacaugucuuccugaaaaagccuacugcuacaguuaauuuuaugguacuacauuaaaucaucuuauaaguuuauaaaacuucuuuaucaaggcuuuugagaaaagauccuauggcucacaaguacuacagaaguacaagcaauggggcaaucggagcaaguacagaaacauuuguuguguacuuaaaaagccuuuucacuauuaaggccuacuaaucaucaugaugccaguuuuguuauaaacagggaaauacaggugauacugugauacuggauacauuauuaggaauaaauccagaagugauuucugcauauuauagacacacucccuugagcuaucuucacaaucuuaucacacuuaaaauucuaggaauuuuaauuuugugaaauucagcaauuuuaguugauaaaacuuaaaugcaaacucuuaggacuugucauuugucauaacuuuauguaaauacaccucuuucuuuuaauaaacacauacuucaaaauuuuuaacauuuuaaucuauuuaaaauuuauauauuuuuuggugcucaguaugagggaaagaaucuagagugacuuucuccaaaugaucaggcaacauuauuaauuggaacagacagccuucucuccacuaauuuaaaauaauaccuuuaucaucuacuaaauucuuuuaagaugaauucuugcucuguugccuaggcuagugugcagggccgcaaucacagcuugcugccaccuuaaccuccugggcucaagcaauccucuagcuucagccucucaagcugauaggcgcacacaucacgcccaacuaauuuuuaauuuuuuuagagacaggguccugguauguugcccaggcuagucucaaaucccuggcuuccaucuugaacucgcaaaauguuaggguuucaggcaugaaccacugcacccaggauaaauucuuauuuauacucggaucuguuucugccugccuauugcuuucuauucaucucuuucuuuuuuccugcauugcuacauuuuauuaucaugucaguaaacccauuacuuuuauuuuucaaauauguccagccacacuuccauguuuauuuuaaagauaaacuguuuuacuaaguucuccuacuauucuauuugcauugauuuuuaauuaauuugcaauaaauuuguuaacuaugaggaguaaagucuucccaacaucuuuuuuuuuuggggggggacagggucuugguucugucgcccaggcuggagugagguagugcaguuagggcucacugcagccucggccuccugggcucaagugauccuccugucucagccucuugaguagcuaggaccacagguguccaccaucauacucugcuuauuuuuaaaauuuuuugguagagaugaaguuucacuacguugcucaggcuggucucaaacucgugggcucaagugaucauccuggcuuugccucccuaagugcugguacuguucuuguucuucuaucuagcaauaagauauguuuuuuccauuacaugcaacuuuuaugucccugucuuacauuauuuaucauagaaguuggucauauuucuuaguaugaccaacuuauuucuuauuauauauuuuguauacaauuucuauuuugcauuacuguaaucaucuuuucuccucauuacauaaucaauggauuaggcuuuaggacuauuaaauuuuuuuuuuuuuuaagauggagucucgcucugucgcccaagcuggagugcaguagcgugaucucggcucacugcaaccucugccucccggguucucccaccucagccuccugaguagcugggauuacaggugcacgccaccaugcccggcuaauuuuuguauuuuuaguagagaugggguuucaccauguugguuggccaggcuggucucgaaccccugaccucaggcgauccgccugccuuggccucccaaagugcugggauuacaggcaugagccaucgugcccggccagaacuauugacuuuuguauauuuaauuuacauuuugccugugccuaauuuaaguuccuuauuaguucucauucuucaugaauaaugcuaauuucaauauuuaugcuucuuuuucauguguuccugauuuaacuaaaaauuccagaauaggccgggcacuguggcucaugccuauaaucccagcacuuugggaggccaagguggguggaucacuugagcccaggaguuccagaccagccuuggcaacauggcgaaaccccgucccuacaaaacuagcugguggugcuugcuugugaucucagcuaauugggaggauggccugagcucaggagguagaggcugcagugagccaugaucacaccacugcauuccagucugggagacagagcaggacccuaucucaaaaaacaaacaaacaaucuuuagaauguuuaaaaauuaagcaaguaggcuggacgcaguggcucacaucuacaaucccagcacuuugggaggccaaggcagguggaucacuugaggucaggaguuugagaccagccuggccaacaucacgaaaccacaucucuaccaaaaauacaaaaaaaugagcugggcgugguggcacgugccuguaaucccagcuauuugggagggugaggcaggagaaucgcuugaaccugggagguggagguugcagugagccgagauugugccacugcacuccagucugggugacagagcaagacuccaucuuaaaagaaaaaaaaaaagaaaaaaauuaagcuaaucaauaugaguaacaguaagaacuauuucaaaauaucuuaagugaaauacauaagauuauguuuagcauugaauuuuuacccuuaauagcuuuuuaaaauacugucuugugacuauaggucuuucugaaaugacucaacauuguuuuacuuaaaaacaaaacaaaacaaaaaccauucauauaaagcaaugagccaaaaauacccauuucuaaagugcauaaaaauagauaaggaaaagccgagcaugguggcacaaggcuguagccccagcuacuggggaagcuaaagugggaggcuuguuuggggccagguguccaaggcugcagugcacuaugaucacaucuguaaauagccacugcauuucaguuugggcagcauagugagaccuaucuuuaaaaaaaaaaaaaaagccaggcccaauggcucacgccuguaaucccaacaucccaacacuuuggggaggccaaggcaaauggaucgcuugagcccaggaguucgagaccagccugggcaauacagggagaccucaucucuaauaaguaaauaaaagaaagaaaaagauuaagaaaaaaggaagaaacaaagauaagaauaaaagguauggauaaccauuuaaaauuaugagacuggcugguugaagagcagaaucuuaagaaauaaaacaauccuuuaagaagcuuauuaaaauauaaauccucaggcuccagggauucugauguauaagucucaggauuuaaauuuuuaagaagcaccccagaugauucaguuguggguagccuacacugagaaccacuacucuccauccugugaggauguuagggaaaauguuaacagcauaauacaguuuuuuucagaugauauuuccaauucaucuuggauagcucaacuuuaauggugaguaugagccuaauuugauauauuuaaguguuacauacaaguuauauaauugcuuugcaaaaaaaguccaacuuagagaaugcucagcauuucaguuucaugaucuaagaacuguaauaagucuaaauagugagagucauucaauaauauauucauugcaauacagcgauuuggagaaaaauuuuaaaagagccaaauagaaauuauacacgcgauuuacaagcugcaaaagcucuuacauucagaaagacaaaaaccacuauaaaaguuuagaauggaaauauuuuagggaugagauagcuuaccuugagauaacuguguuuuuagagaucuuguauccuguguaaaggcagaaccaaccgcacuacuuugggguaagguaccacuguuugauguuucuguuccaaaggaugucaaagagcuuccagcuuaaagagauguuuuuaaaugauaaaaaaauuuuaaaaaauguuugacauuauucaaugauauaaaguaaugcagcauuuuaaugaugguaauugucuaccucuccccccagcaucuguacaaauuaauaaucuuggaaauuaaaguguacugaauaguuugggaauuuuauggcaauauggagggcaggggaagggggagccaauauacuguccacuauccuuggaugcaagcaauguuuauaacacauggagugcuguccuaggcaguuaugcagaugggacagcaaggacccauaccaacuagagaaguagcagaaaugguacauucaacaccaacauuaagguucagugauucuaauacuaaguaucuggacaaacagccaaaucagcagacagguuuacgaggagcuuuuuuagcauuuccaaggcaauagacaauggacucugguuucaaugcuuccccuuaagauaggacugugaggcugcauucugccuaaagcagcugcaaaaaguucuggcaauaugaguaaaaaggucccuagaaagggcccaauucucugccauacuagguuauaucaaauuucuucucuaaguuucuacaguacuuagggaucauucacuuuugauauacugugcucuuuccuugguauuucaucuaagcagguuuucacuauauuucaacaguaccucccccuuccacaaccucuaaauccaaccuaaagaugguagucagagugauucuuuacaaaauauaaauguaauaacauuaucgugcuuuagaccuucugguggcuuccacuguccucaagauaaaaguucaaacuauucacuucaguuaauaaaaccuaccucuucucucaacauuuucuauauuuucaccagucuagcccacagcagaaguuuauccuucugcuccuaaaacacaugaagauuacaaucaugccccuugcaauuugcucauuuucagguuagucaacuccagucccuucaaccauuacucacuucacauggucuuuaggacacucuccccuuccuuucuuggacuccuaauuuaaugaauucuauuuguucuuaucccucuuaaaauguggcuuuagggccgggcgcaguggcucacaccuguaaucccagcauuuugggaggccgaggugggcagaucacgagaucaggaguucaagacuggccugaccaguaugaugaaaccucgucucuacaaaaauucaaaaauuagcugggcgugguggcgcaugccugcagucccagcuacucaggaggcugagguaggaaaauugcuugaaccugggagguggagguugcaaugagccaauauugggccacugugcuccagccugggugacagagugagacucugucucaaaaaaaaaaaaaaaaauguggcuucagaaagcagcacaguaucuuagacaaggggagccacugggacucccuuggaggugcaguccagucuggcugcagcuccaguaagcucaggagaagccuaauacaacuucccacaauaucccgguaauguggggacuagcgcuuucaagaauucuguggggaguagaacccauccaguuauuucuaguauuccugggugaugaccaagacaucagccacuuugauguauauuugcaucuccaggcugcucuguguuuccucaccuggcuuggccucccauugcuuguccucuggauuacgcauucaaugguuagagcaaaucucuuccgugaguuccugaucgugccacaccccccucgcucuacuccaauucuacuaccaauuuaugucuauaaucuauuccaaauuauuuuuaauuuauaguuuaagccaggggucaaguuuuauuuuuuccacagauaaacagcugcugcaacaccucuuguuaaaacaaugucuuuucucuccauugaacugucuugguacucuguuuuaaguaucugagugggucuauuucuggauucucuauucuuuauuccuggucuguuaacgugguaaguuacaacugauuuucaaauguugcagcuucgcaguccugagauaaaucuuugucaucauauacaauccuucuucugaagugcuggcuucuacaucuaauaaacauuacuacguuuauguucaugggggacaaugaucuauaauuuucuuguaacgauccagucacaguugguauuucaguuauuuggccuugguuauagggucagcaaauauuuccucuuccuguauucucugaauuuucuuuuuuucuuuuugagauggagucuugcucugucgucaggcuggagugcaguggcgcgaucucagcuaacuguaaccuccgccuccugggcucaagcgauucuccugccucagccucccgagcagcugggacuacaggcgcgcgccaccaugcccaacuaauuuuuuuuuuuuuguauuuuuaguagagacaggguuucaccauguuggcugggcuggucucgaucuccugaccucgugaucugcccgccucggccucccaaagugcugggauuacagguuugagccaccguacccagucuuuuuuuacuuuuuaagagacaggguuuugcucuguugccuuggcuggagugcaguggcacaaucauggcucacugcagccuugaacuccugggcucaagagauccuucugcaucagccuccugaguuacugggacuacaggcaugcaucauggugcauagcuaucugaaagaguuuguguaagauuagugaaaauuauuucuucccuaaauguuugguagaauguaacaguaaaaacagucuagaauuuucuuucugggugauuuuaaauuacuguuucaauuucauuagaagauauagagauauugagauuuuauuuccucuuguguugguuugcuauuuuucaagaaauuugcccacuucauccaaacuaucacauuuguugacauucauauauucccauauuauucuuuuaaggucuauacugacgucuacucuuucauuccugguauuggcaacuugcuugguuguucuuucuuuccuuaaucaguuuuguuagggacuuaucaaucuuauaaaauaaaaauaaaaaauaaaaaaacccacccaaaacaaacucuugacuuugcugauaauauaaucuauuucuacuucauugauuucugcucuuaucuuuuuauuuucuucccccucuacuacuuuuggaauaauuuucuuucauuuuuuuuccuagcuguccccuggcguccucaccaacuuuucuuagagacauggucucacucugucacccaggcuagaaggcaguggcacaaucauaguucacugcaaccuugaacugcugggcucaaggaauccucccacuucagccucccaagcaguuaggacuaagggcauucaccaccaugcccagcuaaccauuuuuccuaguauuuuuuuuuuuuuuuuuuuuuuuuuuuuuugugagauggagucuuguucugucgcccacgcuggaguucaauggugugaucucggcucacugcaaccuccgccucccggguucaagcguuucuccugccucagccuccugaguagcugggauuacaggcaccugccaucauaccuggcuaauuuuuguauuuuuguagagaugggguuucaccauguuggccaggcuggucucgaacuccugaccucagguaaucugcccgccuugaccucccaaagugcugggauuacaggugggagacaccacaccuggcccuuuccuagcuucuuaaacugguagcuuaaagcacugauuuuaaaaauucuuauuuucuuuuccuuuuuauuugagacaaagucuugcccuguaacccaggcuggaguguagugacgucaucuuggcucacugcaaccucugccuccccagcucaagugauucuccugccuccgccucccaaauagcugggacuacaggcgcaugccaagacgccugaguaauuuuuguauuuuuaauagagacgaguuuuuaucacauugaccaggcuggucuugaacuccugaccucaagcgaucugcccaucucagccucccaaagugcugggaucauaggcaugagccauugcgcccagccgaaaauucuuguuuucuaauacauguauuuaaagcuaugaaaauuuuucuaaacacuguuuuagcuacacccacaaacuuucuggucauuaaauugaaaauaaaauuuuuuuaauuuaauuuuuucuuuuuagagaaaaggucuagcucugucgccuuuccuggagugcagcagcagaaucacagcucacugcagucuugaauuccugggcucaaucaagucucccaccccagccuccugagugcuaggacuacagguauguacaaccacacccagcuacuuaaauuuuuuuuuuuuuuuugcagagacaaggucucccuauguuccccaggcuggucuugaacuccuggccucaagugauccucccaccuuggccaccacccaaagugcugggauuacagguguaugcuaucacaucuggucuagauuuaaaauauucucuaauuucccuuguaaauucuccucugauccauuagugauuaacaaguuuacuugauaccaaauuaucuggggauuuuucaaguuaacuuuauuaauuucaaguuuauuuugugguuuaacaauauaccauguaugauuuuauuccuuuuggaauuuagugugacuuauuuuaugguccagcauuuggucuauauuguugagcaguucaugucuacuuaaaacaauauucugcaauuguuggguauacuguuuuauaaaaguuacacauuuaggacuguuguaucuucuugaugaacugauccuuaucuuuacgaagaacgcccccccaaccuuuaccucuggaagaaauccugaucuuuaagcuccuuugucugauauuaacguaugcuacacacuuuucuuguuauugcuguuuguaugguauaccuuuuucuauucuuucacuuucagugcauuucuuauaaacauaauauaguugggccuugucuuuuuuuuuuuuuuuuuaaauucagucugacacucucugccuuuuaacuggaauguuuaauuccuucacauuuuaccaaaguagaucuuuaacaaucuuucuuucuuuuuuuuuuuuuugagacagggucucgcucuguugcucaggcuggaguacaguggcaugauuucaacucacugcaaccuucaucuccuggguuccagggauucuccugccucagccuccugaguagcugggauuacaggcgcacgccaccaagcccggcucauuuuuuuuguauuuuuaguagagacaggguuucacuguguuggccaggcugauccugaacuccugaccucaaaugauucacucgucucagccucccaaagugcugggauuacaggcgugagccacugugccuggucugaucuuuaauaauccuuaguuuaacauccauaaugguugaaacaccccccuggcuuuaugcuaacuguaaaguucguaagcaucucuucaaggcuucaucacucagugauuaaaaauuagucucuacaaaacacuggagaccuaagagaaccauccuccaauaugguuuggcuauuuaaucaacuaaaauguacccacugauggucuauucagccaauacuccuccaucuggcacauaagauuaugagacuuaaacaaucaacuggaguaaauauaacagaaaaaacaucuaauugcuccauguuucuucacuguaauccuugcuauagaauuacuuuagauagcuggucaaucuauaccuuucacuguuucuaugaauccuuuuucuaacugcagcaguaagcucuugcuacuguucaaugguaacacagggaaauacuguuuugaugcuucauuuauugugagguguuuaauuuuuccaagaguucagaaauuaaggccaguaaugaucuaaucucuuacacauaagaauuauuuuugcaucaguuuuaagaaaaguccgccaggcgcgguggcucacgccuguaauccuagcacuuugggaggccgaggcgggcggaucacgaggucaggagaucgagaccauccuggcuaacacggugaaaccccgucucuacuaaaaaaaauacaaaaaauuacccgggcgugguggcgggcgucuguagucccagcuacuagggaggcugaggcaggagaauggcgugaaccagggagguggagcuugcagugagcggagaugcgccacugcacuccagccugggcagcaacagagugaguccuuuaauucuaccugguauauuauucuucucaauguaugagaguauauauucuucacauacuugccaagaguaugcauauaaucaagcuuuugaguuuuugccaaacugauagugagaaauggugucucaguguagauuuaauuuguauguuuuucacuauaagcaagauuuuuuuuuuuuuuuuugagacacagucuggcucuguuucccaagcuggagugcaguggcgugcucuugguucauugcaaccucuaccucucaggcucaagcaauccccccaccucagccucuggagcagcugggauuacaggagugugccaccaugcuugccuaauuuuuuuuuuuuuguagagccaggguuuagcuauguugcccaggcuggucuccaacuccugagcucaagcaauccuccugccauggccucccaaagugcuaacgucuuuguacuccaggcugggcagcagagcaggacucagucucaaaaacaaaacaaaacaaaacaaaacaaaaaccaaaccaaccaaccaaauggaaaaaaaaaaaaaaaaaaacuuacuaaaaagcaauaauaagggugggcauggugguucccaacacuuugggaggcggaggcaggcagacugaacccaggaguucgagaucagccuggauaacaugcugagaugcuguguuuaccaaaaauacaaaaauuagcugggcaugauggcacaugccuguagucccagcuacuagggagguugagaugggaggacugcuugagcccaggaggucuaggcugcagcgaccugugguugugccacuguacuccagccuggaugacagaaagagacccugucucaaaaaauaaauaaauaaaaauaaaaagcaauaguaauaacacacgaaaacguaaauauauaaaaauuuucucaucaaauagcaauacugugauccagauucauuuaaauuuccuuuuaaaaucagaauacuaggaaccaaaaaugaaaagaggccuagcuuaaaaugugguuuacuuugugccaacaaaagcuaaauuuggcugggcaugguggcucacgccuguaaucccagcacuuugggaggcugaggcgggcggaucaagaggucaggaguuugagaccagccugaccaacauggugaaacccugucucuacuaaaaauacaaaaauuagcugggcgugguggcacaugcuuguaaccgcagcuacucaggaggcugaggcaggagacucgcuugaacccgggaggagggggcugcagugagcugagaucgcaccacugcacucuagccugggugacagagcaagacgccaucucaaaaaacaagcuaaauuuaaguuaauuccuuuucugaaaaacaucugucaccuugaccaaugccacagcuuuccucuuccucauuugguaacuucuaacacuaguuuucuaauuagccacuccacaaauuauccuaaccaauauggaaaucaauuaaucaaaaauaaucugacccugcaaaaauuacucuacugacauggaaaaugccaguaaaaucuucuacuuuugugacacccaaguaauaaaccaacaacccacaauaauauuaaaauuagauuaaaauauuuauaaaagcauuucacaaccacaaaauacucugauuaaaaaguaaaccuugaagaauggcagaagcaauaguuacuauauagauacuacgugcuugauccuguucaaauuuuuuaacauaauuaguuacauaaacuucaugguaacauaagaaguauaaugaugaucucaaagucaguuaacuauuuaauuuagucaaaggagccucaaaaaggauaauacaauuugcaaucauuccuuacuugaauccccaggaaaggauucuaaguuacaguuaacauacaguauaucuugauuuaacaugaauaaauaacauugaucuuacuacuggauuuggaaauuuauggaccaaaguuacacuauuucaccuaaaguaagucuaaaaggaauuaauuuuuaauuaugaaaaaugucaaaccuauguuaaaauugaaggaguacacagaauaucaauauauuccucaccuagacucaucaacuguuaacaucuaaccaaacccacucuguuucuccaucuuuauaccuuaauauacacauuuuucuuuuguuuagagaggcuaaaaucaauuuggcccuuuuacuuuuaaauacuucaaaaccaccucccccaaacaaaaacacuuucccauaugauuaaccagaaaauuaacaauaauaacaaaauccaacaauuaguccauacucaaaaguuccuuaguagucccuaaaauguucuucacaccaacuuuuuaaguuuucuuuuucuccccugcaggaaacaaacacgccaacuuuuuaaaagcccaguauucgauucuauauuacauuuggauguuaugucucuucagucuuugccagccuaaagcaguucugcugccucucuccauucuuuguaauauugaaucuuuugaagaguguggauaacugucucgcaaaacaacccaccuucuggauauauaagcccauuucuucaaaauuagauucuguauuuucagcaagaaccccacaaaggugauauuauguuuugccccccaccccaaucaucacaacaggagacacauaauuguucauggcaaugcuaaacuugagcacucaacgaaguugguaaccaccagaugucuguguuacaaggguacauuuuucccccuuuguaaauugugggaugauacuuuaagaccaccuuaauaugcuguccuaacaccuuucacccaaugacuucagcaucuaaugauaauccucgcuaauuauuauacugagauuagaaaauggcaauuuucuuuaucuaccacugcuucuacuuauuagcaggcauuuuuauaugaaaaaaguaugucuuuuccuuuguuuuucaaugggcccuuguuccuuuuaguggggagugguauuuagaaacuaagagcugagucuacaugugucccuugcuacgggguuuccauuguuucuagguccuuucuacgaacagagcuaggaaauaaccaguuuuuaaaaaaugaguccauacacauaccaucuauuuacauucagcaccacaggguucuuucucaccuuucccauuccauauuuauaucuuccgucuccaugguaaaaacacuauuucccaacauaaguauuuuauucauuugcccuuuccuauaauacauacaaaacaguuuaagaauuaacaccuggcugggugcaguggcucacaccuguaaucccaacacuuuuggaggccaagaugggcggaucacucaaggucacaaguuugagaccagccuggaaaauauggggaaacccugucuccacaaaaaauacaaaagaaaaaucuagccgggagugguggugcaugccuauaaucccagcuacucgggagguugaggugggaggauggcuugagccugggaggcggagguugcaaugagccgggaucgugccacugcacuccagccugggugagagccagaucuuaucucaaaauaaauaaauaaauaaauaaauaauaacaccaauaauacaaaucaaagucaaguuuucuuaguaguucuauuuguuguuagaauauauccuacuaagaguguaaaaguuaccugaauuauuuuuuccucugugugguuuuuuuuguuguuuuauugagacggagucucacucugucgcccaggcuggagugcagugguacgaucuuggcucaccgcaagcuccgccuccuggguucacgccaugcuccugccucagccucccgaguagcuggaacuacaggcgcccaccaccacgcccggcuaauuuuuuuguauuuuuaguagagacggaguuucaccguguuagccaggauggucucgaucuccugaccucgugauccacacgccuuggccucccaaagugcugggauuacaggcguaagccaccgcacccagcccucugugugguuauauuaucaauuuaauauguaauagcaucugugguuucuguuuauauucauucaguuuuauuuauuuauuuauuuuuagacggaguuuugcuguuguggccuagacuggagugcaauggcacgaucucagcucacugcaaccucugccucacagguucaagcgauucuccuaccucagccucccuaguagccgggauuacaggcaugcaccaccaccacguccagcuaauuuuguauuuuuaguagagaugggguuucuccauguuggucaggcuggucuugaacuccugacuucaggugauccgcccacagccucccaaagugcugggauuacaggcgugagccaccgcgcccagcucauucaguuuuaguuugcuuuuuuuuugccauucuuuguuauuuugugaauaaguaaaacauuuaaauacuuaagucacaucuguauaaaaaguauauucacaggaaggaauuuaacaauuuuaauaaaacuuauuagcauaucaaugaguuucaagauacaccugaaacuaaauuuguggugcagugaaacaguaaacugauaauuauuucaaugaaauuuuaaaagauuaggggcaaaagcuugagauuuaaagcuguuuuuuuuuuuuuacacuugagcuuagccaaaaggcugagaagcgauuuuuuuuuaaaagcuguucuuuaccaugguuuaaacgcuaaaaugcauagcuauaaaaacaaaacacugagcuaaucugauuacauccagcuuuugcacucaauagcccuugacccuccagucauaagcaagccugucauucgcccagcccugcuauacauucucauuauaguuucguuucaaauccaguguuacagaaacaaaacaccaagcccucaaucaugcuaugcguaucuuuaugugugcaugucuuauguauguuuaaaauaaacauuuuuaaauguuuuaggccgggcuugguggcucacgccuguaaucccagcacuucgggaggcugagguggguggaucacuugaggucaggaguucgagaccagcuuggccaacauggugaaaccccaucucuacuaaaaauacaaaaaaauuggcugggagugguggcgcacaccuguaaucccagcuacucaggaggcugaggcaggagcacugcuuaagccugggagguggagguugcagugagcggagaucaugccacugcacucuagccugggcaacagagcaagacucugccucagaaaaaaaaaaaaaaaaaaaaaaagaaaaagaaauuaaaaagaaaaauuuauuaauuaaaauccaggccaggcgcaguggcucacaccuguaauccuagcacuuugggaggccgaagcagguggaucaccugaggucaggaguucaagaccugccuggccaacacagugaaacuccaccucuacugaaaauacaaaaauuagcuggguguggugaugcauaucguaaucucagcuaucugggaggcugaggcacgagaauugcuuaaacccacgagguggaaguuguagugagccaagauagugccacuggacuccagccugagugacagagugagacuuugucuuuaaaaaaaacaaaacaaaaccaauuaccaauaagauuugguagauauuggauauaccuaguauauccaauuugguagauuugguagauauuggauauaccuaguauauccauuuuuuuuuuaccuaguaaaaaaaaauguuacucugugaaagcugacuuuuaaaaacccacuaauaucaauaaaggcuuuaagauaucaucaaaauguguucugaauaccauaaaacaaaguuacaaaaggaacaucaaacaacauuucuaauaguugguguugaguuucuauaccuuugugguaaagaaaggaagaauacaaaaacaaaaaaagaaaagaaaaagaaaacauaccaacaccaacagcaccaaacugcugcccaacuaaggaacucggacugaacugacuguaugugggcauccugccgaaagguccauaagaacccauggacuggaaugaagaagucgaugagccuagugaggacugaaggaaaaucaugaguuauguuuccaagcucuaagcaacauguauauaacgaaaaaaaaaauuccagauuuuuacuuuuaagaaaacuauuaaauuauaacuacuagauauaaaaugaauuacaauaugcacuuaauauuaaaauagccaaacaaccuuuugauuucaguaucugucuauaaugugccaauuauacucaaugugacuuacaaauacuuuuuucuacaauaaacuccccauuugaauuaagaguuuuauagauugaggaaagaauuaaaguuacuuaaguaaaguaacuuugcuuaaagaaaaauaugagaaaaaucacacuuaguaauaaugaguuuuagucugauguugauauaaaucucacguaugauuuuacucuuauuuucaaucauuugaggccuacuauuaaauucacagacguagaaacaaacauaucccacauaaaaccauuuacauuuuuacuuauaguuacauuaagcugaggaacauuuuauaaaaacuuuaacuuaaaccuaaagcauauaaaauauauaacauauauuaauacauguauacuucauauauuaucuuacuauaaacuguuucauaauauaaacaugaaguguauuaaaggcuaccaggacauacacucacugauggcaggaccuuuucuguguguucaccacuaguguuaagcacaugccagauacucuguaaauacuacugaaugaaugaauaaggagaucaaguagaaguuuaugaugauuggaagaaguuauucaacaccauuuucauaugcgcucucuuaguuuuucuccuuccauaaaaccgauuacucaaauaacugguuuccuggagaauuaucaaaagccauauaaaagagacaguaagguaacuccaguguuugguguagggagcuaucucuauuaagaaugugucucuuccuucuccauuuaaagagauucacauuuccacuucaggcuuccuuucaccaaaauaagacuuaacaaggguagggguagaugagaguagagaauuucuccagcuuaugcugcaacaaaauuuacaauuccuuauuaaaaagcuuaaauugggagauuuaagagcugaucuaaauauguuaaaauacauugauguuuguguuuucuuauuauauaacauugcaggccaggcacaguggcucaugccuguaaucccagcacuuugggaggcugaggugggcggaucaccugaggucaguaguuugagaccaggcuggccaacauggugaaaccucaucucuacuaaaaauacaagaauuagccgggugugguggugcaugccuguaaucccagcuacucaggaggcugaggcagaagaaucacuugaaccugggaggcggagguuguagugagccgaguucacgccacuguacuccaacgacucugucaaaaaaaaaaaaaaagaaaaagaaaaacaaaacaaaaaccaacacugcauauuauaacauaugcagaacaaugugauuuugcuuuuuuuuccccauuaagccuaauaaucuuaccuaagaguagcuguuauugccuugguuugcaauauaaaccauaucucaauagcaugguagcacggauccuagauucugaagcaggcugccuggaucuguucaaauuguggcuccaucugaacuuccucacuuguuaaaagugagaauaauuauaguaccaaccucagaggguaucuuauaugcacagcacuucuacagaguagccuucaauguuagcuaugguaauuguuguugaaauuagaaaauauuucauaauaaauuccucagcuguuucuuaccuuaguucuaauuuaugauacaaagagaaaaaccuagaugagaacauuauccaguaauuucagguaucccaguaacuuggaaaugauaagcuacaugaacauucaacuagagagaaaaaagccaaggcuaacccugugcggaguuuaccuguacuccaagacaaauuuaccaucaguuaccugaacaauagcugggucuugaggcaaagaacacugugguuuugguggcucacaaacaguaaggucuuuaaugucacucccacggaauauaauguauucaaagacuucaucucgaggugguauuggacgaucugucggucugucuucuguaccaaaggaucgaacuggcaagaaaacaaaggauaugagaugugugacuacucaucacauucagguaguaccccagauucuaaauguuguauuucaaguacuaagcaguaguucugaaaugucugagaaaguauucauuaaucuauagcuaaaaaaguuuuuuuaaagaggaaaauagaguggcuuuugcccgaaguuaaauauaugcaauauaaaagacuaucuguauuaugagguuguguuccucuuauauuuuuauuuauuuguaucuuuagugguuguagugggguguuaaaauguccuuucauuauuuauuuauugaugagacugggucucuguccccuaggcuggagugcagugguguggucauggcuuccugcagccucagcuucccgggcucaggcgauccuucuaucucaaccucccacguagcugggaccacaggcaugugccacuaagcccagcuaacuuuuuuuauuuuuuaguagagaugaggucuugcuauuuugcacaggcuggucuugaacuccuggccucaagugaucuuccugcuuuagccucucaaugugcugggaugaaaggccuaagccacugugccuggcucacgguuaacuuauuuuuaauguccucauucgacaaaauaaaaauuagcaacccaugucuuucuuggggaaggagugggagacaaagauuccuccagucuacaaaaucucaaaguuuggguauugaccuuugggacacagagagcaaugaagguauuaauaacauuuaccuugcugagcaguaaguccucuagaagccaagucaagcagcugccagcuacucagccccaugggacagcuugaaauacccuaguuaccuaaaauaucuaccauauaauuaaaucugauuauuuuaacaaugaagacagcauuacucaaaguuaaacuggggaccaccugcaacacaguaaacuggcuacgaauaaagauuucuaccgaaucuuuuugcuggggacaggguccaaaaaucugcauuuuaagccaauuucuggcuaggcacaguggcucaugccuguaaucccagcacuaugggaggccaaggugggaggacugcuugagcccaggaguuugagaccagcccuagcaacacagugauguucugucucuacaaaaaaauaaacauuuuuaaaaauuagccaggugugguagugcaugccuguagucccagcuauaaggaggcugagguaugaggaucgcuugagccugggagauugaggcuguacugaagcguggcugcacugcagccugggugacacagcaagacccuauuucaaaauaaguaaauaaaauaaccaaauccccaaguuucuuauaaauacauaaguuucagguucauuguccugggagauuucugaaaaugucugcauccauacagaaguuccaaauagagaauaugaaacaucauauuucauuuaaagaguacccuaaaggaaguaaaccccuuaacauuucuauuuuuuuucuuuuuuuuugagauggaguuucauucuguugccccagcuggagugcagugacgcaaucuuggcucacuguaaccucugccucuuggguucaagcgacucuccugccucagccuccugagcagcugggauuacaggcgugugccaccaugcgcagcuaauuuuuguauuuuuuuuuagcggagaugggguuucacuauguuggccagacuggucuagaacuccugaccucaagugauccauccgcuucggcuucccaaagugcuggcaucacaggcgugagcuaccgcgccuggcccccuuaguauuuuuaaugcauacgcuuuuuuuuuuuuuuuuuuuuuuuuuuuuuuuuuuugcagaacugaugcagcgccucaugccugcaaucccagcacuuugggaggccaaggugggcagaucacuugaggucaggaguuugacaccggccucaacaaaauggugaaaccccaucucuacuaaaaauacaaaaaaucauuagcugggcauguuggcaugcaccuguaguccuagcugcucagguggcugaggcgggaggauuggcugaacucaagaggcagaaguugcagugagccaagauggcgcuccugcacuccagccugggugacagaaugacaaucugacuccaaaaaaaaaaaaaaaaaaaaaaacaacaaaaagaauguuauuucaguguaaauaauguccuacacucuuauucuaaaaguucuuucuaguacuuaugagacuuccaggaaagacaguggcacagguaguuuggcagaagauccuucccuaaaacuaaaggaaagaaacaaaaaggaaguuaaaauaucccuaaaaucaugacaaguucucaaacucauaccacgaaauuuuauuaaauaguaucauucagguacagaaugaguuaguugaaacugaaagaccaaccccagaauccauacguaaguauccucugcccucuccugccccccagagaaauuuugacuagcaucuucaacuugcuaagauggggacagggacugcggaaugcccuaccugaagcucccuuucucugauggccaaacaguacuuuagcaggcaggaggauuuuauauuuuuaccuuuauccaaaaggaaggauaaggaggagaaaggacuaauuacaaauaaaucaaucucaccccuaaccucaguaccaucaaaacaaauaaagucucaugcuuccaaaguagcagaugagaucauccugaagcagagagggaaaaagucaaaggcccuucuucuacaaaauuagagaagcucuauuaagcuuccuaaggccuaacagagcuuagccaggugaauucagagucaaguaaaaagagaaucugcauuucacguuuuggcaagcagcagguacugaaaggaccuacuaaagaaaaaaagaguagaaaaaucagggaaucaagaaaaauuuuacaggaaagauggaaagaagggaagaaaagagggaaaggagggaggcaaugauggaaggaaagaaaaagguguaucaaaauaaagaaaaaaggcaguaaagaagaagagaagaaucaaagaggacacggucuucauuuacuuauuuuguuuuuuuuuccauuaccagcaguuugcccugauaggacacagucuucaaaagguagaugaaauacauucaguauuaguauuuaucacagaaaauagaagaaauuuucugaaacaacugcuucgacauucacaagaaaaacagauagcauagacuuuuaugaucaaaacaacauugaaaggguagcaugcagaauuaaggaaagaaaauuacacaagauaaauaaaacagcauaacuaauaaaugcaacaacagucaaugcagcaaaaccaaaucacuagaagagaauaauuuugagaaaagguaaacaagaugucaugaaaaaguacuacagcauuaaaaagguuagagagaagaugauaguuaugaagauccaacaguuaacugcugccccugagauagacaaaagaauaagaaaaauauaauuaaagauauaacagaauagaaaugucuuaacaugaaggccuaaauuucaucaaaagcuuucacuguauuuccagaaaaaaacaaaacaaacaaacaaaaaacagaccacuacaagccacagagacuuaugcuuugguauaucaaaauaacucaaaaaaaguguuaucuaaagauaagaaauggacaauaaauucauuucaacacagaagucuacaugacaauuuacuuugguucuagaauagaaauaguucuggaaaagacuacaaaguuacaaaguguaacaaacuaagaacaguauaucacaacauuuuaacaaaaauugggagauuaaaaugaauggagagagaggaaacucaacagacaguaguaguaucuaaacuuacacuuucaucucucaucaugucaaguaggagucacuugauacacuuuuuuuuuuuuuggcuaguugauaauaagcgaaggcuuuaaaauuuuuuauuugaaagaauuuguuaaauucuacuaugggucuuggaaauaacccauaguagaauuuaaaacuaagagcauacuuuccaaaauauggucugaagaaaaccucuaucauauggcaaaugaagcaaacugaaaaagcaugaaaauagaaaucacagaauaagaaugauuugcacacaccaagaguuugagaaacaugcucuaaugauggaggcuggcuuaauaagauuugggguuuucaaugcaauagaauucuuguaguauugugaagaacaaauuccacaagagagauuagaagggcacacguggcuagaagauacuguuacagaacaaaugagaagucuggaagauuaaaacuugaacauuaacaguagaaaggaaggaggcaugauaagcacagaaaagguaaagaacuacuggaacuauucuacuacaacacauacauuagcucauaugcaaucaguaaauaagggaauuaugucaguacauucagaaaucacauugguucauuuccaauuuuuccuaaaauguuauuuaguuuuugcauuugcagguaacaacaguuaaauacagcuagcccugaguagugccaccacuucuggucaccuuuacuguuuuuaaagggaaaguucuaaauuuaccaaauuauuuguuuaaaaauuuuaacuuaucuuuaagcacacuacuaucuuuuuauuagguuuacauuagugcuuaaauuacaaagaugcacagauuucaaauggucugcuccuaauccuaguuuucccauaaacccuguuccucuuagugcaggaaggcauaccucagauuacagcacaaaugccuuugucuggcuggcaaaaucugaacuauguucuaaucauuuuuuuuuucauucauaacacguaguacuuugagaaagaacauuguuauucuaguauucauuuugggauucuacagcaacuacacauuccaauguaaauacccauagguaaugugacuggaguuuuaagcugaacauaggugccguaugucauugcauuucaucccauuucuuucaaauacuugcugggcaccaccugucccagguacuaugcuagaugcuagggaaaccaguuccuauucucaaggagcucagucuauuugcuuacuuggauuugauaucacugaauuggauuugaagguccacuaaacacuaaauaccacuugcaaugccucuaauaaguacuacuauugguuuccugacaucuuaaucucugaagcugacacagcauuaggcuucaaaguaagccauacuacuacuauuaaguaguauuauguagcugaauagauacugaucugauucugggauauuuuggggauuaucaugaauuaacgaaaauguagugauucagcaggcuuagaauauuuaaguaauauuaggcaggcauuauauuuauguccccacccucagggaaguuacaguccagcaagugggcuaagcacuacacuggaaauaaagcacacaauauaguuugcuagggcugccaaaacaaaguaccagagauuauauuauguucacacagaaacuuguauacaaauguuuauaucagcauuauucaaaacagccaaaugguagaaacaacccaaaugcccaucaacaaaagacaaauuaugaucucuauauaucuuauauauaugauauauauauuuaaaaauacauguaaugaaauauuauucagccauaaaaaaaccacaaugcugauacauguuacaucaagagugaagcgugaaagcauuaugcugaguaaaagaagcuagacacaaaacgucacacaguguaugauuccuuuuacauaauauauccgaaauaggaaaaaccauggagacagaaagcagguuaguggucaacaggguaugggggaaaugaagagggauuacuuaaugccuagggguauuuuaguaggaugauggaaaguuuugaaacuaaggagaggugguaguugcacaacacugugacuacacuaagugccacugaauuguacacaauauaaugguuaauugcauguaaugugaauuuucaacuucaaacacacaugugcgcacacaccuacaaauacagccuacaagagaauacagagaaugacaaaaguaguuggggagaauggggaaacuaggggugguuguccucuacauuuuaaacuucaucaugcugcuacauugcccuaauaauuuuuucuuucuuuuuuugagacagcgucccuucucugucauccaguccagguuggagggcaguggugccaucucggcucacugcaacuuuuaccucccaagcucaagcuauccucccaccucagucucuugaguagcuagaacuacaggcacacacacuacaccuggcuaauuuuuguauuuuuuguagagauaggauuucgccauguugcccagguuggucuccaacuccugggcucaagcgauccauccaccacagccucccaaagugcuggaauuacauacaggugugagccaugaugcccagcuaauaauuuuauuagucuuaaaauagaaucaauuuuauauuucuagcuugaaauaacaccaaagauuuauuaauagaaaugcaucacaugcauuaaaaaaacaaacaacaacaacaacaacaaaacagggucaaauuauuuggcaaaaucacucaucuaauccagucuccagauuuaguuaagcucaaacaucauccuaaugccaaacugguuguuaguguauauaauacuuguauauaaaaucauaguacaaggccagagaaauaaguuguagugacaaacuucccaauacaauaccuccauuauaaaauaccaaaaauguucuaaauuuaagcaugauaaacauuauauacuuaaaauacauaguuaagugaagcuaguacccuccaaaugacacuauuaacauuuuccaggcugggcaugguggcucacacuuguagucucagcgcuuugggagggcaaggugggcagaucaccugagguugggaguuugagcccagccuagccaacauggugaaaccucugucucuaauuuaagaaaaaacaaaaacaaaaauuagccgguugugguggcacacgccuguaaucccagcuacuugggaggcugaggcaugagaauugccugaaccccagaagcggagguugcagugaguuaugaucacaccacuacacuacagccucagcaacagaguaagacugucucaaaagaaaaaaaaaaaaauuucccaaagccugaacuuuuuuuuuuuuuuugagaccgagucuuggucuguugcuuaggcuggagugcaguggcgcgaucucgucucaccgcaaccucugcuuccuggguucaaguaauucuccugccucagccuccugaguaacuggaacuacaggugugcaccacuacgcccaggcuaauguuuguauuuuuuuuuuuuuaaauuagagacuggguuucaccauguuggccaggauggucucgaucuccugaccuuaugaucugcccgccuuggacucccaaagaguugggaugacaggugugagccaccacacccggccugaacuuuuuuuugacaugaacuaaaaauuguaaauuagacucuaauguuaacugaaaagaaaaagaaacgagucuguugaauaccaaaauuugagagcaacaaaugaaacacugaaauauccaaaagacgcuuacaaaguuaagaaacuaaaaccagguucaaaugaaaacuuagaauaagauuuaugauguaaaguuaaaacucuucaguccuguaucagcuccaagaccuggucccagcauacucaaacuuaaauucuaacaaagcucauuauucucaguucacagaucagguuuucuguccucuauuuuucucucucccccuauccuaaauuucaacuugaagauuccagguaucggucagguuuuauagagaaacagaauaaaucagaugugcauauacaaacacagaaagagacuuaaggaauuggcccaagggauuaaggaggccugguaaauccaaaaucugcagagcaggcuggcagaacuccuugcucaggggucagucuuuguucuauuaaaggccuuccacugacuggaugaggcccacccacagauggaggcuacucacaaucuaccaacuuaaauguuaaucucauacaaaaaauacuuaaacagaaacaucgaaaauauuugaucaaauaucuaggcacuguggcccagucaaguuggcacauaaaauuagccaucacccaacuccaccugggcugaaauaaucuguucuuccuuugaaaaccacacagcauucuaucauucugucuauacuacccuucuagaauuuaaagaucuggagaaagaucuguaucuagaucaucuuugcaacucccacagaaucuaacacagugcucuacauauagcugacauuugaauauuucuugaauaaaucacacagcagaaaaagcuauuaaguaagcuacuuccaaaguacugaacaguguuuaauaccaagggaacugaauuaaauuauaaaagaaacucacuuaggauaaaaugaaagaaugauuguuuagaguaaauaacaacugauguugauagaaugggaaagugggaaaaacaaacccaaccucagcauauuuaagaacagucuacaugcaaaagcagcaaaccaggaaaccaaaaaguuacaguuaguauuuuucuucucuuucugacauuuauauauauguacagcucuuguccauucggugccauacacaaacucuugcugaaacuaucugagauacagaaacuaucugagauauguuggaauaagguauuauauauggauuuaauacaacaaggaagguuuaauuacuuaaauacuaaaaagcaccaccucuucuacaacgcaguacucuugcucaggcccugaagguagcaugguagaaaggugacucuggguuuuuuacuuaagagcagagcuuuacaaaaauaagauucgacaguccagcucuuggaaccacaucacggccugcuuccacaaacucucacuuuuugcacaucugcacucucuucucuggccccuucuucacccuuacccacacuacuuucuuccuguuagcaaauauuacugcacugaaugaaaacaucugucccucagccuccaccaucucuuccugaacccacuacgaacuuaacaccccuaacagaggcauuacuccugcccuugugucugcaauauucucgaucaccucacagaucacaugccaagcacuggcgacccaaugacaaaaaacuaccuccacuuccagaggucauaacccagaugacguuccuugcaccuucugcaauauauucucaaaaucaacuucuucgcacuuaacucuagagguuacaucaucuucgacugaaaaaaccccaaagccaucuuguuaagagcccaucuuguccuuauaaaaccaaaaaggcaauuugaaauuuuagagagugauguaauaacaaaacaauacuggcuccuuagaagguuuauuacaaagcaaaacacauuuacaaaggaucucucuuauguaacugaacauaacagauagccuuaacaucuuccuagauagccucuacauguggcuaauucuaacucaucugucaggccccagcuuaaauguuguguccucaagaaccuugucucugacgaaaaacaaaaacaaaaaacaaaaaagcccccucaguuuuaucuaagucaacauugcuaauaaaacugcucuuaagggauucuaaaaauagaagcaauguaauaauaacaaucuguaaccuaaaccccaaauuagauaaaaccuggaaaaugggacaaagggagaaaagugaaaagauauguuaaaacuuuuaacuuaggcauaagcaaagguagcuuguauuuaucugggucuuggaaaauuaaagacaucuaugaacccucuccccaaauguuucuguauguaaauaaaaauugcuuauaacuucaggggaucaagacucccugaaaucuaccaugaacuccauguaaugaaucuauuauagauaauggcuaauuacuccaauugauaauugauauagagaaauacaguuguuugaaauuuaagguuucuaaaaaugcaagaauguuuuaauauuaggaaaucaauuuaauaauuuacauauuaaaagcaaaggaaaggcugggcgcaguggcucaugccuauaauuccagcacuuuggaaggccgaggcagguggaucaccugaggucaggaguucgagaccagccuggccaacauggugaaaccccgucucuuaaaaauacaaaaauuagcuggcaugguggugcaugccugucaucccagcuacucaggaggcugagguaggagaaucacuugaacccgggaggcagaagcugcagugagccaagauugcgccauugcacuccagccugggugacaacuguaaaacuccgucucaaaaaaaaaaaaaaaaagcaaaggaaagucuagaaaagaaaguagaucagagguugccuaggacugggggucguaggcagcuacugacuaaacaucaacaaagaagcuucuugaguugauggaauuguuagaaaacuggacuguggugauggauacacaacuuucacgggaccgcacacuuacagugggugaauuuuauaguauuguaacuuauacccaauaaaguuaaaaguuaauaaguuaaacuuauaacccaaaacuuacacccuucaucccaauuacuucaaucuucuaguuuccauugugccuguugaugucaacuccugagccuuuuaggaguuuggggugaaagucaaguuacaucuuggcuuuucccacugacuacuuagguugcggcucucaacuuugcuaagucauuuaaacucaucuauuugcuuuucagccuuccaaacuguguugauguugucuccuuuccaaaucuguuuuguccuuuauggguuuauuuauuuauuuauuuuuuuuuugagacgaacucgcucugucacccagacuggagugcaauagcacgaucucagcucacuguaaccucugccuccuggguucaagcgauucuccugccccagcuucccaaguagcugggauuacaggugcacaacaccacgacuggcuaauuuuuguauuuuuaguagagacgggguuucaccauguuggucaggcugaucucgaacuccugaccucguaauccgcccgccucggccucccaaagugcugggauuacaggcgugagccacugcgcccggccggguuuauguauuuuuuaaaagucccucucacguaguuuugauaggauuuaucaacaggaaggaaaaguaaaagcauguccaguuugcuaucuuuacccaaugguuuaaauuuaauguugacucucuaagcugcuuucaguugggcauucuuccuuauggcuguuuuuauauuuuaaucuccaaaugauaaaaccaagagacagauaugaaaauaugauauaagagugaaaaagcaggguggaggauaaacgcauccaugaggaauuaaaaacaacaauaacaaggcuggggagcaggaggcaagauagaaauuaucugagauggagcuagaaagaggagggggagaggggagggagggcgugucagagguagagagaaugaauggauuucuuagauuuaaagagaguugacucuuuuuuuuuuuuuuugagauggagucucacugucgcuuaggcuggagugcacugguauaaucuuggcucacugcaagcuccgccucccggguucacaccauucuccugccucagccucccuaagagcugggacuacaggugccugccaccacacuuggcuuuuuuuuuuuuuuuuguauuuuuaguagagacgggguuucaccauguuagccaggauggucucaaucuccugaccuugugaucugcccgccuuggccucccaaaguguuaggauuacaggcaugagccaccgcgcccggccgagaguugacucuucagauucacaagguccacagagaaacacucagaggaaaaaucaaaccaaaccaaaaaacaaacaaacaacaacaaaccagugugaucacauuugugaauuccaggaauagagaauucuaaauaaaagcuuccagagagaaaagugacugagagucagacuggcaucagcaaccccagaauauuagaagaacaaaaagcaguaacuucaaaguuccacagaaaaaagacucuuaauuuggaaauacauagccaaccaaccagucaagcacaagaaaacauagguucacuaagaaaauuugucaccuacauuucccauauauuuuauuuuuuaauuacaaagauucacucaaguaaaauugggaggaggagaaagaaucaacugagaggucaauauuggaaacaagaaacaggaaucugaguaucucugaauagacuagugagagauaauggaccaggguaguagggguggucagaggucaaauucugcaucuaguuugaaagcagagcugauagguucggaucacaugaggugagacagagagagaggaauuaaggauggcuccaagguguuuuggucuuaccaacuagaauagagcugucauuugauuagauggggaaggcugauggaggaacagguuuggagcaugcugaauugagauucuagcagacuucccuacaaguagagauguuaaagaggcaauggauauacaagucaggaguucagaggagaaauucaggcuagagauaggagucagugauauacagguaguauuugaaaccaggaacuagauggaugagaucaucaaaagaaugcagaugauuaaauaaauguuaacagacagagagaaaaggggagauaacugagcccuggagcucucccaacauuuggcggcuuacagguucaaucagccaaggagauugagagguaaccagugagauaugaggaaaaaaauggcauacgaucaaguuaagaaaaugcuucacagagaacagacuaacuguaccacguaaugcugacuggugaaguagaaugagacuaagaacuaacuacuggauuugguaacauggaaaucuuugguaauuuugauaagaaaacuucauauguaggaauaaaaaccuuaguaaacagggcucaaaaaugaaugaacaccagugguguagacaacuucuucaagggguuucgcuauaaagggaaggauagaaaugggguaaucauuagaaaagaggaaauucaguucaaguacagugggguuuuuugguuguucuuaagguagaagaaauaacugccuaucuguaagcagacagaaagauacguuagggaaggaaaaacugaggagaguagagaacugcuggagcaauguucuugaaucaccaagaggggacaaaugcugcacaaguggaaggguggucuuagacagaaauaagaacaguuuauccauauugaucagaaaaaaacauagaagucuggggaacagaugcagguaacuggguaugugagggguaaguuuaucaaaauuaucuuucguuugcuguucuuuucucaguuaacugcuauagaaagcacgguuaaggggcugaaagugaauaugggggagguguuggaggcuugaggaaaaugaauggaauagccauguagaaaagugaaauggauuauggaaguauagugugacugcuaggaagugaccaugacugcggaggcuagcgaacauaaauuuagagugaggcuggucagcacaucuguguugauauaaucaggguugugauuucuuguauaagacagcaagaggggaauggggugggggcugagggaauguguacugacugucgugguugcucauggaguugaagcaggauaaagaaggaaguaaaguuaugaggggaaugagaggacagugaaaggcaguaagaugacaguagacuacaguaggugugaaugacugacugaguugggcuacuagagagacugagcaccuagacagagagggagaucguggugggaaauaacaugggacagcuauucucuauuaagcaccaacauuaaacuaguuacuucuuuuauaucaccucauuuaauuaucagaaugacucugaaagaugggcauuauuauccaucccuauugaaaagaugaagaaguuaaagcuaagguuaaauaacuuguccaagaccaaaaagcugcuaaguauuccaacuggcauuuugggucgcauuuucuuccagaaaaaaacaaacaaacaaaaaacccuacaaaacuagaauaaggcccuugggaauaaauuauuuuacagaccaacucacacuuuguccacuaaaaaacuuacuucaagccagacacuguggcucacaccuguaaucccagcacuuugggaggccaaggcaggcagaucacuugagcccaggaguuagagaccgaccugggcagcauggcaaaacccuguaucuacaaaaaacagaaaauuagcugggugugguggugugugccuguggucccagcuacuugggaggcugaggcaggaggauuaccugagcccagggaggucaaggcugugaucgugccacugcacuccagccugggcaacagagugagacucuugucucaaaacaacaacaacaaaauuuacuucaaugguaucuaguuuuuaaaacagcuaauuaauauauuauuuuauagcaucaugagagaaagacaaauuguuucuauagcaagcaucuucuagcacggaauaauuaaauucaaguuaaacuaucuguaguuacugcuauuauuacuguggcacugaguuaaauacaaaacuccugcuauguaucaugcacagauaagauuucuuuuuucuuccuacuuccuuccuucuacuauuuuuuuucuucaguuuuaugcuguuuucuuuacuuccgacuuagaaaaucauggcuuaccuuacuuaccccuacuagaaaaugaacaguuucuggcaccugacuucagacucccagaauuaccaaguauuucugcggacuauguaacaauaauaaacuguuuccaaggcuccaaguacuggcaacaucacuaaauagggcaacaaaaagaaacuguggcuugaaguuucacuagaucuuugucauuuuagauaguaauuuugugaauugcuagauuuagauccccaaguaaugcaagaaaucaaauaaagcaccccgcaaguauuuuauccaucacacaaagcucuuccacucucuccaauaagguaauaguuuaugacuaugugacuaacaucaagaaguagauaaauuaugccaaugagccagacuuagcagaugauuaaagaaaucuguuaacaauuuacuuguuuuucuauucuuccaccaaucucuugauuuuaagaacaacuuauuuuaaaggcaaguggcuuauauaaucguucuucauaaagucucuuuucccagugcaguagcaaccugguuuccauuugaaugauuauccagguaagcuaacuaaauguaagaauuuauuuuuuauaagaauuucauucauuuuagccuauuuaggcauccuacucacuuauagacguaggugcaaacacaacuggaacuauuccauaaaauauucauacaugucaccacuguguaauuucuuccuacacccugaauggaggcuuccuuuaaacuuuaaaugaaaauuauaauugagcuugagucacaaagaguuuaccuccccaauaauguuaauuaugucacuagauuucauccucuugcaucccuacucacugaaauucuucaagauuucuuaaugugaggcaggauaauuuaauuuuauagggaaaugcaauugugaacauggaaaagcauuauuuggagguauacccaagauacuucuacaagaacaauaagcuaaaaugcuaaaucauuuccauuuacucacuaacuaaacaaccuuucauaccaggagcucagagucuggaggugaaggggaaggugaagacagacaauaaacacauaugcaaauaagcaaagaagauuaaguguaagucaugaucagugcugagaagaaaauaaauucagagcugugacacagacuacaaacugcaacaaacugcagaaacaaacugcaacacagaucaucuauaaacauacauagcagauugacaucaaagccuuucuagguugccuuuaugacuucuugacauaugcuuagguuccgaggaucaaagccccucaaacuuaccuguuucacuuucuagaacuaaagcuagucugugacaucucuagcagaaaauaaggcacaucgaccauuucacagcaccucugcaauuaggcuuuugauuauguggugugauaacuuauccacacugaaacauuuucaaaagagaaaacagauuauuauuauuauuuuguguuuuuuuuuuuuuugagacagagucucgcucuguugcccaggcuagaguacaguggugugaucuuggcucacucuaaccuccgccuuucagguucaagcaauucuccugccucagccucucaaguagcugggauuacagacaugcaccagcacgcccagauaauuuuuguauuuuuaguagagacgggguuucgccauguuggccagacuggucucgagcuucugacuucaggugauucgccugccucagcuuccugaagugcugggauuacaggcuaucauuguuauuuuuuaagacaaggucuuguucuauguuucaggcuggagugcaguggcaugaucacagcuccucuugggcucaagcaaucccccugccucagccucccaaguggcugggacgacagacaugcaugccaccaugcuuggcuaaugcacuuuuuaaaauuuuuuguagaaauggagucucccuguauugccgaggcugguuuugaacuccugggcucaagcaauaccccggccuugaccuuuuggaaauguugggauuacaggccugagucacccugcccagccgggauguuuuuaauaauuaugccagagcaggcacaaacaaggacuuuccaccagggcaaacuaggccauaugguuacccuaauuauauaccacaucaaauguaaauagccaaaaauuucaagaguaguuuauaguuccagauauauuuaaauuauaauauccaagcccuaaauuauaauauggacaauauaaaccaagugaaucccuuacuaaauauaaagcucugaauaucucacauuguacacaaaaucaauuucagaugcauuauaaacgucaaugugaaaaagcaaagcacaaaaagguuuaaagauaaucaaaguaucucuaugauguuuuaaaaaaagaaacacuagccauaaaaaacugaugaacauguuuacauuaaaaugaagaacuucuguuaauuuaaagaaacuacuaaauggaaaaaauguuugcaauauauacauccaacaauggagauauauucagaauacagaacucuagaaaaagacguguuucgauuuaaaaaaggaaaagauuucaaaggcauuuuaugaaaaaugaaauccaaacacccagauaugaaaagcuggucagccccauuuaguaaugagggaaaugauuaaaacuaaauacaacuacauacccaccaggauuggcuagaauugaaauauaugauaccacguacgguuguugguaagggauaugaaacaagaacucuuacauacuaauaaaugaaguaaaaaccacuaaacaacuacuuugaaaaacuaccuggcauuaccugauaaagaccaacauuccccauguucuugcaauucaaauucuaaguauauaaucucaagaaaacgaaauaaacaugcaccagugcacuuaaacagaaauguucauaaaagcauuguuuauaauagccccaaacugcaaacaaucuaaaugcaauauccaaaacaauggcagaaggaauaaacuuguguuauauucaugauggaauauuaugaaacaauaaaagcuaaaaauaaaauauauacaacacaauccuauuuacauaaaguuaaaaaugggcaaaauuaaacucuauuauuuagagauguaaacuuauaugguaaaacuauaaaugucagaagaacauuuauaucuagcuuaaauuaagauggugauaguugugaugggaaaauauagguggugggaggcuucugggaugcuggcaaugucugucuugcccuggguggugguuacaaagauguuuguuuaaaaauauuucauuuuuaucuuauguaucuuuucagccuguguaguuagguuucccaauaacacucucccugagaaauuaaaaaaaaaaaaguucaaaagagaaugcuaagacuguuacucaaagagauuaacucuuaauccauaguuuaaaaacaguaacagggaucucuacauccaaauacacacuguauuauaaauuccaugaauaaacuuuuggcuucaggccgggugcagugccucacaccuguaaucccagcacuuugggaggccaagguggguggaucaucugaggucaggaguuugagaccagccuggccaacauggugaaaccccgucucuacucaaaauacaaaaauuagccagcuguguugggcgccuguagucccagcuacucggaaggcuguggcagaacugcuugaacccgggagguggaggcugcagcgagccaagaucgcaccacugcacuccagccugggcaagagcaagacucugucucaaaacaacaacaaaaaaaaacgaaaacaaaacaaaacaaacacuuuuggcuuuaaucuuuuagacuaccauucuucguucaaauuuugaaauggaaggugaaauuuucugauaucgaauuacucaacaagucauguaaauuuuaaaauuuuaagauugaacuccuugcuucuaaucuugaaaucugaaauguguccaguauugacuagacaguuauaauguaguuuucgauuagauaauaucauguagacuaauauauaaagguuugauaaugucaguuuuugcgaacauaaucaaauuccccaaacugguuacacauuuaacucauguugcuuaagaaaaagcagccgggugcgguggcucaugccuguaaucccggcauucugggaggcugaggcagguggaucacuugaggucaggaguucaagaccagccuggccaauauggugaaagccugucucaacuaaaaaauacaaaaauuagccaagcgugguggcacgcgccaguaaucccagcuacucaggaggcugaggcaggagaauugcuugaacuuggaaggcagagguuacagggagccaggauugugccacugcacuccggccugggcaacagagugagacgccaucucaaaaagaaaaaaaaaaaagaaaaagaaaaagcauauaaugaugugggaugaaauaucaaagccaugaguacaaacauaaauucaaugauuaaaaaaauuuuucacugcuauauucauauauuuaucaagucaugacacaaagaacaaauuuauauuuuaugucauuaugucauaugaauuuaacuauuacagacuaaugaaauacugacucuaaaagcugcugaaaaguuuuuuaaaauguggguuguuaaaauguagacuuuugggguuccugcauaaaaggauauguucguaguuuuuaaaaaagaacaaaaauacuuuaaaauuuucaaauguauuuuuuuucuuugugaggaauaaagguaacacagccaacuuauugagucacuaagcuggcaagacacuuuuaaauucagauuagguaaagcaauacuuuaaaacaaauuuauuaaaccacuuuaaugagaaauuauuuucaacccauaucuggcucucacccagcacuuuucauaauuucauaaagagaggcuuuuucauaauuucaaaaagccagaaaaacacuauacagcuaaguaacuauuguauaaaaaauauaaaaauaaauucaaaauaaggccaagcaaaaacuaaguuacuuaagaagcaucacugggaaagucuuuaauaaacaccaaauaccauccaucauacauccuauagccgauuucuaaccgccaagucuacagguguuuuaaugagguaaugugucacugcauaauguuucacaaggugaagagggaaauguggggguacucccugguuuuucauacuacuuuuaaaauuagacuuggugauuuuaaaaaguguauaauucaaugaucuucagcaaauuugcagaguugugcaacuaucaccaucucauacuacuccuuuaugguguacaguucuguaacaucaaaagguucccuacccagguauaagauuugucccaacaccagggcuauuaaaaagauuuaccagaggcugggcgcgguggcucaugccuguaaucccagcacuuuggguggccgaggcggguggaucaccugaggucaggaguucgagaccagccuggccaacauggugaaaccccgucucuacuaaaaauaccaaauuagcuaggggugguggcaggcgccuauaaucccagcuacuugggaggcugaggcaggagaaucacuugaacccgggaggcggacguugcagugagccgaaaucauugccuuugcacuccagccugagcaaaaagagcuaaacuccaucuuagaaaaauaaauaaauaaauaaauaaauaaaggauuuaccagagcauccaagaaauauuauuaaauacuugaucccgugaaaccacuccccuaucuguuaacgauuuuuaaaauuuuacagauuucgaaaaucuucuucuuuauccuuggaccuaaccuauccacagggucccuaaccaugcuaugcaguucccaccucuaccagaagugcugggaaaaucaccuagguuaucuagcuucccucaaaguauuuuacacuguugugagauuuccuuuaagauucaggagcuaaaguuuauuuucuuucugguuuccuggcggagcaaaggcccugcacgugugaacggaaacaaaacccacacagacucuagggaugccaaauauuaacacuguggguaggggcaccuuccuucucggccgaauucccuuucccagagagccuccagagggaucagucaacgcccacugagccuggaucaaaggucaagcuugccuggucaagaaggauccuggaucaagcuugaacccguuuccagaaacaggggcgucggggcagcagcaagcauuuuuaccacgcgcccuaaugaggugguugcacaacaggcuuugaggauuccgguuuaacagguaaauaccaacagaggaugagccgagggagaugggaucugcuccacggcaucgauggcauuucgagaaugucugcgucgcagagcaaacccaaaguuuuagcacauuacucaagaguucaccagaggaagaucgccacgaauugaaaugaacaaagugagaaaaugggugcuguguagucaacgcauccgcgaugaacucaagcugggcggaaaaauucuuugaauacuccggcuuuguuuugugcuaagacggcagaagccccgaauuucggaguuggaagacgcguuucuccguguucuccggcccguucucggacuucagggccgcccgccgcgcacucagucccguaguuccccgggcuucaggcgcggacauuccggggggcggaaaccagggagccgcggggaggccgcgguccggcccgcgacgccggggcccggagaagggaggcgagaggccucccggagcucgacggagggaggggagggaacgaggaggccgcgggccggagcggggagcagccccgagcggcgcccggcucggcccccacccugaggcccggucccgcguaccuuuggcaagggcuacgguggaguuuucggugucgaugguguagaggaugcccucguagcggaucuccgccuuggagaugaggcugaucuugcugccgauguaaggggugcccccgcucauggcgccgccgccgccgcucccagcugcucgcagagaggcagaucccacgccacugucgcccgcuccgcacgcccgcucgcuccgucggcgccuacagcagccgcuucagacccaacauggcggcggcgccggcuccgcuacccucccccagccucccgcccucaagccgcggcgcggcggcggcggcggcggcggc

SEQ ID NO: 191752 - RNA, 57069 nt, Homo sapiens
gccgccgccgccgccgccgccgcgccgcggcuugagggcgggaggcugggggaggguagcggagccggcgccgccgccauguugggucugaagcggcugcuguaggcgccgacggagcgagcgggcgugcggagcgggcgacaguggcgugggaucugccucucugcgagcagcugggagcggcggcggcggcgccaugagcgggggcaccccuuacaucggcagcaagaucagccucaucuccaaggcggagauccgcuacgagggcauccucuacaccaucgacaccgaaaacuccaccguagcccuugccaaagguacgcgggaccgggccucagggugggggccgagccgggcgccgcucggggcugcuccccgcuccggcccgcggccuccucguucccuccccucccuccgucgagcuccgggaggccucucgccucccuucuccgggccccggcgucgcgggccggaccgcggccuccccgcggcucccugguuuccgccccccggaauguccgcgccugaagcccggggaacuacgggacugagugcgcggcgggcggcccugaaguccgagaacgggccggagaacacggagaaacgcgucuuccaacuccgaaauucggggcuucugccgucuuagcacaaaacaaagccggaguauucaaagaauuuuuccgcccagcuugaguucaucgcggaugcguugacuacacagcacccauuuucucacuuuguucauuucaauucguggcgaucuuccucuggugaacucuugaguaaugugcuaaaacuuuggguuugcucugcgacgcagacauucucgaaaugccaucgaugccguggagcagaucccaucucccucggcucauccucuguugguauuuaccuguuaaaccggaauccucaaagccuguugugcaaccaccucauuagggcgcgugguaaaaaugcuugcugcugccccgacgccccuguuucuggaaacggguucaagcuugauccaggauccuucuugaccaggcaagcuugaccuuugauccaggcucagugggcguugacugaucccucuggaggcucucugggaaagggaauucggccgagaaggaaggugccccuacccacaguguuaauauuuggcaucccuagagucuguguggguuuuguuuccguucacacgugcagggccuuugcuccgccaggaaaccagaaagaaaauaaacuuuagcuccugaaucuuaaaggaaaucucacaacaguguaaaauacuuugagggaagcuagauaaccuaggugauuuucccagcacuucugguagaggugggaacugcauagcaugguuagggacccuguggauagguuagguccaaggauaaagaagaagauuuucgaaaucuguaaaauuuuaaaaaucguuaacagauaggggagugguuucacgggaucaaguauuuaauaauauuucuuggaugcucugguaaauccuuuauuuauuuauuuauuuauuuauuuuucuaagauggaguuuagcucuuuuugcucaggcuggagugcaaaggcaaugauuucggcucacugcaacguccgccucccggguucaagugauucuccugccucagccucccaaguagcugggauuauaggcgccugccaccaccccuagcuaauuugguauuuuuaguagagacgggguuucaccauguuggccaggcuggucucgaacuccugaccucaggugauccacccgccucggccacccaaagugcugggauuacaggcaugagccaccgcgcccagccucugguaaaucuuuuuaauagcccugguguugggacaaaucuuauaccuggguagggaaccuuuugauguuacagaacuguacaccauaaaggaguaguaugagauggugauaguugcacaacucugcaaauuugcugaagaucauugaauuauacacuuuuuaaaaucaccaagucuaauuuuaaaaguaguaugaaaaaccagggaguacccccacauuucccucuucaccuugugaaacauuaugcagugacacauuaccucauuaaaacaccuguagacuuggcgguuagaaaucggcuauaggauguaugauggaugguauuugguguuuauuaaagacuuucccagugaugcuucuuaaguaacuuaguuuuugcuuggccuuauuuugaauuuauuuuuauauuuuuuauacaauaguuacuuagcuguauaguguuuuucuggcuuuuugaaauuaugaaaaagccucucuuuaugaaauuaugaaaagugcugggugagagccagauauggguugaaaauaauuucucauuaaagugguuuaauaaauuuguuuuaaaguauugcuuuaccuaaucugaauuuaaaagugucuugccagcuuagugacucaauaaguuggcuguguuaccuuuauuccucacaaagaaaaaaaauacauuugaaaauuuuaaaguauuuuuguucuuuuuuaaaaacuacgaacauauccuuuuaugcaggaaccccaaaagucuacauuuuaacaacccacauuuuaaaaaacuuuucagcagcuuuuagagucaguauuucauuagucuguaauaguuaaauucauaugacauaaugacauaaaauauaaauuuguucuuugugucaugacuugauaaauauaugaauauagcagugaaaaauuuuuuuaaucauugaauuuauguuuguacucauggcuuugauauuucaucccacaucauuauaugcuuuuucuuuuucuuuuuuuuuuuucuuuuugagauggcgucucacucuguugcccaggccggagugcaguggcacaauccuggcucccuguaaccucugccuuccaaguucaagcaauucuccugccucagccuccugaguagcugggauuacuggcgcgugccaccacgcuuggcuaauuuuuguauuuuuuaguugagacaggcuuucaccauauuggccaggcuggucuugaacuccugaccucaagugauccaccugccucagccucccagaaugccgggauuacaggcaugagccaccgcacccggcugcuuuuucuuaagcaacaugaguuaaauguguaaccaguuuggggaauuugauuauguucgcaaaaacugacauuaucaaaccuuuauauauuagucuacaugauauuaucuaaucgaaaacuacauuauaacugucuagucaauacuggacacauuucagauuucaagauuagaagcaaggaguucaaucuuaaaauuuuaaaauuuacaugacuuguugaguaauucgauaucagaaaauuucaccuuccauuucaaaauuugaacgaagaaugguagucuaaaagauuaaagccaaaaguguuuguuuuguuuuguuuucguuuuuuuuuguuguuguuuugagacagagucuugcucuugcccaggcuggagugcaguggugcgaucuuggcucgcugcagccuccaccucccggguucaagcaguucugccacagccuuccgaguagcugggacuacaggcgcccaacacagcuggcuaauuuuuguauuuugaguagagacgggguuucaccauguuggccaggcuggucucaaacuccugaccucagaugauccacccaccuuggccucccaaagugcugggauuacaggugugaggcacugcacccggccugaagccaaaaguuuauucauggaauuuauaauacaguguguauuuggauguagagaucccuguuacuguuuuuaaacuauggauuaagaguuaaucucuuugaguaacagucuuagcauucucuuuugaacuuuuuuuuuuuuaauuucucagggagaguguuauugggaaaccuaacuacacaggcugaaaagauacauaagauaaaaaugaaauauuuuuaaacaaacaucuuuguaaccaccacccagggcaagacagacauugccagcaucccagaagccucccaccaccuauauuuucccaucacaacuaucaccaucuuaauuuaagcuagauauaaauguucuucugacauuuauaguuuuaccauauaaguuuacaucucuaaauaauagaguuuaauuuugcccauuuuuaacuuuauguaaauaggauuguguuguauauauuuuauuuuuagcuuuuauuguuucauaauauuccaucaugaauauaacacaaguuuauuccuucugccauuguuuuggauauugcauuuagauuguuugcaguuuggggcuauuauaaacaaugcuuuuaugaacauuucuguuuaagugcacuggugcauguuuauuucguuuucuugagauuauauacuuagaauuugaauugcaagaacauggggaauguuggucuuuaucagguaaugccagguaguuuuucaaaguaguuguuuagugguuuuuacuucauuuauuaguauguaagaguucuuguuucauaucccuuaccaacaaccguacgugguaucauauauuucaauucuagccaauccugguggguauguaguuguauuuaguuuuaaucauuucccucauuacuaaauggggcugaccagcuuuucauaucuggguguuuggauuucauuuuucauaaaaugccuuugaaaucuuuuccuuuuuuaaaucgaaacacgucuuuuucuagaguucuguauucugaauauaucuccauuguuggauguauauauugcaaacauuuuuuccauuuaguaguuucuuuaaauuaacagaaguucuucauuuuaauguaaacauguucaucaguuuuuuauggcuaguguuucuuuuuuuaaaacaucauagagauacuuugauuaucuuuaaaccuuuuugugcuuugcuuuuucacauugacguuuauaaugcaucugaaauugauuuuguguacaaugugagauauucagagcuuuauauuuaguaagggauucacuugguuuauauuguccauauuauaauuuagggcuuggauauuauaauuuaaauauaucuggaacuauaaacuacucuugaaauuuuuggcuauuuacauuugaugugguauauaauuaggguaaccauauggccuaguuugcccugguggaaaguccuuguuugugccugcucuggcauaauuauuaaaaacaucccggcugggcagggugacucaggccuguaaucccaacauuuccaaaaggucaaggccgggguauugcuugagcccaggaguucaaaaccagccucggcaauacagggagacuccauuucuacaaaaaauuuuaaaaagugcauuagccaagcaugguggcaugcaugucugucgucccagccacuugggaggcugaggcagggggauugcuugagcccaagaggagcugugaucaugccacugcacuccagccugaaacauagaacaagaccuugucuuaaaaaauaacaaugauagccuguaaucccagcacuucaggaagcugaggcaggcgaaucaccugaagucagaagcucgagaccagucuggccaacauggcgaaaccccgucucuacuaaaaauacaaaaauuaucugggcgugcuggugcaugucuguaaucccagcuacuugagaggcugaggcaggagaauugcuugaaccugaaaggcggagguuagagugagccaagaucacaccacuguacucuagccugggcaacagagcgagacucugucucaaaaaaaaaaaaaacacaaaauaauaauaauaaucuguuuucucuuuugaaaauguuucaguguggauaaguuaucacaccacauaaucaaaagccuaauugcagaggugcugugaaauggucgaugugccuuauuuucugcuagagaugucacagacuagcuuuaguucuagaaagugaaacagguaaguuugaggggcuuugauccucggaaccuaagcauaugucaagaagucauaaaggcaaccuagaaaggcuuugaugucaaucugcuauguauguuuauagaugaucuguguugcaguuuguuucugcaguuuguugcaguuuguagucugugucacagcucugaauuuauuuucuucucagcacugaucaugacuuacacuuaaucuucuuugcuuauuugcauauguguuuauugucugucuucaccuuccccuucaccuccagacucugagcuccugguaugaaagguuguuuaguuagugaguaaauggaaaugauuuagcauuuuagcuuauuguucuuguagaaguaucuuggguauaccuccaaauaaugcuuuuccauguucacaauugcauuucccuauaaaauuaaauuauccugccucacauuaagaaaucuugaagaauuucagugaguagggaugcaagaggaugaaaucuagugacauaauuaacauuauuggggagguaaacucuuugugacucaagcucaauuauaauuuucauuuaaaguuuaaaggaagccuccauucaggguguaggaagaaauuacacaguggugacauguaugaauauuuuauggaauaguuccaguuguguuugcaccuacgucuauaagugaguaggaugccuaaauaggcuaaaaugaaugaaauucuuauaaaaaauaaauucuuacauuuaguuagcuuaccuggauaaucauucaaauggaaaccagguugcuacugcacugggaaaagagacuuuaugaagaacgauuauauaagccacuugccuuuaaaauaaguuguucuuaaaaucaagagauugguggaagaauagaaaaacaaguaaauuguuaacagauuucuuuaaucaucugcuaagucuggcucauuggcauaauuuaucuacuucuugauguuagucacauagucauaaacuauuaccuuauuggagagaguggaagagcuuugugugauggauaaaauacuugcggggugcuuuauuugauuucuugcauuacuuggggaucuaaaucuagcaauucacaaaauuacuaucuaaaaugacaaagaucuagugaaacuucaagccacaguuucuuuuuguugcccuauuuagugauguugccaguacuuggagccuuggaaacaguuuauuauuguuacauaguccgcagaaauacuugguaauucugggagucugaagucaggugccagaaacuguucauuuucuaguagggguaaguaagguaagccaugauuuucuaagucggaaguaaagaaaacagcauaaaacugaagaaaaaaaauaguagaaggaaggaaguaggaagaaaaaagaaaucuuaucugugcaugauacauagcaggaguuuuguauuuaacucagugccacaguaauaauagcaguaacuacagauaguuuaacuugaauuuaauuauuccgugcuagaagaugcuugcuauagaaacaauuugucuuucucucaugaugcuauaaaauaauauauuaauuagcuguuuuaaaaacuagauaccauugaaguaaauuuuguuguuguuguuuugagacaagagucucacucuguugcccaggcuggagugcaguggcacgaucacagccuugaccucccugggcucagguaauccuccugccucagccucccaaguagcugggaccacaggcacacaccaccacacccagcuaauuuucuguuuuuuguagauacaggguuuugccaugcugcccaggucggucucuaacuccugggcucaagugaucugccugccuuggccucccaaagugcugggauuacaggugugagccacagugucuggcuugaaguaaguuuuuuaguggacaaagugugaguuggucuguaaaauaauuuauucccaagggccuuauucuaguuuuguaggguuuuuuguuuguuuguuuuuuucuggaagaaaaugcgacccaaaaugccaguuggaauacuuagcagcuuuuuggucuuggacaaguuauuuaaccuuagcuuuaacuucuucaucuuuucaauagggauggauaauaaugcccaucuuucagagucauucugauaauuaaaugaggugauauaaaagaaguaacuaguuuaauguuggugcuuaauagagaauagcugucccauguuauuucccaccacgaucucccucucugucuaggugcucagucucucuaguagcccaacucagucagucauucacaccuacuguagucuacugucaucuuacugccuuucacuguccucucauuccccucauaacuuuacuuccuucuuuauccugcuucaacuccaugagcaaccacgacagucaguacacauucccucagcccccaccccauuccccucuugcugucuuauacaagaaaucacaacccugauuauaucaacacagaugugcugaccagccucacucuaaauuuauguucgcuagccuccgcagucauggucacuuccuagcagucacacuauacuuccauaauccauuucacuuuucuacauggcuauuccauucauuuuccucaagccuccaacaccucccccauauucacuuucagccccuuaaccgugcuuucuauagcaguuaacugagaaaagaacagcaaacgaaagauaauuuugauaaacuuaccccucacauacccaguuaccugcaucuguuccccagacuucuauguuuuuuucugaucaauauggauaaacuguucuuauuucugucuaagaccacccuuccacuugugcagcauuuguccccucuuggugauucaagaacauugcuccagcaguucucuacucuccucaguuuuuccuucccuaacguaucuuucugucugcuuacagauaggcaguuauuucuucuaccuuaagaacaaccaaaaaaccccacuguacuugaacugaauuuccucuuuucuaaugauuaccccauuucuauccuucccuuuauagcgaaaccccuugaagaaguugucuacaccacugguguucauucauuuuugagcccuguuuacuaagguuuuuauuccuacauaugaaguuuucuuaucaaaauuaccaaagauuuccauguuaccaaauccaguaguuaguucuuagucucauucuacuucaccagucagcauuacgugguacaguuagucuguucucugugaagcauuuucuuaacuugaucguaugccauuuuuuuccucauaucucacugguuaccucucaaucuccuuggcugauugaaccuguaagccgccaaauguugggagagcuccagggcucaguuaucuccccuuuucucucugucuguuaacauuuauuuaaucaucugcauucuuuugaugaucucauccaucuaguuccugguuucaaauacuaccuguauaucacugacuccuaucucuagccugaauuucuccucugaacuccugacuuguauauccauugccucuuuaacaucucuacuuguagggaagucugcuagaaucucaauucagcaugcuccaaaccuguuccuccaucagccuuccccaucuaaucaaaugacagcucuauucuaguugguaagaccaaaacaccuuggagccauccuuaauuccucucucucugucucaccucaugugauccgaaccuaucagcucugcuuucaaacuagaugcagaauuugaccucugaccaccccuacuacccugguccauuaucucucacuagucuauucagagauacucagauuccuguuucuuguuuccaauauugaccucucaguugauucuuucuccuccucccaauuuuacuugagugaaucuuuguaauuaaaaaauaaaauauaugggaaauguaggugacaaauuuucuuagugaaccuauguuuucuugugcuugacugguugguuggcuauguauuuccaaauuaagagucuuuuuucuguggaacuuugaaguuacugcuuuuuguucuucuaauauucugggguugcugaugccagucugacucucagucacuuuucucucuggaagcuuuuauuuagaauucucuauuccuggaauucacaaaugugaucacacugguuuguuguuguuuguuuguuuuuugguuugguuugauuuuuccucugaguguuucucuguggaccuugugaaucugaagagucaacucucggccgggcgcgguggcucaugccuguaauccuaacacuuugggaggccaaggcgggcagaucacaaggucaggagauugagaccauccuggcuaacauggugaaaccccgucucuacuaaaaauacaaaaaaaaaaaaaaaagccaagugugguggcaggcaccuguagucccagcucuuagggaggcugaggcaggagaauggugugaacccgggaggcggagcuugcagugagccaagauuauaccagugcacuccagccuaagcgacagugagacuccaucucaaaaaaaaaaaaaaagagucaacucucuuuaaaucuaagaaauccauucauucucucuaccucugacacgcccucccuccccucucccccuccucuuucuagcuccaucucagauaauuucuaucuugccuccugcuccccagccuuguuauuguuguuuuuaauuccucauggaugcguuuauccuccacccugcuuuuucacucuuauaucauauuuucauaucugucucuugguuuuaucauuuggagauuaaaauauaaaaacagccauaaggaagaaugcccaacugaaagcagcuuagagagucaacauuaaauuuaaaccauuggguaaagauagcaaacuggacaugcuuuuacuuuuccuuccuguugauaaauccuaucaaaacuacgugagagggacuuuuaaaaaauacauaaacccggccgggcgcaguggcucacgccuguaaucccagcacuuugggaggccgaggcgggcggauuacgaggucaggaguucgagaucagccugaccaacauggugaaaccccgucucuacuaaaaauacaaaaauuagccagucgugguguugugcaccuguaaucccagcuacuugggaagcuggggcaggagaaucgcuugaacccaggaggcagagguuacagugagcugagaucgugcuauugcacuccagucugggugacagagcgaguucgucucaaaaaaaaaauaaauaaauaaauaaacccauaaaggacaaaacagauuuggaaaggagacaacaucaacacaguuuggaaggcugaaaagcaaauagaugaguuuaaaugacuuagcaaaguugagagccgcaaccuaaguagucagugggaaaagccaagauguaacuugacuuucaccccaaacuccuaaaaggcucaggaguugacaucaacaggcacaauggaaacuagaagauugaaguaauugggaugaaggguguaaguuuuggguuauaaguuuaacuuauuaacuuuuaacuuuauuggguauaaguuacaauacuauaaaauucacccacuguaagugugcggucccgugaaaguuguguauccaucaccacaguccaguuuucuaacaauuccaucaacucaagaagcuucuuuguugauguuuagucaguagcugccuacgacccccaguccuaggcaaccucugaucuacuuucuuuucuagacuuuccuuugcuuuuuuuuuuuuuuuuugagacggaguuuuacaguugucacccaggcuggagugcaauggcgcaaucuuggcucacugcagcuucugccucccggguucaagugauucuccuaccucagccuccugaguagcugggaugacaggcaugcaccaccaugccagcuaauuuuuguauuuuuaagagacgggguuucaccauguuggccaggcuggucucgaacuccugaccucaggugauccaccugccucggccuuccaaagugcuggaauuauaggcaugagccacugcgcccagccuuuccuuugcuuuuaauauguaaauuauuaaauugauuuccuaauauuaaaacauucuugcauuuuuagaaaccuuaaauuucaaacaacuguauuucucuauaucaauuaucaauuggaguaauuagccauuaucuauaauagauucauuacauggaguucaugguagauuucagggagucuugauccccugaaguuauaagcaauuuuuauuuacauacagaaacauuuggggagaggguucauagaugucuuuaauuuuccaagacccagauaaauacaagcuaccuuugcuuaugccuaaguuaaaaguuuuaacauaucuuuucacuuuucucccuuugucccauuuuccagguuuuaucuaauuugggguuuagguuacagauuguuauuauuacauugcuucuauuuuuagaaucccuuaagagcaguuuuauuagcaauguugacuuagauaaaacugagggggcuuuuuuguuuuuuguuuuuguuuuucgucagagacaagguucuugaggacacaacauuuaagcuggggccugacagaugaguuagaauuagccacauguagaggcuaucuaggaagauguuaaggcuaucuguuauguucaguuacauaagagagauccuuuguaaauguguuuugcuuuguaauaaaccuucuaaggagccaguauuguuuuguuauuacaucacucucuaaaauuucaaauugccuuuuugguuuuauaaggacaagaugggcucuuaacaagauggcuuugggguuuuuucagucgaagaugauguaaccucuagaguuaagugcgaagaaguugauuuugagaauauauugcagaaggugcaaggaacgucaucuggguuaugaccucuggaaguggagguaguuuuuugucauugggucgccagugcuuggcaugugaucugugaggugaucgagaauauugcagacacaagggcaggaguaaugccucuguuagggguguuaaguucguaguggguucaggaagagaugguggaggcugagggacagauguuuucauucagugcaguaauauuugcuaacaggaagaaaguaguguggguaagggugaagaaggggccagagaagagagugcagaugugcaaaaagugagaguuuguggaagcaggccgugaugugguuccaagagcuggacugucgaaucuuauuuuuguaaagcucugcucuuaaguaaaaaacccagagucaccuuucuaccaugcuaccuucagggccugagcaagaguacugcguuguagaagagguggugcuuuuuaguauuuaaguaauuaaaccuuccuuguuguauuaaauccauauauaauaccuuauuccaacauaucucagauaguuucuguaucucagauaguuucagcaagaguuuguguauggcaccgaauggacaagagcuguacauauauauaaaugucagaaagagaagaaaaauacuaacuguaacuuuuugguuuccugguuugcugcuuuugcauguagacuguucuuaaauaugcugagguuggguuuguuuuucccacuuucccauucuaucaacaucaguuguuauuuacucuaaacaaucauucuuucauuuuauccuaagugaguuucuuuuauaauuuaauucaguucccuugguauuaaacacuguucaguacuuuggaaguagcuuacuuaauagcuuuuucugcugugugauuuauucaagaaauauucaaaugucagcuauauguagagcacuguguuagauucugugggaguugcaaagaugaucuagauacagaucuuucuccagaucuuuaaauucuagaaggguaguauagacagaaugauagaaugcugugugguuuucaaaggaagaacagauuauuucagcccagguggaguugggugauggcuaauuuuaugugccaacuugacugggccacagugccuagauauuugaucaaauauuuucgauguuucuguuuaaguauuuuuuguaugagauuaacauuuaaguugguagauugugaguagccuccaucugugggugggccucauccagucaguggaaggccuuuaauagaacaaagacugaccccugagcaaggaguucugccagccugcucugcagauuuuggauuuaccaggccuccuuaaucccuugggccaauuccuuaagucucuuucuguguuuguauaugcacaucugauuuauucuguuucucuauaaaaccugaccgauaccuggaaucuucaaguugaaauuuaggauagggggagagagaaaaauagaggacagaaaaccugaucugugaacugagaauaaugagcuuuguuagaauuuaaguuugaguaugcugggaccaggucuuggagcugauacaggacugaagaguuuuaacuuuacaucauaaaucuuauucuaaguuuucauuugaaccugguuuuaguuucuuaacuuuguaagcgucuuuuggauauuucaguguuucauuuguugcucucaaauuuugguauucaacagacucguuucuuuuucuuuucaguuaacauuagagucuaauuuacaauuuuuaguucaugucaaaaaaaaguucaggccgggugugguggcucacaccugucaucccaacucuuugggaguccaaggcgggcagaucauaaggucaggagaucgagaccauccuggccaacauggugaaacccagucucuaauuuaaaaaaaaaaaaauacaaacauuagccugggcguaguggugcacaccuguaguuccaguuacucaggaggcugaggcaggagaauuacuugaacccaggaagcagagguugcggugagacgagaucgcgccacugcacuccagccuaagcaacagaccaagacucggucucaaaaaaaaaaaaaaaguucaggcuuugggaaauuuuuuuuuuuuucuuuugagacagucuuacucuguugcugaggcuguaguguaguggugugaucauaacucacugcaaccuccgcuucugggguucaggcaauucucaugccucagccucccaaguagcugggauuacaggcgugugccaccacaaccggcuaauuuuuguuuuuguuuuuucuuaaauuagagacagagguuucaccauguuggcuaggcugggcucaaacucccaaccucaggugaucugcccaccuugcccucccaaagcgcugagacuacaagugugagccaccaugcccagccuggaaaauguuaauagugucauuuggaggguacuagcuucacuuaacuauguauuuuaaguauauaauguuuaucaugcuuaaauuuagaacauuuuugguauuuuauaauggagguauuguauugggaaguuugucacuacaacuuauuucucuggccuuguacuaugauuuuauauacaaguauuauauacacuaacaaccaguuuggcauuaggaugauguuugagcuuaacuaaaucuggagacuggauuagaugagugauuuugccaaauaauuugacccuguuuuguuguuguuguuguuguuuguuuuuuuaaugcaugugaugcauuucuauuaauaaaucuuugguguuauuucaagcuagaaauauaaaauugauucuauuuuaagacuaauaaaauuauuagcugggcaucauggcucacaccuguauguaauuccagcacuuugggaggcugugguggauggaucgcuugagcccaggaguuggagaccaaccugggcaacauggcgaaauccuaucucuacaaaaaauacaaaaauuagccagguguagugugugugccuguaguucuagcuacucaagagacugaggugggaggauagcuugagcuugggagguaaaaguugcagugagccgagauggcaccacugcccuccaaccuggacuggaugacagagaagggacgcugucucaaaaaaagaaagaaaaaauuauuagggcaauguagcagcaugaugaaguuuaaaauguagaggacaaccaccccuaguuuccccauucuccccaacuacuuuugucauucucuguauucucuuguaggcuguauuuguaggugugugcgcacauguguguuugaaguugaaaauucacauuacaugcaauuaaccauuauauuguguacaauucaguggcacuuaguguagucacaguguugugcaacuaccaccucuccuuaguuucaaaacuuuccaucauccuacuaaaauaccccuaggcauuaaguaaucccucuucauuucccccauacccuguugaccacuaaccugcuuucugucuccaugguuuuuccuauuucggauauauuauguaaaaggaaucauacacugugugacguuuugugucuagcuucuuuuacucagcauaaugcuuucacgcuucacucuugauguaacauguaucagcauugugguuuuuuuauggcugaauaauauuucauuacauguauuuuuaaauauauauaucauauauauaagauauauagagaucauaauuugucuuuuguugaugggcauuuggguuguuucuaccauuuggcuguuuugaauaaugcugauauaaacauuuguauacaaguuucugugugaacauaauauaaucucugguacuuuguuuuggcagcccuagcaaacuauauugugugcuuuauuuccaguguagugcuuagcccacuugcuggacuguaacuucccugaggguggggacauaaauauaaugccugccuaauauuacuuaaauauucuaagccugcugaaucacuacauuuucguuaauucaugauaauccccaaaauaucccagaaucagaucaguaucuauucagcuacauaauacuacuuaauaguaguaguauggcuuacuuugaagccuaaugcugugucagcuucagagauuaagaugucaggaaaccaauaguaguacuuauuagaggcauugcaagugguauuuaguguuuaguggaccuucaaauccaauucagugauaucaaauccaaguaagcaaauagacugagcuccuugagaauaggaacugguuucccuagcaucuagcauaguaccugggacagguggugcccagcaaguauuugaaagaaaugggaugaaaugcaaugacauacggcaccuauguucagcuuaaaacuccagucacauuaccuauggguauuuacauuggaauguguaguugcuguagaaucccaaaaugaauacuagaauaacaauguucuuucucaaaguacuacguguuaugaaugaaaaaaaaaaugauuagaacauaguucagauuuugccagccagacaaaggcauuugugcuguaaucugagguaugccuuccugcacuaagaggaacaggguuuaugggaaaacuaggauuaggagcagaccauuugaaaucugugcaucuuuguaauuuaagcacuaauguaaaccuaauaaaaagauaguagugugcuuaaagauaaguuaaaauuuuuaaacaaauaauuugguaaauuuagaacuuucccuuuaaaaacaguaaaggugaccagaagugguggcacuacucagggcuagcuguauuuaacuguuguuaccugcaaaugcaaaaacuaaauaacauuuuaggaaaaauuggaaaugaaccaaugugauuucugaauguacugacauaauucccuuauuuacugauugcauaugagcuaauguauguguuguaguagaauaguuccaguaguucuuuaccuuuucugugcuuaucaugccuccuuccuuucuacuguuaauguucaaguuuuaaucuuccagacuucucauuuguucuguaacaguaucuucuagccacgugugcccuucuaaucucucuuguggaauuuguucuucacaauacuacaagaauucuauugcauugaaaaccccaaaucuuauuaagccagccuccaucauuagagcauguuucucaaacucuuggugugugcaaaucauucuuauucugugauuucuauuuucaugcuuuuucaguuugcuucauuugccauaugauagagguuuucuucagaccauauuuuggaaaguaugcucuuaguuuuaaauucuacuauggguuauuuccaagacccauaguagaauuuaacaaauucuuucaaauaaaaaauuuuaaagccuucgcuuauuaucaacuagccaaaaaaaaaaaaaguguaucaagugacuccuacuugacaugaugagagaugaaaguguaaguuuagauacuacuacugucuguugaguuuccucucucuccauucauuuuaaucucccaauuuuuguuaaaauguugugauauacuguucuuaguuuguuacacuuuguaacuuuguagucuuuuccagaacuauuucuauucuagaaccaaaguaaauugucauguagacuucuguguugaaaugaauuuauuguccauuucuuaucuuuagauaacacuuuuuuugaguuauuuugauauaccaaagcauaagucucuguggcuuguaguggucuguuuuuuguuuguuuguuuuguuuuuuucuggaaauacagugaaagcuuuugaugaaauuuaggccuucauguuaagacauuucuauucuguuauaucuuuaauuauauuuuucuuauucuuuugucuaucucaggggcagcaguuaacuguuggaucuucauaacuaucaucuucucucuaaccuuuuuaaugcuguaguacuuuuucaugacaucuuguuuaccuuuucucaaaauuauucucuucuagugauuugguuuugcugcauugacuguuguugcauuuauuaguuaugcuguuuuauuuaucuuguguaauuuucuuuccuuaauucugcaugcuacccuuucaauguuguuuugaucauaaaagucuaugcuaucuguuuuucuugugaaugucgaagcaguuguuucagaaaauuucuucuauuuucugugauaaauacuaauacugaauguauuucaucuaccuuuugaagacuguguccuaucagggcaaacugcugguaauggaaaaaaaaacaaaauaaguaaaugaagaccguguccucuuugauucuucucuucuucuuuacugccuuuuuucuuuauuuugauacaccuuuuucuuuccuuccaucauugccucccuccuuucccucuuuucuucccuucuuuccaucuuuccuguaaaauuuuucuugauucccugauuuuucuacucuuuuuuucuuuaguagguccuuucaguaccugcugcuugccaaaacgugaaaugcagauucucuuuuuacuugacucugaauucaccuggcuaagcucuguuaggccuuaggaagcuuaauagagcuucucuaauuuuguagaagaagggccuuugacuuuuucccucucugcuucaggaugaucucaucugcuacuuuggaagcaugagacuuuauuuguuuugaugguacugagguuaggggugagauugauuuauuuguaauuaguccuuucuccuccuuauccuuccuuuuggauaaagguaaaaauauaaaauccuccugccugcuaaaguacuguuuggccaucagagaaagggagcuucagguagggcauuccgcagucccuguccccaucuuagcaaguugaagaugcuagucaaaauuucucuggggggcaggagagggcagaggauacuuacguauggauucugggguuggucuuucaguuucaacuaacucauucuguaccugaaugauacuauuuaauaaaauuucgugguaugaguuugagaacuugucaugauuuuagggauauuuuaacuuccuuuuuguuucuuuccuuuaguuuuagggaaggaucuucugccaaacuaccugugccacugucuuuccuggaagucucauaaguacuagaaagaacuuuuagaauaagaguguaggacauuauuuacacugaaauaacauucuuuuuguuguuuuuuuuuuuuuuuuuuuuuuuggagucagauugucauucugucacccaggcuggagugcaggagcgccaucuuggcucacugcaacuucugccucuugaguucagccaauccucccgccucagccaccugagcagcuaggacuacaggugcaugccaacaugcccagcuaaugauuuuuuguauuuuuaguagagaugggguuucaccauuuuguugaggccggugucaaacuccugaccucaagugaucugcccaccuuggccucccaaagugcugggauugcaggcaugaggcgcugcaucaguucugcaaaaaaaaaaaaaaaaaaaaaaaaaaaaaaaaaaagcguaugcauuaaaaauacuaagggggccaggcgcgguagcucacgccugugaugccagcacuuugggaagccgaagcggauggaucacuugaggucaggaguucuagaccagucuggccaacauagugaaaccccaucuccgcuaaaaaaaaauacaaaaauuagcugcgcaugguggcacacgccuguaaucccagcugcucaggaggcugaggcaggagagucgcuugaacccaagaggcagagguuacagugagccaagauugcgucacugcacuccagcuggggcaacagaaugaaacuccaucucaaaaaaaaagaaaaaaaauagaaauguuaagggguuuacuuccuuuaggguacucuuuaaaugaaauaugauguuucauauucucuauuuggaacuucuguauggaugcagacauuuucagaaaucucccaggacaaugaaccugaaacuuauguauuuauaagaaacuuggggauuugguuauuuuauuuacuuauuuugaaauagggucuugcugugucacccaggcugcagugcagccacgcuucaguacagccucaaucucccaggcucaagcgauccucauaccucagccuccuuauagcugggacuacaggcaugcacuaccacaccuggcuaauuuuuaaaaauguuuauuuuuuuguagagacagaacaucacuguguugcuagggcuggucucaaacuccugggcucaagcaguccucccaccuuggccucccauagugcugggauuacaggcaugagccacugugccuagccagaaauuggcuuaaaaugcagauuuuuggacccuguccccagcaaaaagauucgguagaaaucuuuauucguagccaguuuacuguguugcaggugguccccaguuuaacuuugaguaaugcugucuucauuguuaaaauaaucagauuuaauuauaugguagauauuuuagguaacuaggguauuucaagcugucccauggggcugaguagcuggcagcugcuugacuuggcuucuagaggacuuacugcucagcaagguaaauguuauuaauaccuucauugcucucugugucccaaaggucaauacccaaacuuugagauuuuguagacuggaggaaucuuugucucccacuccuuccccaagaaagacauggguugcuaauuuuuauuuugucgaaugaggacauuaaaaauaaguuaaccgugagccaggcacaguggcuuaggccuuucaucccagcacauugagaggcuaaagcaggaagaucacuugaggccaggaguucaagaccagccugugcaaaauagcaagaccucaucucuacuaaaaaauaaaaaaaguuagcugggcuuaguggcacaugccuguggucccagcuacgugggagguugagauagaaggaucgccugagcccgggaagcugaggcugcaggaagccaugaccacaccacugcacuccagccuaggggacagagacccagucucaucaauaaauaaauaaugaaaggacauuuuaacaccccacuacaaccacuaaagauacaaauaaauaaaaauauaagaggaacacaaccucauaauacagauagucuuuuauauugcauauauuuaacuucgggcaaaagccacucuauuuuccucuuuaaaaaaacuuuuuuagcuauagauuaaugaauacuuucucagacauuucagaacuacugcuuaguacuugaaauacaacauuuagaaucugggguacuaccugaaugugaugaguagucacacaucucauauccuuuguuuucuugccaguucgauccuuugguacagaagacagaccgacagaucguccaauaccaccucgagaugaagucuuugaauacauuauauuccgugggagugacauuaaagaccuuacuguuugugagccaccaaaaccacaguguucuuugccucaagacccagcuauuguucagguaacugaugguaaauuugucuuggaguacagguaaacuccgcacaggguuagccuuggcuuuuuucucucuaguugaauguucauguagcuuaucauuuccaaguuacugggauaccugaaauuacuggauaauguucucaucuagguuuuucucuuuguaucauaaauuagaacuaagguaagaaacagcugaggaauuuauuaugaaauauuuucuaauuucaacaacaauuaccauagcuaacauugaaggcuacucuguagaagugcugugcauauaagauacccucugagguugguacuauaauuauucucacuuuuaacaagugaggaaguucagauggagccacaauuugaacagauccaggcagccugcuucagaaucuaggauccgugcuaccaugcuauugagauaugguuuauauugcaaaccaaggcaauaacagcuacucuuagguaagauuauuaggcuuaauggggaaaaaaaagcaaaaucacauuguucugcauauguuauaauaugcaguguugguuuuuguuuuguuuuucuuuuucuuuuuuuuuuuuuuugacagagucguuggaguacaguggcgugaacucggcucacuacaaccuccgccucccagguucaagugauucuucugccucagccuccugaguagcugggauuacaggcaugcaccaccacacccggcuaauucuuguauuuuuaguagagaugagguuucaccauguuggccagccuggucucaaacuacugaccucaggugauccgcccaccucagccucccaaagugcugggauuacaggcaugagccacugugccuggccugcaauguuauauaauaagaaaacacaaacaucaauguauuuuaacauauuuagaucagcucuuaaaucucccaauuuaagcuuuuuaauaaggaauuguaaauuuuguugcagcauaagcuggagaaauucucuacucucaucuaccccuacccuuguuaagucuuauuuuggugaaaggaagccugaaguggaaaugugaaucucuuuaaauggagaaggaagagacacauucuuaauagagauagcucccuacaccaaacacuggaguuaccuuacugucucuuuuauauggcuuuugauaauucuccaggaaaccaguuauuugaguaaucgguuuuauggaaggagaaaaacuaagagagcgcauaugaaaaugguguugaauaacuucuuccaaucaucauaaacuucuacuugaucuccuuauucauucauucaguaguauuuacagaguaucuggcaugugcuuaacacuaguggugaacacacagaaaagguccugccaucagugaguguauguccugguagccuuuaauacacuucauguuuauauuaugaaacaguuuauaguaagauaauauaugaaguauacauguauuaauauauguuauauauuuuauaugcuuuagguuuaaguuaaaguuuuuauaaaauguuccucagcuuaauguaacuauaaguaaaaauguaaaugguuuuaugugggauauguuuguuucuacgucugugaauuuaauaguaggccucaaaugauugaaaauaagaguaaaaucauacgugagauuuauaucaacaucagacuaaaacucauuauuacuaagugugauuuuucucauauuuuucuuuaagcaaaguuacuuuacuuaaguaacuuuaauucuuuccucaaucuauaaaacucuuaauucaaauggggaguuuauuguagaaaaaaguauuuguaagucacauugaguauaauuggcacauuauagacagauacugaaaucaaaagguuguuuggcuauuuuaauauuaagugcauauuguaauucauuuuauaucuaguaguuauaauuuaauaguuuucuuaaaaguaaaaaucuggaauuuuuuuuuucguuauauacauguugcuuagagcuuggaaacauaacucaugauuuuccuucaguccucacuaggcucaucgacuucuucauuccaguccauggguucuuauggaccuuucggcaggaugcccacauacagucaguucaguccgaguuccuuaguugggcagcaguuuggugcuguugguguugguauguuuucuuuuucuuuucuuuuuuuguuuuuguauucuuccuuucuuuaccacaaagguauagaaacucaacaccaacuauuagaaauguuguuugauguuccuuuuguaacuuuguuuuaugguauucagaacacauuuugaugauaucuuaaagccuuuauugauauuaguggguuuuuaaaagucagcuuucacagaguaacauuuuuuuuuacuagguaaaaaaaaaauggauauacuagguauauccaauaucuaccaaaucuaccaaauuggauauacuagguauauccaauaucuaccaaaucuuauugguaauugguuuuguuuuguuuuuuuuaaagacaaagucucacucugucacucaggcuggaguccaguggcacuaucuuggcucacuacaacuuccaccucguggguuuaagcaauucucgugccucagccucccagauagcugagauuacgauaugcaucaccacacccagcuaauuuuuguauuuucaguagagguggaguuucacuguguuggccaggcaggucuugaacuccugaccucaggugauccaccugcuucggccucccaaagugcuaggauuacaggugugagccacugcgccuggccuggauuuuaauuaauaaauuuuucuuuuuaauuucuuuuucuuuuuuuuuuuuuuuuuuuuuuucugaggcagagucuugcucuguugcccaggcuagagugcaguggcaugaucuccgcucacugcaaccuccaccucccaggcuuaagcagugcuccugccucagccuccugaguagcugggauuacaggugugcgccaccacucccagccaauuuuuuuguauuuuuaguagagaugggguuucaccauguuggccaagcuggucucgaacuccugaccucaagugauccacccaccucagccucccgaagugcugggauuacaggcgugagccaccaagcccggccuaaaacauuuaaaaauguuuauuuuaaacauacauaagacaugcacacauaaagauacgcauagcaugauugagggcuugguguuuuguuucuguaacacuggauuugaaacgaaacuauaaugagaauguauagcagggcugggcgaaugacaggcuugcuuaugacuggagggucaagggcuauugagugcaaaagcuggauguaaucagauuagcucaguguuuuguuuuuauagcuaugcauuuuagcguuuaaaccaugguaaagaacagcuuuuaaaaaaaaaucgcuucucagccuuuuggcuaagcucaaguguaaaaaaaaaaaaacagcuuuaaaucucaagcuuuugccccuaaucuuuuaaaauuucauugaaauaauuaucaguuuacuguuucacugcaccacaaauuuaguuucagguguaucuugaaacucauugauaugcuaauaaguuuuauuaaaauuguuaaauuccuuccugugaauauacuuuuuauacagaugugacuuaaguauuuaaauguuuuacuuauucacaaaauaacaaagaauggcaaaaaaaaagcaaacuaaaacugaaugagcugggcgcgguggcucacgccuguaaucccagcacuuugggaggcugugggcggaucaccugaagucaggaguucaagaccagccugaccaacauggagaaaccccaucucuacuaaaaauacaaaauuagcuggacguggugguggugcaugccuguaaucccggcuacuagggaggcugagguaggagaaucgcuugaaccugugaggcagagguugcagugagcugagaucgugccauugcacuccagucuaggccacaacagcaaaacuccgucuaaaaauaaauaaauaaauaaaacugaaugaauauaaacagaaaccacagaugcuauuacauauuaaauugauaauauaaccacacagagggcugggugcgguggcuuacgccuguaaucccagcacuuugggaggccaaggcguguggaucacgaggucaggagaucgagaccauccuggcuaacacggugaaacuccgucucuacuaaaaauacaaaaaaauuagccgggcgugguggugggcgccuguaguuccagcuacucgggaggcugaggcaggagcauggcgugaacccaggaggcggagcuugcggugagccaagaucguaccacugcacuccagccugggcgacagagugagacuccgucucaauaaaacaacaaaaaaaaccacacagaggaaaaaauaauucagguaacuuuuacacucuuaguaggauauauucuaacaacaaauagaacuacuaagaaaacuugacuuugauuuguauuauugguguuauuauuuauuuauuuauuuauuuauuuugagauaagaucuggcucucacccaggcuggagugcaguggcacgaucccggcucauugcaaccuccgccucccaggcucaagccauccucccaccucaaccucccgaguagcugggauuauaggcaugcaccaccacucccggcuagauuuuucuuuuguauuuuuuguggagacaggguuuccccauauuuuccaggcuggucucaaacuugugaccuugagugauccgcccaucuuggccuccaaaaguguugggauuacaggugugagccacugcacccagccagguguuaauucuuaaacuguuuuguauguauuauaggaaagggcaaaugaauaaaauacuuauguugggaaauaguguuuuuaccauggagacggaagauauaaauauggaaugggaaaggugagaaagaacccuguggugcugaauguaaauagaugguauguguauggacucauuuuuuaaaaacugguuauuuccuagcucuguucguagaaaggaccuagaaacaauggaaaccccguagcaagggacacauguagacucagcucuuaguuucuaaauaccacuccccacuaaaaggaacaagggcccauugaaaaacaaaggaaaagacauacuuuuuucauauaaaaaugccugcuaauaaguagaagcagugguagauaaagaaaauugccauuuucuaaucucaguauaauaauuagcgaggauuaucauuagaugcugaagucauugggugaaagguguuaggacagcauauuaagguggucuuaaaguaucaucccacaauuuacaaagggggaaaaauguacccuuguaacacagacaucuggugguuaccaacuucguugagugcucaaguuuagcauugccaugaacaauuaugugucuccuguugugaugauugggguggggggcaaaacauaauaucaccuuugugggguucuugcugaaaauacagaaucuaauuuugaagaaaugggcuuauauauccagaagguggguuguuuugcgagacaguuauccacacucuucaaaagauucaauauuacaaagaauggagagaggcagcagaacugcuuuaggcuggcaaagacugaagagacauaacauccaaauguaauauagaaucgaauacugggcuuuuaaaaaguuggcguguuuguuuccugcaggggagaaaaagaaaacuuaaaaaguuggugugaagaacauuuuagggacuacuaaggaacuuuugaguauggacuaauuguuggauuuuguuauuauuguuaauuuucugguuaaucauaugggaaaguguuuuuguuugggggaggugguuuugaaguauuuaaaaguaaaagggccaaauugauuuuagccucucuaaacaaaagaaaaauguguauauuaagguauaaagauggagaaacagaguggguuugguuagauguuaacaguugaugagucuaggugaggaauauauugauauucuguguacuccuucaauuuuaacauagguuugacauuuuucauaauuaaaaauuaauuccuuuuagacuuacuuuaggugaaauaguguaacuuugguccauaaauuuccaaauccaguaguaagaucaauguuauuuauucauguuaaaucaagauauacuguauguuaacuguaacuuagaauccuuuccuggggauucaaguaaggaaugauugcaaauuguauuauccuuuuugaggcuccuuugacuaaauuaaauaguuaacugacuuugagaucaucauuauacuucuuauguuaccaugaaguuuauguaacuaauuauguuaaaaaauuugaacaggaucaagcacguaguaucuauauaguaacuauugcuucugccauucuucaagguuuacuuuuuaaucagaguauuuugugguugugaaaugcuuuuauaaauauuuuaaucuaauuuuaauauuauuguggguuguugguuuauuacuugggugucacaaaaguagaagauuuuacuggcauuuuccaugucaguagaguaauuuuugcagggucagauuauuuuugauuaauugauuuccauauugguuaggauaauuuguggaguggcuaauuagaaaacuaguguuagaaguuaccaaaugaggaagaggaaagcuguggcauuggucaaggugacagauguuuuucagaaaaggaauuaacuuaaauuuagcuuguuuuuugagauggcgucuugcucugucacccaggcuagagugcaguggugcgaucucagcucacugcagcccccuccucccggguucaagcgagucuccugccucagccuccugaguagcugcgguuacaagcaugugccaccacgcccagcuaauuuuuguauuuuuaguagagacaggguuucaccauguuggucaggcuggucucaaacuccugaccucuugauccgcccgccucagccucccaaagugcugggauuacaggcgugagccaccaugcccagccaaauuuagcuuuuguuggcacaaaguaaaccacauuuuaagcuaggccucuuuucauuuuugguuccuaguauucugauuuuaaaaggaaauuuaaaugaaucuggaucacaguauugcuauuugaugagaaaauuuuuauauauuuacguuuucguguguuauuacuauugcuuuuuauuuuuauuuauuuauuuuuugagacagggucucuuucugucauccaggcuggaguacaguggcacaaccacaggucgcugcagccuagaccuccugggcucaagcaguccucccaucucaaccucccuaguagcugggacuacaggcaugugccaucaugcccagcuaauuuuuguauuuuugguaaacacagcaucucagcauguuauccaggcugaucucgaacuccuggguucagucugccugccuccgccucccaaaguguugggaaccaccaugcccacccuuauuauugcuuuuuaguaaguuuuuuuuuuuuuuuuuuuccauuugguugguugguuugguuuuuguuuuguuuuguuuuguuuuguuuuugagacugaguccugcucugcugcccagccuggaguacaaagacguuagcacuuugggaggccauggcaggaggauugcuugagcucaggaguuggagaccagccugggcaacauagcuaaacccuggcucuacaaaaaaaaaaaaauuaggcaagcaugguggcacacuccuguaaucccagcugcuccagaggcugagguggggggauugcuugagccugagagguagagguugcaaugaaccaagagcacgccacugcacuccagcuugggaaacagagccagacugugucucaaaaaaaaaaaaaaaaaucuugcuuauagugaaaaacauacaaauuaaaucuacacugagacaccauuucucacuaucaguuuggcaaaaacucaaaagcuugauuauaugcauacucuuggcaaguaugugaagaauauauacucucauacauugagaagaauaauauaccagguagaauuaaaggacucacucuguugcugcccaggcuggagugcaguggcgcaucuccgcucacugcaagcuccaccucccugguucacgccauucuccugccucagccucccuaguagcugggacuacagacgcccgccaccacgcccggguaauuuuuuguauuuuuuuuaguagagacgggguuucaccguguuagccaggauggucucgaucuccugaccucgugauccgcccgccucggccucccaaagugcuaggauuacaggcgugagccaccgcgccuggcggacuuuucuuaaaacugaugcaaaaauaauucuuauguguaagagauuagaucauuacuggccuuaauuucugaacucuuggaaaaauuaaacaccucacaauaaaugaagcaucaaaacaguauuucccuguguuaccauugaacaguagcaagagcuuacugcugcaguuagaaaaaggauucauagaaacagugaaagguauagauugaccagcuaucuaaaguaauucuauagcaaggauuacagugaagaaacauggagcaauuagauguuuuuucuguuauauuuacuccaguugauuguuuaagucucauaaucuuaugugccagauggaggaguauuggcugaauagaccaucaguggguacauuuuaguugauuaaauagccaaaccauauuggaggaugguucucuuaggucuccaguguuuuguagagacuaauuuuuaaucacugagugaugaagccuugaagagaugcuuacgaacuuuacaguuagcauaaagccagggggguguuucaaccauuauggauguuaaacuaaggauuauuaaagaucagaccaggcacaguggcucacgccuguaaucccagcacuuugggaggcugagacgagugaaucauuugaggucaggaguucaggaucagccuggccaacacagugaaacccugucucuacuaaaaauacaaaaaaaaugagccgggcuugguggcgugcgccuguaaucccagcuacucaggaggcugaggcaggagaaucccuggaacccaggagaugaagguugcagugaguugaaaucaugccacuguacuccagccugagcaacagagcgagacccugucucaaaaaaaaaaaaaagaaagaaagauuguuaaagaucuacuuugguaaaaugugaaggaauuaaacauuccaguuaaaaggcagagagugucagacugaauuuaaaaaaaaaaaaaaaaagacaaggcccaacuauauuauguuuauaagaaaugcacugaaagugaaagaauagaaaaagguauaccauacaaacagcaauaacaagaaaaguguguagcauacguuaauaucagacaaaggagcuuaaagaucaggauuucuuccagagguaaagguugggggggcguucuucguaaagauaaggaucaguucaucaagaagauacaacaguccuaaauguguaacuuuuauaaaacaguauacccaacaauugcagaauauuguuuuaaguagacaugaacugcucaacaauauagaccaaaugcuggaccauaaaauaagucacacuaaauuccaaaaggaauaaaaucauacaugguauauuguuaaaccacaaaauaaacuugaaauuaauaaaguuaacuugaaaaauccccagauaauuugguaucaaguaaacuuguuaaucacuaauggaucagaggagaauuuacaagggaaauuagagaauauuuuaaaucuagaccagaugugauagcauacaccuguaaucccagcacuuugggugguggccaaggugggaggaucacuugaggccaggaguucaagaccagccuggggaacauagggagaccuugucucugcaaaaaaaaaaaaaaaauuuaaguagcugggugugguuguacauaccuguaguccuagcacucaggaggcuggggugggagacuugauugagcccaggaauucaagacugcagugagcugugauucugcugcugcacuccaggaaaggcgacagagcuagaccuuuucucuaaaaagaaaaaauuaaauuaaaaaaauuuuauuuucaauuuaaugaccagaaaguuuguggguguagcuaaaacaguguuuagaaaaauuuucauagcuuuaaauacauguauuagaaaacaagaauuuucggcugggcgcaauggcucaugccuaugaucccagcacuuugggaggcugagaugggcagaucgcuugaggucaggaguucaagaccagccuggucaaugugauaaaaacucgucucuauuaaaaauacaaaaauuacucaggcgucuuggcaugcgccuguagucccagcuauuugggaggcggaggcaggagaaucacuugagcuggggaggcagagguugcagugagccaagaugacgucacuacacuccagccuggguuacagggcaagacuuugucucaaauaaaaaggaaaagaaaauaagaauuuuuaaaaucagugcuuuaagcuaccaguuuaagaagcuaggaaagggccagguguggugucucccaccuguaaucccagcacuuugggaggucaaggcgggcagauuaccugaggucaggaguucgagaccagccuggccaacauggugaaaccccaucucuacaaaaauacaaaaauuagccagguaugauggcaggugccuguaaucccagcuacucaggaggcugaggcaggagaaacgcuugaacccgggaggcggagguugcagugagccgagaucacaccauugaacuccagcgugggcgacagaacaagacuccaucucacaaaaaaaaaaaaaaaaaaaaaaaaaaaaaauacuaggaaaaaugguuagcugggcaugguggugaaugcccuuaguccuaacugcuugggaggcugaagugggaggauuccuugagcccagcaguucaagguugcagugaacuaugauugugccacugccuucuagccugggugacagagugagaccaugucucuaagaaaaguuggugaggacgccaggggacagcuaggaaaaaaaaugaaagaaaauuauuccaaaaguaguagagggggaagaaaauaaaaagauaagagcagaaaucaaugaaguagaaauagauuauauuaucagcaaagucaagaguuuguuuuggguggguuuuuuuauuuuuuauuuuuauuuuauaagauugauaagucccuaacaaaacugauuaaggaaagaaagaacaaccaagcaaguugccaauaccaggaaugaaagaguagacgucaguauagaccuuaaaagaauaauaugggaauauaugaaugucaacaaaugugauaguuuggaugaagugggcaaauuucuugaaaaauagcaaaccaacacaagaggaaauaaaaucucaauaucucuauaucuucuaaugaaauugaaacaguaauuuaaaaucacccagaaagaaaauucuagacuguuuuuacuguuacauucuaccaaacauuuagggaagaaauaauuuucacuaaucuuacacaaacucuuucagauagcuaugcaccaugaugcaugccuguagucccaguaacucaggaggcugaugcagaaggaucucuugagcccaggaguucaaggcugcagugagccaugauugugccacugcacuccagccaaggcaacagagcaaaacccugucucuuaaaaaguaaaaaaagacuggguacgguggcucaaaccuguaaucccagcacuuugggaggccgaggcgggcagaucacgaggucaggagaucgagaccagcccagccaacauggugaaacccugucucuacuaaaaauacaaaaaaaaaaaaauuaguugggcaugguggcgcgcgccuguagucccagcugcucgggaggcugaggcaggagaaucgcuugagcccaggaggcggagguuacaguuagcugagaucgcgccacugcacuccagccugacgacagagcaagacuccaucucaaaaagaaaaaaagaaaauucagagaauacaggaagaggaaauauuugcugacccuauaaccaaggccaaauaacugaaauaccaacugugacuggaucguuacaagaaaauuauagaucauugucccccaugaacauaaacguaguaauguuuauuagauguagaagccagcacuucagaagaaggauuguauaugaugacaaagauuuaucucaggacugcgaagcugcaacauuugaaaaucaguuguaacuuaccacguuaacagaccaggaauaaagaauagagaauccagaaauagacccacucagauacuuaaaacagaguaccaagacaguucaauggagagaaaagacauuguuuuaacaagagguguugcagcagcuguuuaucuguggaaaaaauaaaacuugaccccuggcuuaaacuauaaauuaaaaauaauuuggaauagauuauagacauaaauugguaguagaauuggaguagagcgagggggguguggcacgaucaggaacucacggaagagauuugcucuaaccauugaaugcguaauccagaggacaagcaaugggaggccaagccaggugaggaaacacagagcagccuggagaugcaaauauacaucaaaguggcugaugucuuggucaucacccaggaauacuagaaauaacuggauggguucuacuccccacagaauucuugaaagcgcuaguccccacauuaccgggauauugugggaaguuguauuaggcuucuccugagcuuacuggagcugcagccagacuggacugcaccuccaagggagucccaguggcuccccuugucuaagauacugugcugcuuucugaagccacauuuuuuuuuuuuuuuuugagacagagucucacucugucacccaggcuggagcacaguggcccaauauuggcucauugcaaccuccaccucccagguucaagcaauuuuccuaccucagccuccugaguagcugggacugcaggcaugcgccaccacgcccagcuaauuuuugaauuuuuguagagacgagguuucaucauacuggucaggccagucuugaacuccugaucucgugaucugcccaccucggccucccaaaaugcugggauuacaggugugagccacugcgcccggcccuaaagccacauuuuaagagggauaagaacaaauagaauucauuaaauuaggaguccaagaaaggaaggggagaguguccuaaagaccaugugaagugaguaaugguugaagggacuggaguugacuaaccugaaaaugagcaaauugcaaggggcaugauuguaaucuucauguguuuuaggagcagaaggauaaacuucugcugugggcuagacuggugaaaauauagaaaauguugagagaagagguagguuuuauuaacugaagugaauaguuugaacuuuuaucuugaggacaguggaagccaccagaaggucuaaagcacgauaauguuauuacauuuauauuuuguaaagaaucacucugacuaccaucuuuagguuggauuuagagguuguggaagggggagguacuguugaaauauagugaaaaccugcuuagaugaaauaccaaggaaagagcacaguauaucaaaagugaaugaucccuaaguacuguagaaacuuagagaagaaauuugauauaaccuaguauggcagagaauugggcccuuucuagggaccuuuuuacucauauugccagaacuuuuugcagcugcuuuaggcagaaugcagccucacaguccuaucuuaaggggaagcauugaaaccagaguccauugucuauugccuuggaaaugcuaaaaaagcuccucguaaaccugucugcugauuuggcuguuuguccagauacuuaguauuagaaucacugaaccuuaauguugguguugaauguaccauuucugcuacuucucuaguugguauggguccuugcugucccaucugcauaacugccuaggacagcacuccauguguuauaaacauugcuugcauccaaggauaguggacaguauauuggcucccccuuccccugcccuccauauugccauaaaauucccaaacuauucaguacacuuuaauuuccaagauuauuaauuuguacagaugcuggggggagagguagacaauuaccaucauuaaaaugcugcauuacuuuauaucauugaauaaugucaaacauuuuuuaaaauuuuuuuaucauuuaaaaacaucucuuuaagcuggaagcucuuugacauccuuuggaacagaaacaucaaacagugguaccuuaccccaaaguagugcgguugguucugccuuuacacaggauacaagaucucuaaaaacacaguuaucucaagguaagcuaucucaucccuaaaauauuuccauucuaaacuuuuauagugguuuuugucuuucugaauguaagagcuuuugcagcuuguaaaucgcguguauaauuucuauuuggcucuuuuaaaauuuuucuccaaaucgcuguauugcaaugaauauauuauugaaugacucucacuauuuagacuuauuacaguucuuagaucaugaaacugaaaugcugagcauucucuaaguuggacuuuuuuugcaaagcaauuauauaacuuguauguaacacuuaaauauaucaaauuaggcucauacucaccauuaaaguugagcuauccaagaugaauuggaaauaucaucugaaaaaaacuguauuaugcuguuaacauuuucccuaacauccucacaggauggagaguagugguucucaguguaggcuacccacaacugaaucaucuggggugcuucuuaaaaauuuaaauccugagacuuauacaucagaaucccuggagccugaggauuuauauuuuaauaagcuucuuaaaggauuguuuuauuucuuaagauucugcucuucaaccagccagucucauaauuuuaaaugguuauccauaccuuuuauucuuaucuuuguuucuuccuuuuuucuuaaucuuuuucuuucuuuuauuuacuuauuagagaugaggucucccuguauugcccaggcuggucucgaacuccugggcucaagcgauccauuugccuuggccuccccaaaguguugggauguugggauuacaggcgugagccauugggccuggcuuuuuuuuuuuuuuuaaagauaggucucacuaugcugcccaaacugaaaugcaguggcuauuuacagaugugaucauagugcacugcagccuuggacaccuggccccaaacaagccucccacuuuagcuuccccaguagcuggggcuacagccuugugccaccaugcucggcuuuuccuuaucuauuuuuaugcacuuuagaaauggguauuuuuggcucauugcuuuauaugaaugguuuuuguuuuguuuuguuuuuaaguaaaacaauguugagucauuucagaaagaccuauagucacaagacaguauuuuaaaaagcuauuaaggguaaaaauucaaugcuaaacauaaucuuauguauuucacuuaagauauuuugaaauaguucuuacuguuacucauauugauuagcuuaauuuuuuucuuuuuuuuuuucuuuuaagauggagucuugcucugucacccagacuggagugcaguggcacaaucucggcucacugcaaccuccaccucccagguucaagcgauucuccugccucacccucccaaauagcugggauuacaggcacgugccaccacgcccagcucauuuuuuuguauuuuugguagagaugugguuucgugauguuggccaggcuggucucaaacuccugaccucaagugauccaccugccuuggccucccaaagugcugggauuguagaugugagccacugcguccagccuacuugcuuaauuuuuaaacauucuaaagauuguuuguuuguuuuuugagauaggguccugcucugucucccagacuggaaugcaguggugugaucauggcucacugcagccucuaccuccugagcucaggccauccucccaauuagcugagaucacaagcaagcaccaccagcuaguuuuguagggacgggguuucgccauguugccaaggcuggucuggaacuccugggcucaagugauccacccaccuuggccucccaaagugcugggauuauaggcaugagccacagugcccggccuauucuggaauuuuuaguuaaaucaggaacacaugaaaaagaagcauaaauauugaaauuagcauuauucaugaagaaugagaacuaauaaggaacuuaaauuaggcacaggcaaaauguaaauuaaauauacaaaagucaauaguucuggccgggcacgauggcucaugccuguaaucccagcacuuugggaggccaaggcaggcggaucgccugaggucagggguucgagaccagccuggccaaccaacauggugaaaccccaucucuacuaaaaauacaaaaauuagccgggcaugguggcgugcaccuguaaucccagcuacucaggaggcugaggugggagaacccgggaggcagagguugcagugagccgagaucacgcuacugcacuccagcuugggcgacagagcgagacuccaucuuaaaaaaaaaaaaaauuuaauaguccuaaagccuaauccauugauuauguaaugaggagaaaagaugauuacaguaaugcaaaauagaaauuguauacaaaauauauaauaagaaauaaguuggucauacuaagaaauaugaccaacuucuaugauaaauaauguaagacagggacauaaaaguugcauguaauggaaaaaacauaucuuauugcuagauagaagaacaagaacaguaccagcacuuagggaggcaaagccaggaugaucacuugagcccacgaguuugagaccagccugagcaacguagugaaacuucaucucuaccaaaaaauuuuaaaaauaagcagaguaugaugguggacaccugugguccuagcuacucaagaggcugagacaggaggaucacuugagcccaggaggccgaggcugcagugagcccuaacugcacuaccucacuccagccugggcgacagaaccaagacccuguccccccccaaaaaaaaaagauguugggaagacuuuacuccucauaguuaacaaauuuauugcaaauuaauuaaaaaucaaugcaaauagaauaguaggagaacuuaguaaaacaguuuaucuuuaaaauaaacauggaaguguggcuggacauauuugaaaaauaaaaguaauggguuuacugacaugauaauaaaauguagcaaugcaggaaaaaagaaagagaugaauagaaagcaauaggcaggcagaaacagauccgaguauaaauaagaauuuauccugggugcagugguucaugccugaaacccuaacauuuugcgaguucaagauggaagccagggauuugagacuagccugggcaacauaccaggacccugucucuaaaaaaauuaaaaauuaguugggcgugaugugugcgccuaucagcuugagaggcugaagcuagaggauugcuugagcccaggagguuaagguggcagcaagcugugauugcggcccugcacacuagccuaggcaacagagcaagaauucaucuuaaaagaauuuaguagaugauaaagguauuauuuuaaauuaguggagagaaggcugucuguuccaauuaauaauguugccugaucauuuggagaaagucacucuagauucuuucccucauacugagcaccaaaaaauauauaaauuuuaaauagauuaaaauguuaaaaauuuugaaguauguguuuauuaaaagaaagagguguauuuacauaaaguuaugacaaaugacaaguccuaagaguuugcauuuaaguuuuaucaacuaaaauugcugaauuucacaaaauuaaaauuccuagaauuuuaagugugauaagauugugaagauagcucaagggagugugucuauaauaugcagaaaucacuucuggauuuauuccuaauaauguauccaguaucacaguaucaccuguauuucccuguuuauaacaaaacuggcaucaugaugauuaguaggccuuaauagugaaaaggcuuuuuaaguacacaacaaauguuucuguacuugcuccgauugccccauugcuuguacuucuguaguacuugugagccauaggaucuuuucucaaaagccuugauaaagaaguuuuauaaacuuauaagaugauuuaauguaguaccauaaaauuaacuguagcaguaggcuuuuucaggaagacaugugaaauaaaaaaaauuagcaaggugugguagcgcacaucuauaguccuagcuacucaagaggcugaggcaggaagaucauugggucccaggaguuagaaguugcagcgagcugugauugcgccacugcacuccagccagagcaacagaacaagacccuauccugucccuaaaaaacaaaaaacaaaauguguuuuauaagugauuauaaaauguuuuuuucauaggccaaaacuuacauaaaccaugauuucccauuauaauccaguggaaaaauuguaaugcuucuauuagugguaacuuaauuuugaaauguuaaguagauugugccugugucgguuucuggguuuugauaaaugaucauuuauuuggcuaacuuugccauuaauggcugaaaugguauugcacauuuguaagugcauacuuuagauaaucauaaauuggggaaauauuacuaauaaauuaucccugaaucaucuagguacauaauaaugcauugucagcacucaccaguuguuugacaccugcaaauaugcacagauggacaguaacauuugcagcauauuugggggauuuuuuuacgugaaaugagcauuuuuuuuaagcaaaacauuauauuuuggaauaauuaugagaugugagugccuaagcagagauguacagcaaacauuaucaggacagaaagcaugaugggagcacccgauguuacauucuucaguucaugcugugaccaggcgaccucauaaaaggaaaaauauaauguauaaguacaaaccccauuuuuuguuuuggcucuuuuauauuuguauuuuuugagacagagucuaguuuugucacccaggcuggaugcaguggaccgaucucggcucacuacaaccucugccucccaggcucaagcaauccacccacuucagcccccugaguagcugggguuacaggcaugugccaccacaccuggcuaauuuuuguauuuuuuuuguagagacaggcuuucgccauguuguucaggcuggucucgaacuccugagcucaagcgaucugcccaucucagccucccaaauugcugggauuauaggugugagcaaccgcgcccagccaaaccccauauuaagcaaaaacuugccaagagaucuuuuaaaaggcaaggaaugaguauggcuacuguguaauuaucugaaggguuuuuuuuguuuguuuuuugguuuuguuuguuuguuuuuuugcuggccuuuuaguuuuuauguuuaauuacccaagccccuaaagcauuaaagaacuucaccuaucuaacuuuguaguucuuuuacuuuauuuauuuauuuauuuauuuauuuauuuauuuaugagacagggccuugcucugucaccuaggcuagagugcaguggcacaaucucggcucacugcagcuucugccucccggguucaagcuaucccaucucagccuccugaguagcugggaacacaggcacgcgccaccacgccuggcuaauuuuuguauuuucaguagagacaggguuucgccauguugccuaggcuggucuugaaauccugggcucaagcgauccuccugcuucagccucccaaaggacuaggauuacaggcauaugccacugcgcccggcccuuuacuuucuuauaauagaaauuuaauggaguuaauaccuguagauagauguaaagguauuguuuuagucaucuacagaaaguacuaagaaagauuaaaacaagucaccauagucuuaugguugucauuggcgaaagccuguguuugaccugacuacaacaugauaauuuguaggauaauucuagggaaucucguaccuggcagcaauuuuuuuuuuuuuuuuugauguaaacucuuccacuaaguagaaauaacagauaaaauugugagggggagggaguuguuuugaagcuguugaaguuuuuuuuuaaauuauuauuauuuuuuauuuuuaaccuaaugacaagcccacuaaggauaccauucuuaauaucuggucugauaaguggauuaauucaaauuugugcuaaggguuugaauugauagaaauaaaacucuggacaauuuuuuuuagggucuagauuauuuugaaauccccaauaggguaguuuguuaucuuuugguuacauuuuaggucgcucaagcccucaguuagacccuuugagaaaaagcccaaccauggaacaagcagugcagaccgccucagcccacuuaccugcuccagcagcuguugggagaaggaguccuguaucaaccaggccuuugccaucugccagccaaaaggcaggagagaaucaggagcacaggcgagguagaacuuuagcuguuuacuguuccuuaauugacugaucaauguuuuccacucacuuuauuuucauuagaaggauuuacuucaugugaaugaucccagaaaauuaaacugaauaugauagaauguuuggucuuucaaauuugacucaaagugguggugguguggguauaguuuuuugggcauugcacaggcuuuguuuuggguuuuuugguuuguuuguuugcauuucuaacuauggaaguuuuugaugauguacccugaguugauuuggcacuuugcaugucuucuucuguagcugaaguacacaaaguuucaaggccagaaaaugagcaacucagaaaugauaacaagagacaaguagguaaguucuuggaucuaaaagucauauucuaugcuucucaacagggagaauauuuuaaauauaugauacauaauuacuauaaaaaaaugaaaggcggggguugugacuguaaaggaggagcacaggggagugucacuguggugacagaacaguccuuuaucuugauuguggugguaguuuugcaaaucuauauaugguagaacaucauagaacuaugcauaaagacauaccaaaaaaugaguacauguacaaacuggugacaucugagcaaggucuguaguuuaguuaauuagauugugccugugucgguuucuugguuucgauaauguaccauaauuauauaagaugugacuguuggaguuugggaaguugggugaugggcacaagggacgacucugaacuaguuuuucaauuuuucuuuucuauaauuacuuuaaaauaaaaagauuuuuuaaaauuuuacuuuucugggcccggcacaguggcucacgccuguaauuccagcacuuugggaggccggggcgggcggaucacgaggucaggagcucgagaccagccuggcuaacauggugaaaccccgucuccacuaaaaauacaaaaaauuagccgggcgcaguggcgggcgccuguagucccagcuacucaggaggcugaggcaggagaauggcgugaacuggggagguggagcuugcagugagccgagauugcuccacugcacuccagccuaggcgacagagccagacucugucucaaaaaaaaaaaaauuuuacuuuucuggaaaaaaauucuacuuagugguaggccuuuuuuuuucugagauggaguuucacucuuguuacccaggcuguagugcaguggugugaucucagcucacggcagccuccgccucccggguucaaguaauucuccugccucagccucccuaguagcugggauuacagccgcgugccaccauacccagcuaauuuuuguauuuuuaguagaaacagggcuuugccauguuggccaggcuggccucaaacuccugaccuuauuuuccacccaccucagccucccgaaguauugggauuauaggcgugagccaccgcacccagccaggcaguuaucuuuuaauauguucuugaguauuuccugcuagaaggauuuguucguuuauauuuacauuuuccuauggcuucuacuuuugugguuuuuauguuuugugucaguuucaaguuaggauuauaaaauugguuuucauuguuuucuaugccuuugggaauggaauuuucuucauguuacaaguuugaaacguuuccucauuaaaauuaagcccagaggccaggcacgguggcucacaccuguaaucucagcacuuugggacgccgaggcgggcaggucacgaggucaggaguuugagaucagccuggccauacggugaaacccugucucuacuaaaaauagaaaaauuagcugggugugguggcacacgccuguagucccagcugcucgggaggcugaggcaggagaaucacuugaacccgggaggcgagguuguagugagccaagaucguaccacugcacuccagccugggcaacagagcgagagucugucaaaaaaaaaaaaaaaaaaaaauugagcccagauccuguuuuugaaucaguuguuuaagagcuguaguuuucuuuuaugauuauugauuuaauaagguuuuauauuuucuuuaucuguuuuguaauauauaacauucuaaaaucauucauuuuauuaauauuuucaaauuuauuaauggaaaauaaauuauaauuuuacaacucuucuaaauuaaaaagggaauguauaaucuaccuuauuuagaaaaugauugaaaaaugaucuuucacuuaauuuuagaaaucuagauaugauauuuuuagauguauauguacucuucucuacauuuauauauauauauauuuuuauaucccccccccccguguuuuuuuuuuuuuuuuuuuuuuuuuugagacagagucaaccucugucacccaggcuggagugcaguggggcacgaucucagcucacugcaaccuccaccgcccggguucaugccauucuccugccucacccuccugaguagcugggacuacauaugccauggaauacagaauuuuguuuaauuugacucauuauauuuuacccuuuuuauucagaaaaagagagagcuccccucccaaaauaaaauaacugccauacuaucuuucauugcccuucaaaacucaccccaccaaagagguucauuaacagaacagugcauauucuucccgauuuuuuuuguagauuuuacagacacagacaucuauacccaaaaccuuuuuuuuuuuuuuuuuuuuucccccuggagauagaaucucgcucugucacccaggcuggaguguaguggugcgaucucugcucacugcagccuuugccucccggguucaagccauucuccugccucagccuccuggguaggugggauuacaggcauacgccaccacgccuggcuaauguuucuguauuuuuaguagagaugggguuucaccuuguuggucaggcuggucucgagcuccugaccucgugauccgcccgccccggccucccaaagugcugggguuacaggcgugagccaccgcgccuggccccaaaauauuuuuuuuuaagacagaaggaucaugguguaauucuggcuuguggccgaggcauuuuuaauaguagaggugaauguuucaaacauccuacuuaucuagauuuaugucuggauaugcugcugugggguuuugugguuuguuuucucaaacccaggcaguuugccaaaccucagcaaacagcgcaaaccuaucuuguuacccuguagucacuucucauccuugucaguauguguggagcauuucacgcaauugugaucauuaaacucauacugguuucuguucugcguuuuucaguuaacaucaaauauucuuccucuguuuuuuucuuguuagucauuuuucuuguguuggauauuuggguucccacguuuuucacuauaaauuaugcugcuuuguauugcuuuaucaugucucuuaugauuggcugaaauuuuacuguguuauagaggagagagaauguguagauacaggaaggcuugaauaauauagagccaucuggagagacacaguaaagauggaguaggaaguguuuugagucaguaaggauuggugcuugucuguuuuuuaucugugauguggaaauaacaccuauuuucuugcaauuugugccgauuaguguuuauuuuucuuacuauaaaucuugguuccuguuauucuuuccauaaaaggcuuucuacauuuugagaacccacugugugucuggcacuucaguuugccgguguuggggauauagcaguaaggaaaacaaagccccugaccucaaggagcauacauuaauuuagugcagaagccuccacacuugccuggcuguauacucugucaguaacacaugugaguguggacuccauaaauacaaauguuuagaaauuuugugugagcuauucucagucuacauauuaaauauuagugaaacuuaauuuuuuauuuuguauaaaaaauacaaauacaauaaaauauauagagagaccuguaagcauuucuguuguugacuguugaaucuaaagagcacaauagcaacaucugugcuaaaccagcuauuacauauugaauguccuuuguauauauucuuuauuaucauagcuccaggugcuccuucagcuccaaggagagggcgugggggucaucgggguggcaggggaagauuugguauucggcgagaugggccaaugaaauuugagaaagacuuugacuuugaaagugcaaaugcacaauucaacaaggaagagauugacagagaguuucauaauaaacuuaaauuaaaagguaagcuuugauuuuucuuuucagaaaauaaucuuauuugaucugugaauuacagauguuucucagauuagguguuuuuauguaauucagauuagcugucuugacuuuucugauaugugcuuuuguucuuagaagauaaacuugagaaacaggagaagccuguaaauggugaagauaaaggagacucaggaguugauacccaaaacagugaaggaaaugccgaugaagaagauccacuuggaccuaauugcuauuaugacaaaacuaaauccuucuuugauaauauuucuugugaugacaauagguacaguuuuuaagcuguucuuuuaucuuaugauauugauugaaguguaaaaugguuucauguaaauucacgagguuuaaugaauacuaccauaauuguuuuguuuuguuuugagacagucuuacucuguuacucaggcuggagagcagcagugcagucacagcucacuguagucucaagcuccugaccucaagcaauccucccaucucagccucaguaaaggggacuacaguuguacaccaccccacccggcuaauuuuuuucauuuuuuuguagagaugggggucucgcuauguugcccaggcuaaucgugaacuccuggccucaagaucagccucccaaaguacuaggauuacaggcgugagccaccacaccuggccauaauugauuuuuuaauguuuuauuugcuaaaagaaaauauauacuaaaguucuaaauuauucauucaaaagaagaaauaaccauauacuuuuguuuaaggauauauucauauuugaauauuagcaauuaaaacaagcauuuagguaaugucuaaguaggaccuuuuuuucaccccuguauguuacaguucaaaugaagccagaaccgaagugcuaaucuacuuugaaguuugcugguaccauaaaacugccagauuguaguaaauguggguccagaaaauuggcaaauuauugagagguuaauuaaaggacccagugugaggaacuaacaguucuagagguucuccugcccaauccaaauugucauuguccuuguccuuuuccuggcugaaguuuggugcccucugguggcaguuguuugcuucaauauaaacauggauggacauaauucugagucccacgauuggcuggaugacagcagcaauaauucagauacuucuuggguuacuugguaucggguccauagauugggccaggaacauaauggggaccuaagggcccaccuuccaucuccuagcuucccaagacaaggccucccugucugacuuuaccuucuuuucccuuggggcugaguggaaagcgaagucaauuaccaaucucauuauaucugaauuuccauuauuuuggagcuguuacuauguuuaucagguguauuugcaagaaacuaaugucagucauguguucacaugaaguuuaacagaauauuacaggaacauauugaacucauaugccaugaacaacucgugauaacuuagauaagaugcuuuuuuuuuuuuuuuuuugagauggaguuucgcucuugucacccagacuguagugcaguggcucgaucucgacucacugcaaccuccaccucccagguucaggugauucuccugccucaaccccccaaguagcugggauuacaggcaccugccaccaugcccagcuauuuuuuguauuuuugguagagaaugaguuucaccauuuuggccaggcuagucucgaacuccugacuucaggcgauccgcccccucggccucccaaagugcugggauuacaggcgugagccaucacgccuagccaagaugcuuauuucuaauuagcuuuaguaauuacuuaggcuuaauuugggaguagcacugcauauuuuggcugagggauauucuuuuaaaccugauaugcugaagauuauuugcuuuuauaauagagaacggagaccaaccugggcugaagaaagaagauuaaaugcugaaacauuuggaaucccacuucguccaaaccguggccgugggggauacagaggcagaggaggucuugguuuccgugguggcagagggcguggugguggcagaggugguaccuucacugccccucgaggauuucgcgguggauucagaggaggucgugggggccgggaguuugcggauuuugaauauaggguaaguguuacuguuaauaaauucuuugggguugacaugcauuuuacaagacucaaaacauuuuuacuuguuuuuguuuugggugaauuguuuugaggacauuagaauaacuuccauuuugacuuuucaguagaggauauacgugauucagauguauauauaaagacauuauacaaaaaaagacaguauaguaucaccuuuauuucauguuaacagaauauacuuuuaacacccaaagagucuaucuaggaagcacauacucccagaauggaagggcaagcuuuaacauuuaauagcaguuaacauuuauauaguauuuaccaaguaacaagacauuguuuuaaauauuuuuuuacauauuaacuuauuuaaacugcacaucaacucugugagguagguucuauuauuauccccauuuuacaagugaggaaauggguauagagauauuaaguaacuugcgaaaggucacauagcuaguaagugauggugcuggguguugagcccagcaaguuguuuccugagucaguacucuuaauuugguuuuguugaaaauucacuacauuuucccugguuuucuccuuucaccaugaaauugaaaauguuucgauauauuggccuucaggagcuacugcuagagaauucuguaacucuguauaguagccuuauguguauaauguagcuuuugacaggugucuguaaauuaagucagcauaguaacuaucucaguuaacaguaaacuaucuuaguuuauugauuuuagaaguaguggagaggaagggcuauaacagaaaggaccaaaaucuuguaaagaguuccacuuguaauagcaacaggcagcuggaaacagaaagaccuguuagcaggaguuccauugcccaguacuuaaaacuggccauuguugagaucucucuggaaagagaucaguauuaguggcuuuuggaccugcucuauuaauuuuaaugcuuuugauauugugccaucacagccaagacugccaaaaauuauacucaagucaccagcuuaugccauccagccguugguggccuuauguaguugcgggacuucugacuugcaaaaucaccuucccagcuaggagaaucugucuuaggaacuccagaauagcccucgcuuaucacuguuacugcccuuaaguuugccagugacaccuugcuuacagaauucagcaguaguauuuucacaaauauuuuauuugccauuaacuccucugcaauauuugacacugaccaaccacccaauuuggggucuuucuuccuagucuuuaaaauacucuucuagguuuucaauuuauacucuuccuaauuuuuuaauacucuucauucuuuuuuuugggggguggagggugucagggucuugcugugucacccagacuggagugcaauggcaugaucauaagucacugcagccucaaccucccaggcucaggcaguccucccaccucagccuccuauguagcugggacuacaggcaugcaccaccaugcccagcuaauuuuuaauuuuuuuuguagacacugggucccacucucacuauguuguccaggcuggucuugaacuccugggcuuaagcgauccucucaccucagcuucccaaagugcuggguuuauaggugugccauggugcuuguuccauccucccuuuuguaagccuguccuggacccuauguguuucugcaccgcaucucuaucugcacuguuugcugucagcuuaaccuuccucagacugaucucaucaucuuccuucucuccugucaucucagcucugccuccucccaguguuccauguuggcucaugguauacugcccaggcacuagagguauccaugauuguggccuguugccauuuauuccuuugagaugucccugucaacuaccaugguaacccaccaguugggcuucagaccuucgucucucuuuaccccacuuuaaggcagaucagcuacauuuugaacaaccugugacaacuccuuguugaagaccacauugagucagcuuggucugagaaaaaguacauuuaaauuagacuuggauccagaugagaauaauagcaguaguuacuaguaugaccuuucagacccuugguuuugacauuugugaauaaagaguugcaccauuuauucugaaauaacaccuuuuaaagaucauuaaacuuucagaguuggaaaacaucugagaggucugaccugguuaaaacauaaaccucuucugcaguaucucuuauaggggcugggagcuuacucuucccaagggcauccaucccaccccagggauguucuaacuguuacaaucucagcugggcgugguggcucacaccuauaaucccagcacuuugggaggcugaggugggcggaucaccugaggucaggaguucgagaccagccuggcuaacauggugaaaccccgucucuaccaaaaacauaaaaaaaauuagccgggcgugguggcacacaccuguaaucccagcuacucgggaggcugaggcaggagaaucauugaaccugggaggcagagguugcagugagccgagaucacgccacuguacuccagccugggcgacagagcaagacuccgucucaaaaaaaggaaaaaacaaaccuuccaugcaguaacugugugugcuccaugugguuacuaauacaaacauuuuuuugacaccaugucacacuguuuaucauuuugagccuuuuguaaaacucguaucacauauauugcagaauugaaaaugcauugucauaguuaccuccaugcaucuuugucuacgcuccuguauccuugacagauaguccagccucugcuuagguguugccaggagugauggacucagcgaacccucaggcauggcccaguguuuaggaggcucaguugugacauuguagucccugcucuucuuaauugugugaggaucccacuugauauauuuggccucauuccucauuacccuuuaaccuaucugauucaagcaagcugccucaugguuaucucacauacacauugugcuugauuccaacuccauccccauucauuuaccaaauauacagaauucuucagauaugccaggcacuauguugagcauuggugcugaccgauguaggcccagcccuuuugauguuuacauuuuggugggagacagacauagcuaaaagucagguccccccuuucacuuauccuuuacagccuugcccaaguuuugcucugucuucucuuccuuccuacacugauuuccuccucuucugaccuguggcuaucugcuuucuuuggcacacauuuuaaauacacugacauucccuauuuuuuguauuuaguuuuguucugcaucaccagcuagaugagaaccucuuggcuuuagugaauauguauucuacuuuucuuuccaugacaacacucagcucaacauggagccauagugggcuugaaguaauugcuugucauguugauuaggaauuugccacuccagccuucagugagaccaaaggucugucaauguagcuagccuuugauuguucauuccagaguugaauaauccuuucaucugccacuagagccccgaacccagcagcccuacaccuccuaaaucauaaaaucauuucaccuggcaccuuuaaagguagaaaauggugagugaucacugucacauaaaggagauuuaccacugaagauuaaacuuguaucugaaacaucuaacacuuccucccagagauggacauggaugacauuucugcagccuucaugaaaugaguuggcuuuauuuuuugugcuauauuagcaugagucauugugguuuggggguaagcauaaaugagcuugguuguuuaaugaaaacauggguaaagauaaaaucauaaaguuuuagaauccuuaaaagaaucagccaaacuagaaucucuacgcuaccacacucacauuagaugauaaggaaacuaaggaccccaagaaguuaauugucaugauugagguacaagcuaacaaauccaaaacucacucucuugacuuguggccugauuuuccuuaaggguaauauuguaaauauaggccagugcaaugguguacacauguaauaccagcauuuugggaggccagggcaggauugcuuaagcccaggaauucaaggacagcaugggcaacauaaggagucccuaucucuauaaaaaaguuuaaaaauuagcuggagugguggcacaugccuguagucccagcuacucaggaggcuaaggcaggaggaucaguugaaccugggaggucaaggcugcagugagccaugaucgcaccacugcacuccagccugggugacagagcgaggccugucucaaaaaaaaaaaagaaaagaaagaaauauaaccuuaugguaaguuugguuguaugguguuuucccccucccaccgcccauucuuuuuugaggugagaauggaaaucaggacuagcaauaauaauguaaccagcuccuguuuuauaugcugcugucagggagguuaagccaccauggugggugauaaaaaucacaucuguguuuccucagaugggguucaaagacaacaaggugucugaaugacucagcauaaugcucucucuccucucccccuuucauuuucuccuuucucccucuccuguccccaucucuuucucuuuuuuuuuuuuuuuuuuuuuuuaccuuucagaaaaccacagcuuuuggacccuaaaaggucuggauugaucguacugcuuucugaaagguaaaaaaaacaaauacuuugggaggugugaagguuggcuuugugggggacagcagguucaucuuguagcucauugcugucaacuuaugccauaccauauguauuucaguuuaauaacggggugcaaauguuuugguguuguauacacagaugaaguuaagucucaccuaggaaaugucuguuucuaacaguuggggugagaaucagcaguaaaaaccagguauaugguagcagcuggucuagaggaaaauaaaagcccuuggcuccagcccuuuguacaggccuuuaguuuagggucagucucucuggaaaucuugagauuuuuauugcuuccucacugguuacuuuuuaaaaauuccccagucagcuuucuacuuuucagagcuuauuucagauuuaagaguuauccuuguaaaauugauuuuuaaaccauugcuuccuccuggcaugaaauuuuggagagaaauguuauacugacuggguauuuuauugcuuaguaaagacaucaaagacuuggggauuuuaugaaacuuguuucaaaguauguugacaguuguauuugaugaguuugacuauugaguugaggguuuaaguccuaucacugcuuuuaaaaaauuauuagggagaacaaccaaagaugaggaaguaugccuguauuuuggggugggguucaccacugcauuaaccucuacugacuggaagaugcagucaacaaugagguacuacugaguauggaaguuauagaaggaguuucguggaaaugagugagacagguuuuucuaugaaaguaaaagugggggaguauauuuaaagauaauuuaaaauaaacuugagcaaaguaaaaagaaaauaauacaccaauaauuuggaacaugagcuaaauuuuuuuuucuuuuuuagaaagacaacaaaguugcugcauagucuacaaacaagucucugaaaauaggugaauuucuagcucuucaugguccugaacauugauuucagucuuugcaaagaaugaagaagugaauucgcuguacauuugucaccagcacuggguuuuuguuuuuuguuuguuuuuccgcuuaauuucaaagauaaaaugcaguuacuuuuggggguggaaggcucaucuuaaaacaugagcauuaaauauauuuggaauagcagaagguuaaguaauuucuuauguauaguuaaacuaaagcaguacuucagugggacuuaacaaguauuuuuucaucacugaaagguuuuuuuuuuuuaucacuaaauuguauuuggcaauugcaaguugccugcagauagggccgugauacuguguuuugagccacagaagguuguguguguguguguguguguguguguguguguguguguaugugugugucuuuuuccuccuuucuuuuggggaauccuguaauaugagguagcuuauuucgucaauuaauuagggugcuggaugguagagaauuuugucagucaacuauguacacacaguaaauacuguuucuuaggcaaagguaacuuuuuuauauaguuguaaaauuccauuauauuccauugccaaagaaacauuaagaacuuuguauagcuguauaaaaagcaacuaauuuuuuaaagaauaaacauuuuaaagucagcaaacauacuguguccuugcagaaguugaugugcugagcagcagccuuaugggugggucuuuuuuucuuaguuuuccaggcuuaacauuuuugauuuuguuuuuuaauguuuggaacauaaaugaagauuugauacauuauuucauuaucuaaaaaggauuaauuauucaugcucauuguaagaacuucauuuuguagcaaauggcauaucacaggaucuguccagauaaucgauauuuucaguauacaaauguaaauaaucacagaugagaauguacuuagcuguauuuucaaauaaguaaucuuccccccuuuuguaggacuuuaaaacuaggcaucaaugaaccuguuuuuccuauuaugccuggaauuuagucaugauaccuugacucauuccaucauauuucaagaggauucagagugcuagaaauuauuuugguagccuguaacacacggcaacacugguccuugggccuaugaugacccacagaugacucaguauagaguucauugcuaauuauaaauuacuagugaaucuuuuugauauuuuaagcucuagugggaaaaaucuggccacuuuuguguuuuuaugaaggccauggaauaaaaggauccaaagauuuaaauauuuuuaucuaauauuuugauuguuuucuuaacuuucuccuuaaaacauucaguagugauaaagauauagaaacugcacuguaggagaauuggaauauuuaaggcugguugacauuuuuuauuuucauuuuauaucuuuuguauagcucuacaaggcaguguuuuguaauuugguuucauuaugaagauccaguacuuggcagccauaguuuagacaauauuguucagugcuguuugcuugcauguuaacaacaaaaccuuuuagaggacccacaaaucaugauauugaacacaguuccgaggcauucagagcaucagagcaaguaccauggcaauacauguguagacuguuggagaugucccgggccaauuucaagaaagaaaacuguaaauacuaguucuacuugcucugaaauuaugaguuuaugcguuuucccagcccuccgaaucacugacuggggcguuuugugccccagcaauaacuggcagcauggcauaccugcaguaccccuuacaauauuaaagcaaaguuuuuauucuaaaacagaauaaaacuguucaauaaaaaaugcucgucaaaguucuuucucuuuaaauaguaacauucuguuucaguaggaacauaaugaaaggaaucuuuuaaauggaagagcggaauuauaauguuuguauucccuguaauaacuauaaaucaguuacuuuauuucuaagauugaguuauuguugcagauguuuagggaaagcuaaaagccccuuccuuccccuccuguguguaaauaaaauacuucugagauca

SEQ ID NO: 191753 - RNA, 21836 nt, Homo sapiens
uggauuuaaucauacacauaaacuuuauucaucauugucuuuauguuauaguaggaaaauuaaggcauuucauaaaauaugaaaucaauuguacaaugcaugauacagucaaagaucuggacauggaauuggugucuuaacuaucauuucucaccuuuaaucaauaaacauuauuccucuugaaagaugaugaaaaauuacucauauuaaauacaguaaaaauaaacaucauuaaucaaacacuacauuucuaaccucuuuacauucauuaacaguguggaauacaaacaaugaugguuuuuguuauggcuuuguguuucuuuaaaaugcuaacuaggccaggcgugguggcucaagccuguaaucucagcacuuugugaggccaaggugggcagaucaccucaggucagaaguucgagaccggacuggccaacauggugaaaccccgucucuacuaaaaauacaaagauuagcugggcaugguagugggugccuguaaucccagcuacucgggaggcugaggcagaaaaaucgcuugaaccugggaggcggagauuggagugagcugagauugcgccauuguacuccagccugggcaacagagcgagacucugucucaaaaauaaauaaaauagaauaaaauaaaauaaaauguuaacuaaaaucgauuucuaauuugggaaacauaauaacuaauaccauuugauuuuaaaaagaauuguaucuuaaucauuaagcuaaagacauagcaagaaaacaaugacauggucacuugaagggugucucagccaacuuuucaucaucuaauaagacacccuuaaaguaauuccagcagaaagucucagaaauucauugaucaaccuccaaagcacaucagggaaggugcuaauacaguggauaacaagaacaauaaacagcagaacauguuauuuaaauuuuugagauaauaaaacaauacagaaguaggaacccuugugaaauuauguucugguuuuggguaaugagaucauuaauacguuauaaacuuuauacguguggcacacuguaaggauuaaagaauggaauaagcaagcgagcucccuaaaacaccugauauaagaaacaccaugcugggcacaguggcucacgccuguaaucccacacuuugggaggccaaggcgggcagaucaugaggucaggagaucgagaccagccuggccaacauggugaaacucuguuucuacuaaaaauacaaaauuuaguggggcaugguggugcaugccuauagucccagcuacucaggaggcugaggcaugagaaucgcuggaaccugggagguggagguugcagugagccgagauugggccacugcacuccagccuggguucugggcaagagugagacacucugucucaaaaaaaaaaaaaaaaaaaaaaaaaaaggcugggugugguggcccacaccuguaaucccagcacuuugggaggccaaggcgggcguaucacgaggucaagagauugagaccauccuggcuaacacggugaaaacccgucucuacuaaaaauacaaaaaaaaauuagcugggcaugguggcgggcgccuguagucccagcuacucgggaggcugaggcaggagaauggcaugaaccccugaggcagagcuuccagugagccuauaucaugccacugcacuccagccugggcgacagauugagacucugucucgaaaaaaauaaagaaauacugaauugcaguaacuuuuauaggcacaaacuuccuuaaguuucaagcaaaugaaagucaacccucauuauucaugaggacuucaaguaggccauuuuacaaacaagcuuaagcacccuacaaauggcuuuuucuuacuacagaguucuuaggauaaacguguuuauacuuuggcugaacagucacguggauaucauaaagguggcgaugguaugucacuauccggugaaacugcuugccuuccuucaugauuuccucagucuuuuuuucaguagacauaagauuuuccaaaaagucugaaucuucuaaauauagcucaucaccugaaaaaggaaaaaaucugauuuuauuuuuaaauacaaaauuauuuuucaccauggcagaaaguauaaaauuuuaauuccaucgaguauuauuuuauaaaucacuccaauauacuaaugaaauacaaaucaguauuuuuaucuauuucauauguuuggaacugagauaguuguuaaaucaguauuuauuuugaucuauuuaauauguuuggaacugagauaguuguuaacuaaucuaauucuaugagcuuaccucaauuucuuuauuguguuuuuuuaucuguuuuuugagauggagucucacucuguugcccaggcuagagugcaguggcgcgaucucggcucauugcaaccuccaccucuugggcucaagcaauucucaugccucagccucccgaguaacugggaucacaggugucugccaccacgccugguuaauuuuuguauuguuaguagagacagguuucgccauguuuaccaggcuggucucaaacuccugaccucaaaugauucacccaccucggccucccaaagugcugggauuacaggcgugaacuacugcgccuguccucuuucuuguguuuuuaauauccccuuacaacaccccagccaagaguuuucuuugggcccauaaacaucugugacugguauguuuccacugugaacuguaacuauuauaccaguucaugacucucuuuauucuauucaauacugauauuaagauuggccuugauauucauauacuuuugauguuucaaagugggcuguucuuaucaucuucagguuaauuuagagaaauuccaucaaaacugcuaaauuuucccacuguagguugaguaauaaaucuuuuuuuuuuuugagauggaguuucgcucuuguugcccaggcuggagugcaauggcgcaaucucagcucaccacaaccucugccuccuggguucaagugauucuccugccucagccucccaaguagcugggauuauaggcaugcgcccccaugcccagcuaauuuuguauuauuaguagagacgggauuucuccauguuggucaggccggucucgaacucucgcccuuaggugauccacccgccucagccucccaaagugcugagauuacacgugugagccaccgcgcccagccuuuuguuuuguuuuguuuuugacagagagugucgcucugucgcccagguuagagugcaguggcaugaucuuggcucacugcaaccucuaccuccuggguucaagugauucuccugccucagccuccugagcagcugggauuacaggugugugccaccaugccuggcuaauuuguuuuuuuuuuuuuuuuuuguauuuucaguugagauagaguuaacauuuuacuuuauuuucuucauaauuucauaauucauaauuucaauugaaauuauguccaacugaaaaaaaaaaacaaaguuggcugggcacaguggcucaugccuauaaucccagaauuuggggaggcugaggcgggcggaucaccugaggucaggaguucaagaccagccuggccaacauggugaaacccugucucuacuaauaauacaaaaaaauuagccaggcgugguggcacaugccuguaauuccagcuacucgggaggcugaggcagaaguaucgcuugaacccaggaggcaaagguugcagugagcccagauugcacuccagccugggugacaagagcaaaacucugucucaaaaaaaaagcucccuaauucaaauuagaugacaacuuacgaguucucguaauucaaacuuaaaaugcaaaaaagugagaaaucagccaggcaugguggcucaugacuguaaucccagcacuuugggaggccaaggcggguggaucacaaggucaagaguucaagaccagccuggccaagauggugaaaccccguaucuacuaaaaaaaaaauacaaagauuagccgggcacaguggugggcaccuguaaucccagcuucuugggaggcugaggcagagaauugcuugaaccugggagguggagguugcagugagccaagauugugccacugcacuccagccugggugacagagggaaacugucucagaaaaaaaaaaaaaaagugagaaauuauaugagaaagaccuuugucaaugucuaggaaauauauuaauauaaauguauguguauguauaugacauuaugcagaauuucugguuauaauaauauggauauuuuauaggcuuugaucuuacuuagcuaauacccuguagauuacaaaacacagacuguaauuccugucucuacguugggcaauacagccaugcagcccagggcacugaaugugaauacuaacaaaagcaccgaugcuucacugguuuaccugguaaaagauggaccaucccaucagcaguuaacaagaugaucggcagccaccuuuccaguccuucuaaugcacgacccaaacaaaauuugugcaagucagagagagaggcaaaguuugcaagucuucucacuucguagaacuguggggguggcaaccaaauuucuuuugauaagaaacuuucaguugccucugauggagaugaccacugugaaagacaaaggcaggguuucuuaagguuuaugccauagacaaugugagacuugagacagucagaccaguaccuaagguagaacugaauguguaaaaugaauucauuaaugcgcccugugagaucccucaaagacaacaugaaaagauucagugaagaaagcuggguugauccucuuaagagguugcuuauuaggacacugauccucagaacuaguaaauaaaccagggcagaccccugaggcuugaccugggagagcuguucagcauaagaggugggagaugcagagaggguaaggugguuccggucccugcugaaagaagaaagacucugaaggguaaacucaucacaguagauggagaauuuggugccuguucauuccucugggaaauggguacuuggcuagauccugaggauauaaugauggacaccacaaagcucuccuaggcccuauggggacuucagcaaccaaaaugcuuugugauguggugaugugugccacaugguacaacggcggugaagcaucaggagcaacagcagcuuucaggaagucaccuggcaugacucagccuacagucaagagaguaauaacuugguaggguuucagccaggcaguauuugcccggaaaacuucaguggcuucauucuacaaccuccucuccuuccugagccuucuuuccauagacauuuagauaaaaagagcugauucaauggauauggaauaaccucaaagguuguucuuuuuuuuuuuuuuugagacggagucucgcucugucacccaggcuggagugcaguggcccgaucucggcucacugcaagcuccaccuccuggguucacgccauucuccugccucagccucccaaguaacugggacuacaggcgcccaccaccacacccggcuaauuuuuuguauuuucaguagagacggggucucacuguguuagccaggauggucucgaucuccugaccccaugauccacccgccucggccucccaaagugcugggauuacagucgugauuuuuuuuuuuuuuuugaccgaguacucucugucgcccaggcuggagugcaguagcgcaaucuuggcucacugcaaccucuacuucccggguucaagcaauucucugccucagccucccaaguagcuggaacuacaggcacccgccaccaucguggcuaauuuuuguaucuuuuuuuuuuuuuugaaacggagucuugcucugucucccaggcuggacugcaguggugugaucucagcucacugcaagcucugccuccuggguucaugccauucuccugccucagccucccgaguagcugggacuacaggugccugccaccacgcccggcuaauuuuuuguauuuuuaguagagacgggguuucaccguguucaccaggauggucucgaucuccugacuuugugauccacccgccucggccucucaaagugcugggauuacaggcgugagccaccgcgcccggccuaauuuuuguaucuuuaguagagauggcauuucaccaucuuggccaggcuggucuugaaauccugaccucgugauccacccaccucggccucccaaagugcugggauuacaggugugagccaccgcgccuggccauaagguuguucuuuacuugguuuacuaaauauccacuuauacaccuaggagaaacugauucucgcccccaagcccugggauuuggaauugauuucugcuuuagaugacuguaggucaaagguuugcaagcucguacaugcuuaaacauugacugagaagucugugaagccuucacauucccagggcccugguaugguguccagcaaucuaugaguucagugaguccccuaaucauucugcagguggccaaaauggcauuuaaaaaacagagcccugggccucaaaggaccacccaaucucucuauguuauuuccaaggcaaccguaugaguucagugauaacaacgaagacaaaggguuaaauggcaggcaucaacccacuuaauccaaccuguucaggugaguccagaccacagguuacaauaccuuaucacuuacugauuacuucuuacuaguaaagcauuguacaaaaugcaaugcuuuccugcugagugcaguggcucacgccuguaaucacagccaccugggaggcuacaaugggaggugaguccuaccauggccaggguuacugcuuaaagggaauucccagacugcaacccaaggagcaagagacuaaucagagccugggauuuucacugacuugagacacagcuugaauuuugggaagcccauacagcagaauuugggaagcagcauacaguagucuccccuuaugcaagaggaauacuuucccagaucccuaguggacgcaugaaaucaaggaagugcuaagccuuauacaaacuaugcucuuccuacacauacacaccuaugauaaaauuuaauugaugaauuaggcccaguaagauauuaacaauaacuuauuauuauuaucauuuugagauggaguuucgcuuuuguuacccaggcuggagugcaauggcgugaucucugcucacugcaaacuccaccuccuggguucaagcgauuuuccugucucagccucccgaguagcugggauuacaggcauuugccacuacaccuggcuaauuuuguauuuuuaguagagacgggguuuauuccuguuggucaggcuggucucgaacucccgaccucagguaaucugcccgccucggcccccaagggguugggauuacaggcaugagccaccgugcucagccaacaauaacuuauaauaaacuagaacaaugauaacaauucguguaguaaaaguuggugaauguggucucucucucucucuccaaauaucuuaauauuuucagaccuugguugacugaggguaacucaaaccauggaaagagaaaccagggauaaagcuguaccugagaggaaagaccuacagaguagagcucuagaaaucuguguagggugcacuugaaucuuugcucaacacuuaucuauguaugcauaaggugaaaccacaugagaccaggaaagaaugaugccucuuuuuuuuccuauuauuaguauuuuacuuuauucaccauuguauacauaaggagagaaugauuucugaagaaagaacaauuaccugagagccuuaagauuaaacucccagaggucaccuggggccaaggauuauucgaauuccuuccaaucacaguggagagaucauguugaacacaagcagcacucaaguagaccuuaugagggucauacauuuagaagugcagcuaaugaccaggugcaguggcucaugccuguaaucccagcacuuugggaggcagagguggguggaucaccugaggucaggaguucaagaccaaccuggccaacauggugaaacucggacucuacuaaaaauacaaaaauuagccaggcaugguggcaugugccugcaaucccagcuacucaggaggcuaaggcaugagaaucaccugaaccagggaggaggagguugcagugagccaagaccacgccacugcacuccagccuggguggcagagugaaaguaugucucaaaaaaaaaaaaaaagugcagcuaaauuagcucuagaauaaaggcuacuauaggcccaugcuaaaaucacuuaaaaucauuuaaaauuaaaccucaagacaauuaagguaauuugcaaucacuuaacugcuugcuaggaaauguccaauacucucuuuuuguuuuucuuuuuuuuuuuugagacagagucucgcucugucacccaggcuggagugcagugcugugaucucaucucacugcaaccucugccuccuggguucaagcgauucuccugcuucagccuccagaguagcuagaacuauaggcgcccaccaccaugacuggcuaauuuuuuugguauuuuuaguagaaaugggguuucacaauguuggcaaggcuggucuugaacugcugaccucgugauccacccaccuuggccucccaaagugcuggaguuacaggcgugagucacugcacccagccaaguuccaauacuuuuuuuuuuuuuuuuuuuuuugagaugaagucuugcucuugucccccaggcuggagugcgauggcgugaucucggcucacugcaucucugccucccagguucaaccgauucuucugccuuggccccccaaguagcugggauuacaggugccugccaccaugcccagcuaauuuuuguauuuuuacuugagacgggguuucaccauguuggccaggcuggucuagaacuucugaccucaggugaucuacccgccuuggccucccaaagugcugggauuauaggugugaaccaccaugcccggcccaaaguccaauacucuuuaaggaaugugacaagauucagcacucaacaacauaaagucacaauauccaacauucaauaaaaauugcaagacaugaugaagugggaaaacgucauccaaaacuagaaaaaaaauaagucaacagaaacagacccagaaauuauagcaaggauuaaguuagcagaaaagggcauuaaaaacaaugcuguaaagauacaaaggaaaagaucaacaugaugaaagaaauaaaaaauauuaccugcaagaggcugggcaugguggcucacgccuguaaucccaguacuuugggaggccaaggcaggcggaucacaaggucaggaguucgagaccagccugaccaacauggcgaaaccccgucucuacuaaaaaugcaaaacuuagcugggcaugguggcaugcgccuguaaucccagcuacucaggaggcugaggcaggagaauugcuugaaucugggaggcagagguugcagugagccaagaucgugccauugcacuccagccugggcggcagagcaagacucugucuaaaaaaaaaaaaaaaguuaccugcaagagugguaacagaccucuccuaagaaauuuaugcaaacuagcaaauaagggagcaauauuuuuagguacauaaggaaaaaaaccuaucaaccuagaauuuuauaccuagccaaaguaucuuucaaaaacaaaggcaaaauaguuauuuucaagcaagcaaaaguuagaggauucauugucacaggaucuauacuacaagaaauauuagagaaacuucuuuaggcagaaggauaccagagauagauuuagagcuacacaaaggaauaaagagugcuaaaaauaguaaauauguggcugggcaugguggcucaugccugugaucccagcacuuugggaggcccagcuggguggaucaccugaggucaggaguuugagaucagccuggccaacauggugaaaacucaucucuacuaaaaguacaaaaaguagcugggcaugguggugggugccuguaaucucagcuacucgggaggcugaggcaggagaaucacuugaaccagagaggcggagguuguagugagccaagaucaugccacugcacuccagccugggugacagagugagacuccgucucaaaaaaaaaaaaaaaaaaaaaaaaaaaaaaaaggcugggcacaguggcccacaccugugaucucaacauuuugggaggcugaggcagguggaucaccugaggucaggaguucaagaccagccugaccaacauggagaaaccccaucucuacugaaaauacaaaauuggcuggccauggugggugcaugccuguaauccuagcuaccugggaggcugaggcaggagaaucacuugaacccagaaggcagaggcuguggugagcugagauggcaccauugcacugcagccuggggaacaagaaugaaacuccaucucaauaaaaaaauaguaaauaugcagguaaacauaagacauuuuuucucauuaagacugauggucuaggcugggugugguggcugaugccuguaaucccagcacuuugggaggccgaggugugcggauuaccugagguugggaguucgacagcagccugaccaacacggagaaaacccguuucuccuaaaaauacaaaaucagcugggcgugguggcguaugccuacaaucccagcuacuggggaagcugaggcaggagaaucacuugaacccaggagguggagguugcagugagccaagaucaugccacugcacucuaaccugggcaacaagagugaaacacugucucaaaaaaaaaaauugauggucuaaagcaaaaauaaucacaguguauuguagaguuuauaauaaaagucaaauguaugacaacaauagcauaaaggacaggagggaacaaauaaguauauugcugcaagguucuaacucuauaaacgaaaugaaaaauguauauugcaaauuuuagagcaacuacaaagagacauaguuaauaaguuaauaauggaaauaaaacagucauaagaaaaacaguacaaauagaugggaacaaaaaaugagcaguaagaugguagauaugaaucuaaccuuauugacaauaacaaauuuaaauaaacacuccaacuaaaaagcaaaaguuuuuauauuggauaaaaagcaagacuauaugcugccugcaagaaacacacuuuuuuuucucuuuuuggagauggagucucgcucugucacccaggcuggagugcaguggcaugaucuuggcucacugcuaccgcugccuccuggguucaagcaauucuccugucuccaccugugugaggguucagucaggcuggugggaaaaaauuuaguuauaauagccagaaacccucuuggaaggccugagaguugcauaacuucgguaacagaucuggcugaaggcagccuaguccgcuuaccuuuaauuaaauaaauuaaaguagauacaaaggaauguggggaguuuaucuaacuagcuuguuuacucaugugguccuaagacuaaccuuggaucuaccgcaggugcuuaauugcuuucuaucugggaugucugcaaggucaauuacccucuaaugguguugacucaagccuuugucaauuaaucuuuacugaauaaacaugagucuggcuggcuggucaaggcccaggucgcaacuuuuuacagcacucuccugggagucuguaaguagcccugaugcucagucagacuggcaaagcagaguaucuguaucagugcacguuauucauccaucauugggucagggucugcaggacagacccccgcacaccuggauaauuuuuguauuuuuaauauagaugggguuucgcuauguugcugggcuggucucaaacuccugaacucaggugaucagcccuccuuggccucccaaaguguugggauuauagguguaagccacugcacccagccagaaacacacuuuaaauaauaaagacacagauaguuuaaaaggauagaaaaauauacuaacaugaaucaaaagaaagucagaggggcuauauuaauaucaaacagaguaaacuucagauuucagaauaaagauuauaaccaggaauaaagaaggauauuucauaaucaucaaagaguuaauccaugaacuuuuaaaaguccuaaauguagauacagucaguaccuuacaugggagcuucaaaauacaugaagccaaaucugauagaacuaaaaggugaaaaagacaacuccacaauuauuaguugaagauuuccacauuccucucucagcaccugaugaaacaaggaaaugauauagaagacuugcaagacuggccaggcacaguggcucacgccuguaaucccagcacuuugggaggcccagacagguggaucaccugaggucaggaguuggccugaccaacccagugaaacccgucccuacuaaaaauacaaaaauuagcuaggcaugguggcaggcgcccguaaucccagcugcuugggagacugaggaaggagaaucgcuugaaccugggaggcagagguuucagugagccaagaucagaccacugcauuccagccugggugacagagcaagacucuguuucaaaaaaaaaaaaaaaaaaaaaaaaccugcaagaugcuaugaacaacucaaccuaauuuuacauuuuuaccaaaauaccaacaaauagcagaauacauauucuucuuaggugcaaagggaacauucaccaagauagaacauauucauggccauaaaacaagucucaauaauuuuuuuuuuuuuuugagaaagggccugacucuguuguccaggcugaagugcaguggugugaucauagcucacugcagccucaaccucccaggcucaagggauccucucaccucagcuuccucaguaacaggaaccacaggcauguaccaccaugcccagcuaaguuuuaaaauuuuuucuagauaugaggucuuaguauguuacaguccaggcaggucuugaguucuugagcucaauugauccucuggccuucuucucccaaaaugcugagauuauagguaucagucacuguacuggccaauaaauuuuaaaagacugaaacuggccaggcacaguagcuuaugccaauaauccccaagacuuugggaggcugaagcuggacggucgcuugaggccaggaguucaagaccucccugagcaacauagugagauccggucucuacaaaaaauaaaacaauuagccaagcgugguugcaggugccugugggcccagcuacccgggaagcugagacgagaaucacuucagcccagugagaggugaagccagcuggacuuccugggucgaguggggacuuggagaacuuuucugucuagcuaaagguuuguaaaugcaccaaucagcacucuguaaaaaugcaccaaucagcacucugugucuagcucaagguuuguaaacgcaccaaucaguacucuguaaaaacgcaccaaucagcacucugugucuagcuaaagguuuguaaauacaccaauuagcacucuguaaaaacggaccaaucagcacuguguaaaauggaccacucagcacucuguaaaauggaccaaucagcgcucuguaaaauggaccaaucagcaggaugugggcagggccaaauaagggaauaaaagcuggccacccaagccagcagcagcaacccgcucgggucccuuuccaugcuguggaagcucuguucuuuugcucuucgcaauaaaucuugcugcugcucacucuuuggguuuacacuaccuuuaugagcuguaacacucaccgcgaaggucugcagcuucacuccaagccagcgagaccaggaacgcaccaggaggaacaaacaacuccagacaugccaccuuuaagagcuguaacacucacugcaaaggucuguggcuucacuccuaaagucagugagaccacgaacccaacgaaagaaacuccggacacaucugaauaucugaaggaacaaacuccagacacaccaucuuuaagaacuguaacacucaccgcaagggucugcagcuucauucuugaagucagcgaaaccaagaacccaccagaaggaaccaauucuggacacauuuuggugaccacgaagggacuauuaccuaucacuaagcggugagugccuuuggaccccuuucgcuugcuauucuguccuauuuuuccuuagaauuugagagcuaaauauggggacauguuggccaguuaaaagcgacuaguguggcugcugaacuaaagacacgggugucaggcuuucugggaaagggcuaacaacccccgacucuucggaguggggagcguugguuugccuggaaccagcuucugcuuuuccuguacuucugggcugagccgagggucgacagcgaggaaagccauucagcuccggggucccgacaacaaguugguugacccugcagccaugaauggaacucugaaagucacgucgcacaggcgagacucacccaucuauccuaucuauccugacccuugccuccuggguccuaaugccugucagacaaacuuccucucgccuuucuuugaggcuagucccacuucuaaaaaccacuccaucucuggugcuuuucuaguuucuccuguaagaaugauuucuaggauaaacuucaggacucuguuaccuucuuuagacacccgggcucaccaaucagaaagacacaguuuuugcucaaagccccaucguaggggggauuaucuggaauuuuagaaucccuccucagaaaagcaggccuaacaaaagcuauuccugaaacuaggauaucgggagccucagaaauuguauccuuccuauucauauaacuggggauaaaaggcuucacucuuccaacucuggagaucccuucccucccucaggguauggcccuccacuucauuuugggggcauaacaucuuuauaggacauggguaaggucccaauacuaacaggagaaugcuuaggacuccaacaguuuuccaagaaugcaucaguaagggccacuaaaucugauuuuucucaguccucuuugaggucuaggaggacaggaaagggcgcagguuuucgagaauguguugguaagggccacgaaaucugaccuuccucauuccuccuuguggucuaggagaacuaguguuucugcugcugugucagugagcacaaccauucugaucagcaggguccagggacuguugcggguucuugggcagggguuguuucugcugcugcguuggugagcacaacuacuccaaucagcaggguccggggacuguugcagguucuugggcaagagguguuucugcugcugcauuggugagcacaacuauuccgaucagcaggguccagggaccguugcagguucuugggcagggggagaaacaaacaaaccaaaaccacaggcgguuuugucuuucagaugggaaacacucaggcaucaacaggcucacccuugaaaugcauccuaagccacugggaccaauuugacccacaaacccugaaaaagagguggcucauuuuuuucuauacuacagccuggccccaauuucucucucugauggggaaaaauggccaccugagggaaguauaaacuacaguacuauccugcagccugaccuuuucuguaagagggaaggcaaauggagugaaauaccuuaugucuaaguuuucuuuucauugaaggagaauacccaaguaugcaaagcuugcaauuuacaucccacaggaggaccucucagcuuaccuccauauccuagccucccuauagcuccccuuccuauuaaugauaauccuccucuaauguccgcugcccagaaggaaauaagcaaagaaaucuccaaaggaucacaaacgcccccuucccgggcuaucgguuauguccccuucaagcuguagggggagcggaauuuggcccaaccuagguacauguucccuucucccucucugauuuuaagcagaucaaggcagaccuugggaagcuuucagaugaucuugauagguauacagauguccuacagggucgagggcaaaccuucuaucucacuuggagagaugucaugcuaguguuagaucaaacccuggccuuuaaugaaaagaauguggcuuuagcugcagcccaagaguuuggagauaccugguaucuuaguccaguaaaugauagaaugacaguugaagaaagggacaaauuccuuacuagucagcaagccguaugucaguaagucaguauggauccccacugggaccucgacucagaucauggggacuggagucguaaacaucugcugacuuguguucuagaaggacuaaggaguauuaggaaaaagcccaugaauuauucaaugauguccaccauaacucagggaaaggaagaaaaugcuucugccuuccacgagcagcuacgggaggccuuaagaaaauacacuccccugucacccgacucacuugagggucaauugauccuaaaagacaaguuuauuacccaaucaucuguggauaucaggagaaagcuccaaaagcgagcccugggcccugaacaaacucuggaagcauuauuaaaccuggcaaccucaguguucuauaauagggaccaagauggacaggcccaaaaguaaaagugagauaauagaaaggccgcagacuuagucauggcccucagacaaacaaaccuuggugguucagaggggacagagaauggagcaggccaaucaccugguagggcuuguuaucagugugguuuacaaggacacuuuuuaaaaaaaagauuguccuaugagaaacaagcugcccccucgcccauguccacuaugccgaggcaaucacuggaagacacacugccccagaggacaaagguucucugggacagaagccaccaaccagaugaugcaacaagacugagggugcccagggaaagcaccagcucaugucaucacucucacugaguccuggguauguauaaccauugagggccaggaaauugacuuccuccuggacacuggcguggcuuucucaguguuaauuuccugucuuggagcuguccucaaggucuguuaccauccgaggaauccugggacaggcuguaaccagguauuucucccaccuccucaguuguaauugggagacuuugcuccuuucacaugccuuucuuguuaugccugaaagucccacacccuuauuagggagggauauauuagccaaagcuggagcuauuaucuacaugaauauggggaacaaguuacccauuuguuguccccugcuuggggagggaaucaacccugaagucugggcauuggaaggaacaaacucaagcucuagccuuaagccuucccacaggacgaaacuuuucuuuaaacgucacagagagagcaggaauagcucuugggguccuuacucagacucaugggacaacuccacaaccaguggcauaccuaaggaaacugauacaguagcaaaaggcuagacuaacuguuuagggguaguuguggcaguggcugucuuagugucagaggcuaucaaaauaauacaaggaaaggaucucacugucuggacuacucaugauguaaauggcaaacuaggugccaaaggaaguuuauggcuaucagaaaaccaccugcuuagauaccaggcacuacuccuugagugaccagugcuucaagugcauacauguguggcccucagcccugccacuuuucucccagaggauagggagcgggucaagcauggcugccaacagguaguaguccagacuuaugccgccugaaaggaucucuuagaagucccguuagcuaauccugaccuuaaccuauauaccgauggaaguucauuuguggaaaaugggauacgaagggcagguuaugccacaguuagugauguaaccguacuugaaaguaaaccucuucccccagggaccagcacccaguuagcagaacuaguggcacuuacccgagccuuagaacugggaaaggaaaaaagaaaaaacguguauacagauagcaaguaugcuuaucuaauccuacaugcccaugcugcaauauguaaagaaagagcguuccuaaccucugggggaacccccauuaaauaccacaaggaaaucauggaguuauugcacucaaugcaaaaacccaaggagguggcagucuuacacugccgaagccaucaaaaaggggaaggagaagggagaacggcagcauaagcggcuggcagaggcagggaaagaccagcagagagaaagaggcaaagucaaagacagaaggaaagagaggaagagacaaaggagucagagagaaagagauagaaguaguaaagaaaaaacagugcacccuauuccuuuaaaagccaggguaaauuuaaaauauauaauucaugccuguaaucccagcacuuugggaggccaaggcgggcagaucaugaggucaggaguuugagaccaacuuggccaacauggugaaaccccgucucuacuaaaaauacaaaaauuagccaggugugguggcgggcgccuguaauuccagcuacuccagaggcugaggcaggagaauugcuugaacccgggaagcagagguugcggugagccuagaucaugccacugcacuccagccugggugacagggcaagacuccaucuccaaaaaaauaaaaaugaaaaauaaaaccuacaauugauaauugaaggucuucucuguaacccuguaacacuccaauaccaccuuguugucaguguaaacaagggcauagcccaaaagcacugaggccacugacaaccuguagccuuccuaucaaaaauccuuaacccagcagguuccuaacaggggaucuaaaucugaaggucugaccagacauaggaggaacccccuucaggacaggaugauagauguuuccuccugggcgauuaaggaaaaagacacaauggguacucaguacgugauaaggaaacucuuacagaagcagaguuaggaaaauugccuaauaauuggucugcucaaaugugcaagcuguuugcacucagccaaaccuuaaaguacuuacagaaucaggaaggagccaucuauaccaauuuuaagugaauauggacugaacgaggucuuauuaauagcaaagaauaauugaaaucccaaacuuaagguuuucaacaaaaguaaaguuugcuaaaaguuaacaguguaacacauauuauccuaacuucuaaucuuauggacaucagacccuaucagugccccucaaagcucaaguccaucagcacagggccauacaacugauaccccuacuuauagggcuagaaauggccacugcuacaggaaccggaauagccaguuuaucuacuucauuaucuuacuaccacacacucucaaaguauuucucagacaguuugcaagaaauaacaaaaucuauucaguaaggauaguaacuacaaucccaaauagacucuggcagcagugacucuccaaaacccccgaggccuagaccuccucacugcugagaaaggaggacuuugcaccuuaggggaagaguguuguuuuuacacuaacaagucagggauagugcaagaugccgcccggcauuuacaggaaaagguuucugaaaucagacaacgccuuucaaacucuuauaccaaccucuggaguugggcaacauggcuucuccccuuucuacauccugugacagccguuuuacuauuacucgccuucgggcccuguauuuuuaaccuccuugucaaauuuguuuccucuagaaucaaggccaucaaacuacagauggucuuacaaacggaaacccaaaugagcucaacuaacaacuucuaccgaggaccccuggaccgacccacuggcccuuucacuggccuagagaguuccccucuggaggacacuacaacugcagggccccuucuuugccccuguccagcaggaaguagcuagagcagucauugcccaauucccaacagcagauggggugcccuguuuagaggcgggauugagaggugaagccccuggacuuccuggguccaguggggacuuggagaacuuuucugucuagcuaaagauuuguaaaugcaccaaucagcacucuguaaaaacgcaccaaucagugcucugugucuagcuaaagguuuguaaaugcaccaaucaguacuauguaaaaacgcaccaaucagugcucugucuagcuaaagauuuguaaacgcaccaauccgcacucuguaaaaauggaccaaucagcacucugcaaaauggaccaaucagcaggacaugggcagggccaaauaagggaauaaaagcuggccacccagccaccagcacccaaccugcucugauccccuuccgcugugggagguuuguucuuuugcucuuugcaauaaaucuugcugcugcucacuccuuggguccgcacuaccuuuauaagcuguaacacugaccacaaaugucugcagcuucgcuccugaagccagcgagaccacaaacccaccaagaggaacaaacaacuccugacgcaccaccuuuaagagcuguaacacucacugcgaaggucugcggcuucaauccugaagucagcgagaccacgaaccuaccagaaggaagaaacuccagacacaucugaacaucugaaggaagaaacuggacacaccaucuuuaagaacuguaacacucacuucgaggguccgcggcuuuauucuuaaagucagcgagaccaagaacccacuggaaggaaccaauucuggacacaccaggagcuggagacgagccugggugugcaacacagagagacaagacccccaucuguaccaaaaauaaauaaaaauaggaagacuggaucauauuaagucuguucuccaagaaaaccaaauuaaacggcuguggagauguacuaugucuacacauguacaagugcuuacacaguggccacgcuggaggaaccacguggagagacaggcuccaggccuugagaccccaaagccuaggaaagcagagagcacuucaccaagagcauggcuuuggucuacaggggugagaguuuccagcccgucuaagcguuccuugcugcuuaaucucucugggcuuggccuaugcgggggucccuugggggccugggccgcugggagggguccucccucucacguccuggcgguccgcagcaaggcccugagcaggccuuaccugguagcccaccaccuccgccaagucgggguagacgggcggcggcucgcgcaggcagcacaggaagaaggccgugucaaagcggcgaguggugccccgcaagaaaggggugagccaggcgcuccaguugugcagcgcccagaugucgggugugcagucgaggugggcgcacagccgcaggaaguggcgcggguccuggcgcacgcggucgcgccaggaggccaggcccggcgguggcuccagggcgaggccaggcccgggugcugggccugguggggaaguccugggccgcagcagcagcacgcccgccuccucaaaggccucccgcacggcgcagaugcggaaggcuacguccucaggcagcgucccaguguugucggucuuguggucaucggugucgggcagcgacgggaaagcggugcggcugaauggcgccgggcccaggccgaagcgcggcggcccguggugcggcgcgaagaggcccagccaguccgccgagcggucggccgcauccagcacuccgccggagaagacgugcgcgcccggcaugaagccuuggugcggggagcgcugcagcagcagcagccggaagcccucggccggcggcgggcgcgacggcgggguggcggucuccgggcgcgaccagccagccgccaggacgaugcuggccgcccgccgccagcggcuggggcccggccgcagggagcugcucau

SEQ ID NO: 191754 - RNA, 78196 nt, Homo sapiens
guaaggggugggcuauagggccagaucgccgcgcgaggguggugggcaucgaggucccagcagcggacgagggaggugccgccgucgcccaggaugggcugggaaugaagcgauguagccuuuuaaguaaguguccucgcgcuggccuccuccugcgccuccccucccgcgggauggcugcgccucggggcgcggcggccgggcggggcccggagagugaggggggaggggcucccugcucuccggaguccgcucccggguccgccagguggccccgcgccgccccagcccccgcguccccaggugggugcccggugcgcagccggcgcgcccugcccacuccgccccucgggucuggaggaggggagcggucggcgcggagaaugcacccuccgagccucgcugcgucgacaccggcggguguggccggggugccggguccggcgguucggaucuggcggggcgcggggcggucgccgcgcgguuucccggaggccuagggucugcuggaggggagcggcggguggggguccgagccgcgcgcgcagcgguugugguuuccggggggugaugagggcgcggagcggggaaucccuggcugccggccucucgcagggcgggggggucucugcauucccacagguaaagauuguuaaaggaaaacucuuaagcaccgagagauguuccggauucugagucuguuccgucuugugguugaaaauggacugcccaggagcacacgagccacgcggugcccccuuggcugccccacgaggugcaggggacgugggcacucgcggccugugcugggcgagggagcaagggacgggucuucgcugaggauuuagagcaugcagggaacgagggcugcuggcagugcuggagggacugugaggcugcagagagcucagauuuuacaaguugauggguuucauggauagaggccccuauuuugauuaaaaaaugcacucuucccacuggccgaagaguagagcaguggauauuuuuuuucuuuucuuucuuuucguuuuuuucuuuuugagacagggucuggcucuguuggcuagucuggagugcagugaugccaucauagcucauugcagccucaaacuccuggacucaagcaauccuuucaccucagccucuguaguagcugggacuacaggcgcaugccacuaugcacggcuaauuuuuaauuuuuuuuuuuuuuuuuuguagagauggagucuagcagguugccuaggcuggucuugaacuccuggacucaagccaugcucucgucuuggccucccaagguguugggauuacaggcacuagccaccacguuuugcugagcaguagcuguuacguuucgagaucagccuggcaugaggacugguguugagguggccuaaggguccgguguacugagccccggggccugcugucacccagggguccguccuuuaacugggugagcaguaggcuggguguuugcugccagggcuuggguacuccuggccuugaccauuguguggaagggggguucucagccacccacacgcuacauagggucguucccagggggauaguaguuuucaggacaaaauggguggaaagagggaaaauacucuuucccuucgggggaagcuuuggagacagcagagggugaggaagcugcaaagguggccagaggccagaugugccagguccugagcaccuagcagagaaguugagggcucaccugguggggagugcaggggaauccuuugaggaauccugcagagcucggcgcuggaaagaucgcuuuguuguguugcugguggacaggcgugagugaaauccagggggcagauccaggaggcacagcccguaggccuuggaaggaggggaugcaggaugggagcaggagcagagacuucuucugaccagccauagggacaggaaugcaccuggggaucugacauuggauagacuuacauucccaaguuacacccagucuugccuggugaccugaaauaaucuuggccggcagcuucccugggagggcaggcagaggugucugcagagggccggggguuagggucuccguugugccucuuugugacuguuagacugugucucccucaccaagacagcugcugggucuuuguuagugauguuucugugucccaguuaagguuucuguggcaucugcccugcuggggcucuuccugucugucauuugccagcauuagguugguguccaaugacuccauccucucauagaggaguggaggaaugugaccaugucaugauagguaccaauccuagaaaggauucagcccagaaggauccagacuugauuuguccugagguugauucuccaucugaggaacacugagaagcggcccuagagcuccugcccaucugcccaagauacugguggagggugcauggugguucuucucccugugguccgggaacagggugaugcgguggcauucggaggggcuguugugcuccuccaaacuuucccgcucccugcauggucccgcccugguuccaguccuggcuucucucuagcccugcccauuccagcuaucacuguguugggcuggcacugagcauccugauuguuuugggcuuuuugccuuugugcuugcuuggcuaugaccugggguuagccccucaccuacccuggauauggacaguggaguuccagcucuugugagagaugaccucucccugggagcuggggcuuccucuuaaugccccacuaucguuuuguucaagugggugagcaguuacuccaucucugcagggaaccaggcgcagggcugggugcuuuaaugagaagcuuugagaagaauauggacaggaucucuaaauguuauaggucaggaggacacaagugacuguaacagcauacauacaucaccacauugcuuccauuggugugaaaaauagaugaauagaaaguuuucguuuuucgccuuuuccuucugaaucauaaauuagaccaaauggagaauacugcuuaucuguugggaagcguuccuggucagaguguuuggucagagccccggaagggcgggaacggccaucgcagugagauuucagcagggagugcaucucuaaggaggcugaauucccccaugcugaauucugcugagcugggcugcacgcugucaccagacgguucuugaccacccagacuuaucugggcuagcaggacgguugaagaccacaaaaccacgagugugcacgcugcucccugaaauacuaguuugaggccucacauggcucuccuguucauagaauaacugcagauaacucacauuuagagguauuugguaucuccagcuaacucaacuggauuuucuguacauuuucccaucauuugagcccaggcagggauggaauuuuuuaaaagaaguuuuauaagaagauucacuuaucuuuccaguuuuacaagaaaaaguccauuuucuuugcauguuauuuuaaaauagcaaacuaauucuuuuguuuguuuuguuuuugagauaggucucacucuguugcccaggcuggagugcaguggcccgaucucggcucacugcaaccuccaccucccagguucaagagauucucgugccucagccucccaaguagcugggauuauaggugugggccaccacaaccagcuaauuguauuuuuaguagagacgggguuuuaccauguuggccaggcuggucugaaacuccugaccuccagugauccacccgcuuuggccucccaaaaugcugggauuacaggugugagccacugugcccagccagcaaacuaauucuugcagguaaacuugacaggguauaaaacuguuuuuuuaagcauuuacccuuauguaagaauucaacucuggcauuaagcaccagaucauaugagauuauuacuuuuuuuuuuuggagacagggucuuccucugucgccuaggcuagagugcaguggugcagucauaacucauugcagccuugaccucuugggcucaagugauccucuggccucagccuccccuggcugggugugugccaccauacccauagauaauuuuuugauuuuccuguagagacagggucucacuuuguugcucaggcuggucuugaacuccugggcucaaucaucugucagccucagccucccaaagugcugagauuacaggugugagccacugcaccuggcauauuacagauuuuuuuuugucauuuuuugaaauggagucucacuccguuacacagacuggagugcaauggugugaucuuggcucacugcaaccuccacuucccagguucaagugauucuucugccucagccucccuaguggcugggauuauaggugcccaugccuggcuaauuuuuguauuuuuaguagagacaggguuucaccauguuggccaggcuggucuugaacuccaucucaagugaucagcccgccucggccuuccaaagugcugggauuacaggugcuagccacugugccuggcccuuuuuuaaauuuuaauuuacauuuuuuauuuuuuauugagacagagucccccucuguugcccaggcuggagugcagugucaugaucuuggcucacugcaaccuccgccuccuggguugaagugauucuuaugcuucagcuuccugaguaccugggauuacagggguuugccaccaugcccggcuaauuuuuguauuuuuaguagagacaggguuuugccauguuggccaggcuggucucaaacuccugaccucaggugauccgcccgccucggccucccaagccacugcacccugcauguuacguauuuuuaacacuaggacagaaagguugagaacagugucggacagagguccuuuuucuucuuuuuuuuucaugugacagcacggaugaaaggacagagcucuuugaaucccuacuccuggacagaggauucagucuuuagugaccaagaagacugagguccaagauaaagcagaugacuuggggcuggauaacagcaggcccuguccgcacagcagugcuuguuaagggcgugguguguuuacacaguucuugcaugugaccugcauguuuugauguggcacucagugaccuuccugucucuugcuguucugccccuuucuggccucugcuuggagucuuacuacuuucccauccucuaguucauccccuucccugccguuuuuuucauuuucuuucuuuuuuuuuuuuuugugacgggaucucagccugucacucaggcuggagugcaguggcgccaucucggcucgcugcaaccuccacuucuuagguucaagcaauucuucugccucagccuccaaguagcugggacuacaggugcccaucaccacgcccagcuaauuuuuguauuuuuagcagagacgggguuucaccauuuuggccaggguggucuugaacuccugacuucaggugauccacugccuuggccucccaaaguguucagauuauaggugugagccaccacgcccgaccacugcuguuuucuucugucucugguccuuaccucccagcucuguuuuuaguucguccauggaagccuguccuuguugccucaucuugcgggguggaaguauugguguuccuccagcaucuuuucugaagcagaaggagcgccuuuucccagcuugagucugaccauauugcauccuguuucucacauggcuuucauccagagcaucuuuacuuuugcaaugugccacauagaaccaacuaugucaggaacuagaaagaguuuuguguucuugugacucugucccagcaaaauugcauuaucucauugugguggagacucauaaaaggauuaucugggcuccaguaauaagugaauuuaaugauucaaauagcugaguuauugcagaggcaccccuggggcccaggcagggauuauaugcgaccauuuuuauguuagucucuucucccuaggaggacuggcggagagcucacaggccuuuuucaagcagaacccagggcaccugcagccaagacaguucuggcuggaccuggggaauuaguugaggggccuguguggcugucugucuuguggacuuuucuucuguugaaauaaaauaugacucuuaggcugggcaugguugcucacgcuguaaucccagcgcugugagaggcugaggcgggaggauuacuugaggccaggaguaugagaccagccugggccacauagcgagacaccaucucuacuaaaugaaugaaugaaugaauggcucuuauuuauccuugagucagccagcugcaucucaguuucuucaucugugacacaggcuagugauaccuacuugccuagaguuauugugagcauuaagauaggaugagugcugggugcaguggcucacacuuauaaucccagcacuuagggggagcugaggcaggaggaucacuugggcaauguagcgagaccccaucuguacugaaaauuaaaaaauuagcugggcacgguggcucacgccuguaaucucagcacccuggaguccgagacaggaggauugcuuaaguaacuuagugagaccccaucucuacaaagaauaaaaaaaaaauuagcuaggcaugguggcucaugccuguagucccaacuacuugggaggcugaggcaggaggaucaccucagcccaggaggucaaggcuguagugagcugugauuguaccaguguacuccagugugagugauagagcaagacccgucucaaaaaaaaaaaaaaaagaugaagauaagacugggcacaguggcuuaugccuuguaaccccagcacauugggaggccagggcaggaggcucacuugaggucaggaguuugagaccagccugggcaacauagugagacacuguuucuaccaaaaacaaaacaaaacaaaaaauuuaggcuuggccagguggcucauacccguaauuguggcacuuuaggaggcuaaggugggaggauugcuugaggccaggaguuugagggugcagugagcuaugauugugucacuguacuccagccuggucaguagagugagaccccaacucauaaauaaaugaagguaaguaaguaaagaugaggauguauagaaguuauugcagugccugguacaaggacucucccaaaugguggcuauuuuuaccauuaguuccaaggaauagaauucaucaugcaguuauguaugcauaguguuuucccaaggaagcauucuggaucccuguuacauagugagagaguagcuccuauuucauauuucauucauuuaauuguaucaaggauaaauucacuuuuacgcuuuuuaaauaguugcugauuuucucauuuuaaugaagagagaaggccccaggcucaagcuuagcaucuaaugacuuuuuuuuuuuuuuuugagacggaguuucacucuugucgcccaggcuggagugcaauggcaugaucucggcuuacugcaaccuccaucuccuggauucaagcgauucuccugcuucagccuccugaguagcugagauuacaagugugugccaccacgcccggcuaauuuuuguauuuuuaauagagaugggguuucaccacguuggccaggcuggauccgcccaccucggccuccgaaagugcugggauuaugagguuuuaaauaacaguaauuaccuuuauaauuuuuaacuuuaagaugaucuucucuucguuggaagugauaccauuuuucuauuuaaaguaguaauaagauuucuuuuuaaaauaaauuuuaggccaaggaugguggcauaugccuguugagccaggaguucaagaccacccugggcaacacagcgagacuccauuucuacaaaaguaaacaaaaauaaaacagaaaggaaaauacauuuuuauaaagacaauaaguuauugaaggaaaaugucaaacacuagcaagagagccauuauguguaauuguugggcaaaauugugcucacauugugggcagguuguucacugcccagcagcaggggccgugcagcauguuaccuaggagcugcucacuagccuagugcccuugcacagagcugcgcccccugggaagucgggugccuguuucuaauucucacaaaggucccaugugagcuugcaguaacuggugcuauguugauaugcaguacugcaugucacagauagugaagguggcauggaaaugacccucauaagaguccugcagacagguauuagcauucucuguggugcaggcccagauggaggcucagagaggugggaugacgugguuagaaaucugaucuccuggcugggcaugguggcucacgccuguaaucccagcacuuugggaggccgaggugggcggaucacuugaggucaggaguuugagaccagcguggccaucaugaugaaaccccgucucuacuaaaaauaaaaaaauuagccgggagugguagugcacaccuguaaucccagcuacgagggaggcugaggcagcaggagaauuacuugaucacagggguggagguugcagugagccgagauugcaccacugcacuccagccugggcaacagagugagacucugucucaaaaaaaaaaaaaaaaaaaaauagaaaucugauuuccuuuucugugcccauuuuguaggcacccccucugagagcucauuggcucagaggagcagaccaggggugaugaggagcagcuauagaauguuucaugaaacacacaaagcacugguucacauuaguuagcagcauggagcagucugcagacagcaacauccuucaaacagcuuacuuccuaaagugaguugaacacugaccuguaaucuucuuuuggccguucacagaccuuucagucaugaaucauggaagggucuucucuggcuucagaagucccaguucugaugguagugguagguguguuccauacugauucuuauuuuaucuguacagcgugacucugauguaaguccauuuggcuuuugcuuuuagaaccuuaccuaaaauaagcaaucuaauuuuagcaaccccuuucacaacagcagcaaagucuauacagaauauauaaauagucuaauaaaagucguauacgauccuuauggaaaagucggaggacaucgaagaagacauucauggaaagauauaccauguauguggaugauaaaauucauaauuauagggcugagugugguggcucacgccuguaaucccaacaguuugggaggccgagguaggaagaucacuugaagccaggaguucaagaccagccuggccaacauggcgaaaccccgucucuaccaaaaaauacacacaaaaaguuagcugguguuguggcguguagucuguagucugagcuacuugggaggccgagguacgagaauugcuugaacccaggaagcagagguugcagugagccaauauugcgccacuguacuccagccugggcagcagagcaagaccucugucucgaaaaacaaaaaaaacggcaggcugggcgcgguggcucaugccuguaaucccagcacuuugugaggccaaggcgggcggaucacgaggucaggagaucgagaccauccuggcuaacacagcgaaaccccaucucuacuaaaaauacaaaaaauuagcugggcaugguggugggcgccuguagucccagcuacuugagaggcugaggcaggagaauggcgugaacccuggaggcagagcuugcugugagucaagaucaugccacuguacuccagccugggugacagagcaagacucugucucaaacaaacaaacaaacaaaaauuagccuggugugguggcgggugccuguaaucccagcuacuugggaggcugaggcaggagaauugcuugaacccgggaggcaaagguugcagugagcugagauugugccacugcacuuuagugugggugagagagcgagacucugucucaaaaaaaaaaaaaaaaaauucaugaauuuagugcggguccaauaaaaauccuaauaggauuuuucauguaauugacaaggugauucugauucauuugauauuguaaaggacaaggaauaaccuuuggagaacaagcuggaggggagcuuuucucugugaguuaguaaggcuuauuaugaagcuguagucauguaaaauaaauguucauauguggucucucccugcccuguccaguguaauagcugcuaguggcuauugagcacaugaaauguggcuaguaugaaucgagaagugcuguaaauguaaaaugaacacuagauuuuaaagacuuaagaauaaaaaaauguaaaauauaucauuaauaacaguuuuuuuuuuuuuuuuuuuugagacagagucucacucugucacccaggcugcugugcaguggugcaaucucagcucacuggagucucugccuccugggcucaagcgauucuccugccucauccucccgaguagccuggcuaauuuuuguauuuuguaaagaugggguugcccaggcuuuucucgaacucguggacucaagcaguccaccugcuuugaccuuccaaaguggugggauuacaggcaugagccacugugcccggccaucaugaagaacuuuuuauuauuauuauuauuauuauuauuauuauuauuauuauuauuuggggauggagucuugcucuguugcccaggcuggagugcaguggcacaaucucggcucacugcaaccacugccuccuggguucaagcaguucugccucagccucccaaguagcuggaauuacagucaccugccaucauaccuggcuaauuuuuguauuuuuauagagacgggguuucaugauguuggccagggucuugaacuccugaccucaggugauccacccaccucagccucccagagugcugggauuacaggugugagccacugugcccagccaauaacuuuuaaauaaugaucaagucaagugcagugacauauaccuguggucccagcuacuugggaggcugaaaugggaggacugcuugaggcugggaguucagggcuguggugagcugagauugugccugugaauagccacugcaacauagcaagaccccgucucuaaaaaacaaaauaaauaauggucacauguugaaaauaucauauuuuggauauauuaagauaaaauauaucauuaaaauuaauugcacccuauuucuuucuuuuuuuuuuuuuuuuuuugagacagagucucgcucugucgcccaggcuggagugcaguggcgggaucucggcucacugcaagcuccaccuccuggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccacacccggcccccuauuucuuuuuuaaugugcuacuagaaaauuuaaaaugacauuguguauuucuauguaauauauacauaauuguauuucucacaugugacaguaagacccuugaaacagaguagagccuggaaacaggcuaaacauacgugggaucuuggagugugacagccguagcauuaucaaccugugugaaauggauagaauauucaaaaaaugaugaugggacgauuggcuuacuauauggagaaauauaauuagacacuugauuuauagcauguacaaaaauccagauggauugaagaccuaaaaauagaaaacuuuacucuuuuuagaaaucauaaggacuaucuuuauggcuuugaaauuggaaaggacgugguuucagguagccuuugcuguguaacaaacccacccaaaauguagugacuucaaacugccacaauuuauuacuuccuacguugugugaguugggugggugguuccucuacuggucucagcugggaucccucaaggggcuguauucugcugguggguuggcugugcuugcugggccaccuaggccucgcucuccccccauggccuuucaucaugugggcuucuucauagcauugggaucuugggguaccaagagaaugagaauggaauccgcaagcccuuuuauaaguguguauguauguauauacauuuacuuuucuuauuucuugaauguacuaagacuuuuuguuuuguuuugucuuugagacagaaucucacucugucacccaggcuggagugaaguggcgugaucucggcucacugcaaccucugccuccuggguucaagugauucuccugccucagccucccaaguagcugggauuacaggcacaugccaucacgccuggcuaauuuuuguauuuuaguagagacgggguuucaccauguuguccaggcuggucucaaacuccugaccucaagugacccacccgccuaggccucccaaaguguugagauuagaggcgugagccaccgugccuggccuuuuuuuuuguuuuuuaaagagauggggucucacucuguugccuaggcuggagugcaguguuucaaucauaguucauugcagccucaaacuccugggcucaagcgauccucccaugucagccucccgaguaguugggacugcaggcaugugccagcacaccuggauaauuuuuguauuuuauuauuuguagagacaaggucuugcuauuuugcccaggcuagucuugaacuccuggccugaagugauccuccugccuuggccucccaaggugcugggauuacaggagugagccauugugcccagccccuguaagaccucuugaagcugacacucacaaauuguacagcaucgauucugccuguugguugaagcaagucacagggcuggcucugauucaggggcugcggaaaugagucuacuuccuuuuuuuuuuuuuuuuuuuuuuuuuggagacugagucuuucucuuuugcccaagcuggagugcaguggcaggaucuggggucacugcaaucucugccuccugaguucaagcgauucuuugccucagccucccaggcagcugggauaacaggcacaugccaccacaccccacuaauuuuuguauuuuuguagagaugggguuuugccauauuggucaggcugaucucgaacuccugaccucaaguguucugccugccucggccuuccaaagugcugggauuauaggcgugagccaccgugccuggccuacucuaucuucugaugggggaauagugaagucacuuugcaaaaagaccugccagaggauaggcaugccaauuacagauuucuuaaggcucaaaaagcacugaccuuaaaagcaaagaguggcaaauccaauuauuguugacccuugaacaauauggguuugaacuguguggguccacuuauauguguuuuuuucaaccaaauucagguugaaaauaccauauucacagguugcaaauuucuguauauggagggcugacacagacaugugaguuccacagggccgaccaugggauuugaguauguauggacuuggguauacaagaggaucccagaaccaaucccccaaguauacugagggaugacgguccauucacaucaaaacuucuggccaggcacagugacucaugccuguaaucccagcguuuugggaggcugaggugggaggauugcaucaggccaggaguucaaguucagcgugggcaacacagcaaaaucucaucucuacaaaaaguaaaaaauaaaaaaaagguugggcgugguggugcaugccugcagucccagcugcucuggaggcugaggugggaggugggagaucacuugagcccaggaguucaagguuacggugagcuacgaucaugucauuggacuccagcucuagccugggcgacagugugaaacccugucucaaaauaaauaacauccaaaguucuauuucugaacacacccauuugacaaaaugaaaaagcaaguuacagacuaggagauggugugaguauauguguguguguguguguguguguguguguguauaauuuuuuuuuuuuuuuuuagacagcaucuugcaccaucacacaggguggagugcaguggcgugaucauggcucauagcggccuuaaccuccugggcucaagugauucuccugccccagccuccuuaguaccugggacuauaggcaugggcugccacacauggcuaauuuuuaaaacuuuuuuuguagagauggggucucgcuauguugccugggcuggucuugaccucuugaccucaagugauccuccuaccucauccuccccaggugcugugauuacagccagccugggagaugauauuuaaaacuuacuuuaguauacagauguguaaagaacuauaaauccuaagaaaaaggccaacaacccagcgggaaagugagcaaaagacaugaucaggcaguuuacauaaccgaaagaaauuuaguucauuuaauuaaugaaccaaugaaaaugaaaaacagugggauauggcuuuauacucauagacuaucucagcccaugcaggcugcuguaauagaaggcuugaaaaugacagaaauguguuucucacaguucuggaggcugggaaguacaaggugaagauccugcagguuggaugucuggggagggccugcuucauaaacagcugucuguucucuguaaccucacguggccggaggagcaaaggagcucucccaggccucuuucuuuuucuuuuuuuugaaacggagucucgcuuuaucacccaggcuggagugcgguggcgugaucucugcucacugcaaccucugccuccugggcagucccaagcugggacuauaggcaugcaccaccacacccagcuaauuuuuguauuuucaguagagacgggguuucaccauguugaccaggcuggucuugaacuccugaccucaggugauccucccgacuuggccucccaaagggaggauuacaggcaugagccacugugcccggcugcauaauuacgggcacugaucucauucaugaaggcucugccuuuguaaccuaaucacccccaaaggccccgccuagcggguuaguauuuuaacauaugaguuuuugggggacauaaacauuuagaccauagcacagacuaacagaaauuuuauuauuuuaauuuuugaggagauaguguuuugcuauauuguccaggcuggucuccaacuccuggucuuaagcggauccuccugccuuagccucccgaguggcugggacuacgggcacaugccaccauacccagauaauuguuaauuuuuguagagguagauaauuguuuauuuuuauuguuuauuuuuguagauaauugguuuuuuuuguagauaaauuguuuauuuuuguagaagugaggguuuugcuguauugcccagucuggucuugaacuccugggcucacaggauccuccuaccucaggcucccaaagugcugggaugacaggcaugaaccaccacaccuggcuuccacuuuauuucuuaaaagaaaaucugaggcaaacauggcaaaaugugacgauuccuuaauucuggugcuagguuugcauuauuacucaguacuuuuccaugugcuaaaauauuucauuaaaaauaaaugaguaucuugagaaugucauaauuuuggucauguaggauauucuaaaaauagccauuuauacuuuagccaagacuuggaguuuaacaagauuuucugagcauaauuuacacguuagccaauaaacgggucaucuuggaauuaguggguuguauuugagauuuccugguggagugagucugugggagaaaaaaauggcacgucaugaauccuuuuuuauuuggaggauacucuuuagaaauugccagaugcaggucgggugugacagcucaugccuguaaucccagcacuuugggaggcugaggcgggcagaucaccugcuggucaggaguucaagaccagccuggccaacauggcaaaacccugucuuuacuaaaaauacaaaaauucgcgggugugguggugggcgccuguagucccagcuacucccgaggcugagccgcgcuccagccugggcgacagagugagacucugucucaaaaaaaaaaaaaaaaagaaaaagaaaaugccagaugcaucagaugcagacuuucauguguuacguaaacucgaaaauggcuauucacugcuuuucccucccuuauugcaggagauuugcucugacccaucugaaguccauauggcucuguaugaugaagaccuccugaaaaauccuuucuaucuggcucugcaaaagugccgcccugacuugugcagcaaaguggcccaaauccauggcauuguaagugcacugagccucgggguuguccugaggcaugaaugguuccagagacgugguagacuaaggcucaguuuggagggaguuuguuauaaacucagcuuaacaagcucccagcagugugcuuggucugugagugagcagcgaggggcccccaugagccgcucccuccaggaagccuucugggacugcaguccaggcuguaauacuuucucugaacuccuggcccccgccuguggcuaacugugcccuuucguggagcacccccagugacacuuggucucacgcugcggugcucucguuucucucuugccuauggaggcuucuccagggcuaaaaugaguugugcucccuggggccuuacgaguccuggucugucugggaggugggugcucacccucauagaauaagggaccgaguaaacacauucauacacugcuuugaaagguuuuuccaaagggaaagcaccaugaugaaagaacuuuucugguagaggccacaaccucagaagccuucaggggcagccagguaacaggaaugagaagcaggcaggagacgcugucgccugucauggugggggcaucugccuggacgggggcgggccccacauugugggucuuuccaguucucaggucagugaacuuggcgggcauccuacuuagacggcacugggggacacagugucccgggugcauuugugucaucuguggccucugcuucaggagucuuccgucuucuuuuugucuguuguccccuacucucucaaauggauguccacuucucuuaucccguggggcgacuuuacuuagauaugugaggugccugaggguuugaacugaaggagaagucagguuagcugaguguggcuucagguucucagcggccucucggacgccggaauugacuuucauuuauuuuuauuuuuauuuauuaaauuuuuuugagacagagucuugcucugucacccaggcuggagugugguggcgugaucucagcucacagcaaccucugucucccagguucaagcgauucuccugccucggccucccaaguaucugggauugcaggugugugcaaccacguccagcuaauuuuuguguuuuuacuagagauggaguuucacccauguuggccaggcuggucccgaacucccggccucaggugaucugcccaccucggccucccaaagugcugggauuacaggcgugagccacugugucuggccuggacuugacuuugauuuugcccaggccaagcucugccaucagaaacuggguuucuuuuuuuuuuuuuugagacagagucucacucuguugcucaggcuggagugcaguggcgcaaucucgacucucugcaaccucugccucccggguucaagugauuugccucggccuccugaguagccgggauuacaggcacaaaccaccaugccuggcuaauuuuuuuuuuuuuuuugagacagagccuugcucugucacccaggcuagagugcaguggcgcaaucucgacucacugcaaccuccaccuccgggguucaagcgauuuuccugccugagucuccugaguagcugggacuacaggugugugccaccacacccaacuaauuuuuguauuuuuaguggagacaggguuucaccauguuggccaggauggucucgaucuccugaccucgugauccacccgccucggccccccagcgugcuggaauuacaggugugagccaccacaccuggccuaauuuuuguauuuuuaguagggacaggguuucaccguguugucccagcuggucuugaacuccuggccucaaguuauccgcccaccuccaucucccaaagagaagcuggguuucuugacaucuuuuccaguuuuuaugauuaguuuugugauucauauuucuucaccacaaucuucuuacuuuagauuuuagaagccaaaaaguucauuauuuuaaaaauuagaauauauagcucuuuccaaauaaaaaucucauaaaauucaccaaagacauucacugucaucucuucauuucacagcaauuauuaaaagcugcuguauacaagauacuuugcuugauggugaggauucaccaagaaacagaaacacacaucacucuuuuuuuuuuuuuuugagauaaggucuugcuuugucccccagccugggcuagaauacagugacaugaacacggcucacugcagccucaaaccucuagacucaagcaguccuucugccucagccucccaaguagcugggacuacaagcaugugccaccacaccuggcugguuuuuauuuuuuguagagauggggucucacuauguugcccagguuguucuugaacuccuggccucaagugauccuccugcuucagccucccaaagugcugggauuacaggcaugagcugucacgccuggcccuagaucaccaucuuuacccucauggagcuuaaauucuagugcgaaagauggucauucacugagcgagugcauacuaauuacggugguggugagugucgcagaggaaaaguacgggacgcaaggugggcauggaucagggagggccuggccguacugcgggaauauuuccucucuuccugucuucguuguaugauauuuuaaacuacugucuagacaagugcauauuuucauauauaucuuuauccagcuuuuuagaacugucacacuguggcauaguuauuucuguggaagcucuuuggggaagcucuaucuugcucagcaugguguuagugagccuggcagcugccacuucaggcuuuucuuuuucuuuucuuuucuuuucuuuucuuuucuuuucuuucuuucuuucuuucuuucuuucuuucuuucuuucuuucuuucuuuucuuucuuuucuuucuuuucuuucuuuucuucuuuuuuuuuugaaacagagucucacuguguugcccaggcuggaguauaguggcucuaucugggcuugcugcaaccucugccuccuggguucaagcgauucuccugcuucggccuaccaaguagcugggauuacagacacccaccaccaugccugacugauguuuguauuuuuaguagagaugggguuucacuauguugagcaggcuggucucgaacuccugaccucaagugauccaucugccuuggccucccaaagugcuggaauuacaggcgugagccacuguguccggccuaacuuuuguaauuuuuguagagacggcguucucaauuucuugcccaggcuggccuugaacuccugaccucaggcgauccuccugccuuggccucccaaagugcugggauuacagguaugagccaccaugccuggccaacuaagugcuuuucagcuacaagucaugggaucccacucaagcccacuuuagcaaaagggggauuuugaaugaacuuuucugccuugucaccuuccuuucagggacaccggagaauggagauucuucuuaggcugugccauccaggguugccccacagaaccccagacccucaguccagcuccuccugagauccaaggcauccacaaggaacugcugggguccacauggggcagcagugagccucuugucuuccucagccuuguuugguggacuugaaucagugagguugccaggcauguuggugcaggccuguagucccagcuacucaggaggcugaggcaggaggaucgcuggagcccaggagcucugggaugucgugagcuaugcugauugcaucuccacacuaaguuuggcaucaauauggugaccucccaggaaugggggaccaccauguugcccaaggaggggugaacacugccaugcuggaaauagagcaggucaaaacuccugugcuuugccaggcacaguggcucaugccuguaaucccagcacuuugggaggccaaggcaggcggaucauuugaggucaggaguucaagaccagacuggccaacauggugaaaccccauaucuacuaaaaauacacaaauuagccaggugugguggugcguaccuguaaucccagcugcuuggauggcugaggcaugagaaucuauuguaccuuggaggcagagguugcaaugagcugagauugcgccacugcacuccagcccaggugacagagcaagacucuaucucaaaaaacaaacaaacaaacaaacaaaacaaacaaaaaacccucccgugcugaucagcagugggauugcaccucuaaauagccacugcacuccagccugggcaacauagugagacaccaucucuaaaaaaaaagaaaaaaagaaucagggaggccagcaucucagcagaaaucagcagagugcaggagcugcugucacugucacacuggucagguuugcuggcccaugccggcccccucuuguccgugugaggagggacauggacccacaccuguccaguccgcaguugugcucuaccuauguucauagauugaaagaaaaagucgaauaucucgauggucuccaggaaaaugccauccuuucugucaccucuaagggaucccuguggccucagcaguugaaugccaaauaucuuuccaugaaguuuggacauuguaccaacuuuauuucauuuuuaauauuuugguagagauggggucucacuauguugcccaggcuggucauaaccuuguaccaaguuugacugcccuugagucugcccuggagaucagaguccuuuaucaggcuccaaaaaaugugaaaucacuuaaaaacaugucuuggccaggcaugguggcucacgccuguaaucccagcacuuugggaggccgaggcaggcggaucacuaggucaggaguuugagaccagucuggccaacauagugaaacccuaucucuacuaaaaauacaaaaaauuagccgugcgugguggcagaugccuauaaucccagcuacuggggaggcugaggcaggagaaucgcgugaacccgggaggcggagguugcagugagcugagaucacgccacugcacuccagccugggcagcagaacgagacucugucucaaaaaaacaaaaacaaacaaaaaaaaccaugugucucccgcagagugaaccgcaccacgcuucucccugcgugcacgcugcugggccgccucaucuccauguggcccugcagcaguguguguggggcagcugagggugcagcuugacugcuccuucccuccccacccccaccccguccccgcccccgccacgccacgccucgaagcgccuuccuucgcaggugcuccuuuuguggggaugcccccacauccaggcaggugucuccuuccugcccuccucugcuaucugauuggacaguggaagcgccuucuccugugcucacccagauuucaaauuucaauuucagaggccugugacaaccccacugcuucuaaaagucaccucugugcuuacaacuauccggcuaauuacacaccuguggcguccucagagcaggcugggcaggucugcgucccuggggcuuuagugcagaguugaaaguccuccagguuucccaggugcaccaggagacuggccccuuugccuacaggaaaaacaaaaauuucaaaggagauugaacuugguucuuuuauugaguugucugauuuaaugggguaaguaggcuccgggggccuagucugggagccuagcagcaugucuucuaagccccaggaacuaacuuucauccgagcuaagggcgcugagaccccugcuccaguucucagaauuuauuuaguauagaugcuuccaacaagccguggccauccacuccacgccaggcaccgugccagguuucaggguuacacgaucaauggggaacuuggcacgccuucagggaauuccagaacaggccauuugcaggccagaggaauaucaggacagaaggcagcgugggcaguuguggagugcuuaauccagccuggggaagaagcaggagagugcccuggaguaggugccacucaggcagauucuugccuuuuauuugacuuuucuuuucuucuuucuuucuuuugaaauggggucuugaucugucacucccacuggaguauaguggcgugaucuuggcucacugcaaccuccaccuccuggacucaagugauccuccugucuuagucuccuagguagcugggacuacaggcgugcaccaccacgccuggcuaauuuuuguauuuuuuguagagacaggguuuugcccugucgcccaggcuggucucgaacuccuggacucaagugauccacccgccucagccucccaaagugcugugauuacaggcgugagccaccucaccugucuccuuuuguuuuuccucauaaaaugcagcuccugcaggacuuucuuucccccaaccccacacccuacccccgggauggaguuucgcucuuguagcccaggcuggaaugcaguggugcgaucucggcucacugcaaccucugccucccggccucagccaccugaauaacugggauuacaagcgguugccaccgcgccuggcuaauuuuuguauuuuuaguaguagagacgugguuucaccguauuggccaggcuggucucaaacuccugaccucaggugauccaccugccucagccucccaaaguguuggaauuacaggcgugagccaccacacauggccuuucuuuaauuacugugauuuaaaaaauucuuucuaaaggggcuagaauaaaccauuuuuugguuaagccuugaaauuucuggguccccaccuucuggucaacgcaguaacucugaacuucgucuaugccgguaacucuggaaagucuuugccagcaguaaaaacuccacagcuacuccagaaguagucugaagcccccuaagggauagccuggaggccguuggccuagcucucuacccccuaucccaggcaacuccuccccggucucagcaggauugcuguggggaugguggguggagccagggagcccagcguuggcuucugguugcuaugaaaugcucugggcagcaggggccucucucuuucuuggcauaggaggaacuagagcuccuuuuuaugucugccagaaaacuaguugggggaaggguugguccugagggcccccgauuuacccaguaaacaugcacugggcaccugccucguguccagcagugugcuugacaguggggaugcagugaauggggccagacgugcauuaugcaagucagggaggcggagaaggugaugcaaacaagcgggcagcaugugggcacaguggggcagaguucucugaggccccuuagaaguuccugcuucgaggccaggcgugguggcucacaccuguaaucgcagcacuuugagaggcugaggugggcagaucacaaggucaggagaucgagaccauccuggugaacacggugaaaccccgucucuacuaaaaauacaaaaaaauuagccgggugugguggcggacgccuguagucccagcuacuugggagacugaggcaggagaaucgugugaauccgggaggcggaacuugcagugagccgagaucacgccacugcacuccagccugggcaacagagcgagaucugucucaaaaaaaaagaaguuccugcuucccagaggccacaugaaggcccuccagccacggcccuuccuugaaugggauggugugaguccuucaugcugcagcuggagggggggccaucucugacuucaagcauuaaauacccgaggacuggcucuuuagaucccauugccuguggcccacuuuggccucuaggaucuucuuucuuugucugccaacugcaguggugaggccacuugggagccuugaggucauuucuucuagccuaacaucuaagggccucccuuuauuuuaauuuuuuauuaaaauuucagauuauuauguuuaauuucaaacaaagaauaauacaauggaccaggcacaguggcucaugacugucaucccagcacuuugggaggccaagguggaaggaucgcuugaggccagggauucaagaccagcuuggacaaaauagugagaucucaucucuacuuaaaaaaaaaaugcuggucaugguugugugcaccuguugucccaguuacuuacgaggcugaggcaggaggauggcuugagcccagagguugagggugcagugagcuaugauugcgccacugcacuccagccucggugagagagcaagacacugucuccaaaaaaaaaaaauaaauaaaagcguaaagaaaagaauagaaggaaaccaucauccaugugaaguguucuuuuuuuuuuuuuuuuuuuuaaagacagagucuugcucugcagcccaggcuggaguagugcaaucaugugaucucaacucacugcaaccucugccuccugggcugaagcacaaccucccgaguagcugggauuacaggcacaugccaccauaccuggcuaauuuuuguguuuuuaguagagacagaguuucaccauguugaccaggcuggucucaaacugcugaccucaagugaucugccugccucagccucccaaagugcuggcauuacaggcgugcgccaccacccccggcuaauuuuuguauuuuuaguagagccaggguuuugccauguuggccaggcuggucucaaacuccugaccucaagugauccgccugccuuggccucucaaagugcuacgauuauaggcaugagccaccacgccuggccauguuucuuuuuugaauggugggagaaagugugauuuuuuagcuucccuuuucuguacuuuccaaaugcuccucucuucaucugggcuugucccugagccccuggguccuuauaacugugcuguuaagaauagagagggagccuggggccacuagccugggggggacccagcgauuguaggaaggagccgucagccuccacaucugaagguggagaaggauuuguacuguucgccuccucccucugccugugguggggugaggcugauuccaucacaacagcaacaacaacaacaacagcagcagcagaucaccucagcuggcagccacuguggccguguuggcaagggaccucgggcguucucucugccagcaggucccgcuguguguccagcuggagcgccuuuggggacaccuuguucugcugaggugguaaauggcacgucugucuaauguugccccgaauuguuuuuuccaggucuuaguacccugcaaaggaagccugucgagcagcauccagucuacuugucaguuugaguccuacauuuugauaccuguggaagagcauuuucagaccuuaaauggaaagguauucauuucuugguggaucagccagggucaccuacucgguguuuggggccagaggggaggaagagagucccguucucagccuuucacagcuacuggcaaugguggcauuugacacacacugcagccccguggggggcuggagggacccugccuuugugguggaggaaagggagguagugaugguaagcuggaccccagcugcugucuuggaggccgggaggugccaagcaucucucucugaucccgugaugggguuucugccgugugucgcuggaacaccuccuccuugcugauguccgagccaaaggaaguuguuuuaucccagugccgugaaaagcuugucagugucuuggucccgaauaggacaucagggaugaauauuuuaguuuuuaaaagcuuuuuguuucagcuggacaugguggccuacgccuauaauucuagcacuuuggggggccgaggcaggagaaucacuugaggccaggaguuugagaccagccuggaaaacauaacgagaccccaucucugccaaaaauaaaaauaaaaaaauuagccaggcgugauggugcgugcuucuaguccuagcuacuuggaaggcacaggugggagaauugcuuaagcugaggaguuugagcuugcaguaagccaugauugugucaccacacuguagccugggcaacagagugagacccugucucaaaaaaaaaaaaaaaacaaacccaaaaaacaaucuuuuuguuuugaaauaauuucaaauguuuuaguaaaguugaaaaaacucuuaaaugugcuuccccccaagcuguuaacauucuugccacauugguuuuaucgcugucucucaacacauauuauuauuauuuugaaucuuuuuuuuuuuuuuugagauggaaucuugcucugucaccaggcuggagugcaguggcgcuaucacagcucacugcgagcuccgccucccagguucacgccauucuccugccucagccucccgaguagcugggacuacgggcacccgccaccaugcccagcuaauuuuuuguauuuuuaguagagacgagguuucaccauguuagccaguauggucucgaucuccucaccucaugauccacccgccucggccucccaaagugcugggauuacaggcgugcgccaccgcgccuggccugaaucuuuugagaguaaguugcaggcacugugcccuuuagcccaagacagcucaguguguauuucccaagaacaggcauucucuuauguaaccacaacgcaaugaucacacucagauaauuuagcauugauagaauguccuccaacauauuguccucauacagacugugcugauuauaccaauuauaucuuucauagcaaaaaaaacuucuucuuagcucuagaaucacacacuacauuuuuuuuuucuuuugaggcggagucucacucugucacccaggcuggagugcaguagcuugaucucagcucacugcaaccugcgccucccagguucaagugauucuccugccucagccuccugagugucugggacugcaagcacucgccaccaugcccggauaauuuuuguauuuuuaauagagacgggguuucaccauauuagccaggcuggucucaaacuccugaccucaaaugauccacccaccuuggucuccgaaagugcuuggauuacaggcaugagccacugcacccggccuggauccuuuuuaaauguugcaacagaaaaaacauugagcuguuucuuuaggagaagaaauucuguguucuuugugaaaagaaaagguaagaaagcucucccuaucuaagagauggaaguaaucuugugcugcaguguggccagggcugaaucccaccugcuacucccugcauggcuuacuguggucauggccgggugcugggggcagaccagcugcgcaaagcccgacuccuguccuuuuuguagaucuagguguccaaaagagaacaaaucaacuaagcugacugacagcuggggugagcagaucucuagcaggaaaacagcagugugucuugugagccacagggcagagcagaugcacugacaaccccgugcuuccucucccugucacagcgccacaaaccucagcugccgcaucugaacacagccccugccccagugaggacacuguggccgggcuucccugacuauggggaugccgggaaaaacagggccauuccugaaugggaauaaaaucucccccucucagaaccuaccugcuuccgcuuuaaaagcaaaacaaaacaaaacgacacauaccccaugguuaacaucaacagugaaaaaagcugacaucaugugccuuccaacaggauacacagagggagauaaaacaucccuuucagggcauuccuaucagaaacguguaacuguaaaaccguaaucuaauugucaggaaacaucagacaaacccucccaaacacacggagggagagucugcgauacgcaacaaaaaugucaaugucgugaaaggcaaagaaagaccgaggcacuguuccaaauaaaggaaacugaaaagaugaacaaaugcaucgugugggccaggugugguggcucacgccuguaaucccagcacuccaggaggccaaggcgggcggaucaccugaggcugggaguucaagagcagccuggccaacaugacaaaacugugucucuacuaaaaauacaaaaauuagcugggugugguggugggugccuguagugccacguacucaggaggcugagucaggagaauugcuugacccugggaggcggagguugcagugagccgaggucgcaccacugcacuccagccugggugauggaguaagacucugucucaaaagaaaauagaaaugauucagguaucuugcagccauagcuacuaggccaacaaagaggaaacauuuuaguaucaaaaugagcaaaacaggagaguauuugugccccagcaaacccacaauggggugaaggccguagggucugguuaagugcugcaucgggggccaggcugagagugggaugugguugccccggcugcuggugcagugauggcuuucuuguuuccaggaugucuuuauucaagggaacaggauuaaauuaggagcugguuuugccugucuucucucagugcccauucucuuugaagaaacuuucuacaaugaaaaagaagagaguuucagcauccuguguauagcccauccuuuggaaaagagagagaguucagguauucugggagaaaaaaccuuuuucuccuguuuuagaaaaauguguuuguugaacuuguuccugacuuagcuguugaaagguuaaacaaggccggguaugguggcucgcgccuguaaucccugcacuuugggaggccgaggcacaaggaucacuugaggccaggaguucaaaacuagccuggaaacauagugagacccugucucuauaaaaaaauuaaaaaaaucaagccgggcgcaguggcucacgccuguaaucccagcacuuugggaggcugaggcaggcagauuacuugaggucaggaguucaagaucagccuggccaauguggugaaaccccaucucuacuaaaaauacaaaaauuagcuaggugugguggcaugcaccuguaaucccagcuacucgggaggcugagguaggagaauugcuugaacccagaaaguggagguugcaguaagcugagaucacgccucuguacucgauccugggugacagagugagacucugucucaaaaauaaaaaguaggcugggcgugguggcucacgcuuguaauccuagcacuuugggaggccgaggugggcggauuaccugaggucaggaguucaagaccagcgugaccaacauggggaaaccccaucucuacuaaaaauacaaaaaaaauuagccacgugcaguggugcgugccuguaaucccagcuacucaggaggcugaggcaggagaaucacuugaacccgggaggcagagacuguggugagccgagaucgcaccacugcacuccagccugggcuacagaguaagacuacgccucaaaaaaaagauaaaaauaaaaauaaaaaguaaaaaaauaaaauaauuagccgggcaugguggugcaugccuguagucucaguuacucaagaggcugaggugggagggucacuugagccuaggaauucaaggcugcacugagccaugaucacaccacugcacucuagcaugggcuacagaacaagacccuaucuccaaaaacaauaaaauaaauuauuauuauuauuauuuaauuauuuuugagauggagucuugcucuguugccaggcuggagugcaguggcgcaaucuuggcucacugcagccuccagcucccggguucaagcgauucuccugucucagccuccugaguagcggggauuacaggcgcccgccaccacacccagcuaauuuuuuuauuuuuaguagagacaggguuucaccauguuggccaggauggucuugaucccuugaccucaugaucugcccgccucagccucccaaagugcugggauuacaggcaugagccgcugcgcccggccaauaaauuauuuuuuuaaaaaagguuaaacaucauggaaaauauucaagagccacauggagaccuauauaauuguuuucagugguuccuacuagaacuuuaaagucacugggcuaaggagguguggaucggggcugcuguugcacaggucgggcauugcacaauuccaggaggcagcauucgcauagacagccuaccugugaucagccugggaugugacuguugcccccaugaguuaugcaaagcaguagccccagcuuugucucugggugucagcuucagggcugucucuuauagcgcccagccccagcauugugccucuuugagauuucguuauuuuuaauaaauaauaagucuucauuugccccagaaaauugagauaauaaugugcuggaugcacacugaugcucuuauugucaggaauuggggucuugcccauggucccagauaguuugguuuugucccaggaagaggccuugagaggaccaggcucucuggacuccaggguguccuguaacugggcuguucuuguguagugucuugaaauaaggacauuugcccuccuccccagagggccuaggcccuguaggauaggacagagucaggaaccagcagaggcuucagccggccugaccuguuuguuucuuuuucagaagagccuuuggcacccucagaucccuuuucccugaaaaccauugaagaugugagagaguucuugggaagacacuccgagcgauuugacaggaacaucgccucuuuccaucgaacauuccgagaaugcgagagaaagagccuccgucaccacauagucaguagccgugcuguccucugccuggcgugcccugucucgguucagugcagggugcugggagcccucaguuuccucuggaacugccuggugcugccucacuguuugaagucuuuuaaaaauguuucucucuaacuauaaaaguaguuuaaccgggcauggugguacaagccugucuucccagcacuuugggaggccgagaugggaggaucucuugaggcugggaguucaagaccagccuggguaacauaaaaagaccccaucauuacagaaaauacaaaaauuagccaggcaugguggcaugcacguguauucccagcuacuugggaggccgaggugggaggauggcuuuagcccaggaguuugagacugcagcgugcuauagucauaccacugcacucuacucugggcaacaaagugagacccugucucuuaaaaagaaaaaacaaaccaagugguaaagucauggggaaguauaacaaugaguauuauuauccucuguguuaaccccaaggggaaguuucuccugcuuuuaaugcauauacaccuaaaaaaaaaguugagaaaaaucacguaauugacuucauaaagcuuguguuagcacuugaagcucugugcgccuuacccgcuccggcucccccgucauggccuugcugguaaggguggccugucccucugcucuaugugguuuaggacucagcgaaugcucucuacaccaaaugccuccagcagcuucugagggacucucaccugguaagcagcaggacuucugagagggagaauuguggugcacccccaugcaaauccaagcccuuucacugugcuuuucuugcccucuagaaaaugcucgccaagcaggaggcccagaugaaccugaugaagcaggcaguggaggugaggguggggcggaguggcugggaggcacacccuguugcccgcucacacccugaauggggucuguugauuccacagauauacguccaucaugaaauuuacaaccugaucuuuaaauacguggggaccauggaggcaagugagguagguucucaguuauuaucacccaagauggaagccuucuucugugcuuuuugagaaauuugaagguucguuaaaaucuguuguuaggaugcggccuuuaacaaaaucacaagaagccuucaagaucuucagcagaaagauauuggugugaaaccggaguucagguaaggguuugcgccacagcggcuugguguccucagaggcaggggugcugucuucucccggaagcaggcccucucgguggcagaggugacacgcugguuugaugugguuaguucugaggagcagcgcaguuacuugcaaccaaagauaaagggcugcccuuuauaggugacuguguguggccgucccccucccacacugcaccagcacgccagcuggaugggagccgcugggcacgggguuuugugcagcugguccccaagugggcauguaauuugcccauguggguucugcgugcaggggacaucccaccugcccacccaagggaaccuugccauagagauaccuacuuaggaguuaauucauuucuuuaauuuuuauucuuuuugagacaaagucucacucugucgcccaggcuggagugcaguggugugaucucggcucacugcaaccucugccuccugaguucaagugauucuccugccucagccucccgaguagcgggauuacaggugcacacuaccaugcccugcuaauuuuuguauuuuuagaagagaugggguuucaccauguuggccaggcuggucuugaacuccugaccucaagugaucugcccacccugguuuacaagugcugggauuacaggcgugagccacugcgccgagccuaauuuaaguuucauuaggacacaaaaauguuucaccuaccacaacccucuuuggguuguuucccucuaggaauaggauuuuuuuuuuucagcuuuucuuguacaacucuaucaccuggcagccugaaugggauugaaggcucuucuguuuugccgcugacuugagucagaugacuucucaguaucuguuuuuguguuucauuccuucugguuuguugugagaaguguagauccugagauguguucuuagauccaggccagaggguucucuuacugugcucugaaguugucacuuuccaaauuauuuuacagcuuuaacauaccucgugccaaaagagagcuggcucagcugaacaaaugcaccuccccacagcagaagcuugucugcuugcgaaaaguggugcagcucauuacacagucuccaagccagagagguuugugcuuggaaaggggacuggccaagggguagaugcuacauccagaugaaaaagcaaagagugaugcugucuuaagggauuuuuauggggcugggugcaguggcucaccucuguaaccccagugcuuugggaggccaaggugggaggaucacuugaggccaggaauuggagguugcagugagcuaugaucacaccagugcacuacagccugggugauagagugagaccccuucucaaaaaaaaaaaaaaaaaagaagaaguaaaagaaaacaagucaagaaaaagucaguaaggaagagacauagcuguauguguagauaagggaugauccugaguguauggaaugaaauaaacaggaaugcauaugguagacuuccagccaacagcaucaaagaaugggggauagcuguuuagccacgauaugauggugagcucauagcuguccuggacagaugugcaggaagcaacagcaggagccucugggaaaagagacuggcuggcagggaugggaggaacauucacaguuugcucuuuuguauuguuugaauuuuuaaaugugaaugaauuacuuaaaauuucaaaauggaaaaaaagugaaacuccacaugggcaguggacuccaugucuauaaaauggaagugaccuuaggaaggaccuuggugacuuuaggaagaaagagacuuuaggugauggcucugggcucaucuucauuuuuuaucacugaagccaccucccugggcucuuucagcguccaaggggguggcaaggcauggucugcuuggaguuaacauauuuuuuuuuuuucuuaagagacagggucggcugggcgcgguggcucacaccuguaaucccagcacuuugggaggcugaggcgggcagaucacgaggucaggagaucgagaccauccuggcuagcacggugaaacccugucucuacuaaaaaugcaaaaaaaaauuagcugggcaugguggcgggcaccuguagucccagcugcucaggaggcugaggcaggagaguggcgugaacccgggaggcggagcuugcagugagccaagauugcgccacugcacuccagucugggugacugagcgagacuccguuucaaaaacaaacaaacaaaaaaaagagacagggucucacucugucacccaggcugggugcauuuguagaucacuacauccuugaacuccugggcucaagugauccucuugccucagccucccaaguaccugggauuacaggcaugcaccaccacccuuggcuaauuuucauauuuuuuuguagaggugggggucuugcuauauugcccaggcuggccucagacuccuggccucaagcaauucucccgucucggccucccaaagcacugggauuacaggcacgugcugccguaucuggcuagaguuacuaauaccuuguuuuggucauguucugaaauugcugggcauucuuuucccccuggaccugacaucugaucaggacgcuguaaaggagcuugugcaaugacauuucucccccaguguaugaucucccugauacgugguuucacaaggugugcggugguagggaguugauaugcuugucaguccauuugaaucucaugauggcauugaauguguguuuccccuuugcagugaaccuggagaccaugugugcugaugaucugcuaucaguccuguuauacuugcuugugaaaacggagaucccuaauugguaacauuuucuuuuaagauacucuuuugaaaauggcagugcuuggccgggcacgguggcucacgccuguaaucccagcacuuugggaggccaaggcgggcggaucacgaggucaggagaucgagaccauccuggcuaacacggugaaaccccgucucuacuaaaaaauacaaaaaaauuagcugggcaugguggugggcaccuguagucccagcuacucaggaggcugaggcaggagaauggcgugaacccaggaggcggagcuugcagugagcugaaaucgcgccaccgcacuccagccugggcgacauagcgagacuccgucucaaaaaaaaaaaauggcagcacugcacugugguaguucuaauguaacucuaggaaaagcccaucuucaauuggacaccuguuacgagcuagguguggggccuccccuugcuucauccauccacuuacagauggggaaaccaaggcccggagagcuuacauuucuuguucuggaaugagugucuagacagugguugagcagaaagcugauugccauucuuucuggccccaaaacccauaaucucuccccuggaacccacagcucaguuuacgguaaucagcuugcuaaagacuauuucagggaacuagcuagucauuuuacuuguguuccuaaucgcacacacucugcagagagauccaggggaugguggucguagcuuccugagcgaaccaacugacuagauauuugaucaguugcccaagccaaugauauuuuuuuugcagaagugugacuuggauagacaacaacauaacuuuuuucuuccuuucauuaggauggcaaauuugaguuacaucaaaaacuucagguuuagcagcuuggcaaaggaugaacugggauacugccugaccucauucgaagcugccauugaauauauucggcaaggaagccucucugcuaaacccccuguaagaucucaccccugcccuggccuuccuuugugggcaucaugguucccuugauagggugcugggguugguaugugggcagacggauucuuaaauugccucccaggaauggggccucagcuguuugagggcugugagucuuaaaaaucacucagugaagagaacaccaagcccucaauuggugguaaaaauugguggguuaucauugggauuuacauuguuaauauccuacuucauuaguccccauccucuccaaagacaugugggugcaaagggaagccagaaguagggaauuuggauuucuugaccuugauagucaagaagugaugucacgggaucccuggacugucgcuuuuccagccggaaaccucuguggcugguggcuccuuugccugaguuuuguucgggccugcugggcucauuucacgcucuuggccuggcaggcugcgcucggcuugugcuacuggccuggaucccaugccugccaagggcgagccagguguggaguggcgagggguaugugagcaagugcagggucuggccacugcacacaaccaggugugccgacugagguggggugggcagcuccaaguugcuuguacaggguccugcuccaugcaaggcugcagcuagagcaggcguacuguaggccgcuuccacggugggcacuggggaacacaguggggccuggaagcuuggagacaccaggaacugcagagccccaaagagggugucauagcccuggcucggggaacuccuagguugggcucccugaagggccagagcucuucucuccucucgucaccugcaauguagugagucgggagcauguuuuagcucucuuuauguuacagcucuuucaguccugccauuuggugggucccgaguucuugucccaugucgaggaagaaugagguacguagacuaguggagggugagcaaggcagagaggagcuuuacugaacggcagaauagcucucaggagacccacagugggcagcuucuuuccacaggcaggucguccugacgaguuaaagaggccugacguagguagcuccuuccugcaguugguagucccgacaucugucugagucuggcugaguccgggguuuuuuauggcucagaagggagggaguaugugcugauugguccauaggugggccuggagaaagcaccaugaguucucagucugggucguggacuccacuugggacugacagcccggcccccaggcuuuaggcugucccugucuugaagguggggcuucacugggcaccugcaccuuuccacccagaagcgugucugccuucugccaccaucaacaugcuggccagugcauccaggcuguuugugccaaggggcaucugcaggccugcacugagcugcccucagccccuaccuugacuacucucccaugcucaucagcgcccaaaaucuuggaggggucugaggcaucaggaggcuggugugucagugucacaccaagcaugugcacacauggcuggguugcaacaguacccgggcuuggccucagcuuugcucugaaauugaagucggugccaggaguggggaggagcgggagcaggcacuuacgagccugcggcggcagggaugcuuccugggccccugagagugcagagauuccuggauccagagcugcggcugggcggcugcagcugcgccugggagugcagggcucccgcccugccagcucaguaggagaugggggcuccugccuguuccuggcuccuguuggcccugcagagugcacaaaccuggccgcgcuuccuccacugcagcuuacgucuuugcagcagccacucccgaugggcugccacugccaucugugagaccauuaaugugugcaauuugaggacucaguggccuugccauuguuuccuugguuuuuauugagcauuggcuggggucggcgaggggaugugauuauauuucuaugugaaucgugagaaucuugaaccaugguuguccugcuggccuguuuuacuacauaccaaugaguaaaaugugaucauacagaaaucacaaaguugaaaucuauaaaaugaaaagaucucuguauuauaaggugagagugccaaggauugaacauucaucuuugucagacuuugauguagaaucucccaaaauaaugaugagcuaaagcgucugggagacagcaucagccuguccaggugcucucaggugcaggcauuuccaccccauucauucguuauugacacguucaugcauuuucagucuuuuuccuacccauguauauuuuacauaauugaaauuauauugugugcugggccgggcacgguggcucacgccuguaaucccagcacuuugggaagccaaggcagguggaucaucugaggucaggaguucgagaccagccuggccaacauggugaaacccugucucuacuaaaaauacaagaauuagcugggugugguggcaggugccuguaaucccagcuacuugggaggcugaggcaggagaauugcauuaauccgggaggcagagguugcagugagcugagguuacaccacugcacucuagucugagcaacacagcaagacucugucucaaauauguguauauauauauaaaaaauauauauauauauauagagagagagagagaacuguuuuuuucccaaaagaauagcuuaauuuuuuccuaauuagaagacuaauauuugcuuacaaauaauauuugcagucuauaaaauggcagugaagacaacaaaaacuucccauaaacuuacuagccaggggugacacuuauuaauauuuuagcauuugucuuuuuuucugugcauacacaauuguaucuuuuuuuuuuuuuuugaggcaugugagccagcauuuuauucguucauuucuugcaugugaagcacuccucaaucacauccuuggcccgagauucuuugccaaaguccuuaacugcuacauagcugcagcuagccccuucauagggucuccccucucugucguuuuacagaggccuuacccauuccuuucguuucucauugucaucaaucuuaauuaguuugaccugguguucagcaccuagggucucccuaauguggcacaugcaggcuuaucacaguuggaugcaggcacaccaagaugggcucagcagucgucugaggcuuuggcagcuuggcgaauuccaugugcuaggccaccguggaugaaggcguccuucagcaccccuuguaaaucaguguuaacauccauuacaccgccagcagcagugucuuccucggccauggcagugggucacgggugcagcagugcaaugucuuccucagccacgguugugggucaugggugcagcagugcaagaccuuccucagccauggcagugggucacagguguagcaguacaaugccuuccuuggcuauggcggugggucacggacgcagcugaaucuugaacacaccugagccucugccuccacgugacuuggcgguaacaaggaaugaacacaguuaucuuuuuaaccaaaauuuuagaucaugaucucgcuguacucguugacaguauucagguacuuguugaagaauuaaucucugcucuucucugaagucugauuuaaucaccccacucagcugccagugaaauugggggucauccaucgcaucucggauguggcuggcuguggcucuucugaaaaguuucuuucuucugccuuguuuccauauuuagggggaaaucagcaagauucuagaguauguaugugggcugggugcaguggcucaugccuauaaucccagcacucugggaggcugaggcggguggaucacccgaggccaggaguuggagaccagugugggcaacauagugagaccuugucucuacaaauaaauaaauaaauaaaaaagaaugcgugugugugugcucuugugucucuaccuaugcgugugugcagaucagaauuucuguucauuuccaaggcuggggaguaagaguugugaguuugacuuguuuucuaugaggcugugggaacuuguguuucucucaccgugccugcggugguuuuugcccugcccucugguucuugcagggcaagaaacagauuggucugagaguucacucccuggccggcuuuccugcccugcagaggaaucacucugcugugccuugcugggcccagggugucucuggucaccuggaaggagguguccaccucucaaagaugcucccauccccuugcugcucccuguagcguggcugucuucugcuuucucauuuucuguggaggccuucaccagguuguaaggagguggcugaccaaacaguauacaucggcuucucacaccuccuuuuauuucagaaaauauugcaggcacauuggcaguaauauuugagagguuccuucucucgugcugguguugguuugaggguuugaguccagucuuucuuuuuuuuugagacugagucucgcucugucacccagacgggagugcaguggugcaaucucagcucaaugcaaccuccaccucccggguucaagcgauucuccugccucagccucccaaguaccugggacuacaggcacgcaccacuacgcacggcuaauuuuuguauuuuuguggagauaggauuuugccauguuggcugggcucgucuugaacccuugaccucaagugauccgccugccucagccucccaaagugcugggauuacagguaccagccacugcgcccagccugaguccacuccuauaggcucagaugucuugggcaugucuguuugucucugcaucugggguguaaggaugccccuaaggauaguguuuaguuuggaugggaaagggagggucacagcccaaggcaccccucuuguugucaggguguuggacccugguucugcccuccuggauggaguaugguugguucuggugaaaccuugagacagguaugcaucauccucacggcuggcugugaagcccacccugcagguauugagagaugcucguauauuuacuguggccuguaauugacggagcaggcgucguggcuuccuuguuguugugauucugucuguaucauggccucugucuuagcugcucacugguuuaaguaaugaaguucccuuuaggaauguagagagucauugcuauguauugaugguguuuccuagggaaaaaucccaaguguaucuccucacagcagaagagguuucugaaaaguauuaaggacuaaauaugaggacauccaguuagauuuuacuauugauuuuauauaauauaguuucauggaaauuuucucugcaaaauauacuugagaugaccauaagcuuuuauuuuucuuagagacaggaucucgcucugucacccaggguggagugcaguggugugauccuagcucacugcagccuccaacuccugcgcucaaagggauccuccugccucagccuccuggguggcugggacuacaggugugugccaccacaccuggcuaauuuuuuaauucuuaaauuuuuuguagagaugaggucucgcuauuuugcccaggcugagcuugaacuccugggcucaugugauccucccaccucagcuucccaaagugcugggauuacaggcaugagccaccacaccugcucaacauucuuuaagcauguucauaaaugaagacuucagcuuucugaaaauaaauuacugggaugacucuagaguuaccuuugugaaugaaaaaaagagagaacuuugaaagaaucuggguugggccuggucacucaugccuguaaucccagcacuuugggaggcugaggcaggaggaucaccugaggccaggaguucgagaccagccugggcaauguagcgagaccgccaucuuuacaaaaaauuagcggugcacgguggcacaccuuuagucccagcuacuugggaagcuaaggugggaggaucacuugaaccugguaguucaaggcuguagugagcuaugauuauaccacugcaguccagcuugggagacagagcaagaccccgucucaaaaaaaaaaaaaaaaaaacagauaaaaaaacaagaaagaaccuguaccauucuugucugcagcuuugcaugcuucuggccuuccuuacguuacuggguuucucauagaaaggauuuacccauuucuuuaguaaguccuugcugauacccccucucuuccaauagcucauucuucccugaagauucagucuugggagaccuaccugucuucaucacugcugucuaaaucguuaaccagaguugcggaaagagugcuggauuuacccggauaacaaugugugauguuucucugacccuaagcuccucagcugugaauugcgguguaaaguggauuguuagagcuuuauauggcacacagcagcugggggcagaagugccucucacaggugcugcuguucauuugcuaaguuaacccuccugggggacugcugggaggacccugcauggcagaggaccccaggaauggccuauccccagagaugcugucagcucuaucuuuagguggaccuccaagucaaaacuuagagggcuguaaagagacauccuuauuccacaaauuugucaggguuuggggguuuucuggcagccgcuggcuggagaaaauucccuugacuucccaccaagacccuuuucaggaagcgaauuugucauuacaugguuugguugcaggugcucaaggaagcauugaacugucuugcgagaaaugauuucauaaaguauuauggaaaguaucuagaguuuugccuuuuuuuuuuuuuuuuuuuuugagauggagucuugcucugucacccaggcuggaguguaguggcaccaucuuggcucaccgcaaccuccacuugcgggguucaagugauucuccugccucagccuccugaguaguugggauuacaggcgcccgccaccacacccggcuaauuuuuguauuuuuaguagagagggguuucaccauguuggccaggcuggucucaaacuccugaccucaagugauccacgcgccucggccccucaaagugcugggguuacaggcaugagccaccgcgccuggccuauuuauuuauuuuugagauggagucucgcucucucacccaggcuagagugcaguggugugaucucagcucacuguaaccucugccucccagguuuaagugauucuucugccucagccucccaaguaacugggacuacaggcauguaccaccaugcccugcuaauuuuuuguguuuuuaauagagauugguuucaccauguuggccaggcucguauugaacuccugaccucaggugauccguucaccucagccucccaaagugcugggauuauaggugugagccacugcgccuggccauguggccauauuauuuaauaggcacguccaaaaagcaagaccccucucucuccugcugguugacagugggaaauugagaccagcuugugaaauggcuuuccugcccaaaggccucagauaagacagcagggaauugggcucugcaggcauuuggucagaggcuugaggaggaagggaggccacggcaaugugaguuuccaucuggaggacaauggugugugugcgccgcauuccacgcuggagauggcacauuccacauauacacgcagucagggugccgccaccauccccaucccccacagggagcaaccgucaaagccuccacuuccaggaagccuucuccccaccugacgucagcccguccuccgucucagugagcaggucccauaugagacgggagagaggcgcagccgauacugcucugaagagacagccgggguuguugcugaggugcuggguuuugaaggaucugcacugacaucucgugguguguuugguuuuuucccugcaggagucugagggauuuggagacaggcuguuccuuaagcagagaaugagcuuacucucucagaugacuucgucucccaccgacugccuguuuaaggugagauaccaagacaucucuguggguaaaugugggugaggaacacugcaucucuuggugccucuauaaaauccaucaggguuggccaggcaugguggcucaugccuauaaucacagcacuuugggaggccgaggugggugauaaccugaggccaggaguucaaggccaaguguggccaacauggugcaacagccgccucuacuaaaaauacaaaaauuagcuggguguggugacacaugccuguagucucacuauucgggaggcugaggcaggagaaucguucgaacccagaagguggagguugcagugagccgagaucaugccauugcacucuagccugggcgacagagagacucugucucaaaaagaaaaaaaaaaugaucagggugguggucugcauaaacccugaaguuccauucugugcucagaaugggcaguaggaaugcugagguuuuaaauuugggaucaaggccaggugggguggcuuacuucuguaaucccagcacuuugggaggccgaagugggaggaucacuugaggccagaagcccgagaccagccuggguaacaucaugaguacccgucucuacaaaacaauacaaaaauuagccaggugugguggcgggcaccuguaguccuagcugcucaggaggcugagguggaaggaucaguugaggccaggaguuggaggcugccgugagcuaugauugugccguugcacuccagccuagguggcagagugagagcggcauguuuccccaccucccccagcgugcugugcuguagcugugcugggcggcacacugugggcgcaggccaggccucuugcuuucucaguuccucgcaauacuacuaauuccuccaggccagcucaguggugccuccgcuggcagcccuggcagagcugaugccuccgcugggcucgaggagcccguugucagauguuuaugggcgugugcacuggguugggaacacggugccugacuuccugguggucuggucaccuggcacaugggggcagcucccugcucagacacuggccacaggcaggccgcugaggugcccgcagggcaguccgugagugcugggcgagggcagagcccccugggggaggcugcugugcuuccaggcgaccuggagccagaguggguccuggggaaugagcacguccaggaagcaccaggugagcucugcagguuuguguguugaugggguuuccugcucauugcagcuauucucuuuccuuuacaggcugaugcucuauuagaauaaaagaggauccccuaguccauagcaaguauaaaaauaauaauaaauaaaaaaauaacaagaugaagcugggcaugguggugugcacuuguagucccagcuauaugggaggcuaaggugggaggaucacuugagcccgagagguugaggcugcagugagcucugauugugccacucuacuccagccugggcaacauagcaagaccuuguuucuaaaaaaauaaauaaauaaauucuguuauuugucacccuguagggauucacugaaaaaaaaaaaaaaaaaaaaaaagaacacaagaggaacagggcugaggcuuuuucuagugagguggcaaaauccacacugauguucagagauguguugucugcccgccauuccuauugcuuuauggauuuugucauguuguuuuuuuguuuguuuguuuuuauuuuuugugacagagucucacucugucacccaggcuggaguguaauggugcgaucuugguucacugcaaccuccaucucccggguucaagugauucuccugccucagccucccgagucgcugggauuacaggcgucugccaccacauccggcuaaguuuuguauuuuuaguagagacaagguuuuaccauguuggccaggcuagucucgaacuccugaccucaaaugagccaccugccuuggccucccaaagugcugggauuauaggcgugagccaccgcuccaggcaugucauuguuuuuuuaauuaugggaaacuuuuaacauuuccagaaauagaguaguagaaugagccggccaccauugugcaguuguuucaucucuccucaccuacuuucccuaccaccaagaugauuacaaaggaaaugccagagugcaaaucauuucauccauaaacacauagaugagcauuucuaaaaggacucucggccagguuugguggcucacgccuguaaucccaacacuucgggaggccgagauggguggaucacuuguggucaggaguuugagaccagccuggccaacauggcaaaaccccgugucuacuaaaaauauaaaaauuagccaggugugguggcagaugccucuaaucccagcuacuugggaggcugaggcaggagaauggcuugaacccgggaggcagagguugcagugagcugagaucacaccauugcacuccagccugggcgacaggacgagacuccaucucaaaaaaaccaaaaaggacucucaaaaaauuuacuccuaauaauugaguaauuccagcauguggauagcaucuuggaugucacuuuucagcacauugcaucagguaaccagaaagaaguggagagacuucugagccaagaggaccaugauaaagauaccguccaaaagaugugucacccucucugcuucugcgaugacugugagaaacucgucucuggguaagagggugcugguggaggcucagagugccaggaagcaggagacaggccuccuggaccuucuccacugugcgcugugugacugcagauaaggacuguccucccugccccccagcugccucugcuguacaguggagaugauaacagcugccccuuuggagaaucagauagguuagagguugucaaagcacuugcucacuggcgggcuggcugccaggguaggcugguuauagggccugccccagccucagaaaggggguuuuaggaugggaggaaugucaguuuuucccaguaacauuuuugguuucccauuauccuugucaggcuauuuugcuggguguggaggccuaaaggguuggugggggagagacuccagggccaggugccucuguuccucaugcugggugagcacugggacagugccggagacacacaucucuuggguggcauccugugagccgccuucugucugugguaccugccuaucuaccuggucagggagaggcuuugcugugccauuccccuguguaguuuucuaucucuuucuguauuuuaggagguugaaugaucccucaguugucacuccauucuccagagacgacagggggcacaccccucuccauguggcugcugucugugguaugugguccugggcuggccccuaggggcugucacagcaaagggauggugcccaaggugacccagcagagaggccuggcugaugggcuggguggggguuggcaguuggggcugcaucguggguccacccuccaagggccggaaggagaagaggagcaaacguuccacaggccucgacggccacccugcugccuccugcgcuggcugagccccccugcgugggucccacggcauggaaacacugccuaacgcucccgcaggcugggggcccagcaagggaaggcuugaaucugaacuaugagaacggucucagaaucgucagcucgcaguucuuguggcccugccuuuaaaaaaauauuauuauugucuuuuaaaguauacauuuggcugggcaugguggcucaugccuguaaucccagcacuuugggaggccgaggcaggcaaaucacuugaggucagacauuugagaccaaccuggccgacauggagaaacucugucucuacaaaacauacaaaaaugagccuguugugguggucacgccuauaaucccagcuucuugggaggcugagucagaagaauugcuugaaccuagaagguggagguuguagugagcugagauagcaccaccgcacuccagccuggguggcugagugagacucugucucaaaaaauaaauaaauaaauaaauaaauaaauaaauaaauaaauaaauaaauaaaauaaagugcacauucaagauagaaaacauaagguccuccagaguccccggccaucccugucucccagagaucguugugauugaugagugucuggggugucugcaugcuuguguggauguguggacgcauaaaguguguggugcucuagggcucauaauauucuguugugugcuauuuuucuccuagcacuaugcaagaauauguuuacuugucaguauuuuuuaauggcugcauaauacuccaucuuaugaacugaugagucauggagccuguggaagucuaagucucuuuuccauuauuguuuauugcugagagguggacuuuugcuggguccccuccaaggcccaccccaacaugucuggagucugcggagccuuacuuuauauuagcuguaguuccucucuagcagaaaaaguaucuaccguggguuucaugcccaggacuaggagggugcaauaguguugugguuuuacaguuaagguguggaaggccucugcgccuuccuucuccaucgugacguccuucugcucugcagggcaggcaucccucaucgaccuccugguuuccaagggcgccaugguaaaugccacagacuaccauggagccacuccgcuccaccuggccugucagaagggcuaccagagcgugacggugagcaguggugccuuuguggcgggcugucgcuuugcuccugugagcuugguucugcguggugacuguacggucaugcuggcuacccugcaccccugucuccuggugcugugccccccucguuccacaccagcucugcugcagcaguagucagggaguccaaggacucccggggucuccugggaagacuuucugagucuccuggacaagaucguuagguuuagauuugaaacuuccuggccagaugugguagcucacgccuguaaucccagugcuuugggagcccaaagcaggaggaucgcuugagcccaggaguucaagaccagccugagcaaccuagggagacccuaucucuaccaaaaaauauuuuuuuaaaauuaucugggcaugauggugugugccuauagucccagcaacuugagaggcugaugcaggagguuugccagagcccagcaggucgaggcugcagugagcaaugaucgugccacugcacuucagccugggagacaggcugaguucucuaaaaagaaaaacuuccugaucauaugggggaagaaaagguggggcuuuagacuuuuuucuucagucucucaagugucaggaaugauggguguugguuuaauuugaauaguagcauaaauaagaucgaagaugggagcaaaugaccucccccugcuaagacuggaggccgggccucccagggagccggcugugcccugcucaucgcuuuccuuuaucuccgcagcugcugcugcugcacuacaaggccagcgcggaagugcaggacaacaaugggaauacgccacuccaccuggccugcaccuacggccacgaggacgugaguggcucuugcuguuccgggggggcugcguucacccuuucccacucguagagaagucgggauuucucauuaauguauuuugugucgauaauuauuggaacauuggguguguaaauuuuuuuaauaugaaagaauguuaggccaggcacgguggcucacgccuguaaucccagcacuuugggaggcugaggugggcagaucaucugaggucaggaguucgagaccagccugaccaacauggugaaacccccaucucaacuaaaaauacaaaaauuagcagggcgugguggcgggcaccuguaaucccagcgacucaggagucugaggcaugagaaucaguugaaccugggagguggagguugcagugagccaagauggcaccauuguacuccauccugggugacagugagacuccaucucaaaaaaaaaaaaaaagagaauguuuaauauauuacagaugccauauugaaguaacaaaguuuaaaacaagucacucauuaucuuauccugaagucaaaucauuuucauuucuccuugcuaccgucugguucuuacuuguguacauauucaauuuuuacauuuucuguuuuuauuauuuacuuauuauuuauuuuugagacagggccucacucuggcaccuaggcuggagugcaacgaugggaucuugacucacugcaaccuccuccuuccagguucaagcgauucucccaccucagccucccgaguagcugggauuacaggugugugccaccacacccagcuaauuuuuguauuuuuaguaaagucgggguuucaccauguuggccaggcuggucuggaucuccuggccccaggugaucuuccaccucagccucccaaagugcugggauuacaggagugagccaccgcaccuggccuuuauuuuuuacuuuuuaaaauuagaaaaacaaauuuuuuuugagacaagaucuuguucuguugcccaggcuggagugcaguggcaugauuuuggcucacugcagccuuagccuccuggcucaagccauccucccaccucagcuuccccugggacuaaagguacacaccaccaugccuggcuaauuuuuauauuuuuguagagaaaggguuucgccauguugcccaggcuggucuuacauuccugaacucaaguaauccucccaccucagccuuccaaaguucugggaauacaggcaugagccaccauuucugguucacuuuuauaaugauauccaagaauugcguaauuuccauuuucacguccuguuucaccacuaugugcuuauuuuuuccuacccgcccuccuucuggcuucucuccauagugauauauggauagauuuacacacguguguggggcucaggccuggccaggugguugauguaugaagaugacaccaugcccuguaugcuuuuaugccacuugcuuuccuaacuuagcucuacguuacagagauccucuaggucagucccuguugaucuagcacauucuuuuuuuuuuuuuuuuugagacggagucuugcucuguugcccaggcuggagugcaauggcacgaucuuggcucacugcaaccucugccucccggguucaagcgauucuccugccucagccuccugaguagcugggacugcagacacauaccaccacauccagcuaauuuuuguauuuuuaguagagacgggguuucaccauguugaccaggcuggucuugaacuccugaccucaagugauccgccugccucagccucccaaagugcugggauuacaggcgugagccaccgugccuggccaucuagcacauucuuuaauagcugcagugaucuaucguguguugugucaguggucuccaagaccaccccugggcucagugauuugcugggaggacuuacagaacucagcauauagucgcacucacagcugugguuuguuacagcagaaggacacagaacaacaucagcaaagggaacaggcacgugguggaguccagagaggagagcaggggugagcuucaaacagucucucucggcugggcacaguggcuggcaccuguagucccagcacuuugggagaccaaggccggcaaauugccugaggucaggaguucaagaccagccuggccaacauggugaaacccugucucuacuaaaaaaauacaaaaauuagcugugugugguggcacacaccuauaaucccagcuacucaggagguugaggugggagaaucacuugaacuaggaggcggagguugcaaugagcugagauugcacugcuguacuccagccuaggcgacagagcgagacugugucucaaaaaaaaaaaaaaaacaacaggucucuuuucauggacccacacaggaugggcucaguucuuccagcagugaguuggaacaacacacaggaagugugguccacucgggaagcucauuaggaacucaguccccaagaguuaaugaaggcuaguccuguaagcaccuucuggacagcauguaccaaaaugccauacucccagaagaaacucgggcguucagcauaaaccacauuguauaaaacaauucaggcccagugugagccaccuaaucaguuagggaauuuugggaacacuccccacauccaggcacccauagaauguuucaggccaacaggcagucuugcaagcaggccucucagugguuagcagucucaggccugcuguaguaacucuguucuguacauggagacaucacaguuuuugcagccacuucuuauugauuggcaguuucauccuuuugaaagcaugagguguccuggcugagcgcaguggcucacaucuauaauuccagcacugugagaggcugaggugggaggauuuuuugagcccaggaguuugaguccugccugggcaacagagugagacccugucucuacaggaaaaaaaaaaaauuaaaaaaaaaaaccauccaggcaugguggugcaugcuuguagucccagcugcucgggaggcugaggugggaggaucgcuuaagcccaggaguucaaggcugcagugagcuauuauugcaucacugcacugcaaccugaauaacagagagagauccugucucaaaaaagaaaaagaaaaaaaaaaugaaugagaaugagguguccugaucagauacugugacacuucugaguucugucuguuacugcacauuugcuuggugaggaggucgaggagagcacggaccuugucgaggcuugguacauccaugagcgaugccauuuccccaucucuuugcagugugugaaggcucugguuuacuacgacguggagucgugcagacuugacauuggcaaugagaaaggagacaccccucuacacauugcugcccgcuggggcuaccaaggcgucauagagacauugcugcagaacggagcguccaccgagauccagaacagacugaaggagacgccccucaagugugcauuaaacucaaagguagcucuucccaucucugaggggcaagaugacuucgaaagaagaucgauguccguagcuuaggucuuggccuacuagacaaauugugcauuauugccugagggcagaacuuggcuugcacccuuucugccgcaugugggacgucaucauuaauggguuuuacugauauauuauuuuugguuugagugggcguuuuucucaggguuguuccaggaacuccugcaggcagaguuuguucuggcugccgagugcuauugauuuauuggcaaauggaguggguagaaacgaggcuccgcaggggcagggacuggggagggagcaggauguguuggaacucuuuuuucccggugcuucaccuucaaugccuagagucuuuauugagacucggccaguucuggacaucgagugugguuucuuucauacauaauuuguuaaugagcucaccuuuuucugguaguaauuucuggagacauaguuuggggagcauguugugaagugcuccccucucgugagucaguggggcuuggagguggcucgcagaggccaguucucugcacucucgucucccggcagcagagcuggugaauggcaucguuagagaggcauguggcagacugaccagggggagcacagggcccugugaaauggagaccccagcauggacguccagaauaucugcaagcugaggcuccccugagggauucuguuccacuccaggucucuaggggagccccguuuguacaggccugacuuucugccuuuuuacaaaaauauuuaauuuuuuuuguuguuuugagauggagucucgcucuguugcccaggcuggagugcaguggcacaaucuuggcucacugcaaccuccacuuccuagguucaagugauucuccuacuucagccucccuagcagcugggauuacaggugcccaccaccacaccugguuaauuuuuuguauuuuuaguagggaugggguuucaccauguuggcuaggcuggucuugaacuccugaccucaggugauccacccaccuuggccucccaaaguacugggauuacaggugugaguuauugcgcccagccccaaaauauaugauuuuagaaaaguaauagagaugagaucuuaguguguugcccaggcuugucuuaaauuccuggccucaagugauccucucaccuuggccucccagggugcuggcauuacaggcaugagccacugcgccuggccagcuuucugccuuuugauguuuuacugcucccuuuuauaauuuccagcucuuccagguuguucuuucaguuuguucacaucuuauucuuggaguagcacaguuugaauuuguuuuuauuuuuguuuucucuaaaccucuuuauugaggcaugauuggcauacagaaagcuguauauagucaguguauacaacuugaugaguuuagagaagaguggacauccaugaaaccaucaccaccaucuacgccauaaacauauccaucaccuccaaaaguuuacuucuguucucuuuuuuuuuuuuuuuuuuuuuuuuuugagacaagguuuggcuguauugcccaaacuggaguacaguggugcgaucucagcuuacugcaaccucugccuccugggcucaaggcauccucccaccucagcucucgaguagcugggacuacaggcaugcgccaccacacccggcuaauuuuuguauuuuuuauacagguggaguuucaccauguuggccaggcuggucucaaacucaugaccucaagugaucugcccgccuuggccccuuaaagugcugggauuacaggugugagccaccgccccugcuuucaucuuucuuuuuuauuguuuugguuuuuuuuuuugagacggagucucgcucugucgcccaggcuggagugcaguggcaugaucuuggcucacugcaacuuccaccucccagguucaagcaauucuccugccucagccucccuuguagcugggagguauaggugugugucaccaagcccagcuaguuuauuuuuuuuuuguauuuuuauuagagaugggguuucaucauguuggccaggcuggucuugaacuccugaccucaagugaucugcccaccuaggccucccaaagugcugggauuacaguuaugggucaucucgcccggcuucccucuuuuuuuuuuuuuuaaauuauuuuguguguguguggcagggacacagcauaagaacuacaguaaagcacaguuugugaaggguuagaucccuguuucuggcuucaggggccuccggcuguacccccugaauacugccaaggucgcagcuuucuggcaggcagagcugacugggcugagcagugccaccacggcuggggcugcugggaugucuugggaggaggguucuauugccguggcguuuguuuaccaaaggcccuuccagagggagaucugcagaggaaaagagaggcugccuucucggcuuggcucugagcuguuccuacuugagaccugugggugcuagaggaaaggccacaccucaugccuguggacagacaggccugggggcuggaugcagucaccuuucaggcuccaugcgggucuggcuucucuuaucccuugcguccaugcgugggaagcccugagcccucccacgggacaggaggagccgugaagggaggaagccccgacuucggggugaucgugcguaaguucccaccugcucugggucuugguuuuucugucuauccaagggugcgacugggccacgugaccuaaggcucacugcacugacauuccgaggagcuaggccggcaguggggcgugugggugauggcacugugcugagacgacccccaucucacgggguacuguuggcaucccccuugucccccuagauucugucuguaauggaagccuaucaccuguccuucgagaggaggcagaagucguccgagguaagucagccgggcugagcaggucagguuaccuuggagaccaagggcgccuucucugguccucacguguccuuguguccuguccucucucucguuggggcuccuuggcugcaggccccugugcaguccccgcagcgcuccguggacuccaucagccaagaguccuccacuuccagcuucuccuccaugucagccagcucaaggcaggaggagaccaagaaggacuacagagaggugaggcuuccagaggaagggcuggggaggggaggccuuggcggcccugggcagugguguccagcugaagagccguggccugacaagggccgcccucucagccugcuugcccaugcugaggccgcugcugcucugugguggccgagguuggugccuucaagcugggcccagcagcaucucgcggugcuguauauuuuggugugcccuucauggaccacucccugagcagcaauuagugugguagagugcguuuguguauuaaagagaggauaggcuaagaagaagacaagucaggucauguagaaguccgcugauuucagaucauuuuauuuuuauuuuuuauuuuuugagauaagagucucgcucuguugcccaggcuggagugcaguggugcaauccgggcucacugcaaccuccaccucccagguucaagcaauucuccugccucagccucccaaguaacugggauuacaggcgugagccaccaugcccggccagaucugccucauucuuuagcugaggaguggacuguugaauggauguaccaccuucgauggcccccccaugggugcugaacccucacugacccuaccauagugucccacuacccacaagccgugacaugcucuuggaggaccaagugagcuuagcuccaugcaaagccauagcagagacagccaagagacaugguccagagucuaacggagaccugaaguugucccugggagggguguccacccucauggugucccagcuagcagauacugauagcugaguucaguauuucuuuuuuuuuuuuuuuuuuuuucuuuuugggacacggucucacugugucacccaggcuggagugcagugguacagucauagcucccugcaaccucaaacuccuggggauugccuccaaagugcugggauuacaggccgagccacugcacuuagcuaaguguauuuuucuaaaucauagggguggcuggcgucuuaggaaggacuuguguuccaaggcgaccauggccucaccuuuccacugauaaauauacauuuauauguauauacauauaaauauacauauacauuuauacaauuccacugauaaaguuacaguuuauuauucccuaaauggcaguggguucugcgcacaccagcaacuuccuaggaugcccucccugagcaguuuuagggacacauuuacaggauacuaaaucagccgggcgugguggcucacgccuguaaugccagcacuuugggaggccgaggugggcggaucaccugaggucgggaguuugagaccagccugaccaauauggagaaacccuguaucuacuaaaaauacaaaaaaaauuagccgggcaugguggugcaugccuguaaucccagcuacuagggaggcugaggcaggagaaucgcuugaaccugggaggcggagguugcggugagccgagauugcgccacugcacuccauccugagcaauaagagcgaaacuccaucucaaaaaaaaaaaaaaaaaacuaaaucagacguuaaaaguccacaaaucaagccaauagauuuucagaauguuuauauuauuucuauuauuauuuuauuguugaaaucauuuuucuaacauucuuguuccuuuuauuaagguagaaaaacuuuugagagcaguugcugauggagaucuagaaauggugaguuuuuagaagugcuuuuuauuuuauuuuuauuuuuuagagacagggucuuguucugucacccaggcuggagugcaguggcgugaucauggcucacugcagccuugaacuccuggacucaagcaauccucuugccucagccucuugaauagaugggaccacaguugugcgcggccaugccuggcuaaucauaaacaaauuuuuuguagagauaaggucuugcuauauugcccagucugaucuugaacuccuggccucaagcgauucuccugccuuggccucccaaaguacuuggauuacaggugugagccacccugcccagcuuuagaagugcuuuuuauuauaaaaagcuuguucuagcuuaaaacagccacccaccuguguuucuugucuccgguucaguuucgggccauguggacucugauuuugugcagagggcgcuauguuuaaugcauauuugguaaugguguuguuauauuuuccugacaaguaaugaggcagaucaacauacaggcacauagcgagugugggcccugccuuucagauguccauacuccaggagugugaugagacguugccaagaccagagaccauguccgaggcacagagugugggcucagagcccaggcccacuagccagugugcaaggagggcagcuugguuuuaagagagggcagcgucuuggggagaggaggaaguagagaggcgaaggcagagcccagugguguuugugagguucugcagaagcuguggucagcugggacuccugggccacgagagggggccugaggcuugaggcucugaggagucauaagcagguaucuggauaaagauggagccgccagcccugggcuggcaccuggagagaaugucguggcuugaaggaaggcgucuuuccuaaccauuagguacaucugacagugaaaugaguggacauuggagacagccuuccuuagauucugacggacagguuccccuggcuugccuuuggcccuuugaaaggacugugucuuccacuuuuuuuuuuuuuuuuuuuugagacggagucuugcgcugucauccaggagugcaguggcaugaucucagcucacugcaaccuccaccuccuggguucaagcaauucuccugcuucagccuccugagaaggugggacuacaggcaugcgccaccacacccagcuaauuuuuguauuuuuagcagagacgggguuucaccauguuggccaggcugggcuugaacuccugaccucaggugaucugccugcuuaggccuccccaaaugcugggauuacaggcgugagccaccaugccugcccguaucuuccacuuuuaauggaggagggagugaggugcucacuaagugcccuaggaccaggauggguuuauuuuuuugagaguuuugcucuguugcccaggcuggagugcuauggugugaucauggcucacaguagccuugaacuccugggcucaggcgauucucuggccucugccucccagaaugcugggauuacaccuauaagccacugcgcccagcccuaggacuagaguuuuaaagccaucacccugaggcagcaccaaucuuccuguccuuuuuuaugauagaagaaaauaaucucuggcauaagcugugaaguggaaggacugaggaaggcuucaugagggagcagaagccgguuauaaauggcugugggguuggagaaggaagcgugggcccugauugggaacgguugaugguguguguuuaagauauugugcaugcaaagacgcugaggauguguuccuguuuccguuacucuccaucaccaggugcguuaccuguuggaauggacagaggaggaccuggaggaugcggaggacacugucagugcagcggaccccgaauucugucacccguugugccagugccccaagugugccccagcucagaagguuuggcuuuguuucuguugguggaggucagggaauguaggcaauuuuuguuuuuguuuuuguuuuuguuuuuugagacagggucucguucugucacccaggccggagugcagugguacagucaugacccacugcagccucaaccgccugggcucaaaugauccucucaccucaguguccugacuagcugagaccacaggcaugcaccaccacaccuggcuaauuuguuucuuuuuguagagacucagccuuucuguguugcccagacuggucucggccucccaggcucaagcuauccuccugccucagccucccacagugcugggauuacagacgugagccacugcuccuggccagcaaauucuuccuuuuucccucaggaaaguucucgauuucucagccagauaauuacuguacugcaugucugugaauagguauuccccaagauauggugagacucauuagccuagggcgggugccagcucccugcguggcagguaagcgagcagagaugugucccaugauuagcguuuuggcugcuaucugggccccugagucccguggcaggagcuuaugaacagaugcucaagggucuccuuccagguaccuaaagccccccagggaagcugcacgcauguucugcuguugcuuuuacucaguugaguucacucuucauggggacucucccuccaagugcagagaaauccccaaacccucucccagcuuuccccagggguaacauccuugcaaaacugugguacagaaucacagccaggauaucaacauugaugcaauccguggaucuuaguucagauuuccccaguucugcuuguucucguguguguguauguaguucuguacaguugugccacauguguagguuuauguauccaccaucacauucaagauauuuucugugacagauacuuuuauauacuccuuguucuuuuuauuuauuuauuuuuuuauuuuuugagauagagccuugcucugucgggcgaucuuggcucacugcaaccucugccucccggguugaagcgauuccccugccucagccuccuguguagcggggaccauagcacccaccaccacgcccagcuaauuuuuuguauuuuuaguggagacaggguuucaccauguuggccaggcuggucucaaacuccugaccucaagugauucgcccaucucagccucccaaagugcugggauuacaggugugagccgcugcgccuggccuccuuguucuuuuacagccucuuguucuuguuuuguaaugucucaaaaagacagaacacuaaacugcuuuauaucuuugauuaaauugaaacccaccccgccauucuuuucuagcccaguguuuuagaauuggucuuuaaauccuuuaucgaaguauaauucacagacaauaaagucuauguauuuauacaacuuggugagcuuuuacagauguaaaaccugugaagccaucaccaccaucaagacgcagcaugugucugucaccggaaagcacaguucucucacaagaccaaucauucaaacugcccucuuacagccacacccaccucucucccugccacgcccaccccaccauccccaaccgcuggcaaccacuuaccuguucuccauuucccuaauccugucacuucaaaaacguuacauaaguggcuuaugccuguaaucccagcacuuugggaggccgaggcagguggaucacgaaguuagaagaucaagaccauccuggcuaacauggugaaaccccgucucuacuaaauauacaaaaaauuagcugggcgugguggcgggcgcuucuagucccagcuacucgggaggcugaggcaggagaauggcgugaacccgggaggcagggcuugcagugagccgagauugugccaccgcacuccagccugggcaacagagcaagacuccgucucaaaaaaaaaaaaaaaaaaaaguuacauaaauguaaucacaguauacaauccuuuugggauugacuuucuucacuccguuugauuccacacuguugccuagaaucaggucuguuucuccauggcgggguggcauuccauuuguuuaaugguggcauauacucacuguggaauguccaaggacauguaguuuguugcuaguuuggggaauauuaccaauaaaacugccacgaacaaacauuagaguagacguuucgguaagaacacaaguuuucauuuuucuaggauaagugcccaagagugcaauuguggagucauauggucauugcauggcaauuccaugguucauuuuuauaaggaacugacagucuuuucccaagcaggcuguaucauuuuacaugcccaccagcgauguaugagugauccaguuccuccucguccuccccagcacuggguguggucauuauuuucuguuuuagccauucagauagguguguaguacuaucucaguguggccuuaauuugcauuucucuaauggcugaugcuguugaacagcuuuucaugggcuuauuugccaucuguauauguucuucagugaaaugucuguucauuuguuuugcccauuuucuaauugguuuguuuuuggcuuuaucguugaauuuauauauucuagauauguggauauuuguuagauacgugcuuugcagacauuuucuuucagucuguagcuugucuauaauuuccucacaugggcuuucacagagaaaaagguuuuuagacaucucauuugucaguauuuccuuuuauggauuauacuuuuggugucaagucugagaauucuuugccuugcucuagauuuccaacuuucuccuguuuuuuuuaaguuauaauuuuauauuuuauaguuaaguccaugauccaauuuguguuaauuuuuacucaaagugugagauuuagguugagguucuucuuuguuuuuucuugccuacaaguguccacuugcgccagcaccauuuguugaaaagccucuccuuccucccgugacuugccuuugcaccucaguuggcuauagauuguguggaucuauuucuggguucucuguucugcugcauugaucuaugggcccauccuaccaguaccgcgcugucuugaugacugaugcuguguaguaagccucaguauuggauugaaugauucuuccuaauuuauucuucuuugccaggaauauuucagcuauucuauggccugugccuugccauguaaauuuuauuuauuuauuuaccuauugcuuacuuacuaacuuacucacucuuauaguacccagacuggucugagcuauaucaauuuuagaauuaguuuuuguaugucuacaaaauaccuugcucggauuuugauaggaauuacauuaaaccuauagaugaacuggggagaaauaacaucauaugacucaacguauguugagucuucaugaacaugguacaucucuccaaguauuuaggccuucuuugacuucuuucaucaacauuuugugauuuuuuuucagcauacagauccugccugugucauguuaaguguacaccucaguauuucaucuucuuucaagcaguuguaaaugguauugcauacauagcaugcauucauguguuagcuaucuaauuauagauguguaugucccauacuaagagaauuaggcugggcucagugucauacaccuguaaucccaacacuuugggaggccgagguuagaggaucacuugaggccaggaguuugagaccagccuggccaacagaguaagacccugucucuaagaaacuaaaaauauaaaauagaaaauagaaaaugaauuuggccgggcacgauggcucacgccuguaaucccagcacuuugggaggccgaggcggguagaucaccugaggucaggaauucgagaccagccugaccaacauggagaaaccccaucccuacuaaaaauacaaaauuagcuggccgugguggugcaugccuguaaucccagcuacucgggaggcugaggcaggagaaucgcuugaacccaggaggcggagguugcggugagccgagaucgugccauugcacucuagccuggggaacaagagugaaacuccaucucaaaaaaaagaaaauggauuugacuuuauaaaauagauagagugguguuagccuuuauauuguaggauaauuuuaccauuucuaaaaagaacuucagcgugggugacucuaaggauauugaaaaugacuaaaguuuucccucacacauuuuucagcugugagguaacauguacacuggggaugugcaccuuuugaccuggcccccugcugcuggaugcacaugguccagaacacaauuuccccgagguggguggcuaugaaaacacaggauaagaaaggcagaugguguucccuagcaucuggugggaagugaugaagcccucgggcccucaguaccuguguguggcgagauugcugcaucuccgcugcugcuguuuuugccauuuuucuccucccuguguuuucccacuuuaauuacacaguaaaauacuguggaacucaauugggugaagucuuagguucccuguacuucuaaaaccucuuauucucuuuuugugauuucucaaaaagacacaccacuaaacugcuucaugucugugauuaaaugaaaauccacuccccccauccucuucuagcccagugauuuauuuuauuuuauuuuauuuuauuuuaauuuuuagagaugggguuucacucugucacccaggcuggagugcaguggcacaaucauagcucacuuacagcuugggacuccugggcucaagugauccuccugccccagccucccaaaguccuggaauuacaggcaugagccaccacaccaggccuccagugguguuuaauguauuacuucuuuuuuuucuuuuuugagacggagucucccucugucgcccaggcuggaguacaguggugcaauauuggcucacugcaaccucugccucucggguucaagacauucuucugccucagccucccgaguagcugggacuacaggugcaugccgccacaccuggcuaauuuuuguauuuuuaguagagacaggguuuugccauauuggccaugcuggucucaaacuccugaccucaagugauccgcuugccucagccucccaaagugcugggauuauaggcaugagccacugcgcuuggccuaaacuuuuuuuuuuuuuuuuuuuuuagagacggucuuggucugucaccaaggccagagugcaguguugcaaucauagcucacugaagccucaaacucuugggcccaagggauccuuuugccucagccucccaaaugguuggaacuacaggcacguaccaccaugcugggcuauuuuauuuuauuuauuuauuuauuuuuugagacagggucuugcucugucgccaggcuggagugcaguggcgccaucucggcucacugcaaccucugccuccuggguucaagcaauucuccuaccucagcuuccugaguagcugggacuacaggcaugcgccaccaugcccagcuaauuuuuguauuuuuaguagagacggaguuucaccauguuggccaggauggucucgaucucuugaccucaugauccaccugccucggccucccgaaagugcuggcauuacaggcguaagcuaccuugcuggccuauuuuuuuuauuuuuguagagacagggucuuggcuguguuguccaggcugguuucgaacuccugggcccaagcgauccuccugccucagccucccaaagugcugagauuauaggcgugagccaccacacccggucuccagugguguuuuagaauuuguuuuuaaaucuuuuauugaaauauaauuauauacauuauaauuuauauaauuuauauuuacauaaagcauauguauuuaaaguauacaauuuggcaaguuuuacagauauauaaaccugugaaaccaucaccaccaucaagauacacaacguuucccucacuugcaagaguuuccugugagauuuugccuucccccccacuaugacccccccauucccccaucgccucucccaggcaacccgugaccugcuuuucaucaucauggauuaguuaacacuuucgagaaucuuuuguaaguggaauucuaacgcaugucccuuuucaugucugccuucuuugacucaggauauuuuugagacccauguuggaucaggaguucauugcuggauaguaguugauuggguggacacaccagaauuuguuguuucauucaccuguuaauggacaucugaguaguuuuccugcuucuggauuuguaaauaaagccauugugaacauuuguguacaggccuuuguguggauauauacguugguggguaaacaccuaggaguuacaggccuuuguguggauauauacguuguuggguaaacaccuaggaguauaauugcuggauuauauaguaaggauauguuuaaccuuaaaagaaacugccaguuuuccaaagugguuggaguaguuucuguucccuccagcaggguuugagcauuccaguugcuccacaucccugccaacauuugguauuuugacuuuuuuuuuuuuuuuuggagauggagucucgcucuguugcccagccuagccaacguggcaaaacccugucucuacuacaaauacaaaaaucagccaggugugguggcacacgccuguaaucccagcuacuugggaggcugaggcaggagaauucgcuugaaccggagaggcagagauugcagugagccaggcuggauggagugcaguggugugaucuuggcucacugcaaccuucgccuccuggguuugagcgauucuacagcccaaugcaugccuguaauguagcugggauuacaggcaggugccgccacaccuggguaauuuuuguauuuuugguagagacgggguuucaccauguuggccaggauggucuagaacuccugaccucaggugaucugcccaccucggacucucaaaguguugggauuacaggcaugagccacugugcccagccuugaguuuuuaacuuuagccauucugauaaauaugcaggguauuucauuuaguguguguauguaugugcacauguguguuuuccagcuucuuuuuuauuuuugagauauaauuuacauauaauaaaauucagccuuuaauuuagcauacaguuuuuuuuuuuaaagagguaacauuuuuaaucaucaaaaaguaaaauuauucucaccuaaacccaagaaucacuguuucuuauagcggugguuuaaacagaggugcaaacagcaagugaaucucgucgccuuugcggggcuguggccaugccccucaaaggaaauuuggaggcucuacagcccuggugaaaaaaaaaaaagugaaauuagccagguacaguggcauacaucugcagucucagcacuuugggaggcugaggugggaggaccacaugaaccugggaguucaagaccagccugggccagcuggugagaccccaucucuacaaaaaaaaaaaaaaaaaaaaauuagcugggcacaauggcuugcaccuguggaccuagcuacuugggaggcugaggcgggaggaucacuugagccuaggaggucgaggcuguagugagccaugaugguggugccacugcacuccagccugggcaacagagugagacccugucucaaaaaaaaaaaaaggaaguuguuuuuuggcaugccacauacuucuaaacaaauuggaauccauccuggaucccgccaugaucccgcauugugugugggagcuguggggggcacauggugccaaucacuccagcccaguuucuucaauacugaugacguuuguguuuccaucuucugcgcuucccagaggcuggcgaagguuccugccagugggcuuggugugaacgugaccagccaggacggcuccuccccgcugcaugucgccgcccugcacggccgggcggaccucaucccccuccugcugaagcacggggccaacgcaggugccaggaacgcagaccaagccgucccgcuccaccuggccugccagcagggccacuuucagguucgggcuguguguugggggugguggagcagggugucugcuuugggcuaggaccuugugcuugguaggaacgcugcagggguuugguggcuacccuggaggacacugcucccccgagcccugagauucugaggugcacacgguaggccacucagccucggagcacagagccuugaugcucccuggggguggagccagucccugccccacugccacucccaucugggugauaccgagguugucauucugauucuugcccccagcaggaucuggcucuugagcucgugugguggccaccgagcacuguccccauggucaucuuaccaccuuuacaccccgacagugccuugcucugggccaaacaguucagcacuucauaaagaacagucagggccccauagaggggcucaaggaagaauuuugaauuuuggagugauuaacuuuuugaaagugcugggguuuuuugccuuuuuuuuuuuuuuuuuuuuuuaagacaucaccuugcucugucucccaggcuggagcgugggagugcaguggugcaaucucagcucacacugcagccucaaucuccugggcucaaacaauccucccaucucagccucccucccuaguagcugggaccacaggcgugcaccaccacaccuagauaaauuuuucuuuuuuuuuuuuuuuuuuuuuuuuuuuuuuuuuuuguggagaugggguuucaccauguuguccagacugguguugaacuccugagcucaagcgauccucccaccuuggcuucccaaaguacugggauuacagggaugagccacagcaccaggcccugcuuuucuuuaaggaaaacuguguguauauuuuuucauuuuccuuuaucaguucuacuguuaacuuuuuaaagaaaggagccauauuucaggucuugcaucucucucgccaacaccuagcauagagcuucaggcauggcuuuccuaaucuguaaauucggaguggcgauugcagcucucccugagguagaaaggauagaaaggugaagugagaucacugucgcccagcacaucgggugaagugagaucacugucacccugcgcuucaaccgcacagagcagccccgcagcagaugguagcccuccccucuucaccuggucccuuuucuccugagagucuaaagucuucucaauaagcucagagacggcugggcgugguggcucaugccuguaaucccagcauuuugggaggccgagacggguggaucaccugaggucaagaguucgaggccagcccugccaacauggugaaaccccgucucuacugaaaauacagaaaauuagccaagcgugguggcaggcgccuguagucccagcugcucaggaggcugaggcgugagaaucaguugaaccugggaggcggaggcuggaguaagccaagaucacgccacugcacuccagccugggcgacagagcgagacucugucuggaaaaaaaaaaaaaaaaaagaaagaaaaaccaaaaagaacaacaacaaaaaaauaagcucagagacaagucaaaagaauaucaaacuugagcauuucucuccagaaacuuuguuuucuuauuuuauuuauuuauuuauuuauuuuucauaauuuuucucuggcaggaaaugacagaaauuuugauuaaguuugcacguuuuccuucucuggcccagguggugaagugucuguuagauucgaaugcaaaacccaauaagaaggaccucaguggaaacacgccccucauuuacgccugcuccgguggccaucacgagcuuguggcacugcugcuacaggugagggccccuuccuguccucauucuacacaccugcgccaguuaacagggcgccuccacccagcgacccccgcagcgcacuggggauggagaggcccggccacccaucaaccccaggccucuggggagaggagcagggcgugcgucuucccacacgggguucuccgaugggaacagauggugccccagcaucugggaugcggucucaagggcuccgacgcugcuuuugccaaggguuugggucucaccucaccgaccgggaaugugucacgcuguuaccugagcaugggcugaguggccgccucugucccugcugcucuugaaaaagguuaugugaaugcauuagaauuucuuaaagaaguagggaaaaaccaaccuguccaugacugugcuacucaagggaaacucauuaugguggacuuuugacaaauguguauaguuucaguguuauuuauuaauuuuuuuuugagacaaggucuugcucuguggcccaggcuggaaugcaauggcacccucacagcucacugcagccucagucucccaggcucaggugccucagccucccagcuaacugggacuacagauacauaccacugcaccuggcuaguuuuugcuguuuguuuuuaguagagaugggggucucacuauguugcccaggcuggucucaaacuccugagcuccaacgauccucuugcacuggccuccuaaagugcuggauuacggguguaagccacggggccucgccaaguauuguuuucucuuuuuccgagauggagucucgcucugucaccuaggaaugcaguggcuuacucucagcucacugcaaccucugccuccgggguucaagcgauucuccugccucagccucccgaauagcuggaacuacaggcgcccaccaccaugcccagcuaauuuuuuuguuuuuugguguuuuuuuuuaguagagaugggauuucacuauguuggccaggcuggucuugaacuccugaccucaggugauccaccugccucugccucccaaagugcugggauuauaggcaugggccacugugccuggccccaaguauuguuuucugucuuaauguuauuuaauguagaaacuuauuuacucaaacuuugauuuuuaaugguugcauaacuauggauauaccauagugauuuuuuugaaccuguuucugcucuguacauuuaaguggcuucuguuuucucugcuauuaggauaaaugcugcagcgaacucuuugucuauaaaucuuuuuuucucaguauuacuuuuccuccccaaauuuuaaggaaacuuucagacauaaaaaaaacaauguguuuuauagcgaauaccuguauacccacagccagauuccaugcugacguuucguagcguuccuuuugaucgugugguuucucuuuccagcacggggccuccauuaacgcuucuaacaauaagggcaacacagcgcugcacgaggcugugauugaaaagcacgucuucgugguagagcugcuucugcuccacggagcgucaguucaggugcugaacaagcggcagcgcacggcuguagacugugcugaacagguagguggagagggucgaagagccgagggaauccugagcuccucacagcucccucuggaucccuuuguuuaagcuggaucuaaaauagcaacaccuggcccuuggcaucgccgggcugggcguaguuggugugccagaaguccacagcguggguagauggcugguccucagucuccuggucagagguggugcucugggaaccaggaaucauucuuuucacaggugguuuucaaaggccugaguggaggggccccccccucagcuagcaguagggcugugguccgguaguuacauagagucaggcacucaggaaggagcaagucaugauguucuggugucaccauccucacagugugaacacagccguugucuuagcagcacgauggagaagguuuguuuuguugguggauuuaaaacuccuugaggccaggcacaguggcucaugccuguaaucccagcacuuugggaggccaaggaaggaggaucacuugagcgcaggagcucaugaccagccugggcaacauagugagacccccucucuacaaaaaaucaaaaaaucagccgagcauaggggugcaugccuguagucccagcuacucaggaggcugaggugggaggaucgcuugagcccaggaggucaaggcuguagugagcugagauugugccacugcacuccagccugggugacagagacuuuaucucaaaaaaaugaaaguaaaaguccuugaguccuguaggaaucgugauuauuggccuacugccuucuccagugcuguggaugcuugcguggagagcggcggggaaggguccuuuuccccuggcgagcggcagcucuuucuguuccuguuuuccugcugagucuuucuuuuguuuucuacccaagauagacagcgaguaggcuguuaagugacacaacugagaagcuaacaucaccaucaauccacuccauggacaggcuccuuagaguaauuuuuuguuucuuaagacagagucuugcucuguuguggcgugaucuuggcucacugcaaccucugccuccuggguucaagcgauucucgugccucagccuccugaguagcugggauuacaggcacguggcaccacaccuggcuaaauuuuuguauuuuuuguagagacggguuucaccauauugcucaggcuggucuugaacaccugaccuaacugauccgccucccuuggcaucccgaagugcugggauuacagacgugagccacugugccuggccuccuuauauuaauuuucagugacagaauugaaauauuuuaaacucucaguuuaguacuuucuuaaaugauuauguugaauuuuuuuugguuuuuaaaauuuuuaauuuuauuauuauuauuauuuuuugagacagagucucaauuuguugcccaggcuggaguauaauggugcaaucuuggcucacugcagccuuaaccuuugggcgcagaugauccuccaaccucagccucccaaguagcugggacuauaggcgugugccaccaugaccagcuaauuuuuuuuuaauagagacaggguuuugccauguuggccaggcuggucucgacugccugggcucaagcaauccacccgccucggccucucaaaagugcugagauuacaggcgugagccaucgcgccuggccuuuuauuauuuuuaaauagagacagggccuugcuauguugcccaggcuagucuugaacaccugggcucaagcaauccucccaccucagucucccaaaguggugggauugcacgcgugagccaccgugcccaguuaauuaauguguuucaaugaguacuuacuauaugggggcccucaacagccucaugauaagcauaugauaguagaucuuauuaugguugagcugguugcauggagugguugaauccccagcguggaguccacagagagggcagagcuuuuacccagugguaaaagcagagccgggcuccccaugcaggccugcuuuuaccacugggcuuuauggccuccaagcuccauuuguaauuauuucugagcuuuuucugcccagucacacuaauacugacauuuagaucaaaaacaaauaauaaccuauuaaaaaagaauaaaaacauuacuguuccuuuucccuuucaaauugcagaauucaaaaauaauggaauugcuucaggugguaccaagcuguguugcuucauuagaugauguggcugaaacugaccgcaaggaguaugucacuguuaagaucaggaaaaaauguaagaguuuacguucuuucugucacgcucaaguuggguauauuuagacauucaugaguaguugcugguguucauuuaauuguauauguaaaguguaauuauaaucaugccuggaggagauacaggcaccaaagaaauguauguuaccucccaauuuaucagacuauggguaagcuuuuuuuguuacuaguuuucugguugaugguaaugauguuuccugaggaaauaggauagaaacugucaacacuaccuugaagguucaggugucugccuauggagauggggaacagucucugggauaguuucuuucaugccucauguuccaaagucagguguucugggcauuuccuggacauccaggguaaaugcuaccuuucaagauuuuuuuuuuuuuuuuuuuuuugagacagagucucgcucugucacccaggcuggagugcaguagugugaucucagcucacugccagcucugccuccuggguucacgccauucuccugccucaaguagcugccucccacucucaaguagcugggacuacaggugccagccaccacgcccagcuaauuuuguuuuuguauuuuuaguagagaggggcuucaccguguuagccaggauggucuccaucuccugaccucgugaucugcccgccuuggccucccaaagugcugagauuacaggugugagccaccaagauuuuuuauuuaguuaguuuuuuugagacagagucucacucugucacccaggcuggagcgcaguggugcaaucucagcucacgcaaccucugccuccuggguucaaguuauuccccuuccucagccucccgaguagcuaggauuacaggcacgugccaccaugccuggcuaauuuuuguauuuuuaguagagacaggguuucacaauguuggccaggcuggucucaaacuccugaccucaagugauccgcccuccuuggccucccaaagugcuggaguuacaggugugagccaccgcgccuggccucaagauuuuuuuuuaaguuuguacguguacggagguugauuauaauuaaaacagcaguugccgaacagcagugagacugaaguauuuucuucuuuuuaaaaaguuuagaagggguccuuguucuacuuuuuuuuuuaauuuacaauaugaaauauuauccagugagguaugcaauaaugcaauacaauaauauggauaaacccauucacauaucucgauaacccugagacugucucaccguaauugguuguggcugggggaguuaagggaguuaagguuuuauuuuucuauuucauggggguucucauaauacaggcugacuacccccuaucucaaaugcuugggaccagcaguguuuuggguuuuggaauauuugcauuauacucauugguugaggauccaaaucaggaaaucagauucuucugagcaugaagucaaagaguucaaaaugucucggauuuuguagcuuuuuuuugagauggagucuugcucugucgcccaggcuggagugugguggugcaaucucggcucacugcaaccucugccuccuggguucaagcgagucuccugccucagccucuugaguagcugggauuauaggugcgugccaccacgccuggcuaaguuuuuguauuuuggguagagaugggguuucuccauguugcccaggcuggucuugaacuccugaccucaagugauaugcccaccucggccucccaaacugcugggauuacaggcaugagccacugcacccagccuguggcauuuuaggcuuuagauuuuuggauuggagauacucaaccuguuauaaauagguacuagcuguguuucuuuaagcaaauucagugcuucaguuucuaaauuuuguaaaucugagaauagaaagauugugucugugcuguaauuuuaaaauaaucuuuacaacuguuuuugaaguuuuuagauguuuaucuuuuuaucuacagggaacucaaaacuguaugaucuaccagaugagccuuuuacaagacaguuuuacuuuguccacucagcuggucaguuuaagugaguaugaaacucaaguugauuucugugcuuuugccccuaguuuacuccaagcugcacguaagcugcuucaauuguaauugguuauggacaaaucugcaccuacuaaugucaaaaaugcugccaccuuguggccaaccagaguguuucaugccacugucccaaauauuuauuuucguuuauuuuggguuuuaggggaaagacuucaagggagauuauggcaagagauagaagugucccuaauuuaaccgaagguucuuugcaugagguaaguuauuaaacacuggcuuuuaaucauauuuucuaaagcccggcuuugucaaaaguaauccaugguaaacacgucuccuugaucgucaucuucauuauuccgugcgccguaugaguuagcagcaguuaaaacuggaauuauuucaugggacaguguagaguacagacuucacugauuguuauaacuaaaaguacauuucugagcagaggaguggaaaguguuacaugugugggaaaccacaggucuuggugcuuauaggagaugaaacaucccacauuucacuaugguuuuaaucaccaaagaaagaaaacgacaguuuguauauagauggguaaaugaugucuccaaguaugguguacaguugcucagacaauucuuuauguggccaucuucccacuacauuuuuuuauuuauuuauuugagacagagucuugcucuguggcccaggcuggagugcaguggcacgaucucggcucacugcagucuccaccucccggguucaagcauucucccgccucagccuccugaguagcugggauuacaggcaugugccacuauuccuggcuaauuuuuuuguauuuuuaguagagacgcaguuucaccacguuggccaggcuggucuugaacuccugaccucaagugaucugcccgcuuuggccucccagugugcugggauuacaagugugagccaccgugcccggacccuacugcauuuuuaaaucacucagaagcuugauugaaaaccugugaucggagacagugauucuucucagaaccacagcuuuccuuguugcugaugagaauuuauagcauauguagcauaggcuuguuggaacaaauacacaaaaguucuaaauuguuuuagauaauuaaaaugauuuuaauuaacaugacuaauuuugauaccauauuuagucuuaugugguguugcuaggagaccugcugcuuugugggaaagccagaaucguugaaaucugccugaguuccaucaagugcuagcuuuucccuugcuagcuguaggacuuuaggcagguggcuuaacuuugcugauccuguuuccucagguguaaaacggggauaacaauaguaguacaugccuccuagagucauaaagauugugaaaacaagugaaacauuuacucugacacauguaguaugcacaugccauguuaccacgacagggaugugagaauugaaauuaugccugucaagcacugagcacauuaugugacacuaggcacuaaggggcagcugucacugucaugguuguggcuuccaguacagugaggacgucaacgguuaaaaauguacuuuuucuuuagccagggaggcaaagugucacacugagacagaauaaccugccagcucagaguggaucucaugcugcugagaaaggcaacagcgacuggccagagaggccuggacugacacagacuggcccuggacacagacggaugcugcggagacacacgguagaggaugcggucgugucccagggcccggaggcugcuggcccccucuccacuccccaagagguuagugcuucccgguccuaacaggaaugaggaguuguugaacccacugcuaggaagcaaggaugcaacaagaugaugcugagcgugaacacaucugagaacuaaaugugcuuccaugagacuggcuugagaagucuucagcaccaaguuccugaaagcuuuucuguggcaggaaagaaugcaacaaaaaaguuaaccaccaccaucucucuccucuucaaagcuaaugaauacaauugaaacagacaaaaauuccaguagcauccagauccuuaagccagaggugcaugcuucuuuuuaaguaugaggguuuguuggucacagugggagagguuucaccaccgcauucugaccuccuccucccaaaaggugcuaaaccucucugaccuguguacauucacaaaccacagcuagaauuccuccaccuaggauuaagcuggagagaaguaaguaauuuagguuucaugguacuguagaggccaggcugaaaugucauaucugaaggaagaaagcagcagcuggacaauguuucuuugcaaagcaacacucgaaccaaaagaugccucaaucccauuuugauauucauuuuagugaaaggaugcaucagaccuguuccacaucaugcacaugggaaagggugguuaucauuuuccuucuaacaaguagguacagauauucgguuacuacacgugcaccuguagcaguauuucuagaaacaucccuuuuuguugagaaccucccuugaaugucugucacacucacaccugacgggaugguuacuggauuagagaguagauuuggcacaucuuuucuuagucuuuugauucaaauucaaaacuuaacagcacaaaccaggucagaguuacuuucgguuagaauuuauugccauuuauuccuuuuuauaaauuucuauagauuauacuguuauuuuuauguuauuggccuagagcuacacguauauggguuuguccugaguccguuuucaaaugaccuugugauagggaaaugguuuuguccauguucuuggaaauacuuguguauguacagaaggaagggagggauuauuuuucuacaaaguaauuuaugauuucuaauuuucuaaugugccuuggauaugugccaaaugauggaaaagaaacaguaaacuuuaugauucuugacugug

SEQ ID NO: 191755 - RNA, 80145 nt, Homo sapiens
guugacgccccccagccccucauuuccacaaagcuccgcggcgguucugcccuccuuguacccgcggcgcgcugcggcccguggcgcggccccguucccgccuagccccgucggccuccuuccccucccggagccgcgcgugaggacggcugaggccgcaggucuguggcggcgcgccgggacgcgcgggcgagggucuaccgagagggcgggcgggcgccggcggaacccucggcuacagccccgagccccuggggccgccccuccccgccgcguggcgcagucggggggcgcggccgcggcgucggggcgucgggaggggcggagcgcgggagugucugccgggacgcgggccgggcugggcuccggaaggaccaaguuugcggagcggcuucugcucgucggccgugcggcgaggcagggccugggcugcgaccccggcggccgcucgcggucuugggagagcuggggcgcgugccugaacuucccggcugccccuguccuuggagaccuaccugauggggacgccaggugugcaggggcguggcgcguagguaagcggacccggugccugccucguccaggggaugcucacuagagcgcuaggcuuuuuuauuuuuauuuuuuagagacaggggucucgcugucucgcccaggcuggagugcaguggcguuaucacggcucacugcaaccucgaacucuugggcucaagcgauucucccaccucagccucuggaguagcugggaccacaggcaugcaccaccgagccuggcuauuuuauuguauagauagggucucgcucuguuccccaggcuggucucaaacucauggucugaagucauccuccugccucaaccucccaaagcgcugggauuacaugagccgccucgcccggcuagcgcuagucguccuuauuaauaaagaaucgcuucuggucccuuuucaguuguuuacaauggcauuccuuuugaucugauggaggaacuuuuuuucuuaguucaugggacuguugcagugccugacacauaauugguacuuaaauauguguugguuuucugccuuaacauauuagaauauaugaauuguuuaaaaaaguccucucacacuuagggaggacucuaggaugaggucacaugggggauaagcccaucuguggcuguaggacuuuguuaaacacuccucuucucccucucuguuccagauucuccauuuccagugcuugaaagcacaguacuuaaaucuggcuuccugcuuuuuuuuuuuuuuuugguaugaaugaauacaugaauuguauaauguuaguugguuuguucuguagagcaaguuacccuuaggaauuaauaaacuguggaaacaaucaugucaggcuacuagucacauuuaagaaauaauuaguaagaggcuguucauuauucagaggagugaagcaagauguucuggaggacuggaacccgcuuacucacugccaccacucccccgccucccacuugcugcugccaaaccaggcuccugcucccccccacccauuacucccaccgacgcucccugggauagcagcugcccugauuggcacacccccgcagucaucaccacugaggcguauuccugaagcugccagugugaauuguuuuauagaacacugguguuaaaauucagguaccugagacaaaacaauauuuuaauucuucaaaauccgguugucaacacauuuacuauggaguaucucccacguggccacuucugugggagguacugaagaccuacuaccgccuauggaaguagaaaauaauauacaacuguguaguuacgugacgcauugcgugguaacugcuauggcucagggagggagaagaucagccggaacuggaaugucccaagauguucuggaagaaaagcaguggcucguuuguguugcuuaccuguauuccugacuccuggcagggccugcuguagagcacaugcuucaugaauaaauaugauugaguugaauaaauauuugaauuguguuuugaguguagcuuugaaggccagcaacgauuuagauggcaagaucgagggcaggcugggcacaauggcucauucauguaauccuagcacuuugggaguccaaggcggggaggaucgcaugaggccaggaguucaguaccagccugggcaagauagggagaccccaucuuuacaaaaaauaauuagccagguguaguagcacaugccuguaguccagauacucgggaggcugagguggaucaccugagccuguggaaguagaggcuacagugagccgugauggugccgcugcacuccagccugagugacagugagacccugucuuggggggaagaaaaaaaaagggagggcaugcuaauagagggaaaauggcauaaguaaaggcauuucagcauggaugagcacgggguguguuggggagaaggcacugacguugauggccuguuuauugcuaucuaggagugauuuggagaacaaugcauguaagucugacaucaugauguccauccggcaaagaagagaaauaagagccacagaaguuucugaagacuuuccagcccaagaagaaaaugugaaguuggaaaauaaauugccaucugguaggugauuuaaacuaaagcagcaauuuggguugcuuuuauuucugcauauuaaaaugucacucuccaauaggauaaaaauuuggugggaccuaacaauugaaacuuguuguaguacccugauauucuaauugcaauuugauuagauugauuuuacaguuaugauuugacaaaagaugaaagagcuuugauuagaaguguuugucagcugucuguucauuaacuuacgguucuuccaaucucauccuuugacucucuagaguaaugguccccccacccacaccccagauuuuagucucucucuaauuuuucuggucguguauacuauuuacaccaggcaaccuuaccuugggugaguuuccauuaagguagugaaagguggaucaacauuuuuuaaaaauucuuuauaauuagucaaauuccugaaguuuucuuuugcuuuuuuuuuuuuuucuuuuauuggugggaaaaguaaucagaacuuggucaguuguuuguauaaugguaaagacuugcuaagugaugcaucagauagcauuaauuaccaacuucuugcuuccugaguagcuuuuguaacuaaagcauggucaggauuuuaaaaguuaacaugaaaaucuucauacccauuaaccauuuuggauaucugacagaauuuacauuauuuacagccauguuaauucuuaccagccaggcuaguaaagcaauucagggaaacaguuuaacaaaaguaaucuguaaugggaggucaugacaccuggcucagccauuagcgagugauuaacacguuuuggauaauaguacuuucugaacaccuuaaacaaugcaaagaaaaagaaauauacucccauccugaaacuaacaccaguggcacugucuugcugucuuaaugucauauucugcacauguauacccauaagcauucguauacaguuuugcaaaauugggauccacgugcuguuuuguagcuugcuauuuuucucuuauuauguuaugaacaugucauaagccaguuaacguauuuuugaaauaucaucuauguaaaguauuuuuauagcugccacuguagaagugaaagguuuucuuaccauuugcuaauacagacagaacugugaucaauuuccuuguggccauauguuuguuuaaaacuuuauuuccuuggggcaugucuuaguccauuucuguugcuauaaaggaauacuugaggcuaggugauuuauaaagaaaagagguuucuuugccucaggguucugcagacuguaugagaagcauggcaccagcaucugccucuagugagaccucaggaagcuuccagucguggcagaagacuuaggggagccaguguguagagaucacaugaccagaguagaagcaauuuccagggaacacaggaugucaggcucuuuuuuaaccaaccagcuccccuaggacuaacagaaugaaaacucaguacugcuagaaucucaccaaccuguuuauaagggcucugguuccaucaccacaccaccucccauuaggccccaccuccaacauugggaaucacauuucaucaugagauuuggaggggccgaauagucaaaccacagcaggguacaugccuagauugggaauuacuggccaaaugggaugcucauuuugguggcuuuuacucacugcugccauguugcauuccagagaggcaccaauuuauucuucuagcagcaauguuugaagaugucuauuuuuuauacccuuaccaaaacaguauuagcauuuugaaagcugucaaauuggccaagauuuaaguauaacucacaguuuugauuugcauuucuuuaacauuaaugaauuuaaacaucuucagucuguuauuauuauuggccacuuuuuucuauuguacauugccuguucauguccuuaaucuuuuuccuacugcaguauucaucuugacaggacaauaaauuguccugaaauaaaauaaauuguccugaaaguauucaucuuauguuaaggguauuuaagcuuucuuauaugugcuauccauauuuugccuaguuuauauguccuuuaacuugaguuauguuggauuauuuauucuguggguuuuuccccccagagcauuccugcaaaaccuguggguuuaaaaaaaaaguuuuagguaaucggccaggugcaguggcucaugcccguaaucccagcacuuuaggaucccagcuugggugggugaaucacuugaggucaggaguucaagaccagccuggccaacauggugaaacccuguaucuacuaaaaauacaaaaauuagccaggcaugguggcaugugccuguagucccagcuacucaggaggcugaggugggagaauugcuugaaccuaggaggcagagguugcagugaaccgagauugcacuacugcauuccaucuugggcaacagaacaagauccugucucaaaaaacaauaauuauuuuuuagguaaucaaguuuuuaaaauagcuuuuaaagaauaagccaccaauuguaccuagauuaucuaaaagaucgauuacguccuagacacguaacacauuuagucauccauuuaacagacuucauaguuaaauuacgguuguuaaacugugccggacagaggcccucaguauuaaacaugaauaagauaauguauuugucuucaagaagcucacguuguaguuggcagaauggacacauggacaguuagauacgggguaacaguuguaauagaaugaaaacaggucuguggaaucagaaaggacccuccgcuggagacaggaaaagcuuucccagugacaggcagcuagacuuagcuuacuugauaaucugaaguagaacuauuacauucugauuuuuuuacugacuuaguuauuuaucuguuccauuuuuccaaaagguuguaccaguagaagauuauggaagauuuugucauugacaauugguggaaccauugcccuuugcauuggacuucuuacaucugucuaccuugccacguuacaugaaaaugauuuaugguuuucuaauauuaagguauggaguuucuuugaccauuguaucauucacucagugggaucuccaguaguaagccauguggaugaaugaccaaggcaacacaguuuugccauaaagaauccaaucucuagaaagguuggacuauagagugaaauaacuuuuguguuuauuauuuuaaaauaacauauuagaaucuuuuuuuaaauuuuucuuuauuauuuauuuauuuuugagauggagucucacucugucacccaggcuggagugcgguggcgcaaucuuggcucacuacaaccucugccucgcagguucaggugauucuucuggcuuagccucccaaguagcugggacuauaggugcgugccaccacacccagcuaauuuuuguauuuuuacuagagacgggguuucagcauauugaccaggcugaucucgaacuccugaccuugugaucugccugucucagccucccaaagugcugggauuacaggcgugagccacugcguccagccagaaucuuuauuuuucauuuuaauuuuuugagauaggguauugcucugucacccaggcuagaaugcaguggugcaaacaugggucacugcagccucaaccuccugggcucaagugaguauccugccuaagcuuccugugucacugggaccccaggcaugcaccaccucaccaagcuaaauuugauuuuuuuguagagacagggucucacuuuguugcccaugcuggucucgaacuccugggcucaagcgauccuacugcccuggucuuccaaaauaugagaaugagccauagcacccagcccagaauuuuuauaaucaagugaguuuuuucuuuuucauuaacuuauuccauuuauuuagcaguuauucuaaauuaguauuuuucaaguuauagauugugaaauuagugcaguaggucaugaguaacauuuuucuuaaugaaaucaaaaagaaagaauacuaucacaucuaguaggguugaggauuguuuugugaaacuuuuaauuuuauauauauauauauaugcacaaacugggucacaguauacaagguacuuccuuuucuuuuuuuucuuguuggcuacaacaggaaaaaaaaaaaacagaaaaggaaauaaaaaagccacugcuuuaaaucauggggucuaaauguggcuccacagaggguccucagcauguucaugacuaucuaauacucugugcaagugguuuugcagggcauagggcgauggggaagccauauguuuccagggaaaggaacuguaauuuuaaucagauuuucaggaggguuagccgggcgucacgccuguaaucccagcacuuugggaggucgaggcgggcagaucacuugaagucaggaguucaagaccagccuggccaacaugguggaacccuaucucuacuaaaaauacaaaaauuagccgggcauggugacacacaccuguaaucucagcuacucaggaggcugaggcacaagaaucacuugaacucgggaggaagagguugcagugagcugagaucccaccacugcacuccagccugggcaacagagcaauacucuuuaucaaaaaaaaaaagaaaaaaguugaggggguggucugugacucuuuaaacacguuuccuuguuuucuuucucucucucuuuuucaacauuucuagaacuccucuuggcauuguuuucagaacucguauauaacuuacauguggaaauuugcauccaaauauaccuuacauuuuaaucuaauaugucaugaucuuuaaccuaaacuguggugucuaaugacuaguugcuuguaaaaauaaacaaacaccuucaaagccaaagauguguaucuauaagaauguucgaaagaagugacugaugaaggaucugaagacauuuuccaaagaaaguuuuccaaaacauuuugagcuuugauucucuuacugaaaugagccucgaaaggauauuacuuugaugacaaaucuaauuuauaagaaugaccucuaguguguuuauuuuuaaaacuugcuguguuacuuuauggguacaguauauauaucuuuauacaaauuaucauaguaccaaagaagaauaauucuuuuuuuuuuuaauuauuauuauacuuuaaguuuuaggguacaugugcacaaugugcagguuaguuacauauguauacaugugccaugcuggugcgcugcacccacuaacucgucaucuagcauuagguauaucucccuaugcuaucccucccccuccccccaccccacaacaguccccagagugugauguuccccucaaagaagaauaauacuuaucuuucagugacaguagguaguucuucuugucagaagaauuuuacucguuuauauaucuuuuuuugggaggagcgggggcgggcagggucuuucucuguccccaggcuggagugcaauggcacaauuacagcucgcugcagcccccaaacucugggcugaauugaagcauuacucucaccuuagccucccgaguagcugggaccacaggugcacgucacuguucccagcuaauuauuuaauuuuuuguagagaugggccuacuauguugcccaggcuguucucaaacuccuggacucaagcaauccuccugcguuggccucccaaaauauugggauuauaggugugagccgcuaugcccaccuaucucuuuaaaauggagugcuggcagggcgugguggaucacuugaggucaggaguuugagaccagccuggccaacauggugaaaccccgucucuacuaaagauacaaaagaagagggccgggcgcaguggcucacaccuuuaaugcccgcacuuugggaggccguggcgggcggaucacgagguuaggaaauugagaccauccuggcuaacacggugaaaucccgucuguacuaaaaauacaaaaaaauuacccgggcaugguggcgggcaccuguagucccagcuacucgggaggcugaggcaagagaauggcgugaaccugggaggcggagcuugcagugagccgugaucgcaccacugcacuccagccugggugacagacucugucuccaaaaaaaaaaaacaaacaaacaaaagaaauuagccaggcaugguggcacaugccuguauuuccagcuacucaggaggcugaggcaggagaauugcuugaacucaggaggcagagguugcagugagcugagaucaugccacugcacuccagccugggugacaaagugagauuucaucucaaaaaaaaaaaaagaaagcuuguaaagcgauucccuagaauuaaaccauguagugcguauauauuaacauaaguauuuugaaaaaaggcugaaauaucucugugugagcagauagcccaaauugaaugcuaacaaccguauagcaaggagacauguugaaagagaucauauaacuuaauuauaaacuauuaaguguagcucuuuaauuuaaaacuuguaaccagccuuccuacuuuccuuaaauaaauacaccccaucaucaagaaacuugaacacccuugguuuuucucucuuuacuuucacuggguuaaggaaguucuaguuuuaccuaguauuuacugagcaccuguucuguggguaacauugaguucaacacugcagagaacauggaaggaauaacaaagauuucugaauuuaccagcagauuuuccaguauaguaagugaauugaguaaauauauauuaagcaccuacaguaugccagcaggcacugugcuuagugguagcaguaucacugaguaagauaaggccaugcccccaaggaacuuacacucuugagaaggauacaggucaguauccagacaauuacaggacaucccaacucggugcuaggauggggugagauagagagcacugugggagcacauaggaguggaagccuaaccucauuuuggaagaucagggaggcuuuucuagaggaaaugaugguuaaguagaccugaaggaugaguaagaguuaaccaggcaaguuggggaggaaagaugaguguccuagaagagggacaagugcaggaaauucaagacgcaagagagccuggugugugaagcguuggcaguaguucagccuggcuagagaguacaaggggagaggggauguacugggaaugguaaacagaggccagauaauaaagggucugucuucucugucucaaagauagaacucucucugaauguauuauaguagugaacccuauuuuuaguagaggcagcgaugucaucguauuggcguuucagaaaguugccuuaggcugugauguggaaaauggauuuggggagagcaaaacuaaagucaggaaacugcuaagauaauccaauucaguggauucaguaauauuuaaauauugcauucaaauauucagugaguaucuucuguaugccagacacuuuucuaggcccugggaauaaagcauugaauacgacauagaacuuaauuaugaugaaaaggggaaaaaucagaaagaaaaugaaaaugaauccuacggugaaagucacacgggaugaugagauagucacuagaaggcuacuuggaauugggaaguaaagccgaccacuuugaggacauguaaaccaaaaccuacaugauauuauagaaggaaccagccaagcuaagaucugcgagaacauucuaggcagaggaaacagcaagccaaaagucucuaagguaggaaugaacuuggcaaauccaggaucagagagaaggugcauguggccagaguuuuaugagugaugaggagaagguagaagagaggagaagaacagaucacuuagggcuuugaggcugcauaagaguugcagagucgugaacagagucagagcuuuuuaggaaguggacuuggaaggaugucuugauucauuguguggaagucuguugagagagaacaguugagaggcugucaguccaagcugcuugcucuccuuagcagcgggguggauggauggacaugccauuuucugugacaacgagcaccgggaggagcagagcuggaggaucaguaaguucugacaccagcuauccaccguuaggccaaaccccacaggaugagggcacagcucucuacaaaaaugccuucguuucacacaccaguggcacguuuggggcccccccaggcaacccucacuucugaccagcuggcuacaaauucugagguucccaccacccacucagguucaauaauucacuagaacaacugacagaauucagggaagugcuauauuaugacuacagauuuauuauagcaaaagauuacaaaucagaacgagccaaagggagugacacaugcagccaagucuucgagggucccauuggaagcuuucauuaucuuuuccccauggagucaggccuguuacccuccuggcacaucacuguguuacacuauguggagccaaccaaagaagcucuucugaguacuggugucuaguuuuuauugagguuucguuauguaggcaugauugauuggauuauugcccacaaggcuggacucaaucuccagcccuuuucugcuccuuagaaguugggcugcuagcacauggcucaaagcccugacucucaggccacaugguugaguguucuggcuuggccagccccaauccugagucaucuccuuagcacaaauuaggagcucacccugucaccugcuagcccaggcuuucagaugaggucugaagaaccuaccaugaauaacaaagacacucucaucacuuagaaguuccaaggauuuagaggcuaucucccaggaacuggggacaaagagcagccagauucuuuauucuuagaggguagaguuuugauaugguuuggcuguguccccacccaaaucucaucuuuaauuguaguucccauaauucccacauguugugggagggacccagugggagguaauugaaucaugggggcgggccuuuccugugcuguucucaugauagugucacgagaucugauggcuuuauuuauuuuaauuuuuuucugagacggagucucgcucugucguccagacuggagugcaguggcacgaucucagcucacugcagccuccgccuccugaguucaagcaauucuccugccucagccaccugaguagcugagcuuaacaggugcgugccaccacgccuggcuaauuuuuguauuuuuaguagagaugggauuucaccauguuggucaggcugaucuugaacuccugaccuugugaucugcccaccuuggccucccaaagugcuggaauuacaggugugagcuaccacgccuggccagaucugaugguuuuauagaggggaguuccccgucacacacugucugccugccgccauguaagacuuaacuuugcuccucauucacuuucugccaugauugugagaccucuccacccuuguggaacugugacuccauuaaaccucuuuccuuuauaaauuacccagucuuggguaugucuuuauuagaagcaugaggaauggacuaauacaagguuaccuccccguaaccagggacagaggucagccaaauucuuucuugcacaggaggaaaggcagggaacaaugagcucagguuugacuauguugugaggcacuuuuaaagcaguccaccuagaaauacagaauaaaggaagcuagacuuacggggcugaaggcaggaguuccgucuguguuggaaaugggcauuuucaucuuaccaucuuguagaugugugggugagauuguuucaggagcguguaaaaugagaaaggaaagagaaccugggccaguuugugucugugccucagauaccaucugggaagcuauaaaacaggcgcuuuuccccacccaccacccuuguccucugaaacuuacaauugagcucagagucguauccauuuuuuuccucuuuguucaagcaguaguccauagcacacauuuuggguugucuccuauaucacaagaagaauccuccaauguuagaaccauuucucaaaccuguuaauaccucugccuaggcauuugguuuuguguuuugcuuagauucgcuagaucagcauuguccaauaggacuauaaugaaggaaauguucaguguaugcacugucuaguacaguggccacauguggcuauugaacacuugaaaugggguaguacacucgggaacuaaauuuuuuuuuaauuaaucugauuuaauuuuuaaauauguacauauuuucuguaaauaaacaauuagaaauuauaaauaucacugaacaaagaccuuauuuggccaaagaaaagcucauuuuuggaguguauauuccuuuauaaaucuccuguaauuuauaccauuucuauauuggggaauuauuugagaagaguaaaucugcuuuccuuuccuguuuugggguuauaacuuuuucucaucaaaauugguagguuaguguuuaaugaaaauacuuugauuuuauuuuugaauacuuugaaguaguuguaauuauucagagaguaaaaguauugguuauguaauagacaagucauacacugaauuuaugcauucaaaaugauuuuuuaaauguuuguuguauuguuuguauaugaaaagugggaacccugaaauagcaacuggaaaguugaaggaaaagauacugguuucauauaguaguauaaaagauauaucuaguauccuuucucagcauauuuuuaaaauuuuaaguuauuuuucuauugucuucauuguauuauauuucccuugcuaggaaauugaaaguauucaagauuuuuuaaaauacccuuuauugaaugucuguuacaugcuuggaacuauuugggggcauuuuaauacauauuguauuuauuuguaccuuuuuuuuuuuuuuugagacagagucucgcugugucgcccaggcuggagugcaguggcgcgaucucggcucccugcaagcuccaccucccggguucgcgccauucuccugccucagccuccugaguagcugggacuacaggugcccgcugccacgccuggcuaauuuuuuguauuuuuuaguagagacggaguuucacaguguuagccaggauggucugggucuccugaccucgugauccacccgccucggccucccaaagugcagggauuacaggcaugagccaccgugcccggccuauuuguaccuauuuuuugagacagguucucacucuuucacucaggcuggagugcaguggugcaaucaaggucacugcaaccuugaacuccugggcucaagcaguccaccaaccucagccucccaaguggugccagcuaauuuuuucauuuuuuguagagacagagucucacuuuguuguacaggcuguucuugaacucuuggccucaagcaagccucccaccugggccucccaaaguucugggauuauagacaugagccacaaugccugaccuacauauucuguuuaagcugccuaucuucagagcccaaacacuaacucuaaauuguccuuucaaugcaaccuacuuuuuuacugcccuuuauuguaaacaaaaaguaaaaggcacucccccauuuuuuuuuuuuuuuuuuuuuugagacggagccuugcugugucacccaggcuggagugcagaggcacaauuuuggcucacugcaaccuccgcaucccagauucacacgguucuccugccucagccucccgaguaacugggauuacaggcaggcaccaccacgcccggcuaauuuuuguauuuuuaguggagacgggguuucaccaucuuggccaggauggucucgaucucuugaccucaugauccgcccgccucagccucccaaagugcugggauuacaggcaugaaccaccacacccagcuaguaaaagccuguuuucuuacuugguguucugcccuuauggugccuggcacgucaucagugcuaaguagcuuccagucuucugcaauagagucaacugcuggggcugagggguaugggguaggcagaggaaaaggggaggcacuggcugcugugaagaaucuggaugggaacuagaaccaaaggacaugacuuccggagcuugccuucaaggauacgauaugguuagucauggcagguacaggagccaguggaugcauuuuaagugauuuuuguuuaguaguuuuguuuuuuuuuguuguuguuguugagauggagucucacugucgcccaggcugggguacaguaguguagucuuggcucacugcaaccuuugccucccgaguucaagcgauucuccugccucagccuccugaguagaguagcugggauuauaggugcgcaccaccgugcccagcuaacuuuuguauuuuuaguagagacgagguuuugccauguuggucaggcuguucucaaacuccugaccucagguguuccgcccaucucugccucccaaagugcugggauuacaagcaugagccaccgcggccugccauguguuuaauaaauuguauaguagacaucuguauagucuucauuuuuaguuuuugaguguguauuguuuuuuaauuauugaaacuauguuguaacaaugaugaaaaauuuuaaaugaaaaacauuacuuaauauucauuacccuuaacaaaaagcaguuuucauuuuucccuuccauucuucauccuaagugccuaaauauuuuacuuauuuaugaccccauuauaguuaguuuuuauaaucuaccuuaucugcuguuacauacuaugcuuuuuccauauauacauuuucacaaaacuuuuauaauuauguaaguaguuaugguuuuauaauuucauauuuuugaaguuuuuauucucuugauuauuccacuauuuccaugcucccaacuuuggauaguuagauuguuuauaauaguacaguuaaauccuaacagugcuuacuuauucucacuuuaaaguggcaauguagugguaucaguuccuucuuucuuggaauucccucagagcaauuaaggaaugugaaaaauagauaaucaaguuccagcuuugaugaagggggcugccaaauccaguggcacucagaaagaugcugagagaagagucugcggccaggcaagguggcucacgccuguaaucccagcacuuugggaggccgaggugggcacaucacuugaguccaggaguucaagaccagccuggccaacauggcaaaacccugucucuacuaaaaauacaaaaauuagccaggugugguggucuacuccuguaaucccagcugaagcaggagaaucgcuugaaccugggaggaggagguugcagugagucgagauugcaccacugcacuccagccugggugacaaagcgagacuucaucucaaaaaaaaaaaaaaaaaaagagagaggagucuguaagcugcaggggucagauaaagugaguaaagugucguccuccaaaguuaguggcaucuccuaagggguaaaaccaacagcacccugaguaggaccaugggaugggugugcaggcaguaguggcagccgcuaucuuggauccacucugcuaugaagaacagcaugcuaggcaggccagaaggagcgaucacagagacaagccauauuuguuaagagauggaauuuaagaggacaggaaugaagggaggcaaccugcauuucgaagauccccaaagcuaucaaguucuguugacuaaaaugaggaaaagacugaagaacucacccuuguaaaccacccuauacaaugaaaauucuugcugaccugagcugugugccuggccucacccccacaugaacuuccugcaaguagcuuguguaguaagaacuugccacauucugacauaacugauaaggaaggaacugggacaagauuguccggugauacugcaacaaaaaagggaagagaacaacaagcagacaucauuggugaagaacagucaccagaauaauuuuacaguggagauguggagguuguaaccacacgugucacauuaaaagauaauccuuugccacuguggaagaugaauacaaagcagaaacauaagaagguaugugccuucuucaaggggaaacaggaagagaacaaaaggaagugaaauaugaacuggcagacuuuagacaagaaauagaauuacaaaguagaaucauuauagaaauuaugaccgucucagaugcaacauacaggagacuggaauccguagaauguacagaaagagcaauguuggacaggacugagagaggucaacaaaaugaaaggagauugaauaaagugacaguaugagaaagcaagugacaauugaggacaaagagcagcaagcaugcaucauuugugucccaaaaaaagagaacgagaacaauaaaucaggaaaaacacacacacacacacacacacacacacacacguuuaaagauguaauucaaggaaacuuuccaaaaguaaaaggaaauuugaaucuacuaauugaaggggcagagcaguuuccaggauaaauuggccuagaaaaaucauuagcaggauagaguucucugaaguugcugaacuuaaauauguaaagaaaccuuuggacauucuagacgaaaagaucaaguuaccaauaaggagaaacaaaagucaaccuagcauucaguuucuccacaguaaugucuaauggucaaagaccaugaaugaugccuagaaaaugcucaaguaaaagaaagugauuuacacauuuuaacccagucauuccauugcauauaaagauggcauacaaacuuuuuuguuccuagaaauauguacuuuuaagaauaccugaagaaauuggaagaggaaaaacuucauccauccaugagauacauggaaaaacaaugacagaaagaugcucaguggggcucaaauuuauuuaacuauaggacuaaaacuaaaaauuagugauagaacaaaauguguaugauauaaauaauguuauauuagguacaaaaguaauguaggucuugucauuaauuuuauuuauuuauuuaugaaacagagcucgcucugucgccuaggcuggaaugaaguggcgugaucuuggcucacugcaaccuccgccuucuggguucaagcaguugugccucagccuccccaguacuugggauuauaggcaugcaccaccaugcccagcuaauuuuuuuuuuuuuuuuuugguauuuuuaguagagacaggguuuugccaugucaggcuguucgagacaugccaggcuggucucgaacuccugagcucaggcaguccauccacuucugccucccaaaguuaggauuacaggugugagccaccaugccuggccgccauuacuuuuaaauggcaaaaaccacaauuacuuuugcaccagucuaauacacaagaaugccaacauaaguaauaauguuauaaugcauaauaauaacauaacaguguaauacguauaacacaagauaaaagaagaaggggaagagaggguaaaagaugguggaggcugacugggcacaguggcucaugccugucaucccagcauuuugggaggccaaggcggcaggaucgcuugagcucaguaguucaagacaagccugggcaacauggugaaaccccaucucuaaaaacaaaaacaauuugccaggcaugguggcaugugccuauagucccaccuacucgggagacugagguaggaggaucacuugagcucaggacacagaaguuaucauuagcuaagauugugccauuggccuccagccugggugacagaaugagaccaucucgaaaaaaaaaagguuggggaggccagcuggcacaguggcucacagcugucgucucagcacucuggagggcaaaaggugggaggauugcuugagcccagaaguucaagaccagccugggcaacauagugagaucccaucucuacaaaaaauuuuuaaaaaauuagcugggugugguagugugcaccugcagccccaguuacuugggaagcugaggcaggagggucaccugagcuggggaggucaaggcugcagugagcugugaucacaccacugcacuccggucugggcaacagagugagacccugucucuaaaaaaaaaaaagaaauaaauaaaaaaaaauggaugggaguauccugauuucuuucucuuuuauaacuggaagucagaaaguuugauuuaaaacugauaagacacacaagccugggcaacauggugaaaacuugucucuacuaaaaauacaaaaaaaaaaauuagccaggcuugguggcacacagcuuacacccagcugcuugagagggugcaaugggaugaucaccugagcucaggaagccaagucuucagugagccaagaucaugccguugugcuccagccugggcaacagagcaagaaccugucucaaaaacaaaaaaaggucucuguagaucuucaaguugaccuacagagucaacaugaucccucucagaaucccagguggacuuuucacagaaauugacaagcuaguccuaaaauguauauggaaacucaagggacucagaauagcuaaaacaguuuugaaaaagaagaacaaaguuguaagacucaaacuuucugacuucaaaacuuacuauacagccacaguaaucaagacucugaugcuggcauaaggauagacauauaaaucaauggaauaaaauugggaauacagacauaaauccuuagauggucaagugauuuucagcagggcaccaggaaggacaguuacguggagaaagaauagucuucaauaaauggucuauaaacaaauggauauucacaugcaaaagaaugaaauuagaccacugccucacaccauacacaaaaauuaacucaagauggaucauaggccuaaaugucuaaaacuauaaaacauuuagaagaaaauaugcaaaugaaucuuuuauaacuguggaguaggccaaaacuucauagagaccacacuaaaaacacaugauuaaaaauaaauaaauaaauugguguucaucaaaauuagacauuuuuguacuccaaaguacaccaucagaccaggugcuguggcucaugccuguaaucucagcaguuuggaggccaaggcaggcagaucacuugaggucaggaguucaagaccagccgggccaaaauaguaaaacccuguaucuauuaaaaauacaaaaauuagccaggcgugauggcacacaucuguagucccagcuacuagggaggcugagacagaaggaucacuugaacccgggaggcagagguugcagugagcugagauggcgccacugugcuccaucguggguaacagagcgagacucugucucaaaaaaaaaaaagaaaaaaauuaagacucaaaagucaaaauuauuccuugauccaugggcuguagaauagauuuuguguuagcaggcaugaaaauaacacagauaaccagaugcauuaucaaugagcaguaguauuuugaaaagaauuuuuuuuuucuguguaguagaucucaacagugggccuaaaauaguaaaucgugcugucaacacaugggcugucauccagguuuuguuguccaucuuuagugcacaagcagaguagauuucacaucauucuuaauaaggacccuaggauuuucagaaugguaagugaacauuggcuucaacuuaaagccaccagcuguauuagccccuaacgagagucagccuaugcucugaagcuuugaagucaggcauugacuucuccugagcuguaaaaguccgagauggcaucuucuuccaauagaaggcuguuucaucuacauugaguaucuguuguuuaauguaggcaccuucaucagggaucuuagcuggaucuucuggaugacuugcugcagcuuuuccaucagcacuuucagcuucaccuugcacuuguauguuagggagauggcuacuuccccucaaccucaugaaccaaccucugcuagcuuccagcuuuucuucugcagcuuccucaccucucuagccuucacagaauugaagagagggccuugcucuggauuaggcguuggcuuaagagaauguuuuagaugauuugauuuuccaucagagcauuagacuuuccccguaucagcaaugaggcuguuuuucauucuuaucauuggugcguucacuggaguagcacuuuuaauuuccuuccguaacuuuuccuuuguguuaacaacuuggcucuuuggcacaggaggccuaguuuuuggucucucucaacuuucgacaugcuuuccucacuaacuuaucaucucuagcuuuccauuuaaagugagagaugugccacacuuccuuucgacgcuuagaggcuauuguaaaguuauuaauuccgauauuauugugucucagggagcagagaggccuggggagaggaaaugagacagaagaaugacagagcugucagaacacacacauuucaguucaccgucuuacaugggugugguuuauugugccccaaaacaguuacaguaguauuaauaacaucaaagaucacugaucccagaucccgugacagguauaauaauaaagaaaaaugugaaauauuggaagaauuacuaaaaugugacagagacaaaaagugagcaauagcuguugcagaaaugguguugauaguuguuugaugcauaguugccacuaaguuucaauuuguaaaaaugcauuaucugcaaagggcgggaaagugaggcacagugagaugaggcgugccugaagucguuucccuuuguuuacaauguguucuuucuuugguguuucguuguuuguuuguuuguuuuugaggcaggaucuugcucugucucccagucuggagugcagaggugcgaucucggcucacuguagccucgacuuccugagcucaggugauucucccacugcaaccccucaaguagcuggaacuacaggggcauaccaccaugcccagcuaauuuuuuauauuuuuaguacagccugggucuugccauguugccuaggcuggucuuaaaguccugggcuuaaguaauccaccuaccucggccuucuaaagugcugggguuauaagcgugagccaccgcacccccgcauucuucuuucuuguuggaacauaaacaucuuucggucaaauacuaaauucuugcaccuuuuuguuuccccagcaaauaaauaugcaaugauaaggaaggcaguucuccuuuggcuauaagcaccaacaucacucuuucuuuuuagucuuuuuuccuugugcuaacauuuuccacuguuauucuuauuuacuugauauugccgaauuugcaugucuucccauugaauacuccugcaaagcaaggagacuuuagaauagauagggguaauccacacaauaguaguacgguagugcuaagacugcugauugccugagugugggcccaguggaagaacugucacuucaguagcagacugcccuccucacaagcccugcuuggcacuucucacaugccacggcuuuaaucaacucuggggcaagaaucauuccccucuaacagauggacaugaauuuaaccagacaauaaaccauguaugugccauaaauauguuugcugagggcaugauucccaguacagaacuuuaagaacagcugucuuaugggcuacuauuucuuggugagaugauuuguuaaccuaauucugaaacagauuacauuuauaaaguuaauuuuucgguggcuuccccacuacuagcagucuaauuauuuugggggacaauuuuuguaaacaaaucuuuuuuuuuuuuuuuuuuuuugagacagaguuucacuccaucacccaggcuggagugcagugccgggaucucagcugacugcaacuuccaccucccggauucaagcaauucucaugccucagccucccaaguagcuggaauuacagacaugcaccacaaugcccagcuaauuuuuguauuuuuaguaaagacgggguuucgccauguuggccaggcucgucucaaacuccugaccucaggugaucugcccaccucggcuucccaaaguguugggguuacaggugugagccaccgcgccuggccuguaaacagaacuuuuuuacgugaguuguucuuguuuuuuuaaacaugaguuguuuuguuuuuuuuaaaaaaaagcaagaggagaaagacuucaggaccauugcgauagauguagggaccacugcaaugaggucuugcagugguggagagagauuguacucaacuucuaguacaucaugggugaguaggaauaggcagccaaggagcggauuggggucaguggcugggaaaugaguaagaggaaccacugggaugcgggggauccuggcucaaccaggcuuagaggguucuugcuaaaggcaggccagagugaccagacauuaugugggggaucuauuuacgugagauuuuuaaaaagcuaauuugauguuuccuuuccaaauuuggugucauuugucucaaaggacucuagccuuuugggcauugccagcaacuugucugagugccuguggggaaugugaucauuuauugugagcagucauuuuuuguguguguguacaucuauuaaauugcuauauacacuguuacuucaaugguuuuagcuguacaguuuuuuuuuuguuuuuuuucuuguuguuguuguuuguuuguuuugagacggagucucacucugucucccaggcuggagugcaguggugcgaucucagcucacugcaaccucugcccuccgaguucaagugauucuccugccucagccuccugaguagcugggauuacaggcgccugccaccgcgcuuggcuaauuuuuuguauuuuuaguagagacgggguuucaccaucuuggccaggcuggucgugaacuccugaccucaggauccacccgccucagccucccaaagugcugggauuacaggcgugagccaccacacccggccagcuguacaguucuuuauaaauacaagucuuuugucuuuccacuucuuucugucauuaucuucgaagauguuuucguucugucaacauugcauuccccauggaaccugugcaaauugaauaugaaguauuuguucguuuugcauucuuuagaggauaacuacuauugguguauauuuucacgggugugaucuaccaagcgaaguauaaauugcuguaaaacuggaaaaguguuugaaugagugaagcagauguucucuuagcaugaagcagauguaaaacuugcaagugucugucuaauaaaguauagcauuugguucuguacagcuggugcuagauuaccaauuaaucauguuugaaugcauuuuuacuaauuaggucccccucuguucuuugugcauucuggcuauaauaaagggagagaugggacacaaaagcuuucuaccuuuaguacuuugagcaguguuuuuucuuauucccuggucuuuuauucuuagaaccauauaauucacucuuucauucuuuauuggcucuccaguuugauuugggauguaggugugacaggauuuucacacuccucaagugccuuugaacacuuuaaggaagcuagagaaaagaaaaauaauguaauuaauguuguuguuguuguucuuaauuugcauggacaaaagcuaguauuugcucaguuaacaucaauucauagccucugugguuauuugaaugaguaggaguuuggacauucuagaaacgagugauaccagguugguuuuaaguucucaaaagcaauagagcacguuuucucaaagauaaaaaaugaguggauuaaaguaacuacccagaagaguugccuuuacugcuaugaaagauacaacacaaaucacuagcaaugaaaguuuaaaaagcuguaucauuauguaguagccuuuuuauaacgcaaguguguuauugaaauuaaauuuuaggcccaggcacuguggcuucugucuguaaucccagcacuuugggaggccacggcaggaggaucacuuaagcucaggaguucaagaccagccugggcaacauggcaaaacccuaccucuacaaaaaauacagaaauuagguggacauaguggcaugugccuguaaucccagcuacuuggaagccgagaggaucacuugacccugacacgcaaaggcuacgaugagccgugaucaugccaccguacucagccugggugacagagugagacccugucuccaaaaaaaaauaaauaaauuucagaaccugaugggccuuuuuuuaaaugcuugauuuccccaggauaaauugguuuucugugaaaggaaguucaauauauaagauuugcuacccuaccucccauuuuucuaaaaggaauuaacaaacaaugauaaaaagauuuagaggguagcagaaauauauuaaauaaauaauuucuaagucugaagauaauagcaugaaugguucuuucuuauuuauuuauuuauuuauuuuuugaggcagggucucgcucuaucauccaggcuggaguggcuugaucauggcucacagcagccucagccucccaguaggcugagucucaaucgaucccccuuccucaaccuccccaguugcugggaguucaggugcaugccacuaugccuggcuacuuuuuuuuuuuuuuuuuguagagacaggguuuugccauguugcccaggcuggucuugaacuccugagcucaagcaauccacccacuucagccucccaaagugcauggcuauaggcaugagccaccgcacccagccugagugguucuuuuaaugagauguuuauuaccauuugaaaauuaguuggaguuagggggaagcaaaaugagcuaaaagaaguucaucagcuagaaaaugagauguucaguauuuaucacuuucccccauuggguuuguggaaugugaaucugcuauaauaugaaaaagcauggccgggugcaguggcucacgccuguaaucccagcacuuugggaggccgaggcagauggaucaccugaggucgggaguucaagaccagccuuaccaacauggagaaaccccaucucuacuaaaaauaccaaauuagccgggcauggugcacaugccuguaaucccagcuacuagggaggcugaggcaggacaaucgcuugaaccuggaaguuggagguugcagugagccgagaucgcaccauugcacuccagccugggcaacgagugaaacuccgucucaaaaaaaaaaaacagaucgaauuauauuuuagacaguguguuacagauuuuaggacaugguuuguuuuguuuuguuuuuaacacugguguaaaagaaucucuaauaacauagauuauaacuuuuuauuuauuuauacuuuuacagguacagguuaaguaucccucaucugaaauacuuggggccagaagugucuuggauuucagauuuuggauuauuugcauauauauaaugagaaaucuuggggauaggauucagguguaaagaugaaauucauuuauguuuuauguauaccuuaugcacauagccugaaggugauuuuauacaauauaguucauaaaacaaaguuuguagacacugaaccaucagaaaacaaaggugucacuaucucaaccaucccaguggacagucuaugguuauuuggcaucaccauuguuccugacucugaauuuacauggugccuuuauaaguaaucauuuuguuauacuuauucguacauaaguacuuaacaauaaaaaauaugacauaccaucaauacggugaaaaaaauaacacuuucaggguaacuugugucaucguguuggcucucagaagguauccaauuuuaaaguauuucauuuggauuucagcuuuucagguuagggcugcucaaccuauaaauaaaguguaucaucuaacaguauuaauuggauuauuccagaaagucuuccgugucauuguugcccauugcuucuguuuuauaguaauaauuuaaauuuaauaaaaguaucuuguaacuaaauuggcuaauagcuauuuaaguuuucaguucuucuaggguugaauacuuaucuaaaagcaguuuaaauauuucauguauccauuuaccugcauaaaccucuucccaccaggguuacgcuugucagaguaaaauucaugugucugccuuauuugacuacaaauaccuuuuauucuuagaauaaaaugaaaaugauugaucuuauguaauauugguagcuuuuagguaggugucuaaugcaauuauauuucuuuucauuuuuuuuugugccaucccuguuuugugucucacugcuauuacauaggaauggugauguauucuuuaaaauuuuuuuuaagauuaaacauucacuaaaguagagaauaguaggacagacucccauguaucccucacucagcuuuaacagugaucagccuuccauucuuguuugccaagauuuuuugagacuauauuuucagaguuuuuucucuuucaaguugcaguuauguauccuuucuacaguaacaauauguauuuaaacaaaacuaggucacauaaacccauaggaucuaacucuguuuuaggaaguggagcgagaaaucucauucagaacagaguguggccuguauuacuccuacuacaagcagaugcugcaggcuccaacccucgugcaagguaauuacaacugauaguuucauuuggggucuccugcauuuuuuucaauauuuuagugagaaguacugugcacuaaaaaccacuuaaaugcucucuagaacauguguauuuuuccgugcuaaugucuaaucauuucaugaaaauguuuuuugcucuggaagaaguuauguaauacuuuauauaacccuccucucuuugccuuccagcucuguuccaucccaaaaguaauaucuuugcaauuucaugguuuuguugcugaauuuucucaugaucauuuuggaggaggucuuugcaggugaaaggaguauugucugagaacaggaggcauuuugguaacacaaaugaaaauuacaguugugccucuuguccccagugcuccauucauuccuuuauuucacaguugccauuuuccugcauuuuuacuuccccuaaguggguuagaccccacacucugccuuuacuccaucuaaugaaagccccaacauggaucucuucuaccuaguacauacuugaucggcuuagcaugagugcaugugacagaaaacugcucuuuuauaggcuuuauuuggagucagcuuugacauuuuugguggcaguuauucauaaauuauuuuuuugcuguuguuuuugagacagggucucacucugucguccaggcuggagugcagugauaugaucauagcucgcuguagucucaaucucccagccucaagcaguccuccugccucagccucucaaguagcugggacuaugggugugcacuaccacguucauuuuuuguuuuguuuuguuucucuguggagacgaagucucacuguguugcccaggcuggucucaaacuccugagcucaagugauccuccugccucagccucccaguguguuggaauuauaggcaugagccaccgcgcccagcccauaagugauguuuuuuacuuguaguuuuaucaccuaggagacaugacauuuugguuaucuuugguuuugugccauaaaaauuaaugaguuggucccugugaugauagccagauucauccauaauaaggguaauuaaucaccagcccuucgcuuagugguuuuagcagccauugaugauuaucgucuguaguucuuauuucagaggggaugcaaauuagugaccuucuaauucugucauuccuccuuauuuauuaguuggaacuauguuauauagaaaaccuucucguuaauuguuuggcuaccuugcaguacaguuuauacaagaaaagcaggcuuaguauucauuuuuuccccauacaaucaaaccuuguuauucacagauuccauaguugcaaaaucuuuuacuuccuaaaauguacuuauaacccuaaaaucagcauuaauaguacuuucacagucauucauggacacguccagagcaacagaauacuuuagccucuggcaugcguguuucccacagagacugaaugaggcgacacucugccuccuugucucggcucucacacugcaguguccuuuucagaaagucuguuuuaugccauguccuuugcauuguuuugcuguuuguugaaguuuaaaaugauccucugagccugggcgcaguggcucacuccuguagucccagcacuuugggaggccgaggcggauggaucaccugaggucgggaguucgagaccagcuugaccaacauggagaaaccccaucucuacuaaaaauacaaaaaaauuagccgggcguaguggcgcaugccuguaauuccagcuacuccggaggcugaggcaggagaaucgcuuaaaccugggagguggagguugcggugagccgagaucacgcuacugcacuccagccugggcgacagagcgagacuccgucucaaaauagaaaaguaaaaaaauuaacuaauuaauuaaaacacgacagacucuuaaauggcagaaauuuauuuucucacaauucaggaggcuggaagucugagguuagggagccacauggucagguucuagggagggcucucuuccuggcuugcagacagccaccuucuugcuguguccuuacauggcagaaagagaagagcgaguucucuggugucucuucuuguaaggccacuaaucccaucaugagggcccauaacuguccaacucuuagguuggagaguuauccauccauaacacuccuguguuagacuuuaggcuugccauaauguaauaccacagacugcguggcuuaaacaacagagauuuuucucucccuuuuggaggcuagaaguccaagauccaccugcuguuaggauugguuucuauugaggccucucuuccuggcuuuguagaugcccuuuuguugcuguguccucacauagccuuucccucugugcaaaugcagagagagcacaagggcaagcucuugucuguuccucuuauaagaacaccaguccuaucagauuaagaccccacccaugugaccucacuuacccuuuauuaccuccuguaggcccugucuccaagaacagucauauuagggcuucgggcuucagcauacaaauuugugggggacacauuucaguccacagcaccuccuauugaggaacaucuggguuguuuuggaucaaucuuuugcugguacaaauggugcugcaugagugaccuugugccaaugucauuuuguauuuuugccagccuuugugugggauugauuccuagacaugggcuuucuaggucaaaggguaaauucauaugugauuuugcuggauacugcaaaauuccucuccauagagaugacaccauuuuguauucccaacuguaguauauaggagucuacuuuuuuauaaucucacagaguguauuguaaaacuuuuuuugccaaggcaguaggugagaacuagcaucccucaggguaguuuuaauuugcacuguuuuaauaggagcaagguugaggaucuucuccuguguggaaggacugugugcauguuuucuucugugaacuauccauucaugccuuggauuaauuagccugguuacagugacagaggaccucuguggcuguggaucucuguaacagcaggucaaguucuccuucauccuucucaugacaugucugcugugagggagcugcagcucuggucugcccccaacaucugcgcauucaagcccuauuuggaaugugccagugucauggcagagggcaagagcaagagcugguagaaacaugccuugucuucuaaagccucugcucagcuauggcuuacauccacuuacaugccacugguuagagcacauggccaaagccguucuggggaguggagaaggaaggccauguauacucucccaaaggagauacugcagguugcauggcaggagggcaggguggagaaaugugaaauccucuugcccacauuucuagagaaggaccuuguggugguggugguggugguuucauuccaguuacaaaaguuuuaauuuaccuauguuuguguaaauguuuaaaugauguccaucgaauaugugguaagcucuuugagggcaggaguauguuuuuuuugcuuacucuuauauccccaaugccuaccacagucucuagcacuuacuaaacaaucugugcauaguuuugaaugaaugaauaauuaugaguguaauuauuuucuuccugacuuuucacauaucuauagguuuucauggccuaauauaugauaauaaaacugaaucuaugaagacaauuaaccuccuucagcgaaugaauauuuaccaagagguuuuucucaguauuuuauauagaguucuacccauacagguauguuuugugauauugaauuauuaauaucagaugaaagucaaagucugccauuuugaacugaaaguuaucacaucguucuuucugaucuucaacugguuuaguagaaaaucagcaauacuauauuuuuuuuccauguauauuaugaacuuuauaagauacugcuuuuuauuuacauaggauauaagguuuuuguacacagaugcuuccuggcuuauguauguaugcggucuagaagcuaauaaauauuuucauuugcucucuguaaucaggagugauuacacauucacuccugauggaucuuugagagaaaaaauuuguaaagucagcaaaucacaaugaccacuucucaugugaaugacguaucaucagacaaaguuagguauaaaacuuucuagaguaaagagugaagccagaccugucacggacuuccuuccccugucucuucucgguggugggaagaaaggcuacccgaacgcuucucuaauagaugaaaggggugugggcuugcugcuuggaauuagaggcaagcuccugcauauuguauuccuacugucauguuuuaaauggcacugaggaggguuagggcucaccugacaaacauguuuuauuguucccuuuuacagaaauauuuagagccaguuuauuuuuauauuuacaccuuauuugggcuccaggcgaucuaugucacagcucucuacauaaccagcuggcuacucagugguacauggcugucaggacuguuggcagcuuucugguaugucacaaauaggugaguuggagucaguaugcuucuuuuuuuuccaaaauguaaguaaaaaugaagucacuucauuuccagcucagagaaauuucuucugccacauuuguuugguugggagcaguuucucuuugguuugccuggugguuuacucaauuuuucuuauuuaguuagggagaaagugcuacuuacauguaauuccagcugaggaacagagagcauugaauugcauaucaagaaaaucauucauaauaaucccaaaccuauuaucuguuugcugggugaucaagauuucuccagccgcauaucucaucucuuaaaggguuuuuuuaaauuggcaaauaauaauuauacauauucaugggcuacauagugauauuucaauacauauagaauguauagugaucagaucaagguaauuaacguaucagucauuaaaaaguuuuuuggguuuuuuucuugcuguuuuuuaaagccaaugaagacuuuuaaaauuuuuauuuauuuagggguuguuuuuguuuuuuguagagacaggaucucccuauguugcccaggcuggucuugaacuccuggcuucaagcaguccucccaccuuggccucccaaaguaucaagauuacaggcaugagcuacugugccuugccuaaaaaguuuuaauuauaucuucacuaucaaccuuaauaggguuguguauggcucucaguuaguagagcuuaaagauaaaaugcaagggcguuuuugccuuauuuaauaucuacuauuauaagcaguagagccuuaugaaaucacauuuuaaaaaaauguauucaagaucauuaaauuauugccuguccuauaauggcaauaccaguauucaauaggagucuuaaaacuugaacaugaguucuaauacagguuuuauuuuguaagucuaagcaaauuacguguuaugacaguccuguuggggguuuacuguaugccaagcacuuuacaauauguguuauauggguucuuagaagaacccuauagaguagauauuauuauuauccccauuuuagaaaugauaaaauugaggcuuuaaagguuacauuuuguauauagauacagauauuacagacaucuauauauauuucuuuuauauagagauauauguagauauagauacauuguuugauacauuguuucauauauaucucuaucuuuuauagagagauauauguagauauagguaccuuguuugagauguagauacacacacguauauuauguguuacauaaguguaucauuuauugaaugccuaguauguguggggaugguguacaaagaugaaaaauuuuacccauacuugcccuguugggauucacauucuagagaggcaggaaguuuuuuuaaaaaauacugucaaugacauauuuaagacucaaguauaaaaaacaccaaagaaauacagagagagggaaaauguguauugccucuugacacuaauaaagugagggagaaaugaaaguaaggguuuggcaugauacauuugugaguuuaggaguaaggcuaaccugggcuugaacccuaggugcuaagggcauacccauggacagagcacuuaaauguucucuaugccaauuuuauguuacagggaugaugaugaugaugaugaugaugaugauaaggacaauuauugagaaccaguggccagaaucuuaaguauacuuguccuuaauguaauauaucuuucguugaggaagucuucgaggaaauuauuguaaaaacuaucacuuuggccauuuguguuuucuuuugugcagaauagauaccacaagaguugaguuuaccaucccacugagggagaacugggcgcugccauucuuugcaauucagauagcagcaauuacauauuuccugagaccaaacuuacagccucuuucugaaguaaguguuuauaaaauuucauauauuuuaaucccccaauuuuauauaugaagcuucaaaaaaugugaugugcuuaguaucccaaugcaugugaauaguucuuauuccaugaccaauuuuuaaacuugaguuaaauuaaguuuucuuuucgugagcuuuuuucuacuuugcaaagaaaauguuuucauuuuugauguuaaaaauguacucuacauaaucuacccuuaaauaguugcagcaaacccacacacaauuucugcaaacugucagaauuuuuaagcccuugcucuugagaugugauuuggugcauuaucgccuccauaauaguguggaauacacacaccguaugugaauauuuauaugcaaagugucacuuuaugauaguuagagcuuaaauaacaaaugcaaggguuuucagagcaacaguuuaugguuuuucuguuugguuuauagagauacuggcugcucuugagaaaacuugucugcaagguuuuuuauuacuagagacauguaaauuauacaaagguuuucuuuuuacagaggcugacacuucuugccauuuucauaucaacuuuucucuuuagucugacauggcaauuuaaucaauuuaugaugcugaugcaagcauuagugcuguucacacuggacucccuggacaugcugccagcagugaaggugagcuuugcuuucuuuucucacuugagauuuuggccauuuaguguuuuuauaucauagaaugagaugaaaauaugcaaguacuuauggauaaaauugaagcuguuucuuagaucugcuguaaauuugcuguggccaauugaagcugaguaauuuaugaagccuaguuugaccaucuuaacuuuuauucgcuuauuuuaaguuaaaaaauggaauggauuuuauuuuggggcauaaaugccuaggucaauuguuauuuauagagaugacuuaaauuuuaaaauauaagauagcucuuuuaaaaugucuuacuguguacugccacuuuuaaaaaagaaaucaauagguauauaacagcuuuuuuguaguacuuuauaaaauuuucauagucacauuuaacuaauaugggaugugaaucccuguugacuggcugaaagucacaugugaaauaaagaaaccaguaucugucuccuaaugucugcugcugucauuuaaucacauuuuuucaugugcaaaaauaugauuuuauguauugcguacaguuuuaaaauggcuuauaguuaguauucuaaaguaguaguaacuuaaauauuucccaaguauaauaaaauacuuucuccauaucuaaggcagcagcauagcccaaggauuugugcucauuuauuccauaucaaaggagauccaguaagcuuccauaacugacugagucugaauuaagaaacauaaaagucuaccaagaaauacacauugccugucuacugagacacuguaauagaaugggcacuacagaaaaugccaauauguguaauucauugucauagccacaguuugccuuuuagcuugggaaacaaagaucacagacaacaagaacaagcagacaaaugauagcugcuaauuagcaauacugauauaucuaaaagaagaaaaguuauuuuuaggcagagaaguguuuacagaaguaagaagcuagaacuggaccaccuagaucacaagugaggguagaauuugggugggaugucaggggugggggcagaauaggaagguggaaugcagcaagagcaaguagauaggacuaaguuuauauauguauaugaaauguuuaguguuucugcaggugugccagugaccacuccuacacugcugguaaccuauacacuccuauaaucuuucuuuaguguaguuucacaguagguaucaaaagccuaaaaauguauuugccuuuucaccaacauuucuaccccuauaaguuuguccuaaguaaauaaucugccauguucauuuuaguuguauuguaauaagaaaaagcugggcggaaaagauaaaaagaaauaaaaaacuggaaaugacuugagccaauagcaauaggguauacuuaaauaaaugauggcauaucuaugcaaucaaauauuauauaaccauuaguucccccauauuuuuuugaaaaagcgaaacauagagaaaaugaguaaagguucuggaaaaauacacaguaaaguaucaacagucagcuacacgauugauguucugcauauucuuuuuguucuuuagaucuuuugauuuuuucugauaaugaacaugugucucuuuuuuuuuuuuuuuuucuuugagauggagucucacucugucucccaggcuggagugcaguggcgcgaucuuggcucacuacaaccuccaccuccugaguuuaagcaauucuccugccucagccucccaaguagcugggaauacaggugcaugccaccacacccggcuaauauuuguauuuuuaguagagacaggguuuugccauauugcccaggcuggucuugaacuccugaccucaagggauccaccugccuuggccucccaaagugcugggauuauaggugugagccacugugcccaucugaacauguaucucuuuuaaaauuagaaagcaaagguacuguuuuggcucacauacacaacauuuuaaaauaauauagcuaauugauuuuuuauuuaguucuaaacuuuguucaacuuuuacauuugaaacuguguugguauuagaaguaguuuuaaguaucagacuuuaaggaggaacauuauuacaaugaaaggauccugaguuauaaaacuaaauugcugcugucaggucugaaaauaacuggcucuuucagcuuaggcaagugauuuaacuuaguuucuucauaaauuagaaucacuucucucuaaccaugucaaaugggaaagagucagaauaauugguauagaaaaagguaauacaaauucagagcucaguguggugacaagaagcaguaccuucuacaguacauuuugucaucuuuucaugaaugaugaaacucuuaccagcaaaaccucaaguuuccagucagaaaugugaacagaguaaaacagaacagcaagcauauuauaaaguguauacuuuugcuuaauuaaaggcuaaaauauggagguuaauaaaguuuucuuaaucuauuguggaaacagacgcauucaugauaaaugcuuaagagaucauguuaaguacccuacaugguuccagacaagagggaguagagacauuucuccccguuccuccccaaaguacauugaaaaaccuuagacaguauauguauauaacaaacauaagaggaauuugagagguagagagaagcagacugccuagggaccuugcgaccagagggaaaauuugacagcgaguuucuuggguuuucuuuuugccccauauauccuugacugggugcuggagaagucagaaaccugggaauaacaauggacucaaacaaaaagccuccucccucuagcaaaaggaccagaagagaggaagccuaacaagacagaaaacuuucaaacauuaacugccuuauucuagcgaaaugcuacagaagcaaaaccacagcuccacucccaccuccaucaguaaaguucagugggaagccuagauuccuacccucaccuagcugucacuaggcaugccuugcuuccugccagagcuaugucagagaagucuaguggggaaccagaacuuucaccaucucccagagacaucugugaaggccacuugggaaacuuggacuucaacucucacucagugguaaugagacauccuguccccucucuaucaggauggugucagagaaggucaacagggagguugagacucuaaccaccacccagauguaauaagccuuucucuacugcccuaccccaugcugucggugcaggccauguagggagcaguggugacgcaccucuguuucucccagccagcaugugucagcagggaccuguagagagccugaacuuucgccuucacccagcaauaaggaaguacaccuucugcugacccccagaugucaguggagggcaagugggcaccuuggacuuccauuuccgucugaaaguacugaggcagcacccuucuuuccccauuagcauagcguuggcauaguuugaauguuuuuguggucccccaccaaauuuauauguugaaacccaaauccccaaggugauuguauuaggagguagguagggccuuuuagaaggugauuagugccauuauaaaacaggcacaagggagcuguuucaccccuuucaccaugugaggaggacacagcaagaaagugccaucagugaaccaggaaauaagcccucaccagccacugaaucugccaguuccuugaucuuggacuugccagccuccggaacuaugagaaguaacuuuuuuguuguuuauaagcuacccagauuacgguauuuuguuagauaacagccuaaauggaccaagacacauggugucacaggaggccugcuaacauggcagauuuaaauaagauccagggucccauaauguaauaggauacaguuaaaaaucacuucuuaggccgagcgcaguggcucaugccuguaaucucagcccuuugggaggccaaggcaggcagauauuugaagucaguuugagaucagcccgggcaacauggugaaaccccgucacuacuaaaaauacaaaaauuaacuggcugugguggcaugugccuguaaucacagcuauucaggaggcugaggcaggagaauagcuugagcgagccaagauggggccacugcauuccagccugggcaacggagcaagacucugucucaaaaaaaaaaaaaagaaaaaaaaauucuuauauuaagaauuaggaaaaucucucuugagugaaaagagacaaucaauagaugcuaacacugagauacacagaaauuggaauuaucuuacaaggaauuuaaggcagccaucauaaaaaaaaagcuucauugagcaauuacgaacacacuugaaacaaaugaaaauacaaacucuaagcaaagaaguagaagauacaaagaagaagcaaguggaaauuuuagaacagaaaaauuccaguaaucgaaguuuaaaacucaguggauggacucaacagcaaaaugaaguagucagaggaaagaaucagugaacuugaagauagaacaauuuagaaauuaccuaaucugaacaacaagaaaaaauagaaugaaacaaaaaugaacagagccucaaggaccugugagacuauaaugaaaagucuaacauucagguaaucagaaucccagaagaagacaagaaaagaguuuacugaagcugaaaaaaguaugcaaagaaauacuuucggaaaaaauaguugaaauuuccucaaauuuggcaaaagcuauaaaccuucagaaucagcaagcugaacuaauaucaaacaggauaaauccaaauagagccacacuaagacacauuauaaucaaacuuuuggagacuaaagauaaauuuuaaaaaauugaaaguagucagaaaaauacuguaccuauaggggaaaaccaauuuaaaugacagugaauuccucaucaaaaucaaggaggggcugggcacagugacucacgccuguaaucccagcacuuuuggaggcugaggcugguggauugcuugagcccaggaguuugagaccagccugggcaacaugaugcaaccccaucucuauaaauaauaauaauaauaaaaugauuagccaggcaugguagcaacgugccugaggucucagauacuugggaggcugaagugggagaaauugaggcuucagugaacuguaauugcaccacugcauucuaaccugggcaacagagcaagacccagucucaaaaaaaaaaaaaaaaacaaaaaacaauggaggccaaaaggaaguggccuaguauuuucagaugcagaaaaaaagaacugucaaggcugggugcaguggcucacgccuguaaucccauuacuuugggaggccgaggcagacggaucauggggucaggagauagagaccauccuggcuaacauggugaaacccugucucuacuaaaaauacaaaaaauuagccaggcaugguggcaggcgcuuguagucccagcuacuugguaggcugaggcaggaaaauggcgugaaccugggaggcggagcuugcagugagucuagaucgcgccacugcacuccagucugggggacagagcgagacuucaucucaaaaaaaaaaaaaaaaaaaaaccaucaaccuacacuccuauaccuaguuaaaauguccuucaggaaugaaagggaaaucaaaacauucucaauuaaggaaacuaauauugccagcaguccuaccguaagagaauagcuaaaggaaguuguugaaacagaaaggaaaugauaaggaauuuaagagcaucagaaaggaagacaaggcaaugaaaaaaguaaaaaugugaauaaauauaacagacuuuucuuauucucuugaguuucuaaauuacguuugaggcugggcgucguggcucacaccuguaaucccagcacuuugggaggacgagguggguggaucaccugagguuaggaguucgagaccagccuggccaacauggcgaaaccccaucucuacuacaaauacaaaaauuagccaggugugaugaugggugccuguaaucccagcuacucaggaggcugaggcuggagaauugcuuugaaccuaggaggcggagguugcagugagccgagauugugccauugcacuccagccugggagacgagugaaacuucgucucaaaaaaaaaaaauuauauuugauagcugaagcaaaaauuauaacacugucuuaugugguucucuauauguaaaagaaauacuuuaacaauauaaaugggaaggguaaugagacuuaaauggagguuaggguucuaugccucacucaaacaguuaaaaugucuauaccacuaguccguaauaaguuauuaaugcauaauguaauagccagaauaaccacuuuaaaaaacuauacgaagcaguacaugaaaaaacaguacagauaaauaaaaaugaaauuguaaaaauguucagguaaccuacaggaaggcaggaagaaggaagcaggaauuagaagcaagcaaacaaaaaagaauaaaagagcagauuuaagacuaaaauagcaauaauuacauuaaagguaaaugaucuaaauauacuaauuaaagagauggcaggguggauuuaaaaagcaugacccagcuguugucuaaaacacacuucaaacacaacaauauagauaaauugaaaguaagaggauggaaaaagauacaacaugcaaguaucaaucaaaagaaaggaguagcuauguuaauaucagagaaaguagauaucagagcaaagaaaauuacuagggacagaacagaacauuauauaaugauaaaacguucaauguaccaagaagaaauagcaauccuaaguguaccugcaccaaacaacaguacugcaacguguguggggcaaaaacugacagaacugaaaggagaaauagaaaaauucacaaucgcaguuugagacuucagcacaucucucuggacaauugauagaacaccagacagaaaaucaucagagauauagaacccaacaacaccuucaaccgacagaaucuaaugaucauuuauagaaacuccacccaguaacagcagaauacucauucuuuucaagcauucacagaauacuuaccaacagacuaucucccgagccauaaaacaacgacaaacauaaaagaauuaggauuauagagaauauaaucucugacugcaauggauucaaauuugaaaucaauacagaaagauaacaggaaauguuucaauacuugggaauuaagcucacuauuacaucuauaguaguaauagccagaauaaccacuuuaaaaauauauaaagauauacacuaaaaaagagucuaagaggaaccucggagagcauugaacucaaugaaaaugaaagugaagcauguuuaaauuugugggacacauccaaagcaguauuaagaagaaaauguguagcacuaaaaagcuuauauuagaaaagacagaaagucugaaaucggucauccaagcucucaccuuaaaaaagggagcaaaauaaauucaagccaggagaagaaaauaauaaagagcagaaaucaaugcuauugaaaacaugaauaauagaauuaauuaaaaagagcuagcuuggucgggcacgguggcucugccuauaaucccagcacuuugggaggcugaggcagguggaucaccugaggucaggaguuugagaccagucugggcaacauggugaaacccugucucuacuaaaaauagaaaaauuagcugaccguggugguggguaccuguaaucccagcuacuugggaggcugagcaggagaaucacuugaauccaguaggcgaagguugcagugagcugagacugcaccauugcaccccagccugggcaaugagagcgaaacuccgucucauucauagauagauagauagauagauagauagauagauagauagauagauagauagauagauuagauaagauacuccaucucauucauagauagauagauuagauagauagauagauagauagauagauagauagauagauagagcuggcucuuugaaagauuaguaaaauugcgaaccuucuccauaauuaccuuggaacauuaaaaacuuuucaaucuuaacagacuuugaaaguucugaucucaggaagagugggagguggguggguguugagugcuuaauggauauaauucacauugagugauagauacacgaaaagcccagacuucaucaguauauguuauguacguguaacgaaaccguacuuauaucccuuaaauuuacacaaauaaaauguguaaaacaaaguuuugagccucugugguacuauuuacgugguagccaauauugcauagugguuaagaacacagacucuacaacuaggcugccuaaguuugaaugagucauaugugggucguauggaacaaugcuugcuauuuuauuaauguuaaacagauauuaacugugguuauuaugaauggugaugaggagcauggacacgauccauugaagacagcuguaguuauucuacacagaaaggauauacaguugacccuuaaacaacacaggggcuacuggugccgaugucuccccccagcaguugaaaaucugcacacaauuuuugacuccccaaaaacucaaucgcuaguagccuacuguugaccagaagccuuaccaauaacauaguugauuaacagauauuuuguaugugaugcauuauauacuauauucuuauuauaaaguaagcuagagaaagggaaauguuaauuaaauccaaaggaagagaaaauauacuuacuguuuauuaaguggaaguggaucaucacaaaggucuucauccucaucuucacauugaguaggccaaggacgagguacaggagggguuagucuuacugucucgggaguagcagaggcagaagaaaaucuauguauaauuggacuuguguuguuuaggggucaacuauauucuugcugccuuguuucuauacuguacuguacuaauagaacugggaaagaauauccaguacaccgcugauaauccaggacuuccuaauacacaguacugcucaauuuuacauuuuuggcuguucaucagcaauuuuucuuuugaauguauauaaaacuauacaaucuuguuguuacacaaacugccccuuuuucuagaaauacucucacuugauauaaaaagaacuguaaacaucaaaaaacacccacaaauaaaggcaaccagaaagauguuuuuggaaaaaaagcauuuguaaaugaguuaguauccuuaagaguuccugcaaauccaugagaaaaccauuuauaaaccaaugagaaaagggaacaaaggauacaaacacuuccuagaaagaagagcaucaaaaagggucaaaugcauagguacaaauguaacacaaagugacaauuuacgcuuuacaaaacaccacaaagcauuguugaaaguuuuaaacgccuagauuggaaagauaauucacguucuuggauuggaauacuuacuguuguuaagauggcagugccccccaaauugaucuacagauucaacacauucccucucagaaucccaggaggaguuuuugcagaaauugacaagcuaauccugaaauucauauggaaacucaggggacucagaauagcuacaacaaucuugaaaaagaagaguaaaguuggaagacucacacuuuccaauuacaaaacuuacugcaaagcuauaguaaucaggacagugugauacuagcagaagaauugacauaaacccauggaauagaauugagagagagaaauaaaccugcacaagaaauggucaauuaauuuucaacaagggugugaagauaacuaaauggagaauuaaugguguuuucaacaaauggugcaggaauaacugauaccgacaugcaaaagaaugaaguugagccccuuccucucacuguacacacuaacucaaagugaaucacagaccuaaguguaagagcuaaaaccaaaacuuuuagaagaaaacauaguaauaacucuuccugaccuuggaguagcacaaaccuuagauacaauaccaaaagcacaagugacuuuuacaaaaacagauuaauuggacuucaucaaaauuaaaacuguuguacucaaaagugugcuauuaggaaaguaaaaagacaacccauagaacgagagagaauauuugcaaucauauaucugaucaggaacucccagaauauaugaagaacucuuauaacucuuucaaugauaaaauagcaaaggauuuggguagauauuucuccagguaagauacauaaauguccaauaaacacaggaaaagaugcucagcgucauuagcuaucagagaaaugcaaaucaaaaccacaagcagauaccacuuuacacccacuuggauggcuaaaauuaaaaaacagagacaaaugucgcggaugugaagaaaucagaacucucauacauugaugaugaugggauuauaagaugguguagucacuuugaaaaacagcauuuccucagcauuucuugauuuuaauauagaguuaccauaugauuuagcaaucccacuccuagauacauacccaagagaaaugaaaacauauccaugcaaaaauguuuguauaugaauauucauagcagugugauucauagcuacaaaguggaaaccacccgaaugcccauaucccuuccauaaacaguguaguccggcugugcaauaaauaguguucagcaauaaaaaagaauguugauacauggugcaacauggaugaaacuugagaacaccaugcuaaguaagagaagauagcuaaaaagacugcacuuuauuccauuucugugaaauguccagaauaugcaaaucuguagagaacaguacaucagugguugccggagcuggggguaggggaugauggagagugauggcuaguggauauggguuucuuucgaagugaugagaaugucauaaaauuagacugaggugagaguugcacaacucuaugaauauaccaaaaaucaugaagcacacuuuaaaugggugaauuugaugguauaugaauuauaucaacuaauaaaacugcuaagaaggaaaaacucuuccuucucuaaccaguaguuguacucagggaucuaucccuaaggaaauguuuuuauucaucaguuccuccaauguuuauuaagugccgcucuucuaguguguauucuuuaaggugcuggggauacagcagugaacaaaauauguaacuaaucagacaauucgguuaggaauucugagaaucagaccugaaaaaaauuuuuaaagagauguucacaauguuaauaaaaagccagaaacaccuaaaugguccaguggcaaacaaauuauggcauaugguggaauguuacauaaccauuuaaaauuuaaguuuucacagaauagucacugaugugagaaagugauaugguaggaugugaaggauguaaaauccuguauaugaaauacuauauacugcugugaaaucaauauuauuucuuuagguaauggugcuggguuuugacucaagagcccaccuauugauugcuauuucuuuuuuguguuuuucugaagugucuaacucuccuagaguaagauacauuaucuuuaugauccuaaagaucaucagcauccauuucccugaguucccauugacacuaagcaaaagcacugaacugcugcaagccucacuuuucaaugcuucuaucaauagguuuguuucccuugagguuaagagaacaaaaccauggggauaaucggauuugcugcuaaauaaaacguauuuuucacuugucagaaugaguauggcauugucuaauuugaaagagaagaagaaaacuaacagaauaaguguccacucuuuauuagggacugccuuuuuuuucuuuguggcguguuucguguauucaaguuaguuguguuuugcuucuuuugguaucaaccuaucaauaaguuucauuacaucaagaguuaauccuuagugcucauuaugugccaggcauuuccuccccacccacgccuccccacuuuuuuuagagaccaggucuugcucuguugcccaggcuggaauggaguggagcgaucauagcuuacugcagccucaaccuccuggacucaagugauccucccaccucagccuccugaguagcugggacuacuugcaccacuacaccuggcuaguguuuuauuuuuauagagacacggucucgcuauguugcccaggcuggucuugaacugggcucaagcaauccuucugucucagcuucccaagauguugggauuacaggcauuagccaccgugcuuggccaccaggcauuuucauccauuaccaugucugguucuucugugagacccuacaucaacucugugaggaagguaucaucaucucuuguucacgaugaaccauuuaggucacauagcugguuugcaccagaaucggaacugcaguacaggugcuguuggugccggagcugaugucauugcccaguguacugugcugccugcuaugaagcugugaggucaaagaggacaaggucaugcagcaggagggguuugcagucuaaucaggggaucugggcacacacucacacagacaaagcaaggaaugauacaguccuaaaguauagaguauggaaaacuaggaaauaacacaguaaaguacuuauugguggucauaaacaguaacugaaaucauugaaaagaaaacugaagauuauaaauggcccuugccaauucccaggaauaaauacauucugcuguuguuuacuuccucuacuucauaucaucccucuuuacuuccccuuuaauuaauguuagaagauuucuguuauuaaaagguaaauaaacaguugguauguguaugauuuaguuuccuuuuuuagauuguguuucuuuuuuuggagucucacucugucgcccaggcuggaguguaguggcgcauucucggcucacugcagccucugccucccaggcucaagcgauucuccugucucagccuccgaaauagcugggaucacaggcacgagccaccacgccuagcuaauuuuuuuuuuuuuuuuuguauuuuuaauagagaugggguuucaccauguuggccaggcuggucuugaacuccugaccucaggugaucccacccgccucggccucccagagugcugagauuacagaugugagccaccgcgccuggccuagauuguguuucuugaaucuacauguguuuucugcauuauuuguaagcugagguguauccaccucaugaccaacaugucgacaugugaugaucucuugguaaaaugucuguacucaucuaaucuuugguucuugcaggcgacauggcuguauggaauacagauaacaaguuuacuccuggucugcauucuucaguuuuuuaauuccaugauucuuggaucacugcuuaucaguuuuaaccuuucaguauucauugcaagaaaacuucagguaggacuuuuuuuuuguccuuuaucaaaguaaacuuuuuuuuaauugcgugguuuauugaaccuuauuuucacacagcauacaaagggaaauuuacaaccugauuugcacuaaaaagagcacguggcauugugugcuuuuucuugugcaugugguagcauuucuguuucaagcuuucugggucauccuuuuauuuugacaguuauuucuuagagaauuggaaccuuaccuucaauguggggaucagccaaagaugcuugguugaaugccacugauuuaaaauugaaguaaaagagaaaaguuauuaauuuuuaugugugugaacucaggagcgagaagagucuccugcuuguguugggagcguguucauuacaguccuucacguugguggauacccuguuauuugauguaguaaugcuacucuuuuccccauccuuccauaccauacuaguuauuuuuaggugaauuaaaauuaacuguuuugagaauuuugagaauccaaauaaauaacuuuagaaauaaugggacauuuccuaggguauugucaaaucauguuugaaaacaaugacuugcucuuuuagcuuuauuuauauaauuaaauuucuuauauuuacauaagauaugagucauuuguuuuugcuuaaaauuacaacauccuguuucacauaugcuagaaacuuccgugucaagaagccauuuuguuuuccacuuuuagaagaagaaaucauuuuucuuauuagucuuuugagugagaauuguuauggacaaagguuuuuaguugacuaucaaaaacaacaguucacagucauccuuuuaaccuuaauuauaaauauuacucguauuugaacuguuaagauauuauuauauuuaacaauguauaaaauuaucaagauuauaagaaaacuauuauaugucaaaaggcacaauguacuucuuuuuacacccauaagucuuuuauguaauugacuuguaacuaugcccgugguguaggaauuaauggauaaaagauguaacagggccaggcgugguggcucacaccuguaaucccagcgcuuugggaggccaaggcuggcagaucacgaggucaggaaauugagaccaugcuggcuaacauggugaaacccugucucuacuaaaaauacaaaaacuuagccggguguuguggcaggcgccuguagucccagcuacucgggaggcugaggcaggagaauggcaugaacccaggaggcggagcuugcagugagcggagauugcucugcugcccuccagccugggcagcagagugagacuccgucucaaaagaaaaagaaaaaaagaaaaagauguaacaguuuguucagucagcguauccugaguaccuuccaaauggcagaccccaauccuccuguuucuaaggucugaaaaaauaauuaggaaaaaaaagacuaggacacauuuccucaucguaugaagcucauuauuaagugauucauuuacuacuagaaaaucacaaauauuaagacaguguaaccucaugaaaaugaguagguuguauuuuccacauauauuuucccuuuauguuauaugagccaguguuuuuaaauccuuaaguaagcucaucuucaguguuuaugaaguuauauuaaaacuuaagaauuaaaacauaacucuuuuaauuucuagaaaaaucugaaaacuggaagcuuccuuaauaggcuugggaaacuuuuguuacauuuauuuaugguuuuauguuugacacuuuuucucaacaacauaauuaagguaaguuaauaaaaaugacauguuuaauguauuuuuaauuaacuuauggcauuggagauaauuuuugaaacuuucuuuuucuuuuuuaauaaacuaauuguuuuagagacagggucuugccguuuccuaggcuggccuugaacaccuggucucagauggcccucccaccuuagccucccaaguugccgggacuacaagugugcaccaccacaccuggcuucuuugaaacuuuuaauuuuaaauaaauucuugcuuuauaaaguguauuaacgugacucaagaguuaccaguuuuacuucaaacaggcucaguuuuaacuuugucuuaguagcaaggauuauuuuguugauuuuagucauuaauuucuauguacucuuaugucccaccuugaacuuacucaccuuuuguuaugaaacuuuuaaaagcuuaacuuaaaaagcauuaaacaaauaauuucucuaaauuuaaaauuuuuauuuuuaguaccguaauauacacguagcuuucuguacugugguacuuaaaaaaaaaagacaugauuuuuaauugaguucaguuaauaaguaaaguggccuuacuaucuacuuucugcuggaaagaagaguugagcucauuuuucccaacauuuaacugacuuauaugcaacaggccuaacagaacaacucauuugguaacguaggcauccauugguuuuauguccaguaggugcuuugcuaagauuuuuacaaugccccaggggcucugcuuaguuuaacaugcuuuuuaaauguuuuuauuggcguuuuaauuuuuuuucaggguaggcuuuauuaaagguauaauucuuggaccuugauaucccauuuguuuuuaugcuagagcaaaacuacauugguaucuucagauacuuuugccuguccuagaagguuggucucaggauaggaggcaucugcaaaacaggcuccuucuccacaagagaacugugguccuuguucacgucuguugacuaucaaagaaaaaaaagacucuucacucagccagucacuaugucacuauguucuuuuuuuuuuuuuuuuuuuuuggacagggucucucacccagacuggaaugcacugguguggucauggcucacugcagccucgaucuccuggauuuaggugauccucccaccucagccuccugaguagcuaggacuauguguguauaccaccacaccggcuaauuuuuguauuuuuuguagagacaagguuuugcuguguugcccaggcuggucuuaaacuccuaggcucaagcaguccaccugccuuggccucccaaaggauuguaggcgugaaccaccaugcccagcugucaguauguucuuaaacuccauacagucaaguacuuaucaauaauuuauuuuuaaauuucuaaauuuuuuuugcuuuuuuuuuuugagacaggaucucacugugccacccaggcuggaguacaguggcacgaucuuggcucacggcagucuugaccuccugggcucaagcaauccuuccacuucagccugaguagcugggacuacaggugugugccaccgccccuggcuaauuuucacaauuuuuguagagaugggaucuugucauguugcccaggcuggucucaaacaccugggcucaagguaugcucccacuucagccucccacagugcuaggauuacagacacgagcugcugcacucagccaaaagcuuuuuuugaguugaugaauaccccauuuauccugauggaauuauuacacacuauaugccugugucaaaauaucucauauacuccauaaauauauacaccuauaugcccacaaaaauuaaaaauuaaaaagccuauucaaagccaggugugguggcuuaugccuguaaucgcagcauuuugggaggcugaggugggaggaucgccugaggcuaggaguucaaaaccauccugggaaauguagcaaaaucuaaacucuacuaaaaaaauuuuuuucaaaacuugaguggagcagccaacauuucuggaagaguggccaaagauacacaguucuugcauuggcccacucuacacauucagugaccuguucuuggauuaaaccaguaaagagcugcaucccuggaccaccauuuuuugacuccccgaagaauaacaucuguugaauugcauuugauguuuugccagugaccuacaacaagaggaaguagagaaaauuuuccuugaaaguccuugcuguuuuugcuuuacccaugggaaaaaauuauuuugagucucaguucuaggacuguuaagaucucuuccgagcaacuguuuuguuuuacucuuauaaacccgugaguaacauaaauauguugaccucccuguuugcauuugcugcuggaaugcaaaagaccagauuuguggcucaucucuaaugaauauauuguguguacugaacucaauuuuagcuucaucuuuucucccugucuucauuuuucuucuaauaaauuuuuucaccauuuauguuauuauauauggauuuuuaagccacaaauuuaaaauagaauuauaugaguuaaaauuguaaucacuaaugaugaacacucauauuugucuguccaccccuucaggguuacaacugucuugaauugucuuugagugaauaagucuuggaucaauuguauccacagaccaaaagccccaaagccagacaggcuuugugggcgguguaucuauuugagguuucagaucaucgucuugucaguuuucuggucugaaaacuuaugcacacuaugccucagccuucucccucucccugaaaccaaaaaaucucaucuuuuaccuauuuugcauauuuaacuuauguauaagauguuuuuugaauaaaggauuaugcuaaaaaggggagugggguuuggaaggaguuuggaagucccugcuuuggaauuccucaguucugagaacuacugugaacauuuacugauuuuguacacccacacgcuccugugaaauuggacacugaauauguaaauucaaugggaaguuaucaggaaaccgugccuaaaggacuaauagcaauuuuuguuuucucuuuccccgauagaaaauucuuaaccugaagucagaugaacacauauuuaaauuucugaaggcaaaauuugggcuuggagcaacaagguauaacugaauugaaagucuauguuugcuauuuucuauugaaucagcagggacuuuaaaacuuaaguugucauugugccuucaacuauuaauugcagacucccucugaggaaagaugcaaugucauuucuuugucuuauauugaauuuaauacuuugcuuuccauuuguucccuagggauuuugaugcaaaucucuaucugugugaagaagcuuuuggccuccugccuuuuaauacauuuggaaggcuuucagauacucugcuuuuuuaugcuuacauauucguucuguccaucacagugauuguagcauucguuguugccuuucauaaucucagguaugguauauuucagaaaucuaaugcucuccuuuaaugaacuuguuccauguugcagaaaaauugcaaaguugaaagucagaauaucagacacaaguaauaguauucaucuuaaagggggaacauaccucguuuagaguggacuacacucccaguaguuaggagacaacagaguaaugaucagauugcaugcggucugggcuuaagucuuggccugcacacuugggaacaaagugacucuugagccaguuacauaaccuuuugauauguccauuuccuuaucuuuagaaugggaagacuaagaguacuuacucuacaggauauuugagaaauaaguaaaaacaacauaaagcacuuaaaauagugucuggugccuagacuucggcagguacaagccaucgugaacugguuucauuaucacuguugacucauaagccucuguuguguuuccauuauuagcauccuguguuuuucucccuuccuccucuagcugcuuuuuuguauugcucuugaaauguaagaguuaauuaauuauugcucauuuguuuucuugcaucuugcuucagggcucauaauguuggaguggaccauaauuauuaguaucuacuaaaaguuuugaguaauaacugccaauuuuaaaaaacuaaguauaucuaccaaucuacugaaagaaaaaaaucaggaguaugaaggcuuuuuaaaaacuuguaagaauaucuacccaucaagcugcuggggggguuugcauugacucuucguguuaaacugaaagaaaauuaaguguaagaaguugaagcugcugucauuugugaaaacuuaaugaagcucacgaggaagcccuuuuucuguaguuaccuugccaauuaaugugcuggugaacugugauucacagccacgagagagcugucauuaaaaugaguccagagcaguugagagguuuuaugaucauuaagaaugaaacaacauugaaccaugaaaauauuucauugaacauaaacuauuuuacuauccuugagaaguguucuuuuucauaccuaacccaagauaaaauuuagcccugugaaaauagauggaaauuauucuggacagugugauuuaauaucauuccagacauagcaagugucaacaggacucuggacugcauacaaagcaggaaguucagugggccugcaguaucuuccugaaaaugucugccaugcucugugugaaucuaugagccaucucuggaggcugauuggguauaugaucauagauaaaagauuuuagagcaucuucaucugccagauagggauauuaggacuuuauuagaggaaaagcacuacaugaaaguaauuaaagaaucauaguccagucaugucacuuaacaagggggauauguucugagaaaugcauauuaggcgauuuuaucauugugcgaauaucauacaguauacuuacacaaacauagauaguauggccuacuacacaccuagguuaugugguauaaccuacugcaucuaggcugcaaaccuggacagcaaguuacuauguuuaauacuguaggcaguuguaacacaaugguaaguauuuguguaacuaaauauaucuaaacauagaauagguacaguaaaaauauaaaggccagguauggugggccuguaaucccagugcuuugggagguugagaaggauugcuuaaggcuaggaguucuagaccagccugggcaacauagcaagaccgcaucucuacggaaaaaaaaaagaaaaagaaaaauuagccaggcacgauggugcaaaccuguagugcuaacaagucgggaggcuaaggcgggaggaucacuugagcccaggcguuugagguuucagugaacuauaauugcaccauugcacucuacccuggguaacagagugagacccuaucucuauuuuuaaaaaauacuguaauaaaagauuaaacauuguauaccuauauagggcaguuuucauaaauggagcuugcaggacuggaaguuuuucugugugagccugugagugaaugugaaggccuaggauguuaccauacacuauuguagacuuuauaaacacugugcacuuaggcuacaguaaaucuauuuaaaaaacaaagugauugugcuaugaccuuauaauggcuaugaugucacuaggcaauaggaauuuuucagcuccauuauaaucuuacgaauccacugugguaugugcgaucuguuguuggccaaaauguuauguggcacgugacugucuaaaugugaauuaacuuuuaaauaagggccuuuugucagugccaaguauuuaaaguauuucuaccuuuuuaguacuaggaaggaugauacuaugacuuguuuuguuuuguuuuguuuuguuuuguuuuguuuuguuuugaaaugcaucucgcucuugccugggcuggagugcaguggugcaaucucggcucacugcaaccucugccuuccggguucaggcaauucuccugccucagccuccuaaguagcugggauuacaggcaugcacaaccaccccuagcuaauuuuuguauuuuuaguagaaacaggguuucaccauguuggccaggcugguguugaacuccugaccucaagugaucugccugccucagccucccaaaauguugggaugacaggcaugagccacugcacccugccagauacuaugacuuuuauguagacaucugcauuagugugagggguacaucugaaaggggcaugguguucccugccucagccucccaaaguguugggaugacaggcaugagccacugcacccugccagauacuaugacuuuuauguagacaucugcauuagugugagggguacaucugaaaggggcaugguguucuguguucauggaauuaaucagagccuuccagcuuggcugggcuaugggggagguacugcagacuucucuuagguaucuagagaggauaagagcagauacuccccuugucuguuuuauuuuuauuuacuuuucacaccuugcccuguugauggauauucuuauuuggaguauccuuuuuguaccaauauggaaaccaguguuuggguuguaauauuuacuuuuaaguaaagauuccaauugugaauuaccaauggugagaacugccuuagaguauccuuuuaauuuucguauguauuuaugguaggaaaaaaaggauuucugggaaauaaaaaaagucucuaguuacauagagaagcaucguaugugcccaguucuauuggguauguaugaagggaucaguagaccuucaugaaaguuucaucuuuaacuaguagccuuuacuguuguuuucuuuuccccucgacaacaaauugugcaacaucuaaagucacugaucagucuuaacaucacugaaguggagacagccaggcagugugugcuucccgguguaaugugauguggaauagagccguccuguuuucuguggaaauauguuucaagucccucaguggaugccugaaaccucggaugguuucacacccuuucuauacuauguuuuuuuccuauacauauaucccugugauaaaguuuaauuuauaaauuaaucaugguaagagaauaacaauaauaauaaaauacaacaauuauagcaacaugccagcaucacuucucuugcacuuuggggccuuaguuauguaagauaagggcuguuugaacacaaacaauacagggacauuuaaauguaucuuacuuuauuaguaguuuaguagcugaauguaucugcuugucugucucggguagguggguagacuauacagcguggaaacacaggaccaagggaugaugaucugagucucaggugggacagacagggauggagagauuucaucaugcaacacagaauagcauguaauucaaaacuaugaaugguuuauuucuggaauuuucaauuuaauauuuucggacagcaguuuccucaauaacaaaccacugaaagugaauccaccgauaagaggggacuacugugcaucauaaccccgugaaguguucuugccaaaaaaaugaacuugugucugauaaaccucuagaucuaauuacaaguuuacaagaagcaugaaacguauaaccaccacugugagccacaccugggagacgggaacagcuucaggacauauguucucuauucuuccacaaacaaauggccuguuuuuuaaaaaaaggagauacuuuuauagaucaaaagauauuuaaagauauauauuagugaaaugcaacaugcaguucuuagauccugauucagagaaaccugaaaaaagcaauugaugcaaacagggaaaauagaacaugaacuagguauuagaugauguuaaggaauuauuguuacuuuuauuggguguaauaauuuuaauguagccguauuugguaaaagucaucuuuuggauaucaggagguauugguagguuaaaaaugugauuuuugaggggucauaaaggaacugaauuccaaguuaauggauguguguuuugcuuuugcuuauuuguaaaaauuugaaaaauacucauaauaacugguaaaacaucuuuuaaaaaucucuuucaauuucagcaauuccaaaaaauuugaguuuuuuuuuuugcauucucuuuuaauuuaaagaauugaagcacuuuaaauuuuuacuucaaagcugcugugaaauuucaguuuuucucauuauuaaugcauuuauauuguuacacuuuagccucauaaauucaaaauugaucaaugcgaauucauuucaucuuauggaaauaaucaauuucugaauacauaaaggcauacauuucuuguaucuucuucuuuuacaaagaucuaacuaaaauuauguuuccagcuuaaauuuuguauguugcuguuuuacucagugauucuacaaaucaacaauccguggguaaaauggaaaaaggcacaguugaccugaaaccagaaacugccuacaacuuaauacauaccauucuguuuggauucuuggcauugaguacaaugagguauuuuugucuuaccuguuuguuuacuuuuuauuugaucacucuugauguuacuuagcaauauaauuuggaaagugacaaucaucuucauuaaugaucaugguucccauaaaaucauccuuauauccuaucuucucucaguauaaaauacucaacaucaguuuuuacaauuaauuacaaacacgccucuauguuuuacucaaagcauagucuugaaaaggcaguggaguuaaacaacgaacccuucggcaaauggcaucugcauaguuuuaaguaagauuuugccgucauagacuguaaagcugccuuuauaggugucucagaauccagguuuauauacaacuaguacuucugacuugcgccugugucuguucuugcagaaugaaguaccucuggacgucacacauguguguguucgcaucauucggccuauguagcccugaaauaugggaguuacuucugaagucaguccaucuuuauaacccaaagagggucagugucaucccuuuuuccaucuccuuuuaugacuugcaguauuucuuucauaccacuucuuuuuuuguuuuucaguagcugugagauaaaauggauacugaaauugaagcugaaaauacauaauugauauauuaagauuuuauagggaauuauuuuaaaauaauuuuauuuuaaaaaauuacuuuuuucucagacuauaaguuagauauguucauuauacagaauuuggaaauacaaaaaaaagcacaaaaggggaauuaaaauuaccaauaauccccuuguccggaauuauaacuguuguuauuauaauguauuuucauaaagauaauuauuuauauauguaugacaauuuuucaguagccuauaaaugcaguuuugaauuguucuacuccauaaauucacuagguggcaauauaguagaagcugcagauaucuuacaaaugauuagaauccuaguaucgacucaguuauucugcauauuggagacuugugcuccauuaaauuauauuucugguaauuuuuuaaggcauauauuuacaaagcaaaacuguaaggcagaaguguuuaaaaaagccgggcacaguggcucacuccuauaauccuagcugcucaggaggcugagacaggaaaaucacuugagcccaagaauuccaggccagccuaggcaaacauagcaagacccugucucucaaaaaagaaaagguucaaaauacuuauaaucuaaauaaugucuuucuuauauagauauguauaaugcgauauucaguaccgauauuaauacugcuguaucuaugcuauaagguaagacugauuuuccucauucuugucauucauguauuuagcagaauaauugcuuugauucaauauauuuuguguauuauuuggcaaauagagugguuugugaagguuauaaauaccuccuuagcuucuuacugaaggugacauugaugggaaaauggaucuuuuucccaaauaguuuuaacaaguaaaaacaugauagcgaaaacuacuauagcauuuaauaauucuaauuaauuuugauuuagacucuuaauauucagcugaugcaaauucugaaaauaagguguuuucagaccuauuuugaaaugaaaguaggaaaauuauuuucccauuaccugauuuauauagacuaagagauuuuuaaauguaucuuacuuuaagcuccauauuuuauuagaugcuuaucuucauaagagaauuagacacauaaauaaacacagccuaaggcuaggcuuuuuaaaaucuguucuucaguaucaauaggaaguaucuggauuuuucauauucucauuugacuaguuucugaaacagcaugaacugcccuuuaauucagagaauuucuuaucagagacaaugaucauuggucagguugacuguggcuuuuugucacaucuuugacauuggcagucuugaaucaucacuagggcagauagcacagacuguuuuauccaauugagcuucugcccucucuuuuuaaagaaccuaacauauuaaguuuauauuuuuuuuccuuuaaauuuuacuuuaaguuaaaacgacggauuucaaacucuacuguguagaaccccugauuugggaggguggcuaaaagcaggggugaugggaccucccgcagagaggaucagcuagagcagcucagcuuugggguuuauuugcuuauauuuucauguaggauuuugugaaccaaagguuucaggcuaaagaaaauauugcuaaauacuauauuguaaauauuucaaaaaaauguguucuguuaugagccugucuaucaaaacauuuaccauuagcaaaacucugugcuaacuccuagauauuaaaaaacacacaaauagauuuaugccuccccaccucugggaauuuuauugcucuaaugcgaauaacugaaacuuacuaaaaacaucuagacacgaacaguuaaggauuaaacaguauauguuacugaggaguccugucaguuuaccuuuacacaaugauucaguggauuaaagcacccuccucacagaaaagauaaagcucaugaauguuuuucucaccacugaagauguaccgaacaauaaccaucuuucauacugcccgugugcauguagguucaguucuuuuaugucucagcuaucuauugaaauuuuacugauuuuuuuaagcuauuugaggacugagguguuuuguucguaauaaaauugaggaaggacauuguauaagaaguaaacuguccuagggagcauugauucuugaagcgugguccucagauaaacagcaucagcgucucuugggauccuguaaacaugcauguguuugggucccacuccagaccuaccgaaucagaagccugggaguccaguacagaaauaggcauuuaaccagccccccaguuuuaagaacccccugcuguagcggucacaggguuucucagcaguggcacauugacacuugggccagagaauucuuugccgcugggggcgggggcgguccugugugcuguaggcugcucugcggcagcuucagccucugcccgcucauugaagcacgucuccccuggcuacaaccaaaaaugucaccagacauugccaaaugcccuggggcuggggcuaggggcacaaugucuccccuuacucaucuugaaaaccacugcuauaaaagaacugggacagcuaaagaagccaucaucuccaggaaauccuguugcagguuuucccugaauaagggaguuaguauccugaggaauccuccaaaagacuguuggccuagucucucuugauacaggaguuuaggagaaauccuaaugcauucagcuuucacuguauaaaauaguucagauauuucaucuccacaaaacuuacauaaaaucacagagaaaauuaagaugguauggguaugagggguuacccugaaacugaaucuguuuuccaacuauuccagcucuuacagacuuaccuguaaguaaugugaauucauauauuucaaagccugauuucaguuuuacauugcaauuguaguuagaguuucaaaauuucuuguucauacuaccaauuuugcuguauuucucuuuaguauaagcauauuaaaagggaaaaaagcauguacuagccugcacuccgaagucaagacuuuaguaaaauuaggacguuggucuugauuaacuuaauuggauugcugaaaucucuacugcugauugguaaaaacggcaguuaguuaauucagcacuuucauauuguuaaaggaguuugccgcaaaauucucacuagcuuuuaacauuuucagaauuaauaacaguaacuuucaaacuagaaaaauaucuaauauucauugaguucacagauuucaaauauguuuauacuguaagaauuagagcauuucauuaaaaaguugguauucuauugguuaucaaauuaguaaggaaacauagaucauugaaauauuacaaaggcaucauuuaaucaguaauuuuuacuacaucucuuccaaaaacuagaaccagaaguccugacaccugauuucccaucacuagcaauuuuccugauucacccacccaggagacaagauuugaaugagcaguaaaaauggccaaagaugagaugaccaaaaaaacagugauaggucucaaacacagccagagaucaaucaggugcugcuuugauucuacuagugguucuuaaauaaaaguauuauauuuucuacgucaguggagcauacauacauugucauuggucuucuaugcuaauaugugaagugaauucuaccuuugaccuuagaauguauauagauaugaucaagucuuuuuagucaacugucauuugauaaaaacaauuaagauuuaguuaauuguugaauuaaauggacuuaagauauuagauaaguggguaauucagagaguaauuuuuacauuuuauuuagaaaaccuuaaguacucaaguugaccaggaggcaccaagugguauaaauacagccagauguaccagauauuccuggagagcccuacauuuaaauauuauucucuuucauuguaccagcaauuauauuaauauaugucaaaccauuugaccagauuucuaguacaaaaauacaaucaugcuauuuugaaaugaaaagggggcuggauuuggagccaggguccagguuguagcucugccgcuugugacuuggucaagucagauaccucucugagccucaguuuccacacuucuaaaugaaaaauaaaucccagugggugaugcugccuguugcgucauccaugucauggguuauugugaggauaaaacaaggccguauucuaaagcauuuuugcagcaguaaaauggcucugucuucuacaggauacauucuacuuuuagggguaaauugcaugguauuaguuaauuacauauuccuaacggauugugaacuuucucaugguuggcauucuugucaugucaaaauaauguuuugccagguauuaucaucacauacaauagcauuucuauuggagcaaaauaaaaagcucauuuuuuaaaguuggcgauaccucacauccuaauuaguuucagcugaagauaauuucagaaacuucccaggcgcuaguucccuuguauuaggaggguugcugcagaggugaaauaguuguauauuccaguagcuauguuuauuuaguucacacauuauaugcaguuuaucuuuuuuucauuuaaucuuagugauaguuguggguguagggguggauuuuguuuuuguuuuguuuuguuuuuaauuucaguucuggccaggaaugauggaugaacucuccgaguugagagaauucuaugauccagauacaguggagcugaugaacuggauuaaguaagaggauuuuuuuuaacuuuuaaaauuuuaagugccuuuuaagagucacuauagaccacauuucguuuuggggguuuuuuguuuguuucugaaucuaauuacgaagaaacauucguccuuacuagauuuuucuuuaaaacuccauauuugaaaauaaugucuuucuauuuaagaaauauucucuccagcuauaucucaugaagaaaggaaaauacccauuuggagaggaaaaccgauucaauaaauaaauuucaaaccacugacagaaauggcaauaaaaguuuauaauaucuguugaaacuuaaaauuugaugucucugccaauuuuauguuuauuauuuucauuuuaauaccauucugauuuuccacuaauggugacacuugaaaguauucuuucuggccgggcucaauggcucacgccuguaaucccagcacuuugggaggcugaggugggcugaucacccgaggucaggaguucaagacuagccuggccaacaugaugaaaccccgucugucucuacuaaaaauacaaaaauuagccaggcaugguggcaggugccuccuagcuacucaggaggcugaggcaggaaaaucacuugaacucgggagguagagguugcagugagucaagaucgcgcuacuacacuucauccugggcgacagagcaagacucucucuaaaaaaaaaaaaaaagaaagaaaaaagaaaaaauauucuuuccuuguuuuuuaaauuauacuguaaacuccaguuaaguagaggcucaugacagcucagugcggauuucauguuaacucaucauauugccaaagccuaggaccagagaaaauuuuagauacaaaaccuggaacuuuccgucuugaauaucauaaugcuuuaguguccuauuggcucuuauuucugccggcacuuuguuguuuugccucagcauucagcaucagaaugaaauuuguguauuucaaagcuuuauuaacaaaaccugccucccaccagcaaaaauaaacuuuucuacccagagcaccauuccuaugcccuggaacacuguauuucccuacuuuuaaccagaaagcagcaguguaauuauucacauguaaauagaggcugugcaucacauguggugccuucugaaagcauuggcuggauugucugcgucccauggcuaaugcuuacucaccaguacaggucagcccugcgugucugcagagauggucagugcuugacagcugaggccucccuagggcaacgcauggaucucauagagauuugucuaaaacauacacauggcuuugguccuaaugucggacuggguuugacuagaugcagugaguauaauuuuucacauauuucuggugcugagagcacuaagcguugcuuugucuuuauuuaauuuuaaaucaugccagacgauuacagaguaaauaauuccuucaguauuuauuauguacaaggaaagagaguuauucguguaaaggaaagcuaauuacuuuugcauuaacuauagucagcuggaaauuuaugacguacaucugaaguugaggcugauauuuucuguuuucaggacuaugcuguugaaaucaaugcugaggaccccugcuuucugguagcaugcugaagguggugggucuuccggaucuccuuagauuagcaccauaaacaccccagucuuucaggaauuaauuauaaagucauuaaaaauguauucuagcagagccccagguuaucuucggcagucucagacuagauauauuuauuuguagugccuuuauuuuuaugcuuuuccccacagaaaauuaaaauaacauuucuggcucugaaaaacuggaugagagaugauuccagguguaaagaagagaauacaaguguccuauuucccucguuugggaggugauguucacuccucagacccuccuuuugcuaacagcucgucucccuguagugcuuuuguaguagacauauuccuuuggcuuuuuuuuuuuuuuuuuuuuuuguaauucucagcaacugaaggauuugccuuguuccaaaaaauuuguucuauugugaucuagucucagcuuuuuccccuaaaauucuucaaaucuaaauaauauuuuuguaaaacuagcugcuugguauguuugcaaaauaagcauaaguggugaugaauguaugccaaaauagggucuauguagacaucaaauauguuuguuuaaaucaacacucaaauccacacuggccuguagguguggauuccaaacucaagugacugccuuaauauucuuuuaaucugcccugauuucuucuguuuuugaaacguaaaauaugaccuucaaguuucaccucacugcuuugauuagucacacgguauccauguuauuagcaaguaugaguugugcuggagaaaaggcugcggccuaaggacucuuucagacgcaugggcugugucugaaagagucccaagacgccuggcagagaaccagcacugucccugagggcugccucuguccuccccagccugucuuccugucugcccuguucccagacagucaaagcagacacacucaaaugucugucuucugcccaugcaaucaucacggcaucuaucggacaggggcacagccuccauuaggggagggauggcuguccuugggaugaaucacaacuagagaaauaguggccuguggaaacccuggggacaccucaagugacccuccauuuuggcacagggcaccccuuacgugacguguugaaaagaagcuuauccauccucuucaucacucacacaccuggaagugucccgccccguguccuugcugcuggaguaagccacaccccacaugaggcauuacguugugcuccuggacacagggcuuccgcuuggagauucaggcuuuccaaguauucucagagggcuucucugcuuuaaggguaaauugaaagaugugguugccucagugggaguugguucuuuucuuuuuuauaggcugaagagauauccucaagggaaaauaaagggccuuaccugagggugacacuuaacaugagaagggucauacccaagggauuggauuccugugaagacucuuaaagccuuaacuaauuuauaaaguuauuucacaucugaaguugugcacuuauuaauauaguucagcagauguucaucgagccccagcuguguaugggcaccgugugaaguguguggaugcagguggcgcuccacugcagcugccuuucacuggaguaaccgcugggccucgccucagcacaauugcccucauucuuuucucccgaauucucacccucgacuccauuuuaagaucuucaguggcuuagcaaguucagugggaaaguuuuuuuuagaauucuaauuuuuaguaauagaaaauguuuuaugcuuuccuaucuuuagcuccuaaaaggaguagagauugaagcuucaguaugaaaccaacaguguuuagggauuaaguugcucuuuuuuacaaggauggugugacauuugacauguuguuaaagucagggccccaggcugcgguagccccagccgccuucccuaagagcugggaggcauguccagccuuccacaccccagccuuugugcauucaccugccugcugcucuccacgcuacaccgaugcauugcaugccuuguuuucaagcagaauuaaaugcauauauucauauuuacccuucucugcugauaagguuuccuggauacaaagauuaaaaacuuggauuuuuuuuuuuuuuuuugccuucuggugucucuuucagcaaaagucaggcgguaguuuuaaagguuuucugugcaauuagaaagcacguuuaccucagcaaggcugaaugcaaccacaaucugugguuucuaccuuguuccuuuguguccuugaauguuucauuuuucguuccugaaaauuuucuucugacauuuugcaaauaagauaggcauaucuauauauuugcauauuuugagggaugacauuuuagcuacuucacuuuaggagauuuucacuggaaauagucucuuuccaguaaugaaacccgugugugcaguauuuucucaaugggucugaaaaaauggaccaacuuucuuucacauuuaaccaaagcagaaaguucguguauauuuuaaauaugauguaggcuaaguucagaccuuaaaugccuauaagccucuuuucuauuuaaugaaucauuuuguaguauuugcauaauucuauaaauuuuugaaguguagauaaagcaaauguucacacauuauauuauaaugcucaguuuccccauuaguucaacagcaauuaacuuguugaagcuuagagcuucaaaaauaaaugagauuauuuguucaaaaugccaucaggucuuccuggaaugacauuuaaauuauauaauguaaauccauuugaccugugaguccuugucauuauuuagugacauuucuuacagaacaaauugugugcagguugggcagccugcuauggagcuuggcagagagcuauaaaaacaaauuauccuuucauuuuauacaucauuuguucaaacauuuguaaaaauugcuuuguuuuucuauaauagagaaaugucauucagugguuaaaagcacauuagcuauuuuagauacagaccacagacuguaucaggcaagagugucugugaaggaagagcacccagcauuauguccaucacugugcauguuuucagcuaaggacaacggaucccuucucccuuugccugcuaaauuuaccacaaaauagaaaggacagugaauauaaguaucuuuuuaaguuuagaaaugugugauuguuuguuucucauuuuguuccacuuugcuuguagcuuuuccuuuggcauuugccuuacggguagagugaaguauuggaaguagcagugauauuucccagguuuaccacggagcuggcguaugagacaaagccacauggcauggagggaagaagcaucaucccuacuguccucagaagucagucauuuucaaauaaguguuauuuuugguuuuauuuuauuuauuuuuugagauggaaucucugucgcccaggcuguagugcaguggcgugaucucggcucacugcaaccuucaccucguggguucaagcgauucuccugccucagccucccagguagugggacuacaggcaggcgccaccacaccuggcuaauuuguguauuuuugguagagauggaguuucaccauguuggccaggcuggucucgaacuccugaccucaagcaaucuacccaccucagccucccaaaguguugagauuacaggcgugagccacugcacccagccagaaguauuauuuuuaauucaucuuauaggcaugaggauauauguauuuuacugcuuuaaaauaaagccaaguccucagugaaagaguauguuaacaauccagaugauuguggcacuaacacauuaaauagauuacacuucuuuuaaacuuucugacuuuuugcuaauaaggccagacauuaagacagucacaacuuaaugagcuucauuccauuuuuucuuucauuccccugagcagccaugugucacucgcucugcuggugauggcccugcugcugccuuggggcugcaccugcuaggggccggggaugggagccacucaagagcucuuagagccugcugaggagagagcaucuucagugacugcuguuucauuuccagcuuagcugaaggcuugcaguaagcauuaguaaauacgugauacacuaggcucacuacagcacuggguuauuuugaaguguuugucuguaaugggagcuguuaaguaagcuuuuuucuuuuuuuuugaguuggaguuuugcucuguugcccaggcuggagugcaguggcacgaucuuggcucacugcaacuuaugccucccggguucaagugauucucccuccucagccuccugaguagcuggcauuacaggcacccaccaccacgccuggcuaaguuuuguauuuuuaguagagacagguuucaccauauuggccaggcuggucucaggcuccugaccucaagugaucuccccaccuggccguccaaagugcugggauuacagacaugagccaccacaccuggucuaaguaagcuucuugaagacagguugucauaccauguuugccagcccagcacguaauagacccucagcaauauuuuuugaauaaagaacguuauaacucccuagagggcaguuuaggacuuugggcauuuaagccuuugugaacucuguaauucauccaagggcuaugauuauaguccaggaggcaggcugaaaccuuaaucauuagcuguggcuggauaacaaggccugucaucucugcuguaauuauaaacugcaugcuacuauagcuuugugcaucuucuuggugcugaagcugcacagagauuccuauuauacauucaaaacggugauggugagauagucuugugauuggaauggauguuggaagcucagcugccggguucgucuuuuguguagaaggccagcuuggcacuguucaggcagugagacuacaaaccaggaucauucgccucugauagcucucgccuccaccuccugcucugccaggcguggaaaccagacucaucauguucucucugcauccuaaaucugucuaguucagaggaccaaagacagccacuuuuuggcaugggugugucaaguuaucguaucguugauugcuguggaauggcucaugccaguugagaguauucaaaggaaagaagccuggcuuggaaaaaugguggcacuuuaaaaaacuaauauuuguucauacuuguuuccuuuagcaauuacacucuagguaaggguagcacaguacacaaggcccagaguaaguguuuaguaagugucaguugaauuaaacugaauuucaguaaaaccuuucacuaaggaauucugugcaccuucacguuuucauugaaacccucuuauuccucugaccaugugggacagaaugugagagagucccuguaaauuguugauacggggaacagagcuaacaucuauuuguucuuguuccugggucugucagaaugacaagcucucaagugcagccaagcucaugugaaacuuuuuuccugcuggaaucugcauucuagacucuggcaugggagaggggaugcauauuaugugucauuauguaugcucauugucauuccagccacuuuuuuuccucacuuaagaacgcuuauuggaaugcaagugaaugagagugucauuguuagaaagaaaaucuugaauuuuucaaaaguaaacuauuuguaaaugucacaacuugaauugugggaugucuugcuuguagacauccaaggccucuguuggauggcauucacgcuggagucuuagcgcugaguuggaauaaauaaaacauccuggugggauguaugaaugugaugaggcuucucuuagaaaccgcagcaccagagcuaguugcgugcccugcuccaaaaccauggagaacagccugccauggcuuuuucugcagaggauguugaauuuuaaugauuuuaaauaaacuccucauaaccaucuuccucauuuuaguucaguccagcaggcacagacuccucucaaugcaagaaggauaaacgcagcccgcaguguccucagugggccucugugggaaauucugcacucaggagaauccccagaagagagcucuuagggccuccugagaaauuaacuccuugaccgcuuacaagugacucucagguuuccaaaaaaaaaaaaaaaaaaaagaggaaaggaauuaaaucagcuacuaagauuccuuuuuuccagggaggaaaaaggaaaaaugcuuuuccuauauucugggagucuuuucuuggucccuagucccugccccucacaccccuggaagacagaaaaucguagcguggugggaacuggaaagugaguuugugccuuaguauuagggugccccguguuccuuaaacugcauauaguuucucauaaucaggaccaaagguauauguaaaauaauugcguuuucacaucagaaguauuuguguaucccccauauuaaguaauaagauauuggcuauuucagaaucuuguuuccauguuuuguuguuguuguuguuguuaauucuguuuuuauuuauggugguaucugugauuuuuuuccuuauugcuuuuuuaagcaaaaacccuuggaacugacucaugaucaccugcaguuucuggcuugaugauuuguuacauguugcucuagguagcucuuuuguuaaguucaauacgcaaagcaguggcagucuuuuagguuauuuuuguuagacucugccccucuggaacaauagcaggagaggauugugggucuuggccuagaagccuggacucaagagcuacacugccugccuucuaagacaauuccuuauaaaaguaaaccuagcaaaacaguaagaaguuuccccaccguuauucuggugaacagucaaaaucauacaaaacauuguuguaaaaaacauggggcuggugcaaaaguaacugagguuuuugccauugaaaguaauggcaaaaaccgcaauuacuuuugcacucaauaguuugaguacaaaucaaaaccgaagcaaacucccguuuuuuuucccugacucguaacacuugguaacauagcuggauucuucugaaaaaguuugauauugucuucuuuguugucuuuaaggaucucuuaacagugggguuaauucagacucuaaaaucuuucagcucuaacacuccaagaaaggcuguguuugcgggaagcaugcaguugcuggccggagucaagcugugcacgggaaggacccuaaccaaccacccgcacuaugaagacagcagccugagagagcggaccagagcggugaggcuccccagugccuccccucgcuucuugugggccagcuaugggcugcgugucccuaugugugguaaagauggggcugaaugcugcacccuccagcauuagguuaggaggaugaauuagucuguuuucacgcuacugauaaaggcauaccugacacugggcaauuuacagaagaaagagagguuuaauugacuuacaguuccacauggcuggggaggccucacaaucauggcagaaggcaaggaagagcaagucaugucauacauggguggcagcaagcaaaaagagagcuugugcagggaaacucccccuuauaaaaccaucagaucucaugagauguauucacuaccacgagaacagcacgggaaagacuugcccccaugauucaguuaccucccaccaggucccuaccacaucaugugggacuucaagaugugauuuggguggggacacagccaaaccauaucagaggggaaaucagaacguaagugcacagggcucgcaucuccugguccaggaccucugccugcccauauccacuaaggacgugccauuagaccacagguccuccccaggucgggaccucugccugcccauauccacuaaggacgugagguuaggccacagguccuccccagggaagaaccgagaagacacacgccuugagaugugcagaagagcgcauuugggagcaaagcuuuuggauuagggaggggaaggaaaaggcguugaggcauacuggucacguuucuuauggaccuuucugaagucugggguuuuuguuuuuuaauagauaauaauacagucucauaguucaaaauucagaacauacaaaaggaaauauggugaaaagugccucucccauuauugcaguucuuaguuccccuccuaggaggcagauaauguuagcaguuucuugugucuccuuccacagguauuucacgcauauacaaauaugcggggaggguggugccccuuucuccauuuuuacagaagaaguggcauucuacauucugcuucuucggcauuuaauguguuuuggaaaacauucuauauucaguauauuaacagcuuccuuccuauuuuuaaagcugcuuaauauuuuacauggauguggcauauuuuauuuagccauuucugcuguuucccugucuuuugugauuauaugaacaaugcugcagauaaacuugucugcacaucacucuuuccaggcacggugucugucuguacagcagauucuuggauggggaagugcugggucaggguuguugacaucuguaguguagaucgagagauguuaucaaguccucucucuacagguuguaucuguuuacauucaagucagcagugcaggaaggugccuguguuccuucauccucaccagucagguuucaaacucauaaauguuuccuaaugucacuuuuuucauguuggcgguugaaaaguuguugaaaaagucuuguuuugaggugagauuugacuagccuaaaagcagaugauuuuuacuaaucuccugucuuguauaagaaucauuugaauucagacuccugcuaaaauaggaauuuuuugaugggcugaaguguuccagauaguuccaaauuaacuaggaggaugcaggaaaggggcucccuggcuuuccaggcaccagguucaucagggguggccucuacugcuuggacuggagacugcagaaaagacaggucgagugcacagaacguccugggcaucuccuuuccugucucaguacuaggguuaggccccacacacugacauccucaaggcccuacggcucuucaucaggacccuggaacccuuggaaugccuucagccugagaccuugugcuggacuguaggacaacacaguugucacaguaacagcauccuaccucccuaccauuucacccauccauguggacacaucaaguuagacccucaagcccaaaucagaaaucuagcacucgaaaucagggugcaacaaaggaggcagugccucucuucaugaacccccacauucaacaccucacacagccuguuuccauuccagccccagaaucugggacgcucaguuugcauccauccacugaggguguguggcacugguaugaacgugaagggggccuccuguggcguugcccacggugugcugcaaguggcucucaccccuaggauggacgagagggagaggagcaguggggucucucaauuagcugagaugcggaguagcagguaaagcagccaaugcugccccagccuaggagcagagacccuacagggauccuucuccccaccuaccaguuucagaagcuggggcucugccuuauugggacgugugucccucagacugucccaucacccuuaaugggccauuuuagucuggggguccccuuuuuaaagguagagacugugucuuauuuacucagcccugucauuuaccuugggaaagcagucuuagaauuggugccuacugaugaauauaguccugacuugaaguaauacauucugaauccagauguguucuuccuggcucacucucuucccaaggccgagcacucacagcguucugggaacuuccacgcacacacuccaggccugcaaaugagcgagugcagcguggccugggcuggagagagcaccuuggguguuaggucuuagacucagcccuguggaagguuacaucacauaguuaacucccuggcagucaaguagcauuugccacauugcauuuuuaugucuuuuugaagguuuaucagauauaugccaagagggcaccagaggaagugcaugcccuccuaagguccuucggcacugacuacguaauccuggaagacagcaucugcuacgagcggaggcaccgccggggcugccgacuccgggaccugcuggacauugccaacggccacgugagcaugcugccucucccugugugggggucuccuggaggggcgggacucugauuugaauccuaagaaugugaaucuuuuuauccuuaaugucuaguugaauuacgcuacgaaucaaguauuugcuuuuucucuugcuuccuacagaagcccucucuuggcacuuuagugacugccaccggggcugggcaagggagaggugagaggggagcccuggguccccagugucacaccaaacagagcagcucugccuucagcucauuuguaugauggggcucugcauaaaauguaucugugaaggauuuugcugcuauaaacaaaaccucagccuuuaaacccacugcuccaacgcuucguauuggcuagcugcugcauggcagggaugguggggcccuccugcccuccggucuaggugguggauucccccuaccccuccugcccucuccuacugaguguccuguguccacugguguguuuccacaggccggcuuucagaggcuaaguugcacuccagagcagaaaagcagcaagccgcuucucccuucucccuucugaggaaaguguucuuggagcuaugccaggucucaguagagcaaacagauuuucacccuuuagaggugugaugugugcuguaauuaaugguaugaaagccaauagauauuuguaaacaaguuggacaaagugacaaaccuagccuaaauuugaaaaaaaaaaaucuugacuguacagaauuugagauucagauuuuugcccgaggagaaucauaguucauaacugucuugaguucagaggugguacagaccagagacauccauuuaaauuuugauuugagcgugacuuuuucaguuauuuauuuauuuauuuauuuauuuuuagagacagggucucacucugucacucagacuggaaugcaguggcgugaucuuggcuuacugcagccucaaccuuccaggcucaagugauccucccacuucagccucccaaguagcugggaccacaggcauacaucaccauacccagcuaauuuuguuuauuuuuuguaaagauggagucuggcuauguugcccagaugagucucagacuccugauccaagcgauccuccugccucagccucccaaagugcugggauuucaggcaugagccaccacgccuggccuaaaugugacuuuuucugaugaguuagagagcuuucucugaucacuguaguucucuguauuucauuucuaugagagagacaguauaguauguuccugagagcaagcagaccugaguucuaguucuggcuuucccguuaaugggaucaucgugugacgcugcacucuccuucucagccuuggucugcacuucugaagggggaaaaggauggcccugaugaucuccaggugcccauggacauugaaauaauauaauuuaauuucacucacauaccauucuuaaacccaauacccauuccugcuccuacugucuuuuguaaauagaauuuuccccccaaauuguauuuggguuuguuuugguuuuagaugauggauggcccaggagagaaugauccugauuugaaaccugcagaccacccucgcuucugugaagagaucaaaagaaaccugccucccuacguggccuacuucaccagaguguuccagaacaaaaccuuccacguuuacaagcuguccagaaacaaguagcgcagauuucugcccagugucuauuuuugauacggagaaacugcaucaugaugaaacucaauagaugacguuuccuauguaaguagguagcccaaaccuucaagcugugauaugaguaaguucuacagauguuuacacaaguguugccaucuuugaaagcaucuucuacaagcagaagucuuuuucguugugugucuaucuuucucauuaauguucuuuagccuaaauguuaacaacuuucuaagagugaccuagaauuauguuguuggagagaaugauguguguuccauggauaccuggauaggcacauaacauguuggaagaugagcaccugcucaggauuugaaauacguuuaauuuucaggugacuuaagacagcuaugauugaaucaacuagagaugaugaucgacuuauuuaauaugauuucacuggugaagaccaauugguagcuuuuuaaaaagcacuuuaguguccuguuuuaccuuaaaauguuauaauauuuuccaguugucaugcugucaacauuaacaaaaaaaaucauguuaaggcuuuguaucaaacauuuuguuacacucugucugaaauguaauguggaguacuucagcaguaugugucauguauugugugugucugugugugugcaugugcacacauguguuuuaaugcugggcacagaaaaguguuacaaguuccauaucguaaguccuuaaaggggcagaaauauauguagccaaguagaauuuauuacauuuuaguguuauuauuuuaaaacuuacugauacucuuuaaccucuccugcaguaauaguuuugcuuuauuucuuacucauuucaauuuauuggguuugcaaaauuuuguaaacuuuuuguguuuuuagccuuuguauuuuuuacagccuagaaucuugcaaagucugaauauuuuuuaaauguucuaucuuaacuaguucacuaauacaguauuuuuagcagacagcauuuucagacagcauuuucauaccaaguuugacuuguggucuccaaucuuacugggaaggcccugguaguguaauucuuuuccuuauuaaaagguaaccaagugccucuaagucaugcuuauuuguaaacaacaaagaagaguauauguaccugcucaaaauuuuuuugauaaucgcuuauauaauuaauuucuaaugaugaggacauguaaaaguugccaguaagaacauaguaugcauuuaauuaaaucaagauggcuaauggaauuaacuuucuccccuguucuugccagguggaaaugauuuaagcauuucuccuugcaguuguauugaaguaaauuaccauaggcaucaagauggcugcaucacauuuucaaaugauuuuauauucaguugcuacuuauaaagcagcauucaaaaagucuuuuacacugucauguuggacacaagcagacucagcuuuuaucaaaacuuguuuaaauaaaaaauugacaguagcuggguuauuaaauuaugcaacugaaacuccugaauuauaucuuuucuguaucccuuaauaagauuggagaccacugccguuuaggauaauacaauaauaaaacguuuuaaucaguacuaaaacuuuaauuaagccaauaaugaugcaugccuguuguagcugacagcaugggucaguacauccuucagcgagugccuuacucuaauugaaaccaagcacacguaagguacaauauguuagacucugugauuuuguuuucaaaauccucuguuauggcuauauuuaaauuuauuuuaaauauuccuguauguauucaucuaagcauuugggcauuuggagucuuaauauacaagaaacacguacuuaaauuuuuaugcuuaucaccgcaaugauggcaaacagugauuuuuuuuuucauaguuuaggugucauuguugccagcaccuuuagugcucagucuucagugaaaaauauaaagugccaaaaaaaucuugcaagacagaauccauacuuaacacucuuuccaagacacugugaccauguacaguagcuauuuccugaugaccaaaucucucaacgaaucauguuauuaauaaauauuuuuagcacucaucaguauucuccaaugugaccuucucauuggaguacacagaaggaaagcaaagaagagcaucugacuucuagcucuggcuuacagccucucuaccaggccgaagcaagagacccgcggcagcagcuccccgccacucagaccuggguggugauaaccucaaagaauggcucuguuuucuauugacagaaaacccacuugauuuugcuucugaguuagcagucagaagacccucuaaguacaauagaagugcucuuaacggacucugccugugugacucccaggccccggagucuccaucucucucguaagccaccugccacagcacagcuggaggcuguucucugguguucucagcgcuccggcucccucccuggaguugugcacccgucccaaacuccuccaugcaaguucugcuuccucuuauaaguacacaacucaguuaaguauucacauacacacagaaaauacgggugugaaaagaaagaauuuucuguaaaaauuaaguugaauacuuugguaaaaagugauaaaggcugaguugccaauaaaaguugcuuuuaaauuagguguggcugggaauauuauaagauauuggggaaaauauacaaaucaagaaaauuucugagcuuagauugcuucauagauuuauuuaaguacucaucccaccuuuaaaaccucuaaacugagaagaagggacccaaaucauguuauuggugugauuuaugugagaaguagaacuguagucauuggacccuuaggcaaaggaaaauccgugucuuuauaucagaagaucggcaaacgaauguauauuacacaguuuagguuaugauucccuacuuuaaccuacuuacuuuauuaaaugaccaacuacugauacugaucacaauaguuauuagagauucuaauuuaguuggaagguucuaaucacuuucauuacaggcauuugaaaaauagggauucauuucgaauauauuagccaggagcauaguuagauguuacccaggccauuuaucauccuguuaaugaugauuuucccgacccuugugagaucagcgugacaggaguguguguguguguguguguuucugugggugugugguuuugguugggugcugccagguggcaaaggcauauguaaauacaucugaucugcaucuuuauuucacaguuaacuaaaaguaaaaaugucuauucugauuccauauugauuuugucuaagauguaaaaauuugaguucaucuuuggccaaaaccuaccugaauuaacauacaaaauauuugauuuuuaaaauuuaauucaaaucucaaaaucaauuaaguauucucagauccuauaucuugguuaauaugcucccagauacuuuaaacauggcaaccuuuuggccuaagagaauguuuguucauggaaaaaagcuuuugagaugagagggugucuuacuuucuuguggcaauugauuuucuguuuuaacacccuuuggguaaaaucuugcaaagagcuuuuauaauuuguuuuacugaauuguauggagauuguauaccaaguaaagcucuuuuaaauuacauaa

SEQ ID NO: 191756 - RNA, 16171 nt, Homo sapiens
uacuuuuaaauccagcaauuucacuuugaggaaugaaucccaaagacuauauaccagaauucaauaaagagaauauuaacacaguauuacuguaauacuucagcauuacaguaguaaaaauccacaaauggaauucacaccaggcacaugguuaggcacaguggaauauuaugcagccauuacaaauauuuacaaggaauuuuaaauuacaucaaaaauauuauuuaacauucauugauacagguguucaaaggggcauauaggauaagaaggcaaguacguuagaaauauacauacauaggccgggcgcaguggcucacgccuguaaucccagcacuuugggaggcugaggugggcagaucacgagguaaggagauugagaccauccuggcuaacauggugaaaccccgucucuacuaaaaauaaaaaaaaaauaaaaaaauaaaaauuagccgggcaugguggcgggcgacuguagucaaagcuacucgggaggcugaggcaggagaauggcuugaacccaggaggcagagcuugcagugaaccaagaucgcgcuacugcacuccagcccgggcgacagugcgagacuccaucucaaaaaaaaaaaaaagaaaaaaagaaaaaaauauauguguaccuacauagcauuaaaacaauugcaggaaagacaccaaaucuguuaccagcaguuuucuggguugugaaauuuguaguuuuuauuucauuauauuuucuggguuuuucuagguuuucagcaacaaauacugacaaaaggaaaugaacaguuuucagagacuuacuuuaaaacagaguuaaaggaauacacaugaaauugguaacaguggcugccucuggggucggcauaggagcaggccuucccuugcagcuugcgcccucccguaccuuuuaaauuuuguaccaggcagguauuacuuauucaaaaauaaauaaauuucuacaaagaagauacagauauauaaauacuaaaaccacaggagcugagaagcagcgcuugauuuccugggggaaaucaagaaaagugcuuucggcuccugggggagauaagacuccagguucaggcugcccuuuuaggcccaaagccuccaagucaccccaggacccagcuaguuccagugucuucacucagcaaggccugcuccaucggacacaaaacugaucaggaguuggaccaucuccucccugggcauuuuucccugcaguaggggugggcaggcugugggaggggcugcaguggacacugggccucugagcugggaccaccuguguccccugggccugacacagaccaggaccugaugcacgaguaagaaugaauggggcccaaucgccuaacaaaggcaacucaauuucagccccgauuguuccagaaggauuugcuguaagcaaccggagaaguuggcauuuguucaacauggaaaaagugucccccaacuuugaagcacugaaccaaacaucuuuguugagguuucauucucacgauaucugcaaaucaacguuuuuuccuucacacuaaaaacgggcaacuuuagagcccacuaaagcuauacaaaauugggagggggcaugcucugauuuuccauuuuuaguuccaggguccguaugcaggacuuauuugcaggaagagcaggaaugaucaguucaacaagaaaagccacacucaguuuucacagacagacaaccccuccuucccaccccugcccugucccccaucaacuuaaguggcauauaaaugauuaaaguggcuucauuaacuccaggaguguggccugugcuagggcaccugauuugugcuagacgaggccagcagaagagcaaucgcucugcaagagaaaggcucggcccuuccuuaaucaccauggguuauaauucacccugacguccuuacacacauggaggugccaggauacugagcuuuccuauaagcagggccucagcagaagugccucccuccgagccuccagggccugagaggagagccccaagucccugcccugccccaggaccuggggaccaaggaauaacauuuuuuguagagauggaggucucacuauauugcccaggcuaguuucaaacucuuggccucaagcgauccucccacuuuggccuccaaaagugccgacauuacaagcaugagccaccucaccugaccuacucuugcauucuuuaaagccacaaaucugguaccuucccucuuguuccauuuguaagacuuugaauauuagagauauuuuacacauaauaugugggaaaauggcuuuuuagaaaaacauuuauuguaaucgaucacauucaagucguaguucugaaagcaaagugaaaacacacaguacagcuaugccucaguauccaugggggauggguuccaggacugcaaccucaacccucagacaccgacaucugaggaugcucaagucccugaugggcaauggcauagcguuugcacguaaccuacgcacaccuuccuguauaauuuaaaucaucucuagauuucuuauaauaccaaauacaauauaaaugcuauguaaauaugcuacaccauauuguuuagggaauaauggcaagaaaaaaaggucuguacguguucaguaccaaugcaauuucuuuuuucaaauauuuccuauccaaggcugguuggaucuaaauguggagaccacaguuacggagagcugacuguacuggggaaaucuuuaggguagaaacauuucuuagagaugguuuauaucacaccacuucagaaagagcaauacaggcauaccucauucuacuaugcuuugugaauacuguguuuuuuuuuuaaauugaagguuuguagcagccuggcaucaggcaagucuauuuggcaccauuuuccaacagcaugugcucacuuugcguuucugugucagcauuuugaacaguaaauauuuuuaaauuaagguuuguacauuuguuagacauaaugcuauugcacauuuaguggacugcaauaugcaguaaacaugacuuagaugcacugggaaacuaaaacaaugcgcuuccuugcuuuauugugauguuggcuuuaccgagguggucuggaacugaacccacaauaucuccgagauauaccuguacuuuuuacuaaaaauauuucauuugagaaguaaaccucaagaacuaccaggacuuuucagaugggaagagcgaggcccuggcagggcgagucuaggugugcagccuagugggggccggggucaaguccacucgguauuuguggcuucacucagcaggccgcccguccccuccguggggccauucgacagucccuggguaggggacgguugcacuaggagguaaacaugauuccagcaugggcugcuccaaggcccugagaccccaggaccugcaggggggugggauccaguccugcagcaggugcucugaagaggagucaucucccaagaugagaaggccccggggggaggaugaaguguggucagaccgucggcugagcgugaucacuuccccagacccaugcgggugagaggacucagcagacgccuccgaagccugcggcaggcaggccuuuacucuucacuggggggccagucagagggcugucauggcaggccagugcacaugccaccaacacaugcugcuucaucaguaauuucuggaacaugacacugcacagcgguggccucuccagcgggacauuacuaguaauacacugaugauguggagauuccccagggggcauccgcugggcuucucccaacucccaagccaccucuucagaaucacagagucauuuaaaggggccccccaccuccccggaggugcggccuagucaucauacuggaucucggcccgcagcuccuuggugacguaguucaccagcauggccagcagcugcugcugcagggccucgcugcccaugaccagcgcggucagcugcacggcguccguccacuccaggugccugaugauggcugcggcuucguuaaagagccucuguugcucggcagggggcagcuccauuaggaucugaggaaccggcuuaaacuguccacuugucauccaggcaccuaacagccccccgacagcccccccuagaaaacauggaaucguucaauuagugggucuuauucauaagcgauggccuuacuuaaguucccacugagugcacaccaccaucaccaugagcaggcacauucaugagcgggcugcagcgggcucagccggugccacgccugcuccgccagccaguguggagggcaaagguuuaugcagucuucuguccauuuggcucagauaauugacacccaacaugcauucccugggcuccacauuuaaggaugcaaaaugaagccugccugccccaucucccaccucagugcugggcccacuuucuucuucaugagcugacggagguuucugggcuuacuguaaaaaucccucucuaaucacaaaggagaaggcugagaaacaaaugcauuuucuuuuucuuuucuuuuuuuuuuuuuuuuuuuugagacggagucuugcucuguugcccaggcuggagugcaauggcaugaucuuggcucgcugcaaccucugccucccagguucaagcgauucucccaccucagccucccaaguagcugggauuacaggcgcacaccaccacaccuggcuaauuuuuguauuuuuguagaaacaggguuucaccauguuggcaggcuggucuugaacuccugaccucaggugauccgccuaccucggccccgcaaagugcugggauuauaggcaugagccaccacaaccagccacaaaugcauuuucaagagaaaccaucucaggcugggugcgguggcucaugccuguaauaucagcaauuugggaggccagggcagguggaucaccugaggucaggaguucgacaccagccuggccgacauggugaaacaccaucucuacuaaaaauacaaaaauuagcugggcuugggggcacaugccuguaaucccagauacuuggaagcugaggcaggagaaucacuugaacccgggaaguagagguugcagugagccgagaucauacccuugcacuccagccugggugacagagcaagacucugucuccaaaaaagaaaccaucucaguggugagacugaauuuccuccaccaggcagcugauaugcuccuugccccugaacuuagaaaaucuucagugagcccaugugguuaaaggaccuggggacagauaaggaggcucuuuccucuugaagcagugcuuuucauagauccccuccaaguuguaugaucgauaaauaacaaacuggccgggcgcaguggcucacgccuguaaucccagcacuuugagaggccgaggugggcgaaucacgaggucaggaguuggagacuagccuggccaacauggugaaacccugucucuacuaaaaauacaaaaaauuagccaggcauaguggugggugccuguaaucccagcuacuggcugaggcaggagaaucacuugaacccgggaggcagagguugcagugagccaagacugugccacugcacuccagccugggcgacagagugagacuccaucucaaaaaaauaaaaauaaauaucaaauguaagguagcuuacuauuucuacuucugccacccuaaaagggcagaaacauuauuguuaaauguaaacucauugccaaggcuaugucaugcuauucugggacuuaaagaccuuguauccacggaaaguucuaccugaagaggccacgugcagaauauggugcagagaagcggaaggugcccuagggaagggguccaaagucaagugccuccaagagccagggaggaacuaagaagagugaaggggcgguugggccuuacccggccucuccccugcugagauuggauggguggcaggcucugacuucaucccagucuauagucugggccaaccaagccuugaaucgcauggaccuuccgaggcccaggacacagaagagcuggacagcuugguuccuauggaguggcaguggcuacuucacgccaguucauugcuaccacacaaaauaccagauuuguagcuuuaaaacaucucacgauuuuuaaauaucaccaaucagauauuuaaagaugaagcccacuagacuuagugacucacuuucaacagacagaguauggaaagggaaacagaaacuuugcaguggaaaaacccagcaaacaugcccuuaaccaaguguucaaggugaauaucacugacgucaugugaauaucacacacccccagaauuaaugcaagacaagggagaggggcaugucaccucccaggcaugccucccaaagacuccuaacuccagucccauccuaaacacaacuggcaaauucaaacugagagauguucuacgaaauaccugcccaguacuccucaaaacuaucaaggcugugaacaaggcaagucugagaaaguguuaaaggccagaggagacuaagaaagcaggcgauucaaugcaaugcggugucuuagacuggauccugaaaccaaaaaaaaaaaaaaaaaaaaaaggccauuaaugcagaaacuggugaaacccaaaucaagucuggagaaugguuaauaguaauguauucguugguguugguuucuuagguuuuuuuuuuuuuuuccuuagacagaaucucacucuguugcccagguuggagugcaguggugugaucauaccucacugcagccucaaacucuuaggcucaagcaauccucccaccuuggccuccuaaguagcugggauuacaggcaugaaccaccaugccuggcuaauuuuuuuuuuauuauuuuucguagagacggggucucauuauguugcccaguccggucucgaacugcugggcucaagcaaucuuucagccucaagccucccaaagugcugagacuacagaggcaugcgccacugcacccagcccauuuuaguuuugacaagcauacaguaauacaugugaucgcuaggagaaccgaaacuggauggaagauauacaggaauccuuuguacuaucuucacgacuucucuguaaaccuaauauuauugggaaaugaaaaguuucuuucaaaaaugcaacccaggccagagagaacccacuggcaggcuggacucagacaacaggcagcaaaaccagcgcuugcuucuucuggaagccaagcaccgaggccccuggagcagacaccaccccggguacugagcuggggccagccccauaucccagaggcugaaugccacacgcagacaggguucaccuccucugcaaaagaaaggcacauucugggaagggaaaaccagcuaauuuacaaguuuuacugaacuuuuccccaugacaccagugaaaugcuccaagucgacaagaguugcacucaugugcacuaaaccuuuaugagaacaucaauauuugauuuagagcagcacuuaaugcaaaaagucgccaggaauaucgaccagcaaauuacuggcucuuuggagaggagaaaauuccuuuguuuucaggguaaaaugaugcucccgcccaugaccagggacuggaaguagugaaucccccgggcucucuuaguggacauccuguucucuaccagcuuuuacucaaucugaauaaaauaugugcucccaaaauagcaucugggcacagcuauaugacaaaaugauccccaaagccuuccccugagcacugagauggaggugggggcacagaugcacagugucaucgaggaagaaggaaacagccuugucucccccaucuccgguuccuucccggauggcaagaugcugaagucaggccucacuaauucauggaguuuggaaaggaaaauauggaaagggaaggucuggggccacccacacauuuauuuuucuccucagugugagccucagcuuaacgaaauguccuugaaugucaaucccacuacagaagggaagaacagggcaggaacccggccagcgagcuggggaacggaagccaaccucagcagaaaaguucagcucucugacuccaucuaugguuugggccacagccccaggccagguagaccuucugaggcucaggacacaggaauucuuccuuccccaagccaaagaaaguaacuucaucccagcuccaaggaacaguggaaaaauuagccaaacuuucauucauugccugaaauugauucucaaauagaagcaggugguaaauggccaggcacaguggcucacgccuguaauccuagcacuucgggaggcccaggcggguggaucgcuuguggccaggaguuugagaccagccuggccaaaaggacaaaacccugucucuacuaaaaauacaaaaauuagccgggugugguggcacacacccguagucccagcuacucaggaggcugaggcaggagaaucacuugaacccacaaggcagugguugcggugagccgagaucaugccacugcacuccagugugggcgacagaaugagacucggucucaaaaaggaaagaaaaaagcaggugguaaaggaggugggcaggcccucuaagggugaaaggcaguucuuuugguggucucuuucagaacaagggagcucucucagagugagcuggcucacaugaaauggccacaccauaugugcugagaaggugcauggcuccucccagccuccucccugguuuccuuucugcagggaccucacagucaugaaggccaccaugggacccaggacacccugguaucuucagaggccugcugcucugauacuuauucugggaucccagcacugggggaaagaugccucuaggcccaaaugacacagaugccauuuacaagaguaccccacacuucugagacauucacacagaagccugcauuuccaauggggcaaauuauaucuacaaagaucauuucccagaggcaucuuuaacuccaccaacuccucccacaagacgcauggcaccacuuguacaaguucauuucucccuguguuucuuuucuuuuuucuuuuuccuuuuuuuuuuuuuucuuugagauagagucucguucugucacccaggcuggaguacaauggcaugaucuuggcucacugcaaucuuugccucccggguuuaagcgauucuccugccucagccucccgaguagcugggauuacauacaccagacacccgccaccacgcccagcuauuuuuuguauuuuuaguagagacgggguuucaccauguuggccaggcuagucucaaacuccugaccucaggugauccgcccgccucggccucccaaagugcugggauuacaggcaugagccacacugugccuggccuucucccuguguuucaacggcccuuuuaugacauccccgaggcuggcuaucucugugagacaccugcacuuaccaacggcgagucccggugggccgcccaccaaacccccgacgaaggccauggccccugugaccagggcacccuucccagagugcuugacagccgccuucaucuuccucuccccagaaagggagcacagcagcuucaugauguccuccaccaugauagucaucguggcgggccuucgagggagaaguucagagggacaguuucaaugagcauaagaguauuuccaucacaaugccacucuaguuccuagaguuuuaaggaagggucccccuuuucaggaaagcucagcagcuccaagcgccuguaugacagacagcauccagacgguggaaaguucccacagacaggacaggcagcaguuagugaauaagcaaauagcagcagcugaguggaugaaaggucuucuuugcccucugauuaacuucugacuuacgacagauuaaggagcaacccggccacauguucugcugguucaucacgagggagguggucugacccuucuggcauuaguggccuuugcacuggcccggggaaugcccugcacacaaagcccagcagagaacgggaagucccggcgugaggcaucugagcugaggccaagccagagccagggaagggaugggacccugugaccacacgggcacugaccugcagugggcccugagcagagggucagauaccucccuucuaagacggagacagucccuacaggcuggacucucagacagugccagcaggaugggcaggaagugccuggcguaagucuggaagccugcaggcucccgacccaggauggcucugaacgaacacuguuacuaacacacacacugggcugccuuaagcaacuguucuuaaaagucaacacaguuguacccaugggacacuaaaagcagggaaaagauaaagcagggagacaaagcaacuggagaaaaaauacaugaaaucauucccaggcuuugcaauauauaugaauagacagacggacgggcgaguagaccuuuagcacaaugaccuuuagcacaauccuccaggguagggaaaauguguggcaugcuggagccagggcagggagagacgggcucuggagagcccaaaggcugagaaaaucaaaggggccaugagguggggggucuccucagagcucuggcugagcccaaggcuccagcaguacuucccuuucucaccagcacuucccauuucauucuagguggaaauauugaaacaggugcuacagcaauucaacugaggaaguuauggauagauucuauugcuuauuaucuuuuuuuuuuuuuuuuuugagauggggucuugcuuuguugcccaggcuggagugcaguggcaugaucacaacucacugcagccuugaccuccugggcucaagcgauccucccaccucagccucuugaguagaugggacuacagguaugcaaucaccacgcccagcuaauuuuauuuuuauuuuuaguagagaugacuacuauguugcccaggcuggucuugaacuccugggcucaagagauccuccugccuuagccucucaaaguguuaggauuacaggcgugagccacuacauuugaccuuaauaucuuuggguuauauguuuuaugagguuuuuuuguuuuguuuguucguuuguuuuuaagagacagugucucuuguugcccaagcuggugugcaguggugcgaucauggcugacugcagccuugaacuccugggcuacagugauccccccaccucagucuccugaguagcuggggcuaaaggcaugcaacacuacgcucagcuaauuuuuuguuuucauagagacagggucucgcaauguugcccagccuggucuugacuuccugagcucaagcaaucuuccugccucagccucccagaguacugggauuacaggugugggccaccguacccagacaugugugcuuuucugacccaaggaugauccagaagcagaagucccuacuguaaaauugcucucccaauccugggauauaauuuugagcccagagaacaaacccaugaauccaugagaggaccgcaaagccagguccucagaacuucucugcagucccaggagagcauccugcgcuccugccccuguaaauuucccuucuuuuuccccguugguacacauuagaccugugauucuccacaagugcacgggaaucacugaaaaccuugucagauacagccaguaugggaggguaagauucugcauuuccaacaagcccccaaagugcuccucugaucucacuuugggcagcaagaccccaagagggcauaacgcaggacucugacauucguuacucagucuucaaauucagaaauugcaaacaagcaccccuagauaugucuuuuuguccccauggaguaugagaggcagugggagggcaggccuugugagcccugcucacauaagggacuggaggagcacucaggccugggggucccugcucuggcuacccugugcccugggucucccaaaaccuggucuccugcuuuccaggcccugcccagcuccuuugcuugcugacagguugaaugccuccuccuucuccccagaagagaacccccuuccacuauuccaguggucaagauuuguuuacauacaaaugucuaaacgauaaaauggcauuauaacagugucaggacugaacaggcagaagccaccuggaaauggggagacggagcgcagaaccugauuuauccagucaccaugguccugaaaagcuaucacacaaacaaaaugacauagauagcuagauagagauauacagagagguuuuuuuuuuuuuuuuuuuuuugagacagagucugcuccgucaccuaggcuggaguguagcggcgcgaucucggcucacugcagccuccgccucccacguucaagcgauucuccugccucaaccucccgaauagcugggacuacagacaugcaccaccacaccuggcuaauuuuuguauuuuuaguagagaugggguuucaccauguuggccaggcuggucuugaacuccuggccucaggugaucugccugccuuggccucucaaagugcugggauuaugggcgugagccacuacguccagcacaaaaugagauauauuugaaguacauauuaaaguaaccaaaggaaauaauuuuacaguaaaaucuuacaaaaagcucaaaauccugguguaaaauaucuaaucaccuuugagcuuaguucugguuuauauccagcuuuucaucugucaauuauauuggaaaaagagaggcacugcccaggucucaggagggccccuuuggaggcugcaaggaaccucccuuuccccgggcgugaagacccugagcccugccaugcuuggucugcaaggcuggcuuccaggccagcacccagacaccacucccaaaacagguuuucugcaguuuugggucugcacucucaaaacaguuucugcacagcaagaaaaugcauguagaaguggaaagaaggaaggcaggaaacagauacauaaccacuuuagcucuacuggcuuccccccccaaaaaaaaccuagcuuccgaccugcuccgaaugacuugaggugaaaaucuacagaggcuaaagagauguccuugcaaaaaugcuacuuccagcucuaccugcuccagccaggccagcaucaaugugagaggagagagagaaaucaauuaggcaaauaguuagggcaaggguccuuggcagaauucccuucuaacaaaaagcagccuaagaagucguugcccuuucaggaaacacagauaaggaaggcaagcucuaacacagaaagcggguccccugugugacauacagacauauggugggccccaguaagcacaguccucucccuucuuagaaauacucaagacacggccggccacgguggcucacgcuuguaaucccagcacuuugggaagccgaggugggcagaucacgaggucaagagaucgagacuauccuggccaacauggugaaaacccaucucuacuaaaaaaauacaaaaauuagccaggugucauggugcucgccuguaaucccagcuacuugggaggcugaggcaggagaaccacuugaacccgggagguggagguugcagugagcugagaucacaccacugcacuccagccuggcagcagagugggacuccgucucaaaaaaaaaagaaaaaagaaauacucagacacagaggcuugcauggcacugauaagaagagcuacccuggaccaggcaugucuaccuuggaguguucuucccccccaccacccaaccuuuuucacacaugcacaguaggaagaaauaagcaacauggaguaguaacucaggcuaagaagcccacaugugcacuagaaacaguggggcgggggacucagaaauucgcaccuuauguaaaugaagcaccccucccaccagcuuuucuauaaaaacccuugcauuucacuguaaaauggcaacccaucuuucugggaccccucucugauccagagagcuuucuuucuuuugcuuauuaaacuucugcucuaaccuacccucuggagugucugcguccuugauuuccuuggccaugagacccagaacuucagugauaucucagacaaugaggcagguuucacugagacacaagcccaggguucugcagaaugggagggccagcagcuaucacugcgugugugagggcaggcagaggaagucacuguguuuuaauaguccagcaccacggguagagauguuguggcugacuccauccaagguucaauuucuuuguaguaaucauuucagaaguuagagcauuaacaggcucuuguuggggaagaaagguuaguaacuccaucuccugagcccuugcuaaaaagcucagcuuccugaauucuccaggcucaccagauugagagggaagcccacccugcuccuucucccaccgcaaggcugccuuugucuguaaaugacagggaagugggugaggagggaggauggggacagaccuuagggggugggaguguggcucccccucccccacuguaucacaccuauuucacacucagauuuauccacauaccaggccuugaucacaggaagcccaucugccagccacagggaaggcaaaugccaacuggaagccccgguuucuugcaggcgcccaggcugcucugacagguacagagagacggagacaagcccaucucaccgagagcggccuagcuuucugaguuuggaccagauuguaagagauaagggagaggaaggcuucagauagcuaugaagagagcuaucugaccuccaaguacccuuuucuuuaacaaaaaauuagaucuggcucuugucaacauugaccucccaccucuccauaccccagcgcaaaggcaguagguggaucccaccagcaaacaguuuuggauuagcucauaguuguuguuuuuuuaaaacaaauuaguugccaauauuuaaaaaucaggagauuuugcaugcaccucagauuccugauuucuccugaaaaaucagaagaccagaucacauuggaccugccauucuguguagcaauggaggccagggcugagcaggggccguccccugcccacccccauacagcagggcccugcccucccuaccccagcuccuccuggcagcaugcaccuuaccuaucuacuugaucaauaaacagaucacuucaaagcuucucaaaguaucccucuuucuuuuuuucuuucuuuccuuccuuccuuccuuccuuuucucuuucucuuucguucucucucucucucuuucucuuucccucuccccuuccuuccugcuuuuuguuguugcugguguuguuguuguuuuuuccagaaacgcagucucccuguguugccuaggcuggucgggaacuggccucaagcaauucuuccgccucggccucccgaguagcuggaacuacaggugcuauuccaagauggugaaaccccgucucuacuaaaaaauacaaaaauuggucgggguggcucacgucuguaaucccagcauugcagaaggcugaggcagguggaucgcaaggucaggaguuugagauuagccuggccgauauggugaaacuccgucucuacuaaaaauacaaaaaaauuagccaggcuugguggugucgccuguaaucccagcuacuagggaggcugaggcaggggaauugcuugaacgagggagguggagguugcagugagccgagaucgcgccauugcacuccagccuggacaacagagcaagacugucuaaacaaaagcucaacaaacuaccugccauccccaaaacuaaucucaccuccuaaagcauuaacgacccuuccugaccaaaucuaaacuagcgcccagauuuucuucccauauggcucagcccagcuccgcugccccacagguguccugucaggauccgcuucacauuuauaauaccuagcaccccacccccagccccgccccugccccaccagccacccccacucuaccccaccccuacccaucacauuccgcaccccacccccgccaaacccacauccccaccccacccaaccucacccacucccaccacauccaccacccgcaccccacccccacccaccacacccaugccuacgccacuccugggugacagcgagccagggcccgggacucuagucccagcucugcugcuuacuugugugacuucagccucuccaugccucaguuucuccauagggacaaugacuacacuaacaguguccaccccggcaccgggagggccgggcucccggcagggcggggacccucuccccaaggcacucccgggucuccaggccugcucuug

SEQ ID NO: 191757 - RNA, 28395 nt, Homo sapiens
ggagauuaacgcaaacccggaagcggaucggguggagugaaggucacgucgccauggugaguuuugcucuguguugcauuaagucuccgcuucccagguccccgccgcuucugucccugggacgugggguccccacagaccuggaaauucucgcccgucuuccuucgcccagagcaaauugagacagcccagugagaggccgggugucgcuuccuuucggguuuaaagucgucuggaggcuggucccgucccgggucugucugcuauagggcaauguauacacuuucuauugcguaguuuuucugcucaaaaccuucuucugacucuucccuccucgcgcuauuuaaagucuucacccacgagguggauucuugcccggggcgcaccucccagccaccccucgucggccccuggagcgucgcgccgcagccccagucccagggaggccgcguccucugccugguccugggaucuugcagaccccauccuucucccaaggcgccguccccccuccucccaccucccuacucgugccagagccugcggcuccccaggucucuccuccgcagucaccgcuuccauugaacccacacugggaaggacgcagggcccuguccugugacauggggucuucuugccugccgagcuccagcccuuggaaaacgcgcuccuccgggaugcaggcgucuuacuccaaacccuccugcgauugugugggccgaagggaucaggagacagacagcaguagaaaaccugagacagagaaagaauaagaaaggcccauaacagauggcaaaauagaggauuggugagggauaugccaagauauggugaaaguggaaaaagaaagcaacaaaauaccuagaaaagcagguggagaaaagcaacuggagaaauguagagaaaagcuagauguacacagagaugaaggacggcaagguagggagaguggcagcaaagagggaggcucaucagagugagggagagagggagggauuuggagccagggcagacagagcagaguggugcuggugucaaggagaaccgagggagaaacacagcagggaggacaccuggggaucuggggugacacagaguggggacaggggaguauaucagggaagagagaauuuaacagggagagcagaggaggcgcagagaugggugaagaggcagaaauagauggagauugaggacgauugaaagauuggggagaaggagcaauaagagguuaaauaaguugcgaggauggagcagaagagauggaagagaaggaauagagggaagaagggggauaaacagcagaagagaagagggguacaaaaugaagagcagaaucccagggagaaagaaaagaaaacaagagcuagagagagaagggggagaaugagagauauguacagaauuagggagggaagcgcaguaaugaagaaaggggggcuaggcacaguggcucacgccuguagucuccacacuuuaggagacugaagcaagagaauugcuugagucuaggaguucgagaccagccugggcaacauagugagaccccuaucucugccaaaaaaaaaaaaaaggaaauaacggggcauaaucgugugcaccuguacucccagcugcucuggagguggagguaggaggaugacuugagcucaggagguccaggcugcagugaacugagaucaugccacuacacugcagccuggucaacagagcgagaucuugucucaaaagaaaaaauggggcgagagacuggguuuagaucaguggaugaguucauuggauaugauuaguugugacauguugacuucccuguauauaaucuaauaacuaaaaacuuguuuaaauuauacagauugagaauuuuaaaauuggugucuauaaaacauguacauucuauaaaucuuggcaucagagguuauguuccacuuggaaucccuauucaaccagagggaagugacuuauucaguugugaaucacugucuucccuuuuccuaggauugggaggaugugggguagagaagugggaaaaaagucgcugucuguuauuacauaauacuuuuaauuuaauuaauuaaaugauauuuugagucagggucuggcuguaucacacaggcuggagugcaguggcgugauccucuaacuguagccucuaccucuuggacucaagugauccuccuaccucagccuucugaguagcugggaccagaggcaugagccaccaagcccagcuaguuuacauauauauauauauauauauuuuuuuuuuuuguagaaacgugguuucacuauguuucccaggcuguucucaaaacccuggggucaaaggguccuccugccuuggccucccaaauuacugggauuacaggugggauuacagggauggcccaccgcgucuggccuacauagccccccccuuuuuuuugagagggaguuuuguucuuuuugcccaggcuagcgugcgauggcaugaucucagcucaccacaaccuccgcucccuggcuucaaacaauucuacugccucacucuccagaguaguugggaguacaggcaugcaccaccaugccuggcuaauuuuguguuuuuaguagagacgagguuucuucauguugguccaggcuggucuuuaacucccuaccucaagugacccgcugccucggccucccaaagugcugggauuccuggcgugagccaccacucucaacccauaguaguuuuuaaaagggacaucaaggcaugguggcucacgccuguaaucccagcacguugggagacagagguggguggaucaugaggucaggaguucaagaccagccuggcugacacagugaaacucaaucucuacuaaaaaauacaaaaauuagccaggcaugguggcagaugccuguaaucccagcuacucaggaggcugaggcaggagaauuacuugaacccgggaagcagagguugcagugagccgagauugcaucacugcaugccaggcugggcaacggagcuagacuccaucugacaaaaaaaaagagagaaagaaaaaguaaggaacaucaaaguugggccugguggcucauuccuguaaucccagcacuuugggagcaaaucacugaaggccaggagcucgagaccaaccuggccuacauggugaaaccccgucucuaccaaaaauacaaaaauuagcuggccauguagacauacgccucuaauuucaccuacuccggaggcugaggcaggagaauuacuuggacccggcugggaggcagagguugcagugagccaugaucacacuacugcacuccagccugggugacagagugagacuccgucuccccgccccccaaaaaaagaaaaauuagccaagggugguggcaugcgucuguagucccaucuacucaggaggcugaagcaggagaaucucuuuaggcaggagaaucaugccacuacacugcaagcugagugacagagugugacuuggucucaaaaaaacaaaaaaagaaauagcaaucagcucuuuaaugucucccuuuauauaagcaguaguccuggccauguucgguggcucacacuuguaauuccagcacuuuggaaggcugaugugggcgaaucaccugaggucagggguucgagaccagccugaccaauauagagaaacccggucucuauaaaacuacaaaauuaguguguaggugugguggcgcguggcuguaaucucagcuacucgggaggcugaggcaggagaauugcuugaaccugggaggcaaagguuguggugagccaagaucgcgccauugcacuccagccugggcagcaagagggaaacuccaucucaauaaauaaauaaauuaauuaauuaauuaauaauaaaaauaaaagcagacguauucacguguagucaacacgcaugaccaaauucucucacaggcaccaucugcaggaacauccuauuggacaauaagaacucugaacaucgcuuuuggccaauauaaacauucagaccaggaagucugcaucauauuuuugauguuuuuauugugcaauuuguuuuauacaauguuuucugugaucucaguuuauaaauuuucccaguacacauucuauguuuuauauuuuacacacaguaacuagauaacuaagggcaaugaauauauauaaaauugcuguauugccugguguuauguaacuguacuugugacauuguaauugcacccucugacacuguuagucaguucuuauuccuuuuaaugcuguguauuuacuugaacucauacaucagaagguagugaucuuaacauguauuucagucuuauagugugugcuggugguaaguagaaguuguggcuuuuuucuugagagagaauuguuuagaauucugcaggcuguauaaauguacuuauuauuugcuugcugguuuuaucauggguuagaauaguuuacugauuaauauuuaagauuucacauauggcuuuucaguauaugauauguaauggaacugacacacugcacuuguuaauuucaauaagugccuguucugcguggauuuagguaauuuuaugacagguauucagaaaaagguuguauuaacauuuuuuuuuuuuugagauggaaucucgcucugucacucaggcuggagugcaguggcacaaucuuggcucauugcaaucucugccucccagguucaagugauucuugugccucugccuccugaguagcugggacuacaggugaccgccaccacgccuggcugauuuuuggaaucuuuucuuaucuucucugugcuacgauuauuugauaauacagaauuucaauugauuuugguuacccuuacauaagcuucugguggauuauuuaccaauauaauauauuguguggucuuuuaggauuuauuuguguacaguagauauuguguaaauaugaaggaucuauacuuuucauugaugugacagugauauguuuuuugcaaacugugauacauuuuagggucacaguggaaaaauacuccuuacuuuaggcuuacacauguuugugcccugucagcguuuugucauauuggaaauaggcuuccauagaaaugauuugaaguacacguaaaguauuuauuaaguauuuauuaaagaaucuuacuccuuuuguguuccuaaacuuugaagaucauguuugggaaguucaaaauaaguauuguuuuuugugucauauuuacacauuucaguauguuuuaccuucuggacuuaauuggaaacguauugguguuuauauuuuguagauaucucuuccaaaugcuugaugaaaaagguggaagggucacuugacccagggaguugaaggcugcagugagcccuguuuuugccaccacacuccagccugggugagugagcuacacccuaucucaaacaaacaagccaauaaaugagagguauaauuccuccuuugaaauuaaagaaggagauuuucuuuccuuucaucucuuuucuuaggacauuuauuagaaaauuugcaagugcauuuucuguuuucugagguaguauguuuucuuucuuuucuuuuguuuaauuuucuuuuauuuccuuuucuguuguuuucuuuucuuuccuuuccaacggagacacaguuucgcucuuguugcccaggcuggaguuaaauggugcgaucucggcucacugcaauuuccaucucccagguacaugagauucuacugcuucaacuuccagaguagcugggacuacaggcacccgcuauaaugccuggcuaauuuuuauaguuuuguagagacgggguuucaccauguuggccaggcuggucuugaacuucugauaucagaugauucuccagccuuggccuuccaaaguacugggauuacaggugugagccacugcgcccggcccagggauguauuucugaagaacuugggagcuccuugaaaggcaaacaacagccacgcgcaguggcucacgccuguaaucccagcacuuugggaggccaaggcgggucaaucccgaggucaggaguucgacaccgccugacaaacauguugaaacccugucucuacuaaaaauacgaagaaauuagccgggcaugguggcacaugccuguagucccagcuacucaggaaaauuguuugaaccugagaggcagagguugcagugagccaagauugugccacugcacuguagccugggugacaaagugagacuccgucuccaaaaaaaaaaaaaaaaaaaaaaaaggcaagcaacaagauagauuguaccugugucucaguaggaaauuaaguaauucaaacaucaaaugauuccaauuuaaagcuauggacauuuaaauaauucugagccuugagaggaauguggucaugcaaccagagucuaguggaaugcaggugcaacuucuaggaguuuuccuggcugacugucauggcucaagccuguaaucacaacacuuugggaggccgaggcuuccggaucacuugaggucaggauuucaaaaccagcuuggcuagcguggugaaacccugucucuacuaaaaauagagagaaauuacaggcgccugccaccaugcccagcuaauuuuuguauuaggcuuaguguuaggguuucucccccucccucgggaugaagcuuguuagcugacagagauggucaccuccauuaccaaguagagccaggaugaacuaugugugaccaagggcuuuucaaguccucuucccugaggacugauuacuguuuaucuugaaaacauguccuuaauggguuguauagaacacugaaguuucuuucucucuuuucaaccucuuagcuguuugccucuauuucccaucacauucuggucuaaagcuuauuuauuaaugaaguaguuuuucuuucuuucucuauuaucgucguggagaugauuucucauuugggggaagacucuuuguuuuucaauuauauuuucucacauuuaaaaagugaaguaaagaauauuuccugggccaggcauggugacucacgaguguaaucccagcacuuugggaggccgaggcuggcggaucacuugaagucaggguucuagaccagccuggccaacauggugaaaccccgucucuaccaaaaauaugaaaguuagcugggcauggucgugugcgcuuguaauaccagcuacucgaaaggcugaggcagaagaauagcuucaacccaggaggcagaggcugcagugagccacgaucucgcaacugcaccccagcaugggccacagagaaauacucugucucaaaaauaaaaggaaagaaaaaaguaaaaaaagagaaaguaauagaucucuuucacaaaugugcugggacaacuaacuggauauuuacauggaaaagaauaauauuggaucucuaugucacaccaugaaaaauuuuauuuaaaaacggguuaaaaaaaaaaaggcugggcgggguggaucacaucuguaauccuagcaguuugggaggcugaggugggcggaucacaaggucaggagaucaagaccauccuggcuaacauggugaaaccccaucucuacuaaaaauacaaaaaauuagccgagcgucguggugggcgccuguagucccaguuacuccaaaggcugaggcaggagaauugcgugaacccgggaggcggagcuugcagugagccaaaaucgugccacugcacuccagccugggugacagagcgagacuccgucucaaaaaaaaaaaaaaaaaaaaaaaaagagagaaaaggaaaagagcgagggagagacgagggagggagcccugcgggaggggguguuacuuugucacccaggcuggccuggacccccagguucagcgauucucccgccgcugcuuccugaguagcugggaccucaggcuuccgccccgugcccgcaucccugcuguguuuaggcagcagguggugaccucacuccucccuggccugagcacuccgucccgcaucccaggcggaggcccuagggaagucucugaagcugagcacaggguggacccucccuccugaaugaauggagaauagaaagggggaggauuucuguuauguucugugggccaucagcaugaaaucguauauuccgccccggcagggcuuugcauuucacauuuuaguuugcaugcccguuccagacaauuccagggcuuuugaaucaugcuucagccuuccuggccgcucucaccuccaaacaccgaaaaaaacaggcgcugggugcgaggcggagggaugcacaggucccgccccggccccgcccucugucgguucuaaagggcaaggucucucugccucgcgccccgccucuaccccgcccaggccccgccaaacuguucgccggccccgcccaggccuggcuucaguccugggcgcgcaaaccccgaggcggaucgcguggagugaaggucguaccgcggcgcgugaguuuugcucugccuuguauuaaguuugcgcuucccaggucccuggcgcgucugucccuggaaagugggguccccacggaccuggaaauucucgccugucuuccuucauccagagcaaauugagauguccccguaagaguccggaaguugcuugcuuuuggguuugaacucguccggaggcuggucccaaccccggucuuucugcuauagggcaguguauacacuuccugucgcuuaguuuuccuggucaaaacccugugcugacuccacccaccccguucuuuuuaaaguccccgacccgcgagguggauucccgcccugggcgccucccagccucuccgucuucggccccuggagcgaagcgcuguguccccaguccuggggaggcugcgucuucugccugguccuggaauucugcaggugccacccuugucuuaaggcgccgucgcccccuacauccccccucguggugggcccugcugcuccccaauucuucccuucgcagucaccgcuuccccugaaccagcguagggcaggucccagcggcuuguccuaugacaccggguauucuugccugcccagcuccacccuccggaaaaugcgcuucuccgcgaugcgggugucuuaccccaaacccgcagaguggugcugguggcaaugagaacagagggagaaacacagcagggaggacaccgggggaucuggggugcuagagaguggggacaggggggcguaacagggaagagagaauuuaacagggagagcagaggagacgcagagauaagaggcgguaauauguagagauugaggacgaucaaaagauuggggagaaggagcaacaagagguuaaauaaggaccgggcgcuuuggcucaugccuguaaucccagcaguuugggaagcuuaggcgggcggaucaccugagauccggaguucgagaccagccugaccaacauggagaaaccccaucccugcuaaaaauacaaaacuagcugggcgcgguugcauaugccuguaaugucagcuauuagggaggcugaggccagagaaucgcuugaacuugggaggcggagguugcggugagccgagaucgcaccauugcacuccagccugggcaacaagagugaaacucuuucucaaaaaaaaagcgguuaaauaaguugugaggauggagcagaagagguggaagaggaguaauagagggaagaaggggauaaauagcaggagaguagagggguacaaaaugaggagcacaaucccagggaaaaagaaaagaaaacaagagcuagagagagaaggggagaaugagagauauguacagaauuagagagggaagcacaguaaugaagaaagaggggccaggugcaguggcucaugccuguaaucccagcacuuuaggagacugaggcagagggauugcuugaguccaggaguucaagaccagccuaggcaaaauagacaccccaucucuuucaaaaagaaagaaaaaauuaacggggcaugauagugugcagcuguaauuucagcuacucuguaggcggaggcuggaggaucacuugagcccaggagcuccaggcugcugugagcagagaucaugccacuguacuccagccuggucaaaagagcaagacccugucucaaaaaaaaaaaaaaaagggugggggacuuuggguacagaugagugugugaguucauuggauaugauuaguugugacauguugacuucugucuauaaaaucuaauaacuuguuuaaauuauacagaugaguuugagaauuuuaaauguccuaucugugagccauguauguucuauaaauauugguaucagagguuagcuuccacuuggaaucccuauucagaccgagggcagugacauucaauugugggucacucuucccuuuucccauggugggguaggaaguggugggaaaaaaaaaucgcuguuauuacauaauacuuuuaauuaauuaauuaauauuuugagauagggucuggcucugucgcucagcuggaguacaauggcguuaucuacucuaacugcagccucgaccucuuaggcucaagcgauccucccucagucuccugaguagcugagaccacuggugugagacaccaagcccagcuaguaguuuuuuuuuucuuuguuuguuuuuuuguagaaacaggguuucaguauguuucccgggguggucucaaaauccugggcucaaagguucccccgucuuggccuugcaaaguacugggauuacagggaugagccaccgcgcccggccuacauacuaauuauuauuauuauuauuauuaguuuuuugagguggaguuucacuccuguugcccaggcuggagugcaauggcacaaucuuggcuaaugacucucugugccuuuagaguugaagcgauucuccugcgauacuacccccugaguaucugggauuacaggcaugcgccaccaugcccugcuaauuuuggauuaggaggccgaggcaggagaaucacuugaacccaggaggcagagguuguggugagcugagaucgcaccauuguacuucagcgugggcaauaagagcgaaacucugucucaaaaaaaccaaaaaagaauggagcaaaacaggagaggggcauaaaaugagcagaagcccagggggaaaugcagaaaagaaacagauggagagagaaagugagaaagggcuaugcauagaaugauggagggaagcaguaaugaagacgaagagggacccugggugcagaugaguggugaguugauuggaugugaugaugaagugaugacauguuguuuucucuguuuauaagguaacaaauuuaaaauuaguuuaaauuauacagaugagaaugagaguugccaaacuccugugucuaagugugguucauuuuauaaugauggcgucagaggcagcuucccucugcaaccccucuucagccagaggacagugacuugacucauucguuguggaucacccucuucccuuuucauggcuggggucgggagugggggagagaaguaggguaagaagugacugacucuguuacuauauggaacgugaugaaaggaguauuaaaagugcuuuuguucucuuuuuguaauugguuuccuuuuuucuaguuccucuucauuucauuuuuuuuuuuuuuuuuuuuaauuuuugagauggagucucucugugucacgcaggcuggaguggaguggagcagucuugacucacugcaaccucugccuccuggguucaaggaauucucugccucagccucccaagcagcugggauuauaggcaccugcagccacaccugucugauuuuuguauuuuuaguagagacaguuuucaccaucuaggcgggacuugucuugcacucaugaccuugugauccaccgccuuggccucccaaagugcuaugauuacaggcgugagccaccacacuuggccucaguaauuguuuuuuauuuuuuaauuuuaguuuuaauuuacuuauuuuuguuguggugguuuuuuuuuuuuuuuuuuuuuuuuugacggaguuuuggucuuguugcccagggugaagugcaauggugcgaucuugcucacugcaaccuuugccucugggguucaagugauucuccugccucagccuccugaguaguuaugauuacaggcacacaccaccauggccggcuaauuuuguauuuucaguggagaugggguuucuccaucuuggucaggcuggucuugaacuccugaccucaggugauccucccaccucagccucccaaggugcugggauuacagguaugagccgcugcgcccggccuuuguuauuguuuugagacacuuuuacuguuucccaggcuggagugcaguggcaggaucacagcacugugcagcggcaaccuccugggcucaagugauuuucccaccucagccuccggaguagcuggggccacagacacaccccaccagguccggcuaauguuuagauauauguauuuauuuauugagacucucugucacccacucuggagucuaguggcacgaccucgucucacugcaaacuccgccuccuggggucaagcgauuuuccugccucagccuccugaguagcuggaguuacaggugugcaccacuaugcccugcuaauguuuguauuuuuaguagagacauaguuucuccauauuggccaggcuggucucgaaccccuaacauuguggucuuccugccccggccucccaaagugcugggauuauaggcgugagucacuaugccuguccucauuguuuucaaaguaugauauauuuucaaauauuucuccuuuggcccaagauuucauuagaucuguauuuuuuaaccauuuuaaaauuguuucucuaugaaauuuuuuugaguuuacauugaggucugugugcuuucuagucuuuaucauauaucgaaaacauuuucuacuaugugauauauguuguuagguuguuucaguguguacuugauaaugauaucaaggaccuuuuuucuuuacccuaacaugaaaauucaguugaaguagccuauuccauuuuuuuuucuuaugucaucugaaaaaaugguaaucugugagcuucuaaguaaguguccccucaauucccucugguccauaauauucucuacagauguugaaggaugggcuggauugacuuggaaccuugguuuagcagagcccauguguucuugagaaaagcauuugcucagaucucauuucuacagcugccucuuuuucaguguuuuaaacaucuauugcuaugugugcacaguuguguguauuuugaacauuuuucugggagugaguaaugauauguuugggauugaugccaucagaaccuuacaacuugaaagaaguuucguuugcucagguauauaagaugguccuggaauuuuuguuuguuuguuuguuuuucuuugagauggagucucgcucugucacccaggcuggagugcaguggcaugaucucagcucacugcaaccucuaccuccuggguucaagcaauucuuuugccucagccuccugaguagcagggacuacaggcccccgccaccacgccuggcuaauuuguguauuuuuaguagagacgggaugucaccauauuggccaggaugaucuugaacuccugacuuugugaucugcccgccucagccucccaaacugcuaggauuacagaugugauccaccccgccuggccuuuuuuuuuuuuuuaaaccguuuuuaaauaaaauuuuucauggugugacauagagauccaauauuauucuuuuccauguagauaucuaguuagguauuacaagggugagucaccgcuccugacuggucuggaaauuuucuagaggaggaagaccaaggcagccuauuggcccuuucaggcaaucacaugggaaucagccacauguccuuccuccucaccucagagcaucucagaauaacuuggugaaaugucucccacugugagccucagugagcccaccuguaacauagaggugaggaauaagaccggaaaagcucagucagagugacacugaccccugaaaugacugacaaaauacagugugugacuuuucuucugggagagguagugcucaguuuuaacucgaauuuuaaagggauuccaguucuccaaauauuaaaaaaaaaaaagcacaagaugauuaaaaucaggggauuagacucaaaucaccuugaaccuuaucaucucacagcuuuaacccacuuacacgacuccauguccccugcaggcgucgccccugagcucuacaauccuguguccaguugucucagcugucuccugggucaucaaacaggcauccccaccuucagguguccacgaguggcuuucuaaacccccaaacacauuuccuugcagucugcacaucucagaugagagugacuguguacuucuggaaacuuagccaaacuugacagcauguauuuuauauuugugaaauaaaucacuuuauuuguaaguguuguaauuuauaauauaaagagaaacuuagauguauacgugaaaagagugagaagauacaucacuuccaauuuuuuuuuuuuugagacgaauuuucacucuuguggcccaggcuggagugcaaugccacgaucucaguucacugcaacuucugacuccugggaucaagggauucuccugcgucagacacccgaguagcugggaucacagucgacuuucaaaaugcuuuuggguugugggagaaaaauguuugaaaaccaugucccuaugggucugugcccccaggaccucucugaccucaucuccuaccugugcccuccucucuuccacugcuccagccccacgggucgcuuuccuuuuccuggggcugagguugcuccugucucagggcccucacuugagcugucccucucucuaggaugcucuuccccucagcugcaagugacaagcagccuuucuuuccuagguccuuguucugauaucaucuucuccggguuuccuuugugaucucccacagcccccauuugacacugcagcugugaaaccagaaaaucuuacagagaucucaguuauuuagagaguuuaguuugcccaagguggucggggcagagcuuaauuuuauacauuuuauggagacaugagacaucaaucaauauauguaagaaguacauugguuuggucugggaaggcgggacaacuuuaaacaaaggcaggaagacuugaagcagggaggcggcuuuuaggucacagagaaaugaggcacaaguaguuacaaucuuuugaguuuccuuuuuuuuuuugagaugaagucucauuuugucgcccaggcuggagugcaguggcacgaucucgacucacugcaaccucugccuccuggguucaagugauucuccugccucagcuucccaaguaggugcccagaucuuuuuuuugggggggggguggaggcuuugaucagggaugagucugugccauaaagggggcaucagugcagcccagguccccccugcugccucguguguggcggcuucuccaugaagggagugagaucugaagaccggggucaaacauacacuuguaggucuuccugugggacuuucuuaccucugcaugaucucuggugcagugggcagugggggacuucuuucuacagggugacaucucccgguucaugugguuuugucacaggaagggagugagucauuucuaacaugaagucuuauuuuuuuucacauacaggauugauuucuaaagacucauguuacgugaggaagcagcucagaagaggaaaggaaaggagucaggcauggcucuuccucaggugaagugauauuccucuguggauuaaucugucucuuuccuuucugaaauguaguaguauuauauuguauuguaguaauguauuguagcagccagucuuuucugagucugaagcauuuugccugacacguucacuugcacucacccaugccugcccucaguuccucucaggugcucugagauuccaucuccugugacccagugacaugaacuugggaagaggcuccacugggcauggucuugggaagggcucacacccagacguggauaaacauggggugugggcccguugaugucagagcugcugggcagccuggauuguucaggggccacaucuggaugucagcucagagaaacuacauaugaaauacguauguuaaugugcgcagaugugugguaaauucugggaaaggagacgaauaagaggagauauuuuguaucugauuugguaaugcauuugaagccacacuaguagaucaagaugucucuguguccaaauuuuuuuuuuuuuuuuaagagacaagauguuggucccagugcaguggcuuacaccuguaaucccagcauuuugggaggccaaggcaggaagaucacuugaggucaggacuuagagaccagccuggcuaacauggugaaaccccaucucuacuaaaaauacaaaaauuagcugcaugugguggugcaugccuguaaucucagcuacucaggaggcugagguaggagaaucacuugaguccaggagguggagguuacuguaugccgaaauugugccacugcacuccagccugggagauggagcgagacucugucucaaaagaaaaaagagagagagagaaggugucgcucuguggcuuaguucuggaguacaauggcacaauucagaguuuacagcagccucaaacuccugagcucaacuaaucgcuacuguagccucccaaagagccugaaugauaggcaugggucaccauauguauguguguauauuauguauguauuuauuuauuuuaagauggagucucagucagcaaagcuggagcgcagugguacgaucucggcucucugcaaccucccccucccaguuucaagcaauucuucugccucagccuaccaaguugcugggacuacaggcaugcaccaccacacccagcuaauuuuuguauuuuuaguugagacgggguuucaucauguucguuaugcugaucuggaacuccugaccucaugaucugccuaucucggacucccuaagugcugagguuaaaggugcacaccaccaugucaggccuuauuuuuuauauuguauuuuuauuuuguugucuaggcuggagugcaguggugcaaucaaagcuugcuuuagccuugauauccuggccucaagugauccuccccucuuggucucccaaauugcuggcauuccaaaugggagacagccagcuuggcuggacucugcacauuuuugagauggagugucgcucuguugcccauguuggauuguaguggcggcaucucagcucacuacaaccucugccuucuggcuucaagcaauucuuuugccucagccuccugaguaucugggauuacaggcauucgcugucacgccuggcuaauuauuuuguauuuuuaguagagaugggguuucaccguauuggucaggcuggucgaacuacugaccuugugauuuguucaccucggccucccaaaguucugggauuuacaggccugagccacugcacuuggcuaaagucugcacuuuuaaugacugucaaugcaauggaaaguggagauaggcaucagugguacaggaugcuuuauuacaucauugauuuuauuuuauuuuuaaauuuguuuugaguugagucucuguuguccaggcaggagugcaguggggugauuuuguuucacuguagccucugacucccagauuacagugauucuguugccucagccucuccaguagcuuggauuagaggugggccaccacguggguaacgccaugaugugaugugugugcaugaauacauggguggauaagcccaugguuuauguagaaaacacaacauuugcaauaaguuuuauuuuuuauaauaauuguaaugauuuuaaguauuuuucauuguugucaacuaucacaauaaugaguuaaugguaagauggggccgggcccgguugcucacaccuguaaucccaccacuauggaaggcugagguggguagcucaugacaucaggaguucaagaccauccuggcuaagauggugaaacccugucgcugcuaaauauacaaaaauuagauggaugugguggcaggugccucaaauccuagcuacuggggaggcugaagcaagagaauugcuugaaccuggguggcacagguugcagugagcugagagauugugccacuguauuccagccugugcaauagagugagacuccaucuggaaaaaaaaaaaaauaagaaguauugggaaggauuauauguaugccuguguguguccauucagcgaccuuguaggaugcuccguguucuuacccugggaccuuugucacauucucugcacuagauaaacccgugucaguuuaguuuaaagcuguaucuguuacuucagcguuuauauucaaaugugaaucccagacaucuggauucagugcuuguguugacauuuuuagcuauuugauuugugguaauuuuccuaguaugugugaugcacuuguguccaaguacagaucuuucuucaugggacaguauguuauuuuauggcuuaagacaugggaagcacuuagaacaguguauagcacaugggaagcauucaaaaauguuagucauggcuauugcugucaucauaacaguuuuuuuuuuuuuuuuggagacagaguauugcuuugucacccaggcugaagugcaguggcaugauauugggucauugcaaccucugccuccugauuucaagcaauucuccagccucagccucccaaguaucagggauuacaggcacccaccaccacacccagcuaauuuuuguguuuuuacuagagaagggguuucagcguguucccaggcgggucucaaacuccugaccucaugauccaccugccuuggccucccaaagugcugggauuacaggcaugagccacugugccugaccgaucaugauaguuuuuagauuuggacuuuucuuucaaagccaauggacucuguccucucugaaacaccgcuuguaucuuaguucaucuagagacuaaauaucgccuuguauguugaacauaauagcugacaugucuguagagaaaacccuguguuugcuuuuuuuuuuuuuuuuuuuugagauggaaucuugcucuguugccaagcuaaagugaaguggugcgaucucggcucacugcaaccuccgccuccuggauucaagcaauucuccugccucagccucuugaguagcugggaguacaggccugcgccacaacaccuagcuaauuuuuguauuuucaguagagaugugguuucgccauguuggccaggaaggucuugauaucuugaccacauugucuaccugccuuggucucccaaaaugcuaggauuacaggcgagagccauugccuggaauugcuuuuuuuuuuuuuuuuuuuuuuuagauggagugucagucuguugcccaggauggagggcaguggugcgaucuuggcucacugcagccuccaucuccuggguucaagugauucuccugccucagccuccuguguagcugggauuacaggugccugccaccauguccgucuaauuuuuauauuuuuaguagagacagguuuucaccacguugaccaggcuggucucaaacucuugaccucaaauaaucugcccaacuuggccuccugaaguguugggauuacaggcaugaaccaccucacccggcccuguguuuccuuuuuauuuauauaguuuuuauauuguccauaaaaucgagacuuccauagugacuuaugggaucuuaaaaucuuucaaggaaaaguacaauaaaaugcaacuauacggaaaaaauagucaaaaauaccuuaacauccuuuugucagaacacagucuuugaucaaauaaauacuuauuuucccuuuucucauuuccugugaaggugauaacucaauccuccauaauguuuuguugaaauguauguuucauuuuagggacgcuugacuuucagggauguggcuauagaauucucauuggcagaguggaaauuccugaacccugcacagagggcuuuguacagggaagugauguuggagaacuacaggaaccuggaggcugugggugaggaaaaugucccugcagacaugaggagucugcuccugucuaucuuggcucuuccugguuuuguauucucuuuugugauuuugccccauccaugcugguuuuuuuuuuuuuuuuuuuugacauggaguuuugcucuuguuucccaggcuggagagcaaugguauaucgguucaccauaaccuccgccuuccagguucaagugauucuccugccugagccuccugaguagcugggauuacaggcaugcgccaccaugcccagcuaauuuuguauuuuuaguggacacaggguuucuccauguuggucaggcucgucucuaacuccagaccucagguuauccgcccaccucacccucccaaaaugcugggauuacaggcgugagccaccaugcccagcucauucugguuuuugaggagcaucacagaagcgucucucacuggcacugugacaacguucaucccauaaacuaaugaucaucuucucuaagcagcagucagugguguugcaauuccucccagcgaggacaucauucgggcucacagccucauauguaugaggcucuugacugaacucuuguucaugucacauuuuucacaccaauaugugucacuguucauuuuuaacaagaaaaccuauguucaguuuguuguaggaucaacccuguaagagauaugguuuucaucaaucuuauugagggagcuugugagguugaaugagguuuccauaguuuaguucuacugucauuuccuuaagacacagugccuuucaacuuguucauuucuauguuguuguuguuuuuuucucauagucuugcucuguugcccaggcuugagugcaguggcaugaucuuggcucaccacaaccuccaccuuuuggguucaagugauucuccugccucagccucuugaguggcugggauuacaggcaugugucaccacacccggguaauuuuuggugguucuauuacagauggcaguuucaccauguuggccaggcugguuuugauagccuggccugaugugauucagcugccuuggauucccaaagugcugggauuacaggcaugagccacagccccuggcccauccgaguuguuuuuaaggcugaauaauauuccauuguauguguauaccacauuuuccucacauauuuaucugucgaugcacaucuuuacuauuauaaauaauacuaccaggcugggugcgguggcucacgccuguaaucccagcaauuuggaaggcugaggugggugaaucaccugaggucaggaguucgaguccagcuuggccaacuuggugaaaccacauuucuauuagagguacaguuuuuuuuuuguuucuguuuuuuuuaagauggaauauugcucugucacccaggcucaagugcagugcagugguguaaucucagcucacuguaaccuccacaucccaggucaagcaaucucauaccucacgcuucugagcuguugggauuacacacaugcaccaccaugcccggcuaauguuuuguauuuuuuuuaguagagacaguguuucaccaugcuggccuggccggucuugaacuccugaccuccugaugcacccgcucauccucccaaugugcugguauuacagacaugagccacugcacucagccuagcucuguuuucacaaacacaucucuaccuacugugccaggggauccuuguucacccccauggucuacuguacucuucauagaguuuacuuguuuguuuguguguaugccuuucugguaucuacacaggggauauuguugaguauauucuugaaacuggaaaucagagucacuuaauuuaaggauguaaaacugcuuucaccucaggccaccauacugcugcuuuuuuggaucucuuucauucuugucccuugcccauauuguaauuugaauauuuaaccuugggucaauauuuuaacauuugcucaauuaguuccacuuucguccaagcucaagauuuggucuauccuaguggaauuauauucccacagaggugcaugcacaaaguuuacuccuacaugcccauuacuuccugcucuccacccuugcccuuccuuuccuggccuugacucacaugauacauugaucuggaugcaaauacuguuucuuuccagccuauugauuuuguaaugcugaacaccccaauuuccccgugagccccuccccuccaacaccacucucacugaguaagucaagaccuuguucauccacuggacaaaauuauaggaggccgcuuaaaucagugugugcagggcaucaugacucagcacaugauccaugagggauggcuucagaaccacugucagcagcgcagcucagcgcuugugucccagcucagccuuuguaucccccuugauguacuucuaucuguucuccuuguauuuucuggucuggucauuuucuguacugccugugcugacuauugugccuaagaacaugucgugggauccuucaugcccaggauuaagucuugucccucacuuaccuuaugugcaaacuggggucauguccaugaacacugugggccuccugucauuauuugagaaauaaugauaauuugccuccaggguugguuuuuuuuuuuuguuuuugagauggaguuuugcucccguugcccaggcugaaguucaauugcacaaucucaguucaccacaaccuccaccuccuggauuuaagcgauucuccuuccucagccuucugaguagcugggauuagaggcaugcaccaccacaccugccuaauuuuguauuuuuaguacagaugggguuuccccauguuggcuaggcuggucucaaacuccugaccucaagugaucuaccuaccucagccucccaaagugcugggauuacaggcaugaaccacuguguccgggcuauuuuuuuuuuuuuaauggaguuucccucuuguugcccaggcuggagugcaauggugcaaucuuggcucacugcaaccucgacuuccuggguucaagugauuguccugccucaggcucccaaguagcugggauuaugccuggcacaagccuggcuaauuuuuguauuuuuaggagagaugggguuucuccauauuggucaggcuggucuugaacucccaaccucaggugauucauccaccugcuuuuuaaaacaagugaauacuauuagauggcuucauauaaguuuuauaguacauucucaacuuccuuuguuuaauaagauuuuucagccuucagugauguugaugaugagaugccccuuuuccugccucacucaucucacuguucugucagaaauagcuuagacuggccagcuucaguggcuuucaccucuaauucuagcacuuugaaaggcugagguggguagauggcuugaggucaggaguuugagaccagucaggcaaacauaaugaaaccuugaaucuacuaaauuaaaaaaaauugggcaugaugacucaugccuauaaucccaaacuuuugggagggcgagacggguggaucaccugaggucagaaguucaagaccagccuggccaacguggugaaaccccgucucuaguaaaaauacaaaaauuagcugggcguuuugguaugcaccuguuaucccagcuucuugugaggcugagacaggagagucacuugaaccugggagguggauggugcagugaaccaugaucaugccacugcacuucagccaaggugacagaguuagauuccauuugccaccaaaaaaaaaaaaaaaaguuagccaggcaugguggcaugugucuguacucccugccuagcuguuaguccauucuuaguucuuaaaauguuguauauuuucuugaccucauacaucagaagguagugaucuuaacauguauuucaguucuuauauugugugcuggugguuaaguagaaguuguggcuuuuuucuucagaggaaguuguuuagaauucugcgggcuguauaaauguacuuauuugcuugcugguuuuaucauggguuacaauauuuuauuaauuaauuuuauaauuuuacauauggcuuuucgguaugugguaugcaauauaacugacacacugcacucguuaaugucacaaagugccaccaggugcaguggcucacaccugugaucccagaaauuugggaggucaagggggguggauuacuuaaggucaggaguuugagaccagccuggccaacauggugaaaccacaucucuacuaaaaacacaaaaauuagccagguguaguggugugugccuguaaucccagguacucaggagguugaggaaggagaaucacuucaacccagcaggcagagguugcagugagcugagauuacaccaugacgcuccaaguuggagugcaagacuccuucucaaaacaauaaaaauggaaacaaauuuuuuuuuuuuuuugagauggagucucacucugucgcccaggcuggagugcaguggcaugaucucagaucacugcaaaguccaccuccuggguucauaccauucuccugccacagccucccgaguagcugggacugcaggcgccugucaccacgccuggcuauuuuuuuguguuuuuaguagaaacagaguuucaccguguuauccaggauggucucgaucuccugaccuugugauccacccuucucggccucccaaagugcugggauuacaggcaugagccaccgcacccggcccaaaaauuuuuucaaaagucacuaagugccuguucuguguagauauauauaauuuuaugacauuuauuuagaaaaauauuguacuaacuuuuuucuuuuuuuuuuuuuucuguuugaggcagagucuacuuugccacccuggcaggagugcaguggugugaucuuggcucacugcaaccucugccucccguguugaagugauucuugugccucagccuccuaaguagcugugacuacaggcacggaccaucacaccuggcuaauuuuuguaaucuuuucuuaucuucucagugcuauaauuguuugauaauacagaauuuccagugcuuuugguuauccuuacaugagcuuguuguggauuauuuaccaauauaguauguugugugguuuuuuuuuuuuuuuagcauuuauuuguacacaguaaauaugguuuaaauaugaagaauauauauuuuucucuuccuugaugugacagugauauguuuuuugcaaauugugaugcacuucaaggucacaguggaaaaauacuccuuacuuuaggcuuauacauauuugugcccugucaguguuuugucaugauauaggaaauagacuuucauagaauugauuugaaggacauguaauugcccuuuauuuacuaaagaaucucacucuuuuuguguuccuaaacuuugaauaucauguuugggaauuucaaaauaaguauuguuuuuugugucauauuuacacacuucaguaugauuuaccaucuguacuuaauuggaaauguauugguguuuauauuuuguagauaucucuuccaaacacaugaugaaggaggucuugucaacagggcaaggcaauagagaagugauccacacagggacauugcaaagacaucaaaguuaucacauuggagacuuuugcuuccaggaaauugagaaagaaauucauaacauugaguuucagugucaagaagaugaaagaaauggccaugaagcacccacgacaaaaauaaaaaaguugacugguagcacagaccaacaugaucacaggcaugcuggaaacaagccuauuaaagaucagcuuggaucaagcuuuuauucacaucugccugaacuccacauauuucagaucaaaggugaaauugcuaaucaacuugagaagucuaccagugaugcuuccucaguuucaacaucccaaagaauuuccuguaggccccaaauccauauuucuaauaacuaugggaauaauccccugaauucuucauuacucccacaaaaacaggaaguacacaugagagaaaaaucuuucccauguaaugagaguggcaaagccuuuaauuguagcucacucuuaaggaaacaccagauaccccauuuaggagacaaacaauauaaaugugauguauguggcaagcucuuuaaucacaagcaauaccuugcaugccaucguagaugucacacuggagagaaaccuuacaaguguaaagaguguggaaaguccuucaguuacaagucaucccuuacaugccaucauagacuucauacuggaguaaaaccuuacaaguguaaugaguguggcaaggucuuucgucaaaauucagcccuuguaauucauaaggcaauucauacuggagagaaaccuuacaaguguaaugaauguggcaaggcuuuuaaucaacaaucacaccuuucacgccaucaaagacuucauacuggagugaaaccuuacaaauguaagauuugugagaaggcuuuugcgugucauuccuaucuggcaaaccauacuagaauucauaguggagagaaaacauacaaguguaaugagugugguaaggcuuuuaaucaucaaucaagccuugcacgucaucauauacuucauacuggagagaaaccuuacaaaugugaagaaugugacaaaguuuucagucagaaaucaacccuugagagacauaagagaauucauacuggagagaaaccauacaaauguaagguuugugauacagcuuucacguguaauucacagcuggcacgacauagaagaauucacacuggagagaaaacuuacaaguguaaugagugucgcaagaccuucagccgcaggucaucccuucuaugccaucguagacuucauaguggugaaaaaccuuacaaguguaaucaguguggcaauaccuuccgucaccgggcaucccuuguauaccaucguagacuucacacucuagagaaaucuuacaaauguacgguuuguaacaagguuuucaugcguaauucaguccuggcuguacauacuagaauucacacugcaaagaaaccuuacaaguguaaugaaugugggaaagcuuuuaaucaacaaucacaucuuucacgucaucguagacuucauacuggagagaaaccuuacaaaugugaagcaugugacaaaguuuuuggucagaaaucagcucuugagucacauaagagaauucauacuggagagaaaccauacagaugucagguuugugacacagcuuucacguggaauucacagcuggcacgacauacaagaauucacacuggagaaaaaacuuacaaguguaaugagugugggaagaccuucaguuacaagucaucacuuguauggcaucguagacuucaugguggagagaaaucuuacaaauguaagguuugugacaaggcuuucgugugucguuccuauguggcaaaacauacuagaauucacaguggaaugaaaccuuacaaguguaaugagugcagcaagaccuucaguaacaggucaucccuuguaugccaucguagaauucauaguggugagaaaccuuacaaguguagugagugcagcaagacguucagucagaaggcaacccuucuaugccaucguagacuucauaguggugagaaaccuuacaaguguaacgacuguggcaauaccuuccgucacuggucaucccuuguauaccaucguagacuucauacuggagagaaaucuuacaaauguacgguuugugacaaggcuuucgugcguaauucauaccuggcaagacauauuagaauucacacugcagagaaaccuuacaaguguaaugaauguggaaaggcuuuuaaugaacaaucacaccuuucacgucaucauagaauucauacuggagagaaaccuuacaaaugugaagcaugugacaaaguuuucagucgcaaaucacaccuuaaaagacauaggauaauucauacuggagagaaaccuuacaaguguaaugaguguggcaaagccuuuagugaccggucaacacuuauucaccaucaggcaauucaugguauagggaaauuugauuaauauaaugauugucacaaagucuucaguaacacuacaacaauugcaaaucauuggagaauccaugaugaagagaaaucuucugaguguaauaaauguggcauguuuuucagacauuguucauacauugcaguucauuggcaaccucauacuggagagaaaccuuacaaaugucaugauugaggcaaggucuucagucaagcuucauccuaugcaaaacaggagaauucauacaggagagaaaccucacaagugugaugauuguggcaaagccuuuacuucacauucacaccucguuggacaucagagaauccauacuggacagaaaucuugcaaaugucaucaguguggcaaggucuucaguccgaggucacuccuugcagaacaugagaaaauucauuuuugagauaacuguucccaaugca

SEQ ID NO: 191758 - RNA, 10785 nt, Homo sapiens
uccaaguggucaccauuuauugagcaccucaacuucucugaucuuccauuuccucccaguggugccuugaugcgggggggaugggggggcgggggggaagggggcugauuauauuuucauaggagaaaugggacaugaaagaggcuaagucaccgacaggcucacacaacccugccuccagaguccaagguuuggggaacgcauccaaccccuccucacccgugacagagauaccaggagagauucgagaggggaugggugggggaggaccaauuccacgaccugugauauucgagagcuuuggagggagcccucggugugaccccuuccgacugggugucuuagggccauuuaccacuucaggcuacagccagugagaccgugguggagacgaaaugagggugcagugcgugcuacacacgaagcgcuggaagggaggcaucgugacggcggcugugaauggcguguguccaucaagucacgcuccgcuuaccccacugcgggcaaacaggaaacaucaggaaucugaugcucaaggagggucaggaccaugcugagcgcacccagaaccagcagaggcccugggcaggagguccccaaccaauccccacucgcucaagaaucacacgguguucagcccccuccucccugagacccaggaguccacgaccccaggcccuccuuccucagccacagaugccugggguccccagucccacuucuucuaggcuuaguccuggcccucuccucucucagaccuaggauggucccccagcccccuccucccucagagccugaagcccaguucgagacccuucuucccugagaccucgaagucuggggucccagcuucuucaggguuucaggugaaugggcccccgucuccuucccaaccccacauggaaggccagguaagguaacggguuuauucacagugucauuuacaggcagcccccaccccgcggcaucagaucccggcgggaggcccgaagucgcuagaagguggggacggccuuggaggcggggggccgggccggauccccgggcguccccggcgucgccuccucguccagaccccggcggcccuugccgauggccaggcggggccggccgcgguucaggccguccaggagcgcgcaggccuggcagagcgcgcggcuggccagcgccccacagcgggagcaggcgccggggcgcgggggccgcgcggccggggccagcgccaggcgcucggccgagugcacgagguccagcaccgcggacggccgcgccgccuccaggcgcuugagcaggucccgggcguggccgcggaaggccucgggcgcguagacgcacuccucggagaaguagucgaggcggcggaagugcgcguacagcaccaccuccuucugcgaggcgaacugcagcgggcggcagcgcggcagggcgccccccucgccgggagagcccaggcccccgccccgggccagccgccccgcgucgccccguaggaaguucaugagcacggucuccgccaugucgucggcguugugaccugguggggagagaagggagcgggugagguggggcgcggagggcgcugcuggccagggagccccccggggaaccaaggguccaccaggacccagagagagacugggaggagagacccacggagacccagggcacaguggggccgccaggacccagagagagacggcgacggggagagcaagccauggagacagacccccaaacauggugugacagccaggauccagagacagggagggggagagagagccauggagaccccuagggcacugugggcaaccaggacgcagagagagacggggagggcaagagcgagccauggagacccuccgggaaccgugaagcagccaggugcaggcugcagguggacacaacaaaaaaucaaagagaaacauaagcuccccuggcgcaacuugggcgugccuucauguaccacccgccuacugcauagcggaccuuaugcuaguugcccuuucauauagggaguaaaagugcauuaugcugcuaauaaccuuaucagccucaguuaaaaccguaauucaaacuguacacaaaaaucagaaggcauuuaaggcauuuaaccgagauucucaggagagcuggagggguaggcaggcugcugucucccccaccgccuagggaauccauggccuaauucugggaaccuguuaauauguuugguuguaggacaaaggggaauuaagguugcaaguugaauuggggcugcuaaucagcugacuuuacaauagggacagaauggugcguuauccaggugcgcucaagguaaucacaaagacccuuagaggggaggagggaggcagaaaagggagagauagggccauggagaccuuugaacauagugggcagccaggacccagagagagauggggaggggaagccugagccauggagccccucuggcaccauaggacagccaggacccagagaccgggagagggagauggggccauggagcccccugggcacuguggugcagcuaggugguggcuggagguggacacagcaggaauugagaggggaacacacacaagcucccuggggaacuuggggauaccucauuugccacccgccuacugcauauggggggugugagggcagaggcaagguuagagugaugcaaacgguguaggacucaaacugccauccuuggcuuugaaaauggaggaagagccgggcacaguggcucaugccuguaaucccagcacuuugggaggcuaaggugggagaaucaccugaggccacgaguuugagaccagccuggccaacauggcaaaacccccaucucuacuaaaaauacaaaaauuagcaggucaugguggcaggcaccuguaaccccagcugaggcaugagaaucucuugaaccugggagggagagguugcagugagccgagaucacuccacugcacuccagccugggcuccacagcaagacucugucucaaaagaaaaaaaagaaaagaaaauggaggaagggaccaucagccaggaaugugggcagccuccggaagcuggaaaaggcaaggaaauggacccccuugccccagagccuccaggagaaaggcagcacucuugacacuuugauuuuagcccggugagacuucccagacuucuaucuacagaacuacaagauaauaaaucuguguuguuuaaagcugugaaauuugaaguaauuuguuacagcagccagagaaaacaacugguucuugacacagagccucugacaacccagacuguaguuuuuuuaugguuuuuuuuuuucauuuuguuuuauugugcguguguguguguguguguguguguguuugagacagggucucacuuuagugcccaggcuggaggacaguggcacgaucucagcucacugcaaccucugucuccagggcuuaagugaucccccugccucagccuccagaguagcugggaccacaggugugugccaccaugcccagcuaauuuuuguauuucuauacagacgcaguuucuccauguuggccaggcuggucuugaacuccucugagcucaagugauccaccugccucggccucccaaagcggcugggauuacuagcaugugucaccaccccuguaaucacugcaguguuuuuguguuaucuuuguuuagaaguaacagugagaaauauuuacacacuggucaccaugaaauugaagcuaaacuuguucugugucuugucaaguuauacuugagucuauaucagugguucucaaucugggaugagucugcccuccuucccucccccagagacauuuggcaauggcuggagacauuucugugugucagguuggggguggggcacuacuauuaaauagcaucuaguggguagaggccagggauacugcuaaaauccuauaacacagaggacagcucccuaaaaacaaacuaucuggccccaaauaucaauagggcugaaguugagaggcccuggucuauaugguaaaaaaccuccaagaacuuggcucuaauuguguuuguaguaaugguuaccucccaaagaccugccaagcccugugaccuugagauugggcauguuugcuacugcaaacgacaucucguugaauguuuauugacuuaaaguuguaaaccacauuaauuaggggagacuggauuugcuccacaccuugucauuacaaacccacuuaagagcucccaguuuuguaauaauuauuacaacaauuauuauacuacgccuuugaaaauggaguguauaaacaaaggguagaaaucaccuugcaagucagggauuuuucuggaaggcuucauuacuuuuggaaguacaauuaauaagugauucuaucaaauuaacuuuaaaauccgaggcagccucucauucuuuuuuuuucucccccagcuggaaucuugcucugucacccaggcuggagugcaguggcgugaucucgacucacugcaaccuccgccucccggguucaagcaauucuccugccucagccucccguguagcugggauuacagccgcccaccaccacacucagcuaauuuuuguauucuuaguagagacgggguuucaccauguuggccaggcuggccucgaacguuugaccuugugauuccgccugccucagccucccaaagugcugggauuacaggugugagccacugugcccggccgaagccuuucauucuuuccauacacugucugcucuuguaugguaaggauuauucuucccauuuucaaucacagagaucuagggauuucuccaaaguuacucaguaaggaaagggccacaucagugaaugaagcucaguaagccuuccccagagccaguggcccuaccuagcaugguggcacaugacagccucagaacuacuuuugccuucauaugcuuucagugugcugauucucuccaaccaucaucucucaccuccaucaccgcagcuggcuucccacugacuggucuccucggcuuugucccugucccuccaacccagguuccucgccauggccugggugagcuuuucaaagugaaacucucuucaugucacuuuuacugguuccgccacagccuacaggguaaggccugaccucuuccaccucuccagccuccccugcccuugcuuucuggguuccagccacacuggacuucuuggggcagcccaaauuggcuuuucacaggccaauaaccucucccuaauucuuacccgcuuuaccucuucacugugagccuucagauuucaaaaccguuccuugaccccacucccuccacgucauaggguucucuguguguacacauaguccauaacauguccauacauggucaauaacauguauaauguuuauaauuuuguaccugauaaccaugcaaagguaggaacuugugcguaacuguauucucagcccuagccugacaaugaugaugauaauagcauguauaaaauguguaaucuauauuauaucauacggguuauguaacauaacuauaauauagauaacguuauacuucuacugacucaucuaauugucauaacaaguuuaugagcuggguaccauucauaguccuguuuuagggauggggugaaacagaaguacagagugguuaagaacuuugguauggccacaguugggauccggcauauagcagaaacuuagcaucuguuuguugaaggaauggaugaaaaagacagaauaaaaaaguuaucuuccagcacuuugggaggccgagguggguggaucacgaggucaggagaucgagaucauccuggcuaacauggugaaaccccgucucuacuaaaaauacaaaaaauuagcugggcgugguggcaggcaccuguagccccggcuacucgggaggcugagccaggagaauggcgugaauccgggaggcagagguugcaguaagccgagaucgcaccacugcacuccagccugggagacagagcgagacucugucucaaaaaaaaaaaaaaaaaaaaaguuaucaaagaggagaggccaaccaagaaaaggaauuaagagauggagaugcuuuuuagagaaagagcuggauucugaaagguggaccauaagagaucaagcauguuagaaacauuuaaaaauaaguaaaggaccagagaucuccagagauuuucaccucccaccccuuuggcaaucuguggagaccaagacgguggccaagacccaaaaaccuuugugaucacugccuggccccucugucuccccagcgucuugaaccuuuaaagggccccagccccaaacugcagcaugcgcccuuccgcaccuccguacagggauccucccauuaagccaccagggucuccucgccgccuucuggagcaugcgccugaauccccuuucaggucccgccuccucgccugugcauucgccccacugccucggagagugccgcucugcggcccguacuacgcucaccugucacgaugugcguggcucccacgcggcgcgccccuuccuccagcgcccggcgccgcagcacuccacagaaggugcagcaggagcggcugcggccggagccggcugugcugcgggccacggcguccaucguccagcccccaaagaggucuucguaggccacgaccgugagcggcagcucccagcgcgccgccuggcgccgcacggccgccaacgccgcgucccgguagccaccgaugcccucaucgacggccacgagcugcagugagaugcccaggcgcggcgccagcgcgcgcagcacgugcgccagcaccguggaguccuugccgcccgaggcgcccacggccaccaccgcgccgggcggcagcaggcggccggcgagcaccgugugcagcaccucggccucgaaggcggcgcagaagcaggcaccgcacagcgcuuggcccgagagcggacggcggagggcggcgcgugcagcauggcaggaggcgcacggcggggcgggcauugcgggaggggucggcuucuccuagacagggagagagaggagguggguuacauauggauuccggauugcagggucccugccaucggggagauugucuggauugcaccucugcccggaauagaccagggagacgugugcgcgaguggaguagcuucuucuagcgcuggggauaggaugguuauaaauagguccgguguaaggaagccacugccuuagggaaggcuucuuggauugcacccauuaugcaagaagaagagaaguagcuuaagaagcuggcuucauggguaaagagagggagcgacaagcagguuauacccaggauuagguuguguccucuccagagggauggggguguauauuaaggcccauuugucacaaccuccagggaggccacccuuguuacaguccugaucaggacaagguagguaucauuggccugggccaccagggcuguuaaaagcccuugggaggugagggguuuuugacucuaagggcagagggaggccaggggacugaagcucugugcagcgggagguggaaaacaggaaaggccaacugauugcacuuuguagggugggauacggucuccaggaauggguucugauugcauccuaugaaaggcagggugaucaccuucuccagggaacacaggcagccuggaucacaccucucaggagaccagcugggguugcacacauuuugagggugagaaaaugggugggccuccaagauugaacucaacccugcucugguaucagaaugccccacaagcuucugugcucucaccaagacauggaucggcccaucuuugaccuucaucuguuaucuuuccuacuucauucuuccccacccagccuagacuccaacccuccagucaaauccugguccugccugccuggugaacccauaaaaacuccccaggcucaguucuccuccccaagccaccaucaccuccagccuggacuacuguagucaccuccuugccauucagagcaggucacgcugcuucuaggauuuaccacaauguguggaauuauuuuaugugacuauauauuuaccaucucuaacuucuaugagggcagagaccaguaccacucagaugucuaauaggcaucucaaaacccaaauuccugauucuucuaacccagcgugcuucuccuggaguacagggcagcuccauccuucuagcugcucaggccaggagcuuugggguccaggacccuggacugcucuuucucucacugcacuugucaugcucccaguggguggcaccaaacugcaaugccaaguccggaccuuuucaaacuccagguaccuaaaugaaauuuagcaaauccuguuugaauguaguuucaaaacagccaaacacuuaggaccgucuccacggcagcacccuagucuggucugucucucuccuggacggcugcauggggcuccccacaggucuccugcucccgccuugccuccucuacaaacacuccuucacauaacagccagugggaucaugcccugaaucuucucagcauccuccccuggaucccaucucacuuuaguauaauaacugcuaauggccgaugaggcccuacauguguggcuccuuguuucuccaaccuccucuccuucagccuugaugucguuuacucugacaccugaggaauacuccugcuccagauguuugcacuggcucuccccucugcccugaguacucuuccugccacugagcccaagaagcagcccuuaggacucaucugcagugaccgucgggaacaucugucacaggugagcagcaacucuuggaaucuuucuucccccgacuuuugacucacuccuucugugcuccuggauuuccugcucaauucucuuuuggggacgccucuucauguccucagguccugccuagcacccaucucuuuccauuuuuuaaagauuuuuaauuuaauuuaauuuaauuuuuugagauggagucuggcucuguuacccagguggaaugcaguggcacaaucucggcucacuguaaccucugccucccagggucaagcguuucuccugccuuagccacccgaguaacugggacuacaggcguguaccaccaugccuggcuaauuuuuuuuuuuuuuuuuguauuuuuaguagagaugcgguuucaccauguuggccaggcuggucuugaacuccugaccucaagugauccgcccgccucggccucccaaagugcugggauuacaggcguaagccacugugcccagcuucuuuccauucuuaugagcgccucugaaucaugauauucagaugucccuccuggcugguccuccacauggcuggggcaccuuaaagauguucagacccuaagcgcccagacaaccuauuucuuccucgaaaggcagaaaccuguucuugcccaucuguucccucucuucugagagcagccaccaccuuucauccagcccaucugcaggacaggacguaacgucacccuggacucaucucuccucacccccuaaaucuacagucacccaguccugggggguccacguccugaggaagggagacgcucgcaggggacaaggcugcacaaguuagcagagccucauaggccaugauguggaauuuuagguuuauucaggaggagaugggagccuugggagguuuuugaacaguaaagugguaugaucuggcauguuuuaaaaggauuccuagacuggucaacauagcgagaccccaucucuaaaaaaauaaauaaauaaauuagcugcaccugguggcacaggccuguaguaccagcuacucaggaagccaaggcaggaggaucacuugagcccaggaggucaaggcugcagugagccaugaucgcaccagugcacuccagcgugggugauagagugagaccuugucucaaauaaaaaaagugggauucguuuggcugcuguguggggaggacuguugguugucagggacaaggacagaaggcuggaggucagcacacuagacaggagugcuggcaguagaggugggaagaagugaaauuuuggaucuauuuugaagguggagcccacaggacuuguauaagacugauuggaguggggacuggggcaacgacgagagaaagugaugaaggguaacuuugagguucuggccugagcauuggagggacgguggggccauuuugugaggugagaagaccaggaauuccauuuggccacgucagguuugacaugcauguuaagcgucuucccucaaagacuuuauggacccucgucacugagucgagcgccuccaccagggcccucagagcugcccugauccugacuagcugucacuggugacaggucugucucucugcuucaaggcagggacaggguuggucuggugcccucgcucccgccgcccugcgcagagucggugcucaguaaguaucuguaggaugagggaauaauaagugcucccagaagagaggccgcggaccccagggaugccucuggauugcagccuugucaaaaggacagauaauguguggcaugggggcggggacaggcagauaguaacauaggggcgggggcaagcagauggucuuauccugucuuggggaagggaguggcccgguaagagacaggccggaccgcagcguucaaagugggaauccuggcuacaaggccucagggacacgggcgcugggaaaucacagaggccuuacgcucgaagagacccucaacccucccacggcaccgcaacaaagagccggaguccacaugccgacccaccgcaggaggaaauacucacccgggcagaacucagugcugggaugcccacacugcccaccacgc

SEQ ID NO: 191759 - RNA, 49082 nt, Homo sapiens
gaugagcaaugagggaauaauccccauuccgucuggaaucagagggcgggccugccgcggaggcaucugggaaacggaguucccaggcaggcgaagcccaggggccgucaggaagucagcggcgccugcgcgggcgccucagauucaggaugcgcgcgcagcgcucuccgcccagcggaaguuuucgcugggcaacugagaaggugaguccggguaacugcggaggauccgagggucaggcugcagaagcccagaaucccaccccaguccccaaguacagaggugaggggaagcgaggcgaacgaggggacgucccccgacccccuagccgcagcucggccggggcguccgugacgucagcacgaccguuugugggaggcggaggccccugcugucgggguucggaaugagagcggcuccgggucgcgggguucacuggccuccucuugagcuucccaagccaccuugggcuccguguugggcauggcuaaggcggagaugggcggaacuugugggaaguucgacagcuccuccgcugugaaacuuggcgucuaagucaucccgugguuucuauggaggugcggccgaagggaggcucugucgucgccuaggcaaucgccccaccugcgcugagguggggucugacuuuuagccuuuuugcugugcuguuuccugaacuuucuaggaggaacacuauacaguaguugacgcauagcagcuguucccuaaacauuuguugaauaagucaaauaaauuaagauaaagacuggccugaggguuggagucuuaggguuucaaguccugaccuggccauugcauaggugacuucagcacauccaauuuuauugagcguuuacuauauggaaggcuccgugcaaccgauauuacacuacuauaaccuggguuugaacggugcuagucuaauaggcacuguucaagcccagguuauuauagcagugucuaaaacaaaaauccugcccagcuaauucacauucucagggugguuggggaugccagacacuaaaaaagaaauguuaaagaauauuuacaggucugcagucccuuaucuauaacuuuaaaauccaaaacguucugaaaacugaaaggucuuuuucucuguuuugcaacuuacuuggcaggccaaccucaccuggcuuugaacuuguuugcuggcaauacccacucugaacugaugugugacuauuuagaauuuuuaaagauuuuguugugcaaaucauauacuuauggagaguugccccuggaucucgccgguguuguaauauguaauagguucuaaaauccaaaaaauuuggcugggcacgguggcucccgccuguagucccagcacuuuaggagaccgaggugggcggaucaccuggguucaggaguucgagaccagccuggccaacauggugaaaccccaucucuacuaaaaauaaaaaaauuagccgggcaugguggcaugcgccuguaaucccagcuacucgggagguugaggcagggagaaucgcuugaacccaggaagcggagguugcaagugagcugaggucgugccacugcucuccaaccugggugacauagcaaaacucuguccaucaugcaauacauggcagaagcaagauccaaacccaggcagauuauuucccaaguuuauccucuuaaccccuguacugaucugcuucuaaguggcacgucuuuuuuagggaccauccagcuagauaauuccggcccugagcuuugagucucuggcuggaugucuagauuugccugagagaugaauguguacugacacagcuggggaccccccccacccaccuucuuggcacauuuucuuuugcaaaggagacaaugauuuauucacucagcagacguagacccagcauuugcucugugccaggccuguuugaggcucugggcacacuguggcaaacaaggcagggaaaaguccccgccaucaugaagcuuacauucuaguaagucagaguaugucagguagugacaagcacugugaagaaaaauaaagcaagguaaggaggauaaaacaugcuauuaguaaaaugguguccagggccaggcacgguggcucgagccuguaaucccaggacuuugggaggcugagggggaucaccugaggucaggaguuuaagaccagccuggccaacauggugaaaccccaucucuacuaaaaauauaaaauuagccaggcguggugacacgcaucuguaaucccaacuacaugggaggcugaggcaggagaaucacuugaacucgggaggcagaguuugcaguaagccgagaucgugccauugcacuccagccugggcgaaaagagccaaacuccaucucaaaaaaaagaaaagaaaaaacacaguaaaaucguguccaagaaggucucugagaaggugacauuugaacagagagcuaaagaaugugaugaggaaguuaacugugugcacucuuagggggacagcguuccaggcagaugggagagcaggugcaaaggucuuggggaagaaacguucuugucacgauuggggaaaagcaccgaagcuguuguggcugacucagcgugagcaaggggagaggugggagaggucagagagggaacagggaaguggcagaucauacagggggcuccugggccaugguaggaauuucagcauuuauucugucuaaaaugaaauccaccauacgguuuugaguagaggagggacagggucugacuuacauuuuauuuauuuauuuguuuauuuaugagacugagucuugcucuguugcccaggcuggagugcagcggugcaaucuuggcucauugcaaccucugccucccagguucaagcgacucuugcgccucagccucccaaguagcugggauuacgggugcccaccaccacgcccggcugauuuuuuuuuuuguacuuuuuuaguagagacgggguuucaccauguuguccaggcuggucuggaacuccuaaccucacgugauccgcccaccucggccucccaaagugcugggaucacaggcgugagccaccguguccgacccaccauaugggccagggcagggacacagacagggucugacuuagauuuuaaguggauccgucaagcuacuggguugaaaauagauuguagggacaagcguagaagccgaaagucuaguuaggaggcugcugcaguagcacaagggagagaugguggccuagaccaggcuggugacggugucagaaccggggguggcacaugguuaaaagacucucuugccgugguuccacacccaacaucagcuuccagauuuaaaucuacaagaauguucugaccugcugccccaagaacccaguccgguuuugcguuuucguuguauaaauuggcaccaggugaagaacaugggcuuuuggguucuggauuucagcugcguccccacuguuuucuaggugaguggagucaggucugggggaaggagaauugucacccuuugagcaucauuuuguagguuucaaagaugggauaaucaucccuaccucauagaguggagggaaagauuaaacaaaaucaugugucuggcucgccgcuuaagagguuuguggcccugggcaagucauuugcucucugagccucugcuucucaucuccccaaaggggaaaucauucuuaccuugaaaagggugauugggaagguucuguagauaauaccugccgagaacuuagcacaguggucugcacauacugaacugucaugaaaugagaaccgucuuaagugagugacuugaccucucugugcagcagggacucccugucccgguuacuaugucuagagaacaaaucgucccacaauucacugguguagaaccaccauuucuugugcccauggauccuaugggccaggaauucagagugagcacagugagguggccuguuucugcuccccagugccugugccuuagcaggaagacuugaaggcugggguuuaaguggucugaggacuugcccacucacccagcagcugaugguggcuguuggccaggggccucaguuccucuccaccugagccucuccaugugguuucucugccugggcuacuuuaggcugccucaugccguggaaacuggcuuccaugggugagcauccugagcgagccagccaggugcaaguuguuuuuuaugacccagccugggaagucucauggccuuacugcugccgguccucuauugguaggagcagucacagcucugccgagauccaaagggggaggaacagagacccugacuccugggaggagggguuacaagguuccaaagagcacacaggaccagaaauagucaugugaccugcuuuggaaaauacaaaugccacacucuccuaugaaguggugauaauucuggaaccugcguccugggcuguuguauagacuaaacaggauaaugcauagaaaguugucugccugaggacuccuucccagauauugacagcucgcucccugguuuccuuugggucucugcucagaugccucccucugggcgaggcccuccuuggccacccugugugaauagugacccaccaaccucuguggcauccuguuuucuucuaugguacuuuauuguccuccauagcccuuucuccaucugaccuguucagcgguuccuugcucauuuguuuguuagugucucuucccccaccagaacgugcgcauccugaagacaggggcuguguuguuuccuuugcugcuguuucccuaguggcuggcauaaacaggaaacucggugaauaguuauagaguaaaugaauaaacgaauggauuuggcacaugcuggugacauggccagugcucaguaaacauuagccauuaucuuucauuucuaugugaaagcaugagucagccucuccacuuuuguucacuuacaggucgcugucaagauggaguuuccaacccaguaaauccaagggccagaccgugaccucauaaagguauuaucccuugggcacagccucucaagaccuuuuuccuuuuucccaccagcagcuggcuccugcuugucuccucuggguugcugcuggccagcuuuacucccagaaggaacguugucauagguauggcagggcucaccugguuaggcacuugcugcauccuggaggcaucuuuauuggagggcagucagcaucuggggaaauucuauuuaacacgaagccguguaaaaccaucacagauuucugccagguguggaggcucacgccuauaauuccagcacuuugggaggcugaggcggguggaucacuugaggucaggaguucgagaccagccuggccaacauggugaaaccccaucucuacuaaaaauauaaaaauuagcuagguaugguggcgccuaccuguagucccagcuacucaggaugcugaggcaggagaauugcuugaaccugggaggcagagguugcagugagcugagauugcaccacuacacuccagccugggcaacaagagcaaaaguccaucucaaaaaaaaaaaaaauuagcugggugugguagcgcauaccuguagucccagcuacaugggacacugacaggaaaaucgcuugaaccuaggagacggagguugcagugagccaagaucgugccacugcacugcagccugggugacagagugaaacucugucucaaaauaaauaaaaccaucacagauuucuaaacaaacgcuuuguucacauaagaagucuagaccaggcaugguggcccacaccuguaaucccagcacuuugggaagccaaggcaggaagauugagcuugagcucagcaguucgagaccagggcaacauagcaagaccccaucucuacaaaaaguaaaaaaaaaaaaaaaaaaaaaaaaaaaaaaaaaaaaaaaggccaggcaugguggcacaugccuguagucccagauacuugggagacugaggugagaggauggcuugagcccaagagcucgaggccgcagugagccaugaucaugccauugcacuccagccugagugacagggugggacccuguugcuaaaaaauaaaaaagaaguguacagucuggcuaggcuaggcuucagcaacaagcaacuucuaaaucuuaguaguuuaucacaaucacacauuauuucucgcuaauacaacuuuccaggcaccagccucuauacaguuuaaaaauacauauauuuuuaauuagccaggcaugguggcccacgccuguaauccuagcuacucgggagacugaggcaggagaaucgcuugaacccgagagguggagguugcagugagccgagaucgcgcgacugcacuccagccugggugacagagcgagacuccgucucagaaaagaaaaaauuuuuguuuaauuuuuuuucuuuuuuuuuuuuuuuuuuuuuuagagacggagucucgcucuuucuccccggccggacugcaguggugcuaucucggcucacugcaagcuccgccucccggguucaugccauucuccugccuaagccucccgaguagcugggauuacaggcgccugccaccgcgcccagcuaauuuuuuguauuuuuaguaaagaugggguuucaccguguuagccaagauggucucgaucuccugaccucgugauccgcccgccucggccucccaaagugcugggauuacaggcaugagccaccgcgcccggccuuuuuuuuaauuuuuaauuuaccuggguacauaguagguguauauauuuauuggguacaucuaggcaauuuggucuugugacaccagugucaacacccagguuugccuggcagagagggaagaggcagugagaccucuagcuucacaaaaaugcucaccaguauuugugccuuugagaaagagauguuauuuuacauauuauuagcaggacaacaaaucacuaaguuagucuggcuaacuuaaguuagaaugacuggcuuucuagagaguaaaagauacuugaccaacagccuuugcaguccagaugucuuacaugacuccuuuguuugaaaaaacagaagggcagauuuaugccacagaguguuucugcucuucugcagccugaggaaaaggaauccaggaccccuucucuccucauguggcugagauuucuuucaccagcugauggggauggccugugguuuuuaaggacaagcucuauaauuucaaaagucaguaccuagaggaaauagacaggccugaggagcucagaacuuccuaucaaagaagaaagggaagaauagaaauauuaaugacuggaauauaguaacuuggguacaaggcaugauauggucacagcaagcacuaacauaaaaggcuuucuaugggccaggcccuguucucagcaccucauauaaauguauucauuuagaccucaucgaccauucuaucagauaggagcugggagaagccccauuuuacagugggguagacugugacacagagagguuaaguagcuugcccagcauguagcagaucugggauugaaaucuggcagccuggggccaaaccugugauuuuaaggacuccacuguuugcauuugcaacagaagccagccuuuacagugaauaaaggaaaaggguuugaucagaauggucucuugcagccagggugguagcucaugccuacaaucccagcaguuugggaggcugaggccggaggauugcuggaggccaggaguuccagaccagccugggcaacauagugagaccccgucucuaaaaaaaaaacuuaaaaaauuagucaguugugguggcacauaccuauaguuccagcuaccugggaagauugcuugagcccaggaguuugaggcugcagugagccaugauuaugccacugcauuccucccuggugacagagugagacccuaucucuaaaaaaauuuaaaaaugaauauucucuuucaaggugaaauuaaaucacaagcccauguuuauauuaacuucuauuucaauaguuucacuuuuuuuuuuuuuuuuuuuuuuuuuugaggcagaguuucacucuuguuacccaggcuggagugugauggugagaucucggcucaccacaaccucugccucccggguucaagugauucuccugccucagccucccgaguagcugggauuacaggcgugcaccaccacgccuggcuaauuuuauauuuuuaguagagacgggguuucuccauguuggucagguuggucuuggacuccugaccucaggugauccgcccaccucgaccuuccaaagugcugggauuacaggcacgagccaccgugcccggccaauaguuucacuuuuaauugcuaauguacaguaagccugagacuauaagaacaaauaaauggccuuuuuuuguugcugcuguuuguuuuguuuguuugagacagaguuuucacucuucuuguccaggcuggagugcaauggcaugaucuugguucacugcaaccuccaccucccggguucaagcaacuuuccugccucagccuccugaguagcugggauuacaggugcaugccaccacaccuagcuaauuuuuuuuuguauuuuuaguauagacaggguuucaccauguuggacagacuggucucaaacuccuaaccucaggugaucugccugugauggccucccaaagcgcugggauuacaggcuugagccaccgcacccggcguauugcucuuuguuagaugcucguuacaaauagcacugccauaaugaagggcaauacaaacugccuguuguacuucauccuuguuaauuucccuucuucacuuaacuggcuuaaaacucuucuauauccucauuugucauagucucaguauguaauuuggacuuuuaaaaaguaucaggaauuagcucagagagaugcaaagcauagagaguaauuuagugaacacucaucauucuacuaaauuagucaggauagaauaggcugugcugccaugacaaauaaacccugaaaucuugguggcucaauacagcagaaguguauuuguugaucaugagguuccaguguggaccaggcagcccuccuucaucuugcuaugucaguugggagccauggccuccagggccaucccugcagguggagggggaggcagaggagguauucugacuccuaacugccucggccaugagaugacucuacucacaccccauuggccagaauuagucauguggccucuaccuugcugcaagggaaccugggaaguauaggggagcauauugauauuuggggaacauugacugucacucccauucccauugcauguuuuaagaagugaacaucacaaacaguugaagacccugguugugccuccugccacucacccugugauuaagagcaguucaacaauacuuccacugaccuucagcuggcccguuucacuuuguguuuguucauucuguuuuguagcaugaucuccuucuguccagacuguggcaaaaguauccaagcggcauucaaauucugccccuacuguggaaauucuuugccuguagaggagcauguagggucccagaccuuugucaauccacaugugucauccuuccaagguaagaaccagagcauugagccuguuucugcggugggaauaaggugcauacacgugugugucugcggagggaggaugccuuugcagccugucugacccuguccugacacuggagaagcccaggccucaggacuggaccccucugucuaccaucagucucuuggccucuuauuggccucauggcuuugaacacugucuccauguuaacaucuccuucauuucuaucuccagccagccuggacuccccugcuuggaggagauauaugugcagccugccagcuuggcaccugcagguugaguaucccuuauccgaaaugaugaggacuggaaguauucugauuuuggauuuuuucagauuuugggauauuugcauuauacuuacugguugagcauccugauucaaaaaucugaaaucuggcugggcacaguggcucaugccuguaauccuagcacuuugggaggcugaggcaggcagagcacuugaggucaggaguucaagaccagccuggccaacauccugaaaucucaucucuacuaaaaauacaaaaauuagcugggcauaguggcgcaugccuguaaucccaccuacuugggagucugaggcaggagaauugcuugaacccaggaggcggaggucgcagugagccgagauugcaccauugcacugcagcuugggcaacagagugagacucgaugucaaaaaaaaaaaaucugaaauccacaguaguccagugaaauuucccuugagcauccuguugacacucaaaguuucagauuuuggagcauuuugcauuucagauuuccggauuugggaugcucagccuguguuggauguccuggucacaucuuagucugaacaugccuucaccugagcuccugguguuccugccgccugcccuagacuuccccauugccaugaauagcacuccauucauccaguuucccaggccggacccuggggaucauccuugaguucucuuugucucgcaccccgugacacacccaccccuucagcaaaucuuguuggcucccucuuuacaaucagugcaguaucagcccacuuccuucuccgcaccucccacaucccugguccucaccucucuuaugcagaagccuucuugcccucugcuccccucucuugucccuguagucgucuucacgcagccaccagagagauccugugaauacagucagagcccaucauuccucugcucauacuuccccaagugaggugaagggaccagguccccauuuccccucagaccccaccucccgacccuccugcuauuccagccacacuggccuccuggcugccccuccacaccucagcacgccugggccucagccugugcgcuugccgcucccuccuggacgccucuucccuuaugggccugcaugccccacucuuucacugccuucagguuuuguuuuuaguuguuuuuguuuuugagacugagucuugcucuuucgcccaggcuggggugcaguggcgcaaucuuggcucacugcaacaucucggcucacugcaaccuccgucucccagguucaagcaauucuccugccucagccucccaaauagcugggauuacaggcgccugccaccaagcccaguugauuuuuuguauuuuuaguagagacaggguuucaccauguuggccggcuggucucaaauuccugaccucaaaugauccacccgccucggccucccaaaguacuggcauuacagacgugagccaccaugcccagcuuuguuuuuuuuuaaacagucucgcucugucacccaggcuggagugcaguggccccaaucucagcucacugcaaucuccgccucccgaguucaagugauucuugugccucagucucccgaguaguugggauuacagguauguaccaccaugcccggcugauuuuuauauuuucaguagagaugggguuucaccacguuggccaggcuggucuugaacuccuggccucaagugaucuaccugccucagccccccaaaguguugggauuacagucaugagccacugcgcccagccaugccuucagauauuuauucaauuguuacuuucucagagacacuuucccuaccacuacuaauuaaaguugcaucuucccucuaugcaaugauccugucccccuuccuugcuguguauuucuuuuugguacuugucucaacccuauuaaauacauuauuuugcuuggauugcuucuucuguaagcuccauaaggacagaaacuuuuuguguuucuguaaccuguguugauugugguuuuguaaccugcuguuugcacagcaccugggucugugccuggcaugguauugggugcugagaaaucuuacugacugguugaaugaauuaauuaaauaucaguaguaggucuugcucacuggaaggcccaagcccagauacuauauugguaaaucaaagaagguuuauccaucggacaguugugcagaaggcagucagcauacauggcggggagucaagugacauucauuuuaucauuugggaguguguuuagcugcagauaacagaaaaugcuaugacaaggguuuaaacaaaugauuagguuuauuucuucuuuucuuucacuggcaaguauguagagcaauauuuuucuuacuaaaaggggacagugcguauugggaugguguccccaugaugcccuaagggacccaggcuccucugucuuugcacugagccauccuuagcauauggcuuuuguucccaugcuuacugccuugaggucucaaguugacuucuucaucuccacaguuccaggcaaaugugaacagcguuugccuuggcccaacuugagagucagaguguuuuuuuuguuuuguuuuguuuuugagacggagucucgcucugucgcccaggcuggagugcagugacgcgaucuuggcucacugcaagcuccaccucccggguucucuccauccuccugccuuagccucccgaguagcugggacuacaggcgcccaccaccacgcccagcuauuuuuuuguauuuuuaguagaggcgggguuucaccguguuagccaggauggucucgaucuccugaccucaugauccacccgccucggccucccaaagugcugggauuauaggugugagccacugcgcccggccuuuguuuuuuuaagacagagucuugcucugucgcccaggcuagagugcaguggcacgaucucggcucacugcaaccucugccucccagguucaagcgauuuuccugccucagccuccguaguagcugguauuacagccgcgcaccaccacaccuggcuaauuuuuguauuuuuaguagagaccggcuuuccccauguuggccaggcuggucuuaaacuccuggccucccaaaguguugggauuacaggcaugagccacugcacccggccagagucaguucuuaacccaaccccugccuuuccuaaugcuaaccuagagcccaguucauuauucacuccaucagucaucagauggcaaauauguauggguaaccugccaugugcugaggugcuguauuugucccgaggauuauaguaagaaaugagacagcccugguuucuggucucucaguaagacaacagacauugaauaaaugauuaucagcagguugcaugauaacagaggggaacugaauggacccuggaacauauauaagggaacaugcuuuucagggaaucagggaagaucucccuaaguggguaaaguuugagcugagcuagggaugaagaagaaugggccaggcacaguggcucacgcauguaaucccagcacuuugggaggcugaggcagccugaucaccugaggucgggaguuuugagaccagccuaaacaacauggagaaacccugucucugcuaaaaauacaaaauuagcugggcgugguggugcaugccuguaaucccagcuacucgggaggcugaggcaggagaaucgcuugaacccggaagggagagguugcggugagccaagauugcgccauugcacuccagccugggcaacaagagcaaaacuccgucucaaaaaaaaaaaaaaaaagaaugagcaaggugggaguuggcacauguguuccagccacugggacaugguauggggagcagaggugaggcgaggggagccagacacacuggaggagugaggaacauuuccaccugggggaagacaggcaggaccacgggagggaguuugguuuuaacuacacacuggaggagugaggaacauuuccgccugggggaagacaggcaggaccacgggagggaguuugguuuuaacuacacacuggaggagugaggaacauuuccgccugggggaagacaggcaggaccacgggagggaguuugguuuuaacuacacgcuggaggagugaggaacauuucugccugggggaagacaggcaggaccaugggagggaguuugguuuuaacuguggugacguggagagcugcggaagagcuucuaccaaguaggcaacacaauaggcuuugcauuuuggaaagauuucuguggcuucucuguguggaaaauggauucgaggcauggaaaccaguuaggaggccauuccaguagcccagggaccaaccaugcuggcugaguuagucagugucaacuaaaaagaaaggacauuuguuuuuagcaauauggcagaccagaugauaauaaaaacuccuuauuguucagugugcccaaauauguggaauaaaacauuaaaauguccuuuuaaaauauagagcuaagugguaggaaaguaaggggaguccauggagaugagaaacaacaggaaaacagagaccacagggcuaagcaaguguuacauagguguuauuuguccuggggcuguuugcugauggccuugagccuguguuuuauuggggugcaggagacaaagcuuagggccuuagcaguacaggaguugcaauuggaaauuuccucucaaaucuggggcuccucagugggugaacuacaacaaaagcaauuguuccacagaaaauugguggagacauuugucgccuuggugguggguaaauaaaggaggaaugucuucuuugagaauucccuuuuuuguuuuuguuuuuuguuuuuuguuuuuguuuuuguuuugagacacagucucacucugucauccaggcuagagugcagugguguaaucuuggcucacugcaaccuccaccucccguguucaagcgauucuccugccucagcuucucaaguagcuggguuuacaggcaccugccaccacacccagcuaauucuuauauuuuuaguagggacgggguuucaccauguuggacaggcuggccucaaacuccugaccucaggcgauccacccgcccuggccucccaaagugcugggauuacaggcaugagccaccacgcccagccuucuuggagaguuccuaaccaagaauucacguucucaccaguuuggggccagaauucacacugaucuguguggucccccaaaaugcaagcugaacauuuaacuuaaaguggugagauguggguaccacucccugccugauauaaacaaaucuucucuuggaaaacauccuuuaaagacaaacaucagggaauuaccacaggucaacauccaaggaucaugaguaccagucucuguugauuuacaaagacaccaggaaauaagcuagcuggagagucagcagaaacaacaaacugcagaaucggaccugccaagaccacagacuuuagaauuaauagaugagaauguuuacaaagcaugcuuaauacauuuaaauaaauaaaauaacaaauugaaaguauaaugaaggaauagguuaaaguugcacaggcaaauaagagaaggaaccaaauaaaaacucuaaugauuguauguguguauauguauaugugugugucuauauauguauauauguguauguguguauauauauacacacaaucauuguauguguguauauguguguguguguguauauauauauaaaauaauuauuguaaucagaaacucggugggugguuuaaacagcagacuagacauagcugggagaauuaguuaacuggaagauagauuuuaagaaauuacauggaagaggccaggcaugguggcucaugccuguaaucccagcacuuuggaaggcugaggcuggccgaucacuugaggucaggaguucaaaaccagucuggccaacauggugaaaccccaucucuacuaaaacuauaaaaauuagcaacauuacaggcauguuggugcaugccuguaauccuagcuacuugggaggcugaggcaggagaauugcuugaacccaggaggcagagguugcagugagccaagauugcaccacugcacuccagccugggcaacagagugagacuccaucucaaauauacauacauauaaagacauuauguggaaaggacacagaguggcaaagugcuggaagauacaagagaggcaaagaccuaagaaggagagaacaacuaaaaggaacaguuugcucauauauuuacauaauagaagaagcaagaauugguguugagggccaaagagaacagcauagcugaguauaaccucagggcucccaguccaauggugccugcagaggggccuuuguaacuccagucugcauuuugucugccuuucuuuaggcucaaagagagggcugaacuccaguuuugaaaccucuccuaagaaagugaaaugguccagcaccgucaccucuccccgauuaucccucuucucagauggugacaguucugagucugaagauacucugaguuccucugagagauccaaagguaagaguuaaggucuaucuggccugacucuuaaguggagcaaaguuaggucaucugaugaucuuugggacaaaacugccacagccccggcucaaacaucauccaucccugccuggacucugacuccagcagcuuccccagccucccaucucccccuccagucugccucuauauggccccagaugggucuuucagcaccuagagcugccccggccccucccugcacacagaccccuacuguuccuggugcccucagaccaagcucuucagucugguaucuguguggccugguuccugcuuuagcccucaacacagucuuugcccagaaaacacuuuuggggauuaaccuuggucuuugcuaagccuguucccucagcccagggcacucucaccuucguucuuggccuuguguacugccacucagccgauacuggucucuaggaagcuucucuugagugccauaggcucgcauccagaccuccucaucguccgccagagccucuuuccagccucuuuggcgcccccccgugccugcugcagccuucauuggagcgcaugucagucuaggcuccacaucccuuucggccucacuuucugggcugggggcccuuugcagguagggacccagcacaauuaguguauauacccucugcccagccagugcccaggacacgggaggccugaggacuauguuccuucuccuguucacugagccccuggaucugaagccacagccacaguggcagugugaggcguccccuuugcuccucauuauccucugggcccagaggccucuugccauuacuugccuuuaggggauggugggugggaggaacagaguaagcgaugucuuuuccuguguccaagucugucucccaccacacccaccccauucucuugccaggcuaggagcccuucuagggcagggcuuuggucuaacaaauuuuuuggcccuuuucuaucucaggacugaguccuuuuucaggauguuuuuggguaaaugucuagaauguccuuuauucccuggcaaacuucuccucauccaacaagauccaacucuaacaucccuuccuccaggaagccuacccugacuucuccaggcaggaucucuuucucuuuugggcccuaauaucugucuguacugcccugucucagacccgcaucugacuagcugugucuagagcagacuugcccaccaaacugggcacuccugagggaaggaugcagguccgacuccuaucuggugccccaacaucaucacacaaaggccugacucauagaaggucccaggaaauguuuguugaaugaacgaauuuguaaaggaacaguauuuugcgugcuguuucacuccccaucuaacuuuucucuccuggauggugcuuuuacuuuauucuuacauccuccugcaggcuccgggagcagacccccaacccccaaaagcagcccucagaagaccaggaagagcccucaggugaccagggguagcccucagaagaccagcuguagcccucagaagaccaggcagagcccucagacgcugaagcggagccgagugaccaccucacuugaagcuuugcccacagggacagugcugacagacaagagugggcgacaguggaagcugaaguccuuccagaccagggacaaccagggcauucucuaugaagguacacucuguccaugggcggccagggacugggucgucucagcaccaggacagugggaggggaccccguucugagaaugggaauggaagccacaucccuagcugcagaccugucgcuaggcaacuuucucuuagaccuuggacucuauaccuacccaccugcagggccgggcaauagugggaaugagugcagcaggcuggaguaaggcaguugggaguggcggggacugcggccaguuggcaugugcccugugugaagugugccccuccucaccccaccugcuaccugcuauugucacgugggagugcaggcccaggggcugcauguuaaggaugguuguucuggccagugugcagagagaggauggauccccacguaaaauuugguucaaacaucgagacugaugaugucacacacacaccaagaggaugugagagguuuauugcuuacauaauaggggucucuguggagagcaggcaggccucccacacagaucugagaugccuugagagugaggaaaggagacuggucagguguuucaucgugcuuggggguggggcugggcucaggguuucugcacaggggccaacaccaugcaugguuugagucucguggaugcacaccccaaaggagggagcacccaagcuugcucauccgcucacccaggugugggauggaaggggaggagggaggcacaaggcugaaaagcucagacucuguuacaaugaggaaaauaauuauggcaguaguauuaguauuaacuguaauaaauauugagugcuucugcaaggccaggccuguucuaagcacuuuacauggguuuuucuuuuccuuucuuuucuuuuuggaacuuuuuaauugagauaaaacucacauaaaaguuauucuuuuauuggccaggcgcgguggcucacgccuguaaucccagcacuuugggaggccgagacaggcggaucacgaggucaggagaucgagaccauccuggcuaacgcggugaaacccugucucuacuaaaaauacaaaaaauuagccgggugugguggcuggcaccuguagucccagcuacuugggaggcugaggcaggagaauggcgugaacccgggaggcagagcuugcagugagccgagguugcaccacugcacuccauccugggugacagagcgagacuccgucucaaaaaaaaaaauuauucagugagacuccaugucaaacaaaaaguuauucuuuuauuauuauuauuuauuauuuuuuauuuuuuugagagagagucuugcucugucacccaggcuggagugcaguggcacgaucucggcuuuuaacaaccuccaccuccuagguucaagcgauucuccugccucagccucucaaguagcugagauuacaagcgcaugccaccacaccgggcuaaauuuuuuuauuuuuuuauuuuuauuuuuuguauuuuuaguagagacaggguguuaccauguuggccaggcuggucucgaacagcugaccucaagugauccaccuaccucagccucccaaagugcugggauuacaggcaugagccaccacgaaaauucauucuuuuaaagggugcaacugaguggccuucaggauauucagaguguuaugcaaccaucgucacuaucuaauuccaggacguuucugucaccccaaaaagaaacccaguaguucugagccaucacucugauucuucccccaguccacuggcagccacuaaccgccuuucucccuccguggauuugccccuucuggguguucacagaaguggaguccugcgcuguguggccucuugugucuggcaucccucacccagcggcgugugcucaaggugcauccaugcuguggcgcgucacugccgcacuccuuuuauggcugcgugauauucugcuguaugggaacaccccauguggcuuagccacuuagcagcugaugggcguuuggguaguuuccgcuuugggcuguuaugaguaacgcugccaugaauauuugcuuacaaguuauuugaugggcagagguuugcuaaauucucaccgcagccuuaggaugucaguacuaucccuauccccauuuuauacaugaggaacauggaucccagagaugugaauuauuaggcucugggcuccagaaucuuccaaguuuuccaggaaaagcuugaaaccuagauuucaauaggaaaucuuugaauuggaagugccugcuggccagacaggcacguagacaauuuugagccuuccguuggccaucccugccuugaagucugggcaggugggcaggacagcugguguuucagacagccccgaaucugaguccugacuuggcuccgacacacugagggagccccagcaaacagcccaggcacucugugccuugauguccuccacuggaaaagugagaugacgccuuguccccugucuccuggggcuguuggcucaaaugaugauaggagauggaggccaagcacuuggaaaacuguacaggguccuucccaggcagagguaggcaguguuaauaacagagggacagauaggcagggccaggaaaggugagggagaggggaaagagugugaccaagaccaagcaggagcaagagaaagagggccguggcuaacaccuagggagcacucaccugugccagcacuuuuauuuuuaagagauggagucucgcuccaucacccaggcuggagugcgguugugcaaucacggcucacugcagccucaaccucccaggcucaagugauucuccccccucagccucccgaguagcuuggacuacaggcaggcgccaccacgccaggcuaauuuuuuaauuuuuuuuaaauagagacagucucacuguguugcccaggcuggucccaaacuccugggcucaagcgauccucccgccucagccuccuaaagugcugggauuacaggcaggaucccaugccagacacuuugggaacucucugugucuuacccauguaaugcugccagccacacugugagauaggcacccauauuaccccauccugcaacugggguacagagagaggaagcuacuugcccaagggcacacagccuggaaguaguagagcugggauuugaacgcaggcacucuggcuucucccaagaaagggagagaaaggagaaggagagggcagggagaaagagcgagaagggaucaugaugagaaggaaugaggggccgaggagcacagagggaggagaaagggagaaggaugaaaaccaacaguaagaaagagauugaggugagagagcaggguggggagagggcaggagggcggggaaggaagagggagaaggagaggaaaacacacagagccaggagcuccugagagaagaaaccacgcuugaccucccccagaaacccacaguggaagcacaggaggagcuacucugggccaaugugguuuugguuuucccuuauaugacucagguuguuugauaaaaauagcaaaccccagugcccagccugugugagucauccauuccuucagcagucccuuuauuuauuuauuuuuuaaaguagagacgaucucacuauguuggccaggcuggucucaaacucuuggccucaagccauccuccugccucugccucccaaaguguugggauuauaggcgugagcacugugcccgguugcucaguggauccuuaagcagcaccuaccauuucaugugucuggccgcggugccagcacagacagugcagggagagcggggcuggugaaggcccugcugaugcggagcuugcauuuggggacacaccaccauugggugacaucgccccagagcaaaucgcccuuuucuucugccaguuugcaccagucaagaagagaugguggaguuguaugucccguaauuuaaagcaauaacaguaaaacaacaagaacaagcugaaucguuaugguuauucgagcaguggacacuuuaccccacucucugcgccaugcucuaagcauuuuauuaacucuugugucucuguccaguacugaacuauaaugucauauaucccgggccucgcugagcuauaggggagaaccaccauccgucaucagucacaugaauccgugcggcugcucacugcggugcacuugggagagcugcccgugagcagcagcucagggucgggcccacgcugcccucugcagcuucugccuuugcagaugaaagguggggcuuguguuaguuuccuguggccgcuguaacaaguuaccacagugagugguuuaacacagcacaugcuuauucuccuacagcucuggaggccagaaguccaaaaucacuggguacgaaguuuagguguuggcucugcugauuccuucuggaggccggaggggagaagucagucaggguccccagcagggccuggggagguggaaggcauggggcacccuggagcucaguggugggcugggcugccucugcuugccgcuugucgcuugaccuuucgaaugacagcaugacccugugccucaguuucuucaucugcagaggggagaugguaaugcuacugcccucacagggcugcagucaggagagugaaaugaguagagugaugccgggaaaacggccacugccguauaugugcuuucugguguuagggucaggaugggucccagaacagugcuccugcuccaaguucaggaccagcugaccuuugggaaggggaggugcucaccugccugcaugccacgcccuggucuucauuuggcacauguagagacuuuccauuugucagguuuccggcaagcagaaaccuggaucugccacccuagaucacagagucuagagcccugggcuuguggccugucucugcuggggcccuuggccaagccccuuuucccuucuggccucccuuggcucccucuacaaugaaaauugcccagcuagcuuuccaggcuguuggcugcagggccaguuagaaaagugaaagagaaaagcuuuuuauaaucugcaaagcagauuauaaaauuguaucaaauugccagcuuuuccugcuugccucugaguaccgggcacguacgcauugucauuaaccucauggugccucugagagacaggcacuguuacuaugccuggguuccagagcugggcggaugcuuggucaugaugucacagccugcuccagcaugauccccccagugcucuccccacagcuggaaaggauuuuucuuuccccgagaugcggguccugcauacgucucccucucuuccccugggcucagagcacccuuggccuugaacguguagagcuggcucccaacccuguuccagcuggagcuucuugagggcaaggauggcuucugggugacuuugucaccccccaucccucagcucagugucuuagacgauaccagccucgaugaugaagggagagugggaacgaugagaacagaggaaggagggacaccagcgugagucaggugugcgggcgacaagagcucaacucaugggcuuugggauuagcuagacccagguugagccagcucugccacuccccggcuggggagcccugguguuauggggauauuuuaaggccaccaccuguggagcaauccugaugugccaggguccgugcugggcucugggcugaguggguucacugagcagugugcgugaagggggaugcagacucuugcugcacacaucgcuggugcugcucuuacuccugccagccuguugaguccuugcagccagucucgggguaggccuuacugcucccaucuuacagacaugcaaauggaggcccaaagucauacagagagcagauggaggagcugggauuugaacccugggucagccuggcguuucuuggccucucuccucuucucaucugucagaugggaccaugcaugugaagcccacacuuagcacagggccagagacguggugaggucuguaaaugaacaguaagggcuacuggagcaggcucugucgggggacaagcaugcagggugcuuauggggagcugccucagggaucagaacccaaggaggggguaaggagcaggaggugggcugcgaugcagcccagugauggccucagccgacccugcagggcucuggagcaaaagugguccuucagcgugcguccguguugggccaggagaggcugggccuuuauguccaccucaaucagucacuggaccugggucacccugggauguggccuuggaugaagucacucugccuaggacgcaccuaauugcccagccacaggcugugacaguacaugggaacuguccaccaggaaguuccucagaggcucagugcucggggcuguuauuggggaguagucauguggcccccucugucugacauguauccgcaucccagguuccccagaggaaagcagguguugcacagaaaccacagugauugcacaagcaguuuaggcucagcgagccccacucacuuaggggauucugggagcccucccggaauccagggucccagaccuugccaggagagccgucucaggccugcugcauuagcccuuccugcauggcuggauagugacagagagaaagaggaagaagaagcuuauuuaaaacuaggaagcagcaagucgugagagccaagagugcgcuugaccuuguuggaaccagggcaccagagccgcuucucauugcugggaaguuuggggaugaugacccugaccuuccgcgugguuauaaccucacucccuuguuuguucccccacagcugcacccaccuccacccucaccugugacucaggaccacagaagcaaaaguucucacucaaacugguaagugacccugcagguggggggcagcuuggaggggagggacuuucacaaacacauccuugacuucugagcccgucugucagcugggagagcucggccgggggccaggguccccaccugcaaggaguauuaagaccgugggcggggcaggcgcccaguucuccaucaucccaggguguuggaaacccacaguuggauccacccaagucuggcucugaugcuucccugcugugugaccugggcaagcccaucccccucagagcucaguuuccucaucugugaaauggagccacuaauacccacaggguguggcccaucugcccccuaccaccggccucgcagcgugcucguaucgagcaccuacuguguaucaccgugcugggugugggguccaaaagagaacccagcagauggggucccugugcugaggauucagugaaaucacacaucgggugccgagcaugagucucagcagacaggacaugugcacucgagguuggggcuaaaaggaaacaaauagagaaagggagaguggccacgagggugaaucacgccuuccacacagaggaggugccuaacagaagggcaucguggugguucauagccccgccaucaucccugggugcugggauuacaggugacucuuauuuucuuuuuguuuaucagaauugucucacaccccagaaaaccagggacagcugggucaguugcccucccuccgcccuagguggaggccaugagagugggucagagcgugggcuguggagccgggcucacuagugguggguagcaccugcuuugagagccuggcauugccugagccgggcuguguuucauaagcacugcuucauugaauccucccaguagggcagcuaccgugucccauuuaacacuucucugcaugguucaggugugucuggcacaguaggcaccccaucaaccugagcuguuccuguuauuacuacuguaauuaugcucaucauccuagaaauacagccuugcucucuguucgugcaucugaccucaucaacauuuccugaggcucaaaacuuggugaugaugaguuggccccaggcccagcccuggagaggcucccagucuggcgggagccaugucaugucccagucccaucgggaagaggggugggcugggaggggagcacagggcacugggccaaccagaagacauucacccuccccauccacugggaaggcagcucuguucugaagcauucgaaaggucaggggcugaaugcccagugguguucauccauccauuuauucauuuauucaccaagccuuuccugcaaccuccugugaacugagugcuggggacaucugcagagaugggucagacccaauuccugcccugaaggagcugcccccuugggggaguggggcaggcaugaauaccccacaugagauugcucagggccugcauggcugugcccacgucgcucgcgucagucacuaugggcuucgccagcaucguggggaggacuccaggacgcaaaaagagaaaaggacaagaagaggagaagauggggcagggagccaggcucacuaaugaccaguagcagcaccugcuuauugagaaccuauuaugugacagucccugggcugagugucacaagcauuaugucauuuaauucuuuuggauuuuuguuugagacaggaucucucucugucacccaggcuggagugcagcggugcaaucaaggcucacugcagccacagccuccuagguucaagugauccuuccacuuuagccucccaaguagcugggaccacaggcaugcaccaccacguccagcuuuuuuuuuuuuuuuuuuuuuuuuuuuucugguagagauggggucuuccuguguugcccagguuggucuggaacuccugggcucccaccuucaccuccuaaagugcugggauuauaggcaugagccaucacacccagccuuuugguuuucuuugggguuuugugugugcguguguguguguguauguguguuuacuaugucauugaauuauuucagcaagccuaugggauggcuuccauguuccuauuuaacagaugaggaaauggagacucagucacuugcccaggugcacccagcacgcagguugcuuuguucacagcuauauccccaaugcccagaauaauacucagcauauaauggaggcuuuguaggaagaaugaaugaaugaauggcagagcugggguuugaaccuagaucuguuugacucuauacucuuaagaacucagcugcaugaguuguguuuaauuaaaauauuuggugcuuuuuuuuuuuuuuuugcuacaaaaucucacucugucacccaggcuggaggugcagucuuggcucacugcaaccuccgccucccagguucaagcaauucuccugccucagccucccgaguagcugggauuacaggcacgcaccaccaugccuggcuaauuuucguauuuuuaguagaggcaggguuucaccauguuggcgaggcuagucuagaacuccuaaccucaagugauccaccugccucagccucccaaagugcugggauuacaggccuaagccaccacaccuggccauuuaguguuauuuuaacaaauaccuaauauuaaugguggcuuaagcaagaugauguuuuauugcuuuuucauuuaaaagucaggggcaguuuuccagagcugauaggaugguuuuauaaacaaggggcccuguuuccuucuuuuugcaccaacauuuucaacgcauaaccugcaucuccugggccguaguggcugcuucagcuuccaccaucacaucugcguugcagccagcuggaacagaagaggaaagguagagccugucccagcccacuaagggcauaaccuggaaguugcccacauuucuucugcucacauccucauuggccagaacuuggucauguggucaguccucacugcaaaggaagcugggaaacguaguuuuuaugcugaaggcuacauucuagggaacacuguggcucuuaccauaagagaaagaaaaggaaccuggguacagcaagguagcucgcagucucugauguguguuugugugcaguaccugaggaauuuggcuccgauguggggacuugaugaggagccuggucauugagggaguaacaaauugccaguggggacugggggcccuuaucugagacuucagugugacagccuucugccccuccugucccccaccaggaugccaaggaugggcgcuuguucaaugagcagaacuucuuccagcgggccgccaagccucugcaagguaccugacagggaacugggcaaggaggggagagugaggggggcgccaacuuggucacagcacuugacuucuaccugcaggcaugagaagggugggcuuagauuaaaggcccagguuugcucccaucuguguccauaaccugacuccugugaccccucaggccucaguguguguugugacuggcucacaccagcucuuggaagccaaguauuaaauuuucaggcugggcguggguugacgccuauacucccagcacuuugggaggcugaggugggcagaucacuugaggccaggaguuugagaccauccugggcaauguggcaaaaccuuaucucuacugaaaauacaaaaauuagccggguguaauggcaugcaccugugaucccagcuacucaagaggcugagcugagagaauugcuugagcccgggagacagagauugcagugagcugugauugugccacugcacuccagccugagcaacagagccagacccugucuccaaaaaaaauaaaaauaaaaauaaauuuuuaggaagauggcaagcugguuguuacagacagccaguacuagcaauuaaauuauauaggccaggcgugguggcucaugccuguagucuuagcacuuuggcaggcugagguggguagaucaccugaggucaggaguucaagaguagccuggccaacauggugaaaccccaucucuacuaaaaauacaaaaauuagccaggcgugguggcgugugccuguaaucucagcuacaugggaggcugaggugggagaaucacucgaaccuggaagguggagguugcagugagccgagaucaugccacugcacuccagucugggcgauagagugagacuuagucucaaaaaauauauaaaauaaguuacauaauuuuacaaauaaauuauauucaaaacaaagguaaugaacccucagaaauucaucacuuccuaauuauuuccuacauguccugugaucucugccagugagguugugugcacuauugucucuguguggugagaaugcugcaugauggccuccccuguauaucucucccaccccaccuccagucaugucauguugguagcuuggaguuggccauagcaggaguauuuauuuacacugcagaaauuagcaaaugcagucgggcgcgguggcucaugccuguaauucccacacuuuuggaggcggaggccgguggaucaccugaggucaggaguucgagaccagccuggccaacauggcaaaacccaucucuauugaaaauacaaaaaaaaaaggccgggcgugguggcugaugccuguaaucucagcacuuugggaggccgaggcgggcggaucaugaggucaggagauugagaccauccuggccaacauggugaaacuccaucucuacuaaaaauacaaaaauuaguuggaugugguggcacgugccugugaucccagcuacucgggaggcugaggcaggagaaucacuugaaccugggagguggagguugcagugagccgagaucacgccacugcucuccagccuggugacagacgaagacuccaucucaaaaaaaauaaaaaauaaaaaaaaauuagcugggccugguggcagaagccugcaaucccagcuacauggaaggcugaggcaggagaauugcuuaaaaucaggaagcggagguugcagugagccaagaucgcgccauuguauuccauccagggcgacagagcaaaacuucgucucaaaaaaaaagaaaaaagaaauuagcaaaugcuacccaucaggacugccuucccuggauagccagcuguuaaacuagcaucagcucgccauugguucugguccaccccacugagaucuggaagacaggcagaggcacauuccggugaugccauggcuagguuagacacguguugaucuuguuagcucuaugugugaauucggaaguaacccugucauuaucccaucucugcacuccagacuuguauaugcuuccuccagagccaccaugaucaccccaucaccugcagaccuggaucacagacauucauggucacccaugccugcccugucaccagccccuucccaccaucacccacccacaauguugucaccuccaacaaggagacuuggaggcggucugggcacucugugcuucuucucugagaacuagcucuuacugccaugggcuugggacuggguggguucuaaccucaagccccugcuuuccgcagucaacaaguggaagaagcuguacucgaccccacugcuggccaucccuaccugcauggguuucgguguucaccaggacaaauacaggugagcugcucugcucacugcuugccucaccggccucuuuccucuucuuccuguugugacuccaggcauggcugggaccccgaagccgugggccaggucuuugcuuccugccuucucguaguuuugaccuaguuugcugcccagccagucagaaccuuugaucucaccugggaccaggaccuugcagcccacgcaacaguccauccuuggcggccgguacuccucucuccccuguucaucucccaccuccuggggugcuugugucuuccagguucuugguguuacccagccuggggaggagccuucagucggcccuggaugucagcccaaagcaugugcugucagagaggucugugcugcagguggccugccggcuggugcguacccagaaguugcucagcugccgcgucagggagggcacaucacauccuaguuuagcaggcacuuuagucauugacacuuccggcccccaccccccuccgcugcacacugggggcuggcucacugacugccauggcaggcgguuagagccgagaugauggguggucaguccuguggagggcccuuggggggccaugagcauuggaggaaggagccccggccucaaacugaaggcuuagauuaggcuuccugguggaggguguuucuaagccaagacucucaggaugaguggaaauagcaaagugcuggguggaagaggaagaggauagaugaggagaggaugguccggccaaggauacagcuggggcaaggcuuguguggaagggagagcauauggcauuuguucauuaguucauucauucauccccauuaaauauucaucaggcacuugcugggugccagacgcuguccccggggcugggugcagagcagggagcagcauaaacaugguuucugugucuuagagcucacagucuagugggaggggccaauagugaaucaaacaguugcacaaacuaugacaagugcucugaauagaagcggccccugcugugauugagaguaagagggcccaguuugcaucgcuggagggauggacguaccaagggagcgacaugcugaguccuaaggucuuuauguucaguaucugcaguauggcacugcagugcggaagagauggaguuggucuggagaggucagcggugaccacaucacacggggccucgcacagcaggcugaggggcugggaucugucuugagggcacuggagagccacaagagugcugggauuaggggagggcggggucagcucuggguacagaaaggcccucaggggccauauggggagggacuggaauggggagaagaaucugagugaggguccaugugggagaggacaaggcugaggagggucccgggccccggggguggagagucuauaggaggagaacgagcagaauuugguggacaguagagcccuggggucaaagaggguuggggauaugaucagaauguagcugacacucaggcagcagacacaaucaaagaauuggccgggcgcagcagcucaugccaguaaucccagcacuuugggaggacgaggcagguggaucacuugagcucaggaguucaagaccagccugggcaacauggcaaaaugcccucucuaauaaaaauacaaaaaauuagccgggugugguggcacccaccuguagucccagcuacuugugaggcugaggugggaggaucaccugagcuugggaaaucaaggcuacagugagcagugauuguaccacugcacuccagccugggcaacaggaguaagacccugucucaaaaauauauauauacacacagcaaaaaaagagucuggagcucauagggacagcuggagcuggagaucaagauauaaauugcuuaacaagauuuauuucugcucucuaggacaggugagaagagcucuuugauauccacaggugcugagucauuuuugcagagagacauuaaccccuuuucccucugcugaguuugucaucagcuaagagagaaauacaggaguagauaggaagccacgcuuuagcucaauugaugagcuuccugagagccugauuagaggcgugcucaaugugcugucacagcgggcuccucaugcuaccccggauuuagucagguuuaacccccagucacagugucggacaaccccaggccuuaauaguggggcucccuccuggucugcaccauagccucucuguguuagucguacugcucaugcagacacugacuugcuucuucccccagcuggaugcccuggaguuccuccaugagaaugaguauguucauggaaaugugacagcugaaaauaucuuuguggauccagaggaccagagucagguaagagccagcuccugcccacucuggaagaucucugggcucagguucccaucugucuccaaaucucuauuuauuucauagugcuuauuacagacaaaggauugcuguccaucauauauaaagagcuccuucaaauaaauaagauaagcaacuuaguaggaaaauggacaaaggauaagaaaagcaauucuuaaaaaaagaaauccacaggcuagcuaaauaauaugaaaagauauucaaccuccuuaguaacuauagagauguaacuuaaaacaagauacuauuuucacccuuugaacaaaauuaagcaugauaauaauauucauugcugauaaggauauaaggaaguaggaauucuucauauacuguuggaagcaugaauugggaaacccuuuuggaaggcaauaacagucacaguuuuaaaugcaccuguuuuuugucuuugauuuuguuuugagauggaguuucacucuuguugcccaggcuggagugcaauggcacgaucucggcucaucacaaccuccaccuccuggguucaagcgauucucugucagccuccugaguagcugggauuacaggcaugcgccacuacgccuagcuaauuuuguauuuuuaguagagaugggguuucuccauguuggucaggcuggccucgaacuccugaccucaggugauccgcccgccuuugccucccaaggugcugggauuacaggccugagccaccgugcccggccaaaaugcaccuguuuuuugauccacaaguuccugucuuaggaagguguccuaccuauauauucauaggauuguucaaagauaaguguacaagauguuccuggcaacacugauuguaauagugaaaugggaaacaccuuaagcgggauacugauuaaauaguauuuuaaaguaacuucuaauugcucuuacaauuacaaaugacagaaacccaacuuuacaugccuuaagccaaaaaccaaaagggacugugugcaauguauuaguccacagaauggagcaauccaggacugcacugucucgggcacggcaggauccaggagcucaaacccugucauugggaagccggcucucccaucucuggacuccucaugcuucugcacugcucguugucaggcagacuuauuccucauggugacaaaauugccaccagcaaauuaggcuuaaauccccaaagcuuagcagcccuggcagaaacagaccugaacugcguggacugagaacuggggaaaagcaaucccagaugaaaauccuggaacuaagcauuaggaaucuucagagaaacagaacuggcagggugugugugugugugcguguguguguguguguagagauuuauuauaaggaauuggcuuauugauaauggaagcuaagcaguccugagauucuucaguuugcaaucuggagaccuaggagagccaaugauguaaguuccaauccaaaggccagcaggccugagacccaagaagagggguuguuucaguucaaguccaaaggcaggaaaagaccaauguucuagcucaagcagucagggaggaggagcuucugguuacuuagcuuuuuauucuauucacaucuugaguugauugaaugagacccacccacauuaaggagaauaaucugccuugcucagucuacaaaccccaauguucaucucauccagaacacccucauagacacucccagaauaggguuuggccaaaugucugggcaccccauggcccagucaaguugccacauaaaaaugaccaucauggccaggcccaguggcucacaccuguaauuccagcaguuuaggaggccaaaguggaaggaucggaucgcuugagcccaggaguucgagaccagccugggaaacauagggaaccucaucuguacaaaauaaaaaauaauaaccuauccagguguaguggcauacacaugugguuccagcuacucaggaggcugagguagaaggaucaccugagcccaggagauggagacugcagugagccaugaucauaccacugcacuccaaccugcgugacccagugagacccugucucaaaacuuaaaaaaaaaaaauuauuuuuuuaaugaacaccacaaacuguaaacagaaaaacagggagccggggaaguguauauaggucuuacauagacaaaaccaacaguuguccacuauccauaugguggaauaagaugcagccauugaaaagaagacauggacugggcacaguggccaaggcaggaggaucacuugaacccagggguucaagaccagccugggcaacagggcaaaaccccaucuuuacaaaaaaucggcugggcaugguggugcaugccuguagucccagcuacucgggaggcugaggugggaggaucacuggagccuaggaggcugcagugagccgugaucgcgccacugcacuccagccugggugacagagugaaaccccaucucaaaauaaauaaguagauauuuuugaaagaagauuugguuaacuuuauguaucaggcagaaagcauuuaacuuuuguuuuaaacucaguuaagccuuauaagaacccuuugagguggggacuauuauuaucaucauuuuacaaauggagaaaucauagcagagagaacugguauagcuugcccaagguuguaccgccaccagcgggcugaguuggcauuugaacccaggccaucuggccccagaguuaaugcccagaaccacuauuaaaguguaaagugccggugcccaacaggaggucuggugugaggccucuguggaaaacaagagcccccuccccauccacauauguuuaccugguuauuuaaaaaaaaaaaaaaauuuuggaaugaugcauacgaaacuguuacuagugguuauuucugggcgauggguuuuaggggcugggaggaaauauggauggcugguuuggguucuuuuuacuucacaucauuuuuacuaugagcaugccuuaguuuuguaagugaaaaaugccaucuuugguagaauguuuguugucacuugcacccacgauggaaaucucugacuucuacgcuccuaaccuccaaucuguauggcuuuucccuguguccacaggugacuuuggcaggcuauggcuucgccuuccgcuauugcccaaguggcaaacacguggccuacguggaaggcagcaggagcccucacgagggggaccuugaguucauuagcauggaccugcacaagggaugcgguacgaggccagggauggguuugggaccgcagagagaugcuucuuauacaagggcagcucuaggaguucacagccagagacagcagguggccagacaggagaggcacuaagggcgccaggacagggauuggaaccacagacagcgucccgaccgcaagggaggugggugggguagcgguucagcacuaagcauagugggaggcugggcacuggggagccugaguuccagagguugggguucaggaucuguuguagacuuggaagaugggaguugccuaggagucauccaggaggggcuguugaggaggugguuggccaccacaucuggagugugggagggagaucugggcagaggcucugcaguaucucagaaguuaucagccgaagcccugggagaggaugggaucauccagggaaaguguacagacuaggaagagggcccagggcagauuucuugagccccucuuucucacaucccuuuauaucauggccguccacaugccugccacauccucccaucagacugagcucccccaguacagggauggcaccccugccuccagcaucgggugguggaaggccagcacggacaaguagugcuugucgagugcuuacacaaagcguugucuaaauuaagcguugucuuaugcucaggaagcauaagaaaaauaaacugucagagucucccccgcccucccccacugaggcuggguuugguacccauccuucugggcucccguguguucuguguccuuugucacucagguagucgcacgcuauagcugucuccccacuaggcugucacgggcugggacccgacgagauccuggucuggguuuucagaagugagcugggccuggcacacgggugcugaggcuugauugaaugagugcaugaaugaaagaggaguggaugagggugaccugguaaaaggggcugagagaaugguugagugagagagagaaugagucagcuucugccuacucaugaaagugaaugagcggaggagacagcccauauggcuggaaggcuggguguaugagugugugguugagucagugagagagaggggaaggaagggggguggacccaccagugaguggagcguccagacuugagcugccaccuuuacuccuccuuccccagggcccucccgccgcagcgaccuccagagccugggcuacugcaugcugaaguggcucuacggguuucugccauggacaaauugccuucccaacacugaggacaucaugaagcaaaaacagaagugagucuaggggucagcagaaccccugcagguggucagcagaaccccugcagguggacagaagcccagagcccaacugggagcaggagggaaggggagguggcauccagcagagcccaaguccucugagccgcacaggcaugugcugcaguguccacacagcaggcgaggcagguguuccggagccacacugccugggcucagacucuggcaccaccacugugggguguuaacgucugcgagccucaguguccugcuccaugagauggucuccuacuagcuacuaccuuaugggacugcaaagaguucagggaagucaggugcacacagcacuuagcacaggggcuggcucagagaaaaugcucauuguggccgggcgcgguggcucacgccuguaaucccagcacuuugggaggcagaggcgggcggaucacgaggucaggagaucgagaccauccugacuaacacagugaaaccccgucucuacuaaaaauacaaaaaauuagccaggcaugguggcgggcgccuguagucccagcuacuugggaggcugaggcaggagaauggcgugaaccugggagugggagcuugcagugagccaagauugcaccacugcacuccagccugggcgacagagcgagacuccgucucaaaaaaaaaaaaaaaaaaaagcucauugugugugggaaacuaugacucauucaucacaaacaugcaggcaaucugagcaggauaggcccaggcccugccucagcacugguagcaccaccuaugcaguguccacacugccagaucagugccuucaccucuguguaaaccaccaggucuuaccagugcugguuuaaacauucagcaccaaagccgguggacagcggaacauaugaggaaguucuggggugagauugaacacuaagggcauugagcagcuggacacagagggagcacuagggguauggguucagcacuagggacagcaggcagcugggcacaaaagggaggcacuaagguguguguucagcaccaagaacagcaggcagcgggacacaaaagggaagugcuagggauguggguucagcaccagggacagcggagcacaaaagggaagcgcuguggguaugaguucagcaccaaggacagugggcagcugauccuagcgggcgugcuaggcaugcacuucagacaugaauaucaguugcccaggccgggcacggugguucacgccuuaaucccagcacuuugggaggccaaggcagauggaucucgaggucagcaguucgagaccagccuggccaacauagugaaacucugucucuacugaaaauaacaaaaauuagccgaagcaguggugggcaccuguaaucccugcugaggcaggaaaauugcuugaacccgggagguggagguugcagugagccgagcucucgccacugcauuccagccugggugacaaagcaagacuccgucuuggacuuguugcccaagucaucugggaggcagcuggccaucuacgucugaagugcaggagugaagucuaaagggagacucagaccccgggaauaucuccggagccaucagcugaagccccaggagaggaugagauuaucugggaaggcauauagagugggaagagggugaacccuccaguaaauggcguugagucccucauguuucccuguccuuagugugccgugaaguccuucccaguccuucccucacaugaagccuuucucguuuuauuuuacucccuucgugucucccaacuuccuucucucaaccauggacagcugcucaagcacacuuaacauguguucugauguguucacuuagauguauuuguacccucaaaaucgcaugcuggccguggugcugugugugauuugcguaagugauguuccacucugcgucucaucugucucuggcucucuucagcuuuaacccuaucccuacauguggaccgaguucacugcuucugacuccggcuucuaaaucaauuuucuauagacaugucuguguccuuaaacuauauauggugguacuguguguuaauuuguauaaauggcacuaugcucuaaaccucaugcuguuucuugccuucuuucacucaauguuauguuuuuaacuuuaacuauacaccuaguucacuacuucugaauacuccuaaauguguuaguuuagaugcaucuguguccuuaaaaacucuaugauguucuuggguauguguuuaauuggcauaaguggcaccaugcccagaauuucauccuccuucagagaaggggaugugugucgucauuuugacuuccuucuacugacuguucaaagcuaacauuuauuauacacuugucugugccaggcacugccccuggugcuuccccugcauccucacaacugcucugagcugcgugcucucgugaucuguggcacagagagcuuagguaaucaguccaggccacacagcuacuaagcaggggcuccugggcucaaaccugggccauucaacuccagagacagcccaugucaccuacgugcugcuucccaaguggaggaggcuuaugaggugaacuggugguuccuggacccagccuaccuucacucaacaaauacugaacccuugccaugugcuagacucuguucuaggcccuggggauacaggaaugaguaagacaaaaaucccugcccucagggagcucacauccuauugcgggagacaggagcuaaagggugaaacacauggugugucagaggucagacugaugagggucaugaggccagguccuggguguccacuggugggacuguuggugggggugugcagcacacuuguaggucuaaugucaggggcaggucucgcagcgaugguaacagguaaaaugcccccugaaggaccaugaagcuuuaaacaguggcaagaaggaugacacaguuugaugcuaauuugccccaacaucccugcggaaagaggaagagacaggccuucagcccccagacuuccgcaggcaaccucugcaugggaagccagccucaggaccugcuagaacacaaguccauugccccauuuucuuggagcuuauuuuuacacuuacucucuagcuuuaacagauggugcugggguuuucugcucacaguggugagacagguuucuuuugaaaugaagccaggugaaaacgagucacagaaugaguggcccgcuggagucccuguguaagugaagguagugaaaugcucccucacacacucuaauggguuaguucaggacaagacugagcuguucucacaaggagaccccaaaacacugcagcuuccaugagggaggguucacuccucucacuaacagucccaaggcaggagacugagggcaguaggggggccucaauucccugugacacacacacacauccuucucuggauacaacagagagcacacauugugggugcccaaggaauagcagcagaucuggugcgguggcucacgccuguaaucucagcaguuuggaagcuuaggugggcagauugcuugagcccaggaguuugagacccgccugggcaacguggugagaccccaucucuacaaaaaaaguagccgggugugguggcacgcgacuguagucccagcuacucaggaggcugagguggaaggaucacuugaguccaaggagguggaggcugcagugagcugugauugucacugcacuccagccugggcaacauagugagacccugucucaaaaaaagaaaaaggaaagaaaaaucguaguggaaugaagaacaacuaaggagugaaugcugagcccgcccaggcuucaguguggacacagaggucgggcagacgcagccccaaugucgggaguucagggcugggaggagacacggacaggaagcaggagcugcaggugaggguggagguagcccggcacugugggagcagaggggaggcacaggaccccgccaccggcuccuggaaacccucaccugggagaugccugaccuggucucuagagaacacaagagccucccaggugggcaagggggaggcaagauuccuaggcagacaggacagcacagcucugaacccucuccacuuacgcauucagugccagguuccugaggccaguggcugugcuggacacccagguuagaaucagcccauggugccucugaacuccagucuugucagggaaacuggucuccaaggcuccccucgguugagucuucuccccacuucacuuccuaacuccuaagagcggucuuaucaugcuuuucacauccccccaucuaaagagacuuguugaaugugacugguucacagagagggucugcacucgccaacauggugcagggugaguuaagacaggucaugguaaucaucucauaucaaugauagcagcauggauaacaguaauuccacagccccagcuccagaccacaaccauagagggccaggcgcacaaaaaugcucucuggagaguagcuggcaauguugacacugucccccagaugcaccuccucacccccagcccauagucuguuagcccagacaauaaccaaggggaccacaagggggcgauguugcuacaugcucguuuccuggcacccuaaggugcccugcgcuaggacgguuuacugguauacauggccuuuuuccauucauucaacagauacucauuuuuugcacauuguaguucacgacagacaaaaugaguaaaagaaggaggagaggccguugaaguccccgaggcuuucuggcauucaaggccccuugcugggcaaagcacaaaugagagccagcuuuggacccgcuguuagggcugcccaccuggccagggagagcccauggcaggugguggcagugguguugcugugcaguguauaauguccuguugauggcacaaccgggccuuccugcgcauguaugucaauggccgccaugggacaucuguggaccuacgcacaggcccaggagggacagaguuccuccgccuggaggggucuggggaagacuucuugggaggccaagcccucgagcuguaucucaaagggagaacagccaccugccagagcucaggguggggaagaccacccaggcagcgagagcgauaugugcagaggcauacgugcguggauguguggccucgugggccuaggaguccuuugguguggcugggacaugcaaugggaggaaggaguggggagauggagucagaggguggccagugugugcuggggagccaugggagggagggugggcugugagcagggagggucagggacagguguaaagagacccucuggguccacauggggauacacaggaggccagcaaggaguugagguccagggagaaagguugagggcugagcuggccccagauccauggggcagaggaggacauggggcagagagaguugagaaacuggaggguggggcugggggauggcgaaggcagggucagagaccagugacugggcagguggugggagcuggcccgaugggccaggcagagaaguggaggggcugggccuggaggauggagcaaaggcagugggcaaaucaggauuuuuccugaacaaacgguugcacgugcaugcauguguuuguguuauacauauauguguauguguguguauguacauauacagucaguccugauuauucagaguccauaugugugaauucucuuacucacuaaaaguaguuguaaccccaaaucaauucuugcuguucuuucauggccacuuacagacacaguguggagaaaaauuuuaaucaucugacacacauguucccagccuaggguggaaccagacagcauucugccucccuauuucagccuccacacuauauacgcugguguccuuuucacuguuuaguuaaugauacauuuuuuccuguuuuuaugcuuuuugucagugauuaugccauuuaaaauggccucagccaggcgugguggcucacaucuguaaucccagcacuuugggaggccgagacaggaggaucagaccagcaugggcaacauagugagaccccaucuccacaaaaaaucaaacagccaccuagcauaaugcugaagggcugucugaugucccaaagccugagaugguuaauaauucguguguuuuaucagcuuuguucaggcaugagcuacggugcuguuggucaugagucuguggggaauucuuaucauuucagguugccuugggauucauuuuaauguaagcuggacuuugucaugccagaaacaaggcucggucaccgucagcaguuugcaguuuuccaccuccucccaguuccuccgugugguugacccagauaucuccguuaugcagccgccuccgggggaccaccucccucccuuugagucagccacagacagccuacuugacggccccgcuggcccccacauuccacugaacugugcggaugccacagugacccccucucaggcacagcaugaccuccugaagucgagccugcuugcuuugaaccuaccaguuaaaaucuccucaaaauguuuggauaccgcccauuggccccucacagccacgagcucccugaccagugugcgugugugugugugugugugucugugugugugcuugggacggguggggaggucaccuuugggugugcggugugcccccaggaccuguaaguaauaaaaucuuuauuuccaucuuggaucuuuccucaucaucaaagggauccucuccgucuuaaggaucacagauuaaaagaguucaaugcuaaugaaucaacaauacuuauuacauaagauguauuucaacagaaacauacauaaaacaagguguauuguuuuguuuuguuuuguuuuugagacggagucucucucugucgcccaggcuggagugcaguggcucaaucuaggcucacugcaagcucugccucccagauucaugccauucuccugccucagccucccgaguagcugggaccacaggcacccgccaccacacccggcuaguuuuuuauauuuuuaguagggacaguuucaccguguuagccaggaugaucucggaucuccugaccucgugauccaccccccucggccucccaaaguguugggauuacaggcgugagccacugugcccggccaaaacaagguguauugaucggggaaaaucguguggccagaggcuugcaggaagcagugcuguuucccuugggagcaaugguaguggauugguugauucaguguucacagugacuuuaagaacauaacuucccuggauggcagaggggacuguguauauaucuuaggcuguguauauaucuuaggcauucuguuuuaaaagguugcucuccuuucccuaagagaccuuucacauguguuucugucccuucagguuuguugauaagccggggcccuucgugggacccugcggucacuggaucaggcccucagguacguccugaagggagcgggaacaggcggggacucgggcaggaccugguggcucagauccaucuugggguggcuucuccuuacaccucuucauuuuuuuuaguuuuccaaauugcauuuguaauacguacccauuguagaaagacaaaaucgucaaaagauucacuagugccucugaaaaacaaaacaaaaacacaacuuuuuuuugaagacaggguaauuuuuuuuuuuuauuuuuaagacagggucuagcucugacauccaggcuagagugcaaugguacgaucucagcuuacugcagucuccgccucccagguucaagcaauucucgugccucagccucccaaguagcugggguuauaggcgugcgucaccauaccuggcuaguuuuuuguauuuuuaguagagacgggguuucaucauguugcccaggcuggucucgaaccccuggccucaacugaucuaccuaccucggccucccaaagugcugggauuacaggcaagagccaccaugcccggccauuuuuaugaacaaaaaauaagcucacccuacauacaucucauucuaccucuugcuuuuuucacuuaacccuggggccauccuucaugcccuuccuuauagaugcaccacagcuuuuaucaacagcugcacaauggucaugguuuguccgcaccguaacuuauaaagccaaucccuguuacuggguauuugcacugucuuguuggggugucggggguguuuguuuuuccuguugucuuugugccccuccugaagagcuuugaugcuuuucuccaagcuggaggcagaaauggacagacagaaacagauagcuuguucccucuggcucucuaaggcucauuuuuuaauuauuuauuuuuuuaaaauuuauuuuauuauuuuuuuugagacggagucuugcucugucgcccaggcuggagugcgguggcgugaucuuggcucacugcaagcucugccucccggguucaagccauucuccugccucugccucccaaauagcugggacuacaggcacccgccaccauguguggcuaauuuuuuguauuuuuuuuuuuuaguagagaugggguuucacuguguuagccaggauggucucgaucuccugacuucaugauccacccgccucugccucccaaagugcugggauuacaggcgugagccaccgcgcccggcugaauuacuuuaaaucccuggguucagauuauggcucagcugcccaagugacacuccccuccaguucuaccucugugaaccuugggccucgaggauuuuaagcuggucagccagagguuggagguggaggugaagcagggcccgcccucuuuaaagauacaugcuaaauauuuauaugcagguagacugcauugcuagcugggauuugcuuuaaaacacugcaggccaggggaggggucuugaugaaacaagauuggcugugaggugauccuuguugaaacugagugauggguacuuggguguucaugcccuucuacuggugccugcguaugacauuuuccaaaacugaaaaacaauugaaguccucuggcaaugccaggcaacaagaaaaugggcacuuuugcugagacccucaugccccucagucccccaccccuccauccuuggguggagacccccaggaucgggguugggggaugccucucaggcucucccuugcuggggguugucuugaccacagagacccugcagaaguaccugaagguggugauggcccucacguaugaggagaagccgcccuacgccaugcugaggaacaaccuagaagcuuugcugcaggaucugcgugugucuccauaugaccccauuggccucccgauggugcccuagguggaauccaggugggaagagcuugugaggcuuaagccucucaccccuugcccucacccgagcccugccccaggcuccaggagacacuucccagaggcuguuccacguucauaccagggcccagcuucccagggagacacuggguuuuuccgcacgguccuugaacuucccagccucaaggaauggcaaguagcagaaacccggcucaacuuggcuuuaagaaaaguggggauugauuggcuguuguagcuagaaaauuacaagggggagcuucaggcacaacgggauucagggccucaaaaauagcaucaagacguuguuugucucucgccaucuucugucccuucuugcauccaugccucccucuguccuuccacccggccaccuguagucucuacuuuccuuuggccuggcccccuuggcgcccccauacacaaaagguagcugcuccaugccuucgggucucguucauagugcgcacuaccccuuccuguggaugacggacacuccucacagccagcagcugggcguuugcuuaguuucccagauuuuuauuuuaccaacagugcugccugugugcacagcccggcugcuggcgcacgcugucuguggauggagguaucaacuugacagugcugacuagauggcuuuacuuccaucagcacuuuguguaaacgugcaggaauuuuuacaaggucaaagacagacuacacaguaaauuuuggcaagggugcagagaugugugcugaagaggagcuucuccaggcuccuuuucucuccccggaguagucauuucucucaucggaguuggcuggaaccaaagcucagugcuuugucugauuuggcaccacccugggggcauuuggcagugucuggagacacuugguugucaggaugcgggacaguggaggccgggaugcugccugacauccugugacaugcagcacggugcccaccuguaccaccccacaaagaaucccccggccccguggucagcagcaccacgauugugagauccuagucgcagggcaucuugaacagcaucuccuuuugacggccugucucccggcgcagcgacguucuucuuggcgcuuggauuacaagugcuucugcauucccacaacguuuccuuacaucugaggcugaaaccugagcugacacgugugugucaagcgauucguggagcaccugcgcacagagugggccaguggugagggguggggacucuuuucuccgugguggaguagcaggcucucugccucaaccaguggugccgagaguaaagucaugaccugugccaaucucccucuuucccccaccucuccagcucgauacacagcuccuccguguacccaguuauccaggccagacagcucgggguccuccccaacacccuugcucccccagcagccuccuccaaaccuucggucccgggugagacugaccacggggucacuugucacagucuucugcuggcagccagcuccuccagggcagggucgcgucugacucugucaucucugcuuuucuggcauggcacagggcagaggcuucauccuguuuaucgauggagcgagcccaggcuucccgucgucagugccacugugucucacagugccuuccucacccagggcaaagggcauuuagaaccugacaccugacaaccucccagggucuccaccgucucacacccacgcgcucccuggaggccacucacucagccccuugguugggaacauaacgaggagauggcauuuaaggagcccagugaucuucgagcaccuugaaggucaucuugccugugcuccacagcagcuccuugccuuggcccgaggccgagcucccuuccucccccgugcacgaugcaccagccacacccccgccccucugauucuagaccaggccaagcuggaccccaccccggaaccuuugcaccugccaucccgaguucuggaaagcuccccucauccuggcuuuauguaccugcugcuucucaagacccgaggccuuccccauccuccaugaggcauccucacugccuccccacccacuugcucaucaugucaccuguuuuccacacagcccuuguucccaucuggagggaagcguguguuuaguguguagucuccacccgccuccuccucauccuaagcccagcaggggcuccucaucccguauggucaugaugacauccccaguaccuagaagaugacauccccagaaccuagaaggugcuuggcaugaagugaaggcauagaggguguuccuugaaugaaugagacacuaacagcauuuuuauugucuuccagaacuuuccauuugcagugugcaacagaaaaaaaaaaaugaaguaaugugacucaaggccugcuguuuaaucacagauaagcuucuagaacaagcccuggaaugugcauuccugccacugguuucaggauacucaucaguccugauuagccucccggagggccccaguuucccucccgugaaugugaaguuccccaucuugguggccugcccuucagccaguguccuagcaaagcuggaugggguugggccggcccacaggggggaccccuccuacccuugacaccucugugcuuugguaauaaauuguuuuaccagag

SEQ ID NO: 191760 - RNA, 22624 nt, Homo sapiens
cccagcucacacaucuuuauuggccuggaugugggguugccaaaccaguugccccuguccugugucagccagcuguggcaauuucacccuuauuccuuggagaggccagcugccugcuggaaggagucagaagucgguggaugucauugaggccuuggaggccccagucuggcgggagagaaauccacaccugugccuggaguucuccuucccugacccucugaaccggcgcuuaaaaugcugucccgccuggaacagggaggccacauccagcagugcguccucaaugugcugccccagccugugggaauccuggaaggagaacaggucagagccaggggaagcugggagaugggauccuggaggcugagaaacaagagggcuaagggccuggauuccugagucugagggaggaggagcuggggccuggacucccgagucugagggaggaggggcugggggccuggacucccgggucugagggaggaggggcugggggccuggacucccgggucugagggaggaggggcugggggccuggacuccugggucugagggaggaggggcuggggccuggaauccugggucugagggaggaggggcugggggcccagacuccugguuccugaggaaagagggaguugguggguauacacguuugucucaccguuuuugugcuugauuuuuugcuggagauguggaaggugaucaugccaucccccaugaagauauaagaaacaccauaaccauggucaucagccuggagacggaaagagugaagggaagaaaauagcuccgguccccuccacccccacuaugcaggagugcaggccccccagcccccucuuuccucugggggccagcgcgcccagcuccacucacaggcccgaauccaccgccugaggaaacauaguccggguaauuguggacgucaaacagaugcauuugcugaacagggaucuggcugguggacagcugccacugcuccgaauggaccugaggacaggagcccaucacaugugcaggacagagaucugcaguuccggcccuuggcuccacuucacucccugcaucccuggcuuuuuuuuuacccguaaauccgggccuccuucucccuaaccacgcccuucuccugaccacgcccuaucuggccacgccccucacucgucucaccacccacacccacgucccucuccucuucucccucggaccacgccccuccucugaccacgcccuuuccucuuauccccaccccacugacccucuccccuuuugucugcucccguugucccguugccucuccgccuucugccuugccgcccccccacaacugacuucucugcugacgcauccuuucucaacaucacccuccuuuuuuuuuuuuuuuugagacagagucuugcucugucguccaggcuggagugcaguggugcgaucucagcucacuacagccuccgccucccggguucaagggauucuauugccucagcccucccaaguagcugggauuacaggugccugucaccauacccagcuaauuuuuguauuuuuaguagagacaggguuucgccaaguuggccaggcuggucucgaacucuugaccucaagugauccgccugccucggcuucccaaacugcugggauuacaggcgugagccaccgugcccggccuugauggguccuuuuucaacaucacccuccuucccugaaaccucucccuucuuccauggucucccacuucccucucuaacccuuucccugugccccaaccugggucaggaagggcgacugcagguggaggaaucgggacacgauguacagcgcaaacagguggcggucaacucccugcccgcucauggcugccuucagcagagccuggugcuuguccacugccacgcggaacagggcgaggcacuguggguccugcaguccccagggaggucacaggucauggaaagacaggaagucgacuuagggcugggccugcggcacaucuggccucaacugaguuugccacaucccugcaaggugggaauaucaaccccauuuuacagauggggaacugaggcuuagagaggggaaaucauuuggccagguucacacagccagggagagccaggcggguuccuaggugugucuggccccagaguccaaacuccuuccauggaaccacaauaccuuguaggugcagggcuagguguagggcaagggagaagaggugcagggcaggugggaucugggcagagaggguacaggggugcaaaggaaggucacaagucacaaagagguuaaaugggcagaguuacguuguaaaaauggaguuccagccaggugcauuggcucacgccuguaaucccagcacuuugggaggccgaggcagggagaucaccugaggucaggaguucgagaccagccuggccaacauggugaaaccccgucucuacuaaaaauacaaaaaaaaaaaaaaaaaauuagcugggcaugguggcgggugccuauaauuccagcuacucaggaggcugaggcaugagaaucgcuugaaccugagaggcagagguugcaguaagccgagauugugccacugcacuccagccugggcaacagagcaagacuccaucucaaaaaaaaagaaaugggguuccuucuugggugcacccccagugcccugugagaccaccaugaaagcagauaucacacuaugcugggcugucuccccccaucagugagcucuuugaagucagaggccagguccgauucaucccuugucccuugugcuccucguggaggcuggcuucaguaggucccaucaacguuugcaaguggaugagugaguacacagaaauaacugaagccucaagcgagggcugcacccaccgucuucucuuuguccuccauggcccugacaaaguugcaggccucccucgugcaagaccgcaccgucuccguccggccuuccaggaauaagcgagucauggccgacucauaagucaggcagaauugaccccuguccugggggacagggaggagaagaggagucugucagcugggcucaggagaucuuacagacuugaccuaucucuguccagaccuccagccuccuccagccagcccaagaaugguuggaagagagaauucaagauggccgacccacaauggcagcgaccacaaggaaccguggaggggcaggucuugggggcucagguggacugagacccugcgggggcuguggauggggaacccaacugacccggaagugggccaguugcaaggcgaucuggaugaagcugucugaagagagguggcagcgucggaugaagcucuugccaaauagggagaauggaacgacauggcagucgacauuuucagacaagaucuuggcuccccucagggcuagagagauggaggaguggaucugccagaggaggagggaagaggaguaguugggguuacagauggggguagggugaaagccaggaauaaggcuggaagcggagguggauguggaguuaagguugcggcagaauauggaaauggggacaaagaagagaagagaauugaaggaugagacuaaagauggggauaggggcugggcgugguggcgcacgccuguaaucccagcacuuugggaggccgaggcgggcggaucaccugaggucgggaguuugagaccagccugaccaacaugaugaaaccucgucucuacuaaaaauacaaaaaacuagcuggccgugguggcacgugccuguagucccagcuacuugggaggcugaggcaggagaaucgcuugaacccaggaggcagagguugcagugagcugagaucgcaccacugcacuccagccuggguacagagcaagacuccgucucaaaaaaaaaaugccgggcgcgguggcucacgccuguaaucccaacacuuugggagacugagguggcuggaucaccugaggucaggaguuugagaccagccuggccaacauggaaaaaccucaucucuauuaaaaauaaaaaaauuuagccgggugugguagugggcaccuguaaucccagcuccucaggaggcugaggcaagagaaucgcuugaaccugggagauggagguugcagugaacugagaucgugucauugcacuccagccugggugacagagcgggacuccaucucaaaaaaaaaaaaaaaaauggggauagggauggcauguguagacuggaacaagauugggguugggccacaguugaagcugggguuggggauggggauggaggagggacugagagugguuugggaauagaacggggaagggguuggguaugggaagugaauucgaguugggcauggguugugguuggaggugggguuguggcugaguacgggaugggguuggugugggguaugggguugagguuggguaugggaugaguugggcauggguugucauuggaaguggggucguggcugaguacaggaugggguugggguuggguaugggguuaggguuugguaugggguggaguuaggaugaacaugggaaugaauucaggugguguugggaugggauuggguauggagauggauuuggaaggaaaauggaguagggguuggugcugggguuggacaguggugguuuuugagucugaaacagguagagaugggguugggguugaggaugggauuggcagugggaggacgguuggaguuggggcuggagaugagguucguguugggguuugagguuguggaugcauauggccugauuugggggugggggaagcauggguuucggguuggggguaggaaugggguugauuuucacguucagauuagggguggggaugaguuugaagucaaggcuaggaaucuugggacuuggaggagaggcccagaaacccagccucaccuggucuggaaggucccauugcagccgcuggggcugggguagugugggguccgggugccccuugcaguggccgucuguugaguagcccagcugaaagcauucuguagccagagugaacugugggcaaacagaggcuguuagagucccuuccucccuguggacugaggccaucuaacccgggaccucuuuucaugcagcccuuuuucggguagggggcagucccugagaaacagaaaccucugauauucacagaugcggucucagguucauguucaucaagaacaggacuaacaccaauacucaacugguguuuacuguccuuauuuucuuuuccuuuuuugacagggucuugcucugucauccaggcuggugugcaguggugaaauuauaacucacugcagccucaaacuccugggcucaagccauccuccugccuuagccuccggaguagcuggggccacaggcauguaccaccaugacuggcugguuuuguuuuuuuuguuuuuuuuuaacguuuuuuguagacagguucucauuauguugcccaggcuagucucaaacuccugggcucaauugaucuuccugccuugaccucccaaagugcugggauuacaggcaugagccacugcacccagccuggagucaucuucuugcucuguaacuccucgcugugugacucugggaaaaucacuucccuucuuugagccccaguuaccaacucaucaaaggaagguccucaucccaguccccuuucuuugccaggugacccugggccagccucugccucucccugagccucaguuuuucuuuucuuuuuuuuuuuuuuuuuuuuuuuuugagauguauucuugcucugucgcccaggcugaaguacaguggcacaaugucagcucacugcaaccuccaccucccggguucaugcgauucucaugccucagccucccgaguagcagggauuacaggcacacaccaccaugccuggcuaauuuuuuuguauuuuuaguagaggcaggguuucacuauguuggccaggcuggucucgaacuccugaccucaugauccgcccaccucggccucccaaaaugcugggauuacaggcaugaaccaccgugcccggccaagccucaguuuuucuucugacacuaaggcgcuggagaggacggucuuuggagauggggcagggguccccagaaccagggagggcuggccgcccuaccucccacauguguccugagauggggcagucggcccaggagugcuccacgcugaggcccagcuucccguuagagaagacgauuagggugaaggauuugucaaaccagcugucagggagaguucagaugggucaccaagagcgaggggcacggggaccucagagugcuuucugugggacuugaggggguuuucuagaugggaagaugugggaauccauuggggugcugguauggggaucucuaggaccauuggggguccccaguaguggcccuggaggucuccaagacaugucugggauuuagaguuuggagauuguuuuuuuguuuguuuguuuguuuugagauggaguuucacucuugucgcccaggcuggagugcaguggcgcgaucucggcucacugcaaccuccgccucccaaguagcugaggguucaagugauucucccgccucagccucccaaguagcugggaucacaagcaugcaccaccaugcccagcuaauuuuugcauuuuuaguggagaugagguuucaccauauuggccaggcuggucucaaacuccugaucucaggugauccgccccucucagccucccaaagugcugagacuacaggcaugagccaccaugcccagucuggaguuuggagauuuuuaggaaacuugccgaggaagguucaaggcuuuugggggugcugggaggucagcgggaccccccuggggccuaggaauucagugaugccugccaggccugagaaucucuaggucuggaagucugggucuagggccauggauuuggggugccugcauuaaggccugaggauugaaugguucaaguucugaggcugagguugccaagucuggggucccugggccuagggguccuggguuuggugguccucagaucuggggucucugggucugugaugcugaguucucugggucggaggguccagcucagggguuugggagucucagauuugggggucacugggucugguuuauaggucuugggucccagguugagggguuccccaggucagaggucuccaggucccaaagcacugggucugggguccucagcucuaugcagccccuggucuacagacucugcaggugugggcuccagggucuggcugucuacugucagggguccuaggucugauacuggauucucgggugccacaucugggggccccaucccaagacucacucaccgaucauggccccggccggccagcagagcaugggcguaggcauccaacgacgcugccggguccucccuggugagccccgcgggcucagcauccagugacacaaagaaagcggccccuuccaccgccuccagggccuccgcugccugggucuucagggauguccgcaccugggcccacgugccccuggagggcccgggaugugccugaguccauccugcccagccgccaccuggccccacccugcccuuccacagucucaggacacuggcggccucugagagccccugaccccugaccccugacccuuaccugggagcagcugucagagcugccagauguuccucgugggggcaggccggugagggaucauccaggauucucugaaacugcugcuccagggcucucggggaaagcaggcuguuucgggaguggguccccaugcggaagaaucggccccgguggaagacagccacguguuggcugucauggagguggcggauguagucuagggguggcguuggcagaagcaugggggcaggaaggccagacacauaaaaauagugaccauuuauuauauacuucuuaggugucgucaguuguucaaaguacccuaguaaucaucagcacccuaggacuuuuauuuacuuaguauuuggagacaaggucucgcucugucgccaggcuggagugcaguggugagaucucagcucacugcagccucaaccuccggggcucaggugauccuuccacuucaggcucccgauuaacuggggccacaggugcauaucaccaugccuggcuaauuuuuaaauuuuguauauagaccggaucucacuacguugcccuaggcuggucucgaacuccuggccuaagcaauuguccaccucggccccacaaagugcugggauuacaggcaucagucacugcgcccagccccuagguacaauuauuaucccacuuuaguggaagcugaggcucagagaggguaauaacgugcagaaggucacacagcaaggaagcaaugguucccagcucagucaggcggacuccagaaaacaugcucuuagccacuauauuguucugccuccaucaguggggacaggagagggucucaccuuuuuggaccccuggaauccgcgugguguugaagaucuucucguacugggcagagcauaaggggcgcauucccaucagcaaagucugcaggaaaccgugggcugugagcugccuuccaggacccacguggcccaaaggccacaggaccacaccuccaucccuaacccacuggggcccucucaccggggguaucuccuggcgguucaggcgguggcgguacaggaggagggcauggacggcauucccagcgcgagcugccugcagaggcgugggugugacauacaggaaguccuggggaccaggagaggggauggcaaaacacccagggucagguuugcccccgauggagccacugacccaaauacagguccugaccccaaaagaggguggaaugaugaaucccagauggcgcgucuagauccaggucacugagcaugaccgucacauuccgcccagguaccccccaacccuagaccuggggccuaugaaccucaccccuccccuucucaccaucauguaauaguugcuguucaccaucagcggauuucgggagcgcagguacacaaauuccucccaccagucacugaccugggagcgggguggggagacacacagugaggggcuggggccuguugggggagggacaguaggacagggaaggccccagaugcuccugcgucaggcagggaggauagagccaaagaagucagccaucguagucaguaacuagcgaucaccuagaaauccauccaugggggaucaguuagcuaaacccuguuauacuccggcaguggaauauuacauagcugguggaaauaacaagguacagcugggcacgguggcucccgccuguaaucccagcacuuugggaggcuaagcggguggaucaccugaggucagguguucaagaccagccuggccaacaugaugaaacccugucucuacuaaaaauacaaacauuagccacacgugguggugcacgccuguaaucccggcuacucgguagccugaggcaggagaaucgcuugagucggggaggcagagguugcaaggagcugagaucgcaccauugcacuccagccugggcaacaagagugaaacuccgucccccccaaaaaagaaaaacagaacauaaauguaaaauuuauaaaacaauaaauaugugaaauaauauacauauguguaaauacaugaaaauuguggccuugccaauaccaugauaaaauucaaacaaugaaaaacacaaaagaaagcacugugucacgguuuagcugcucuuguaggguuuuuuguuguuguuguuguacauaaaaaaauggugcgugugucacuggcaguuggcuuggagguacaauaaaauauacaggcugggcgcaguggcucacaccucuuaucucagcauuuugggaggcugaggugggaggauagcuugagccucggaguuugagaccagucugugcaacauagcaagaccccaugucuacaaaaaauuuaaaaauuagccaggcuuaggggcacaugccuguagucccagcuacucaggaggcugagaugggaggauggcuugagucugggaggucaaggcugcagugagcuuugaucacgccacugcacuacagccugggugacagagugagaccccuuccaagaaagaaaaaggaaagagagagaaagagagaaggaaggaaggaaggaaggaagggagggagggagggagggagggagggagggaggagagagagacagaaagggagggagggggagagagagaaagauagagaaagaaagaaagaaagaggccgggcaugguggcucacgccuguaaaucccaacacuuugggaggccgaggcaggcggaucacgaggucaggaggucgagaccauccuggcuaacacggugaaaccccaucucuacuaaaaauacaaaaauacaaaaaaaaaaaaaaagaaauuagccagguaugggaggcugaggcaggagaauggcgugaaccugggagguagagcuugcagugagcugagacggugccagugcacuacagccugggcgacagagugagacuccaucucaaagaaaaaaaggaaggaaggagacagaaaaaaaggaaggaaagagagagagaaggcaggcaggcaggcaggaaagaagguaggaaaggagggagggagggagggaaggaagggaagaaagaaaugaguguguguguguguguguguguguguguguaaacagaaucuuguccaaaagugugaagaaaaaaauauuuaaccagaaaagcaaggccugcauucccuuuuacuucuccagauauuucguccccuucgcuggguuugaccaacugaggcuuccacauagcugccucguggggcucugccggggacccucuucccuuccccucucacucuugcugcagcuuuucucaucccagcccagugucucaaugaccuacaaugguaggucucacgguagcuuccucugcagccucccgcccuccagucuuucccccacaccaaagcugacccugccccuucccugcuccaaacccucccauggcucccuaguacccccaggaaagaguccaggauccucagucuggaguucaggccucucccaccacuccucaccauucaacuccuuugguuuugucuuuuuuuuuuucuuuucuuuuuuuuuuuuugagacagagucuugcucuguggcccaggccgaagugcaguggcgcgaucucaguucagugccaccucugccuccuggguucaagcaauccucccgccucagccucccgaguagcugggauuauaggcgugugcgccaccagaccuguuuaauuuuuguauuuuuaguagagacgggguuucaccauguuggccaggcuggucuugaacucuugaccucacgugauccgccugccuuggccucgcaaccugcuggcauuacaggcgugagacauugcaccagggcuaaguccuggaauucugguucaaacuuuggaagaucaagggugaagcucagaauacuggagcaucuauaccccaaacuucaacauuaaauauauagagagagcauauauauguuaugagcauauauauauaaauaaauauauaagccuauauauaaauaaauauauauuuauuuauaauuuauaaauaaauauauauuuauuuauaauuuauaaauaaauaaauauauauuuauaauuuauaaauaaauauauauuuauaauuuauaaauaaauauauauuuauaauuuauaaauaaauauauauuuauaauuuauaaauaaauauauuuaauauauuuauaauauuuauauauuuauuuauaaauuuauauauaaauauauuuauauauaaauuuauaaauauuaauauuuguauauaaauauaaauauauauauuuauaaauaaauauauauauuuauauauacacuauauauuuauauauaaauaaauauauauacauauauauuuuuauauauauauaaauguggagguuaggauauagauguaugugagcggggcucaggguauugacccuugggggcugggggcguguggguugugggcgugucguggggcagggcguauaacucgcaaguuuagcaggcgagcucacaaccuuagcccuucagguggggcguugguggcgguggcgggacucacauaauuggacgcccaccaggacuugagccgcagguaccacugcagcagcgacgccugcagccucaggaauuccugcgccaggaccgcgguccagucgaaguccucgucggagaggaugggccggaccgacuccagguacuaaaggggagaagagggcaggucacgcccccggcccgccccggccgccccagcccgucugcgcgcucccaggcccaccuugcgcacgguguccugcacagagggcacgggcuggcguggcagggagcgcugguaacugaacagcaucggguggcggccagagaagaugcggaccagggccuggggaggaggaguuaccgggucauuaaccccucaccggagccagggaguugacggggcaggggucgacagugggacagaaacccaaagagaaggacacagagacuuaagagcaucggagaccccaagagagaaaggaacagagacccagagacaggggacagagacccagagagagggggacagagacccagagagagaggggggcagagacccagagagagucggggguagagacccagagggggggacggagacacagagagagagggggacagagacccagagagagggggacagagacccagggacagaggaggacagagacccagaaagagagggggaagagacccagagagagagggacagagacccagagagagggggacagagacccagagagaggggaauagauaagcgggucccaggagagccugagcagggcuaugccccucccauaccagccaggucuuggugggggaggacauggcuccguggggcucaagaagccagccgugguaggacagaagcagccucagggccacgugcagugugaagaucagggcuccccacaaacacgaggcaaacagcgcggcugccaggaccccccggagcccgugguguuguccaccccugcggggagagaaacagaggcugggccugggucuccuggccucagaaccucccucccuuccagcccccuccagccccugcgcugaucuuuuggcugucagacagagaaacccauuuuugucauuuuaguaggugugagcucugucacccccuccagcccccucccauuguggcagcaccaagcuuccaaagucacuuuccauggaaguugguagguguuuaauaaaugacagccauuauuucuauugaggggacacuuuuuccuuccagcuaucacuacucuaaggcaauaguucugaaacuguggcuccugggagcacugccugggagcuuguucgaaaugcauauuccugggcgccuuuaagaccuaacaagccagaaucucucagggugggguccagcaaucagcguuuuuuuuuuuguuuuguuuuguuuuugggauggagucucgcucugucgcccaggcuggagugcuguggugcuaucucggcucacugcaagcuccgccuccuggguucacgccauucuccugccucagccuccggaguagcugggaauacaggugcccaccaccacgcccggcuauuuguuguuauuuuuaguagagaugagguuucaccguguuagccaugauggucuugaucuccugaccucgugauccgccugccuuggcaucccaaagugcugggauuacaggcgugagccaccacgcccggcauguuuuguuuuugagauggaguuucacucugucgcccaggcuggagugcaguggcacuaucucggcucacugcaaccuccaucuccuggguucaagcaauucuccuaccucagccucccgaguagcugggacugcaggcgcccgccaccacgcccagcuaauuuuuugcauuuuuaguagagaggguuucaccacauuggccaggcggcucucgaacuccugaccuuaggugauccacccacuugggccucccaaagugcugggauaacaggugugagccacagcaccuggccauagucagcgguuuaacaacccauccaggugauuccaauacaagcuuaaauuuaggaaaagcuggucuaaagcuacauuaaaucaacauguuuguuugcaaaguuugcaaaugucaccuggaggacuugggucaaaucacuuucccucuguagacuggggguaaaucuagcguuccaggaauuuuuuuuuuuuuuuuuuuuuuuuuuuuuuuuuuagagacaggggucucuauguugcccaggcuggucuccaacuccugagcucaagccuccugccucagcccuccgaagugcugggauuacaagugugagccacugugcccggccuccgucuuggaauugucuacaucugauccugggucuguucuuuggggccaucugcacaaaauguggaccuuccuccccgggaggacucauccgagaacuagaccugacaucucaccugcacccaguuuucagacccuuccugaagaucacaauaacucaauaaaaauaaugcagccacucccaugaggaccuccuggcacucuacugacuauaugacaggcaugauuuuuuuuucuuuuaauugagacggagucucucucugucgcccaggcuggagugcaguggcgugaucucgccucacugcaagcuccgccucccagguucaaacaauucuccugccucagccucccaaguagcugggauuacaagcaccugccaccacacucggcuaauuuuuguauuuuuaguagagacagaguuucaccauguuggccagacuggucucaagcuccugaccucaggugauccacccgccucagccucccaaagugcugggauuacaggugugagucaccacaucccgccgacaggcaggauuuugauuaauucuuccaagcacacuaagaagcaauuauucauaccucauuuuacagaugaaggccuugacaaucaacaacgaugagauccuugccuaagacuacaugacuagagacgggcaaagcucauacuuuuuuuuuuuuuuugagacagagucucgcucugucaccaaggcugaagugcaguggcacaauuucgacucaccgcaaccuccgccucccggguucaagugauuauccugccuuagccuccugaguagcugggacuacaggcgcgcaccaccacacccggcuaauuuuuguauuuuuaguagagacgggguuucacuauguuguccaggcuggucucaaacuccugaccucaggugaucuggccaccucggccucccaaagugcugggauuacagguguaaaccaccaugcuuggcuauuuuucuuuuuucuugagacagggugucacucuguugcccaggcugcaaugcaguggcaugaucucagcucacugcagccucgaccuccugagcucaggugaucuccaccucagccuccuggguagcugggaccacagguaagugacaccacacuuggcuaauuuuuuguuauuuuuaguagagacgggguuucaccauguugcuuagguuggucucaaacuccugggcucaagugauccuccugccuuggccuccaaaagugcugggauuacaggcaugagccacugugcccagcaaagcucacaccuuuuuuuuuuuuuuuuuuuuuugagauggaguuucgcucuugucacccaagcuggagugcaauggcgcaaucucggcucacugcaaccuccaccucccggguucaagcgauucuccugccucagccucccuaguagcuggaauuacaggcuccugccaccacgcccagcuaauuuuuuguauuuuuaguagagacaggguuucacccuguuggccaggcuggucuugaacuccugaucucaguugauccacgugccucagccuuccaaagugcugggauuacaggcaugagccaccaugccuggccuaauuuuuguauuuuuaguagagacaagguuucaccauguuggccaggcuggucucgaacuccugaccucaagcgauacacccaccucagccucccaaugcccaaugugcugggauuacaggggugagccacugugcccggccucaccuccuuuuucuucaugccaugccuuuauuaaucugacccaauguaagucucagagguuacuuuucuuuagcagguacaccacaaugacagaggaacuuacugggugaagggagagugauuggggguuacugggcuggaguggggggaccucaccagucaggcagcaacucuuugaucuucuccaucaguccuaaggaaggauccagcuggaggaaccaggcaagcuggauggcacugaagaggaaaagccaacugagggggcuggcaggaaacacaccggugagaaagucauucuguggggaggaaagggcauccauugaaucaucugcccucuccucugagccccuguucugugccauccccagacauuacugagcacccagugcggagcccugagcuggaggcucaagaucuaguagggaacagagagauccagguccugcccucagcgaggucagaccagaaugaaguaaguauuaauugcuauagggcaagaaauaggaggagcccugugcugccaaguuacaguucgagggcaucagggagggcucccuggaggaggauauucugaggcaggaccuggaaggggaggcugucaaaggcagaacaguccggaugugguggcucacuccuguaaacucagcacuuugggaggucaaggaggagaaucccuugagcccaggaguucaagaccagcgguggcucacgccuguaaucccaacacuuugggaggcugaggcaggcggaucacuugaggccaggaguucaagacuggccuggccaacauggugaaauccgucucuaguaaaaauacaaaaauuagccgggcaugguggcaggcaccuguaaucccaacuacuugggagacugaggcacgagaaucgcuggagcccgggaggcugagguugcagugauccaagaucacgcuacugcacuccagccugggugacagagcaagacaaggucuccaaaaaaaaaaaaagaaagaaaaaaaaauuaggcgcaguggcacacaccuuagucccagcuacuuggaaggcugaagcaggaggaucgcuugagcccaggaguucagggaugaagugagcugugauggugacacugcacuccagccuggguaacaaaguaaguaagacccugucucaaaaaaaaaaaaaaaaaagaaaagaaaagaaaaagaaaaaugaucccuauucagagcagggucuggagcucaguaaggccuucuagaaguaccagggcauggaaugaaugaggaacgaccaacagcacugcguuacuaacuaaacuccuuuggaagccucagagagauaacuaacguuuaaugagcacuuacuacauuccaggugccauuuacaaggauuaacaauuuaaauccuccccaaaccaugugaaauaaguacuaagaugaucucauuuuacaaaugaaaacacugggguuuggccgggcgcaguagcucaugccuguaaucccagcacuuugggaggccuaggcggguggaucaccugaggucaggcauuccagaccagccuggccaacauggcaaaaccccaucucuacuaaaaauacaaaaauuagccaggcgugguggugggaaccuauaaucccagcuacucaggaggcuaaggcagaaaaauugcuuaaacccaggagauggagguugcagugagccaagauccugcuauugcacuccagccugggcaacagcaacagagugagacgcugucucaaaaaaaaggccaggggcaauggcuuaugcguguaaucccagugcuuugggaggccaaggugggcggaucacgaggucaagagaucgagaccauccuggccaacauggugaaaccccgucucuacuaaaaauacaaaauuagcuuggcgugguggcacacgccuguaguccuagcuacuuggaggcugaggcaggagaaucacuugaacccaggaggcagagguugcaguaagucgagaucacgccacugcacuccagccuggcaacagacugacuccaugucaaaaaaaaaaaaaaaaaaaaaggccaggugcaguggaucaugccuguagucccagcacucugagaggccaaggcggguggaucaccugagaucaggaguucgagaucauccuggccaacauggugaaacccugucuauacuaaaaauacaaaaaauuagccgggccugguggcaggcaccuguaaucucagcuacuugggaagcugaggaaggagaauagcuugaacccaugaggcggaaauuggagugagccaagaucaugccauugcaauccagccugggcaacaagaacaaaacuccgucucaaaaaaaaaaaaaaaaaaaaaauugugcauuuuucuccauguaauguuaucauauauaugugugugcauguauauauuuauaggucuauaaauauguauguaucuauguauguauguauuuaaacacacgaaaaggauggccacauguuuguuuuuuuuugagacggagucucgcuuuguugcccaggcuggagugcaguggcacgaucucggcucacugcaagcuccgccuccuggguucacgccauucuccugccucagccucccaaguagcugggacuacaggugacugccaccacgcccagcuaauuuuuuuguauguuuaguagagacggaguuucacuguguuagcuaggauggucuugaucuccugaccucgugaucugcccgccucggccucccaaagugcugggauuagaggcgugagccaccaugccuggccaaggauggucacauguuaacacuuuaguugguagacuggccugaggcccaaggagucccaggguaagggcgggagagggauucggaguucaaggcaguggcuguuugccaacuggaacagauuauacaaccaacaagaccacagagguucaguuuagccugcugaagcaucccagcuucaggagauccuccuggccgccggcucccacccccuuuuuuuuuuuuuuuuuugaaacggagucuugcucugucacccaggcuggagugcaguggcgcaaucuuggcucacugcaaucucugccuccuggauucaagugauucuucugccucagccucccagguagcugugauuacaggugccugccaccacacccggcuaauuuuuguauuuuuaguagagaugggguuucacuauauuggccaggcuggucuugaacuccugacuucgugaucugucugccuuggcuucccaaagugcugggauuacaggcgugagccaccgcaccuggccugccacccccuuauuuaacugcaacacccccacaucacucuucucuacccgauuuaucauucaccauagcaugugucaccaucaauaucagaugacacuauagaaugucaccauacccuauauuuugcucaucuguuuuauugccuucuguuuugcucaucuguuuuauugccuucucccccaacucgaaugagaacucuauaaaagcaggauucugucuuuauuauuuauuuauuuauuuauuuauuuauuuauuuauuuuuuauuuuauuuuauuuuuuuuugagacggagucucgcucugucgcccaggcuggagugcaguggcgccaucuuggcucacugcaagcuccgccucccggauucacgccauucuccugccucagccuccugaguaauuggaacuacaggcacccacuaccacaccaggcuaauuuguguguguguguauuuuuaguagaaacgggguuucaccguguuagccagaagggucucgaucuccugaccucaugauccguccgucucagccucccaaaguguugggauuacaggcaugagccaccgugcccgaccugucuuuauuuuuuuaauagagauggggucucccuauguuguccaggcugguguccaaguccugggcucaagugauccuccugccucagccucccaaagugcugggauuaaagccgugagcccgcagugcccaggcgugauucugucuguugauaucugcuguguucuccaugcuaaagagggccaggcccuuaccggaugccccauaaauauauggugaaugaaugaagaacaauaucagaagcuaacacucagaccucgccaugggccaggacauagaagaauuaauuuagucuucaaggcuauccugugagggaggugcugucaacacccauguuuuccacgaggggaaacugcgacuccaagagaggugcuugcccaagaugacacagcuacuaagcgguggagucaggauucaaacucaaucaugaccccacagguguuccagaccccaguucacacacagaggaugugacaagcagggagucccuguauggagacagugcaagaguucuagaaccagaaacccugggacagacaugggugcugguuacacauugggcaugcgcauuccagaacagggacagagcaggaguuugggccgggcgcgguggcucauuccuguaacccaagcgcuuugggaggcagaucacuugaggucaggagaucgagauuagccuggccaacauguugaaaccccgucucuacuaaaaauacaaaaauuagcugggcguauaauccaugccuguaaucccagcuacucgggaggcugaggcaggagaaucgcuugaaccugggaggugguugcagugagccaagaucaccccacugcauuccagucugggcaacagagugagacucugucucauaaauaaauaaauaaauaagccaggcaugguggcgugcgccaauaaucccggcuaccugggaggcugaggcagggaauugcuugaacccaggaggcggagguugcagugagcugagaucccgccacugcacuccagccugggcgacagagugagacugugucucagaaacaacaacuacaaaagaagcuggagaugaaaggaagaaaugauaauuucaccauaagggaaggauauggaguucuagaaacuggaaguggguaguuuuuggggggcccaguuccccucuugggugaaagaagugagcagagguucucagcagguggggcuguggaucccagaagugagccacggagaaauugcuaaagggguccugggagcagacaucaaaauucuaagaaaaaggggugauagucucccagaaaugaaccagcugaaaugccggaagugagccucagacaucccggaagcagaaaccuggauccccggaaggaaaccgaccagcaccgcuccucacccagaaacgugagagaugccuuuuccaggagcgcaggccagagagguagaucuccugcagcacaggggcacugaguuccacuucagccccguccgaggucagcgagggucggaagcccacggccuggugcgcuucagccaugucacgcuggagcccugagucgggcagagucauacuucaggaccccagccccuccgcccucagacucaggaguccaggcccccagccccuccuccuccuucauacccaggaguccaggccccagucccuccucucucagauccaggaguccaggcccccagccccuccucccucagacccagaagcccaggccccagccccuccucucucagauccaggaguccaggcccccagccccuccucccucagacccagaagcccaggccccagccccuccucccucagacccgggaucucacgcuuucagcugccuuuuugcgccgacccaggacuacauaaccuagcucauccuucucuaagcaccugaagggucuugaggguccugguuuguagacccggagguuuugagggaaggacgucaauucgggaccucugggaacgcauagagaggccagagggauagcucgcguuaaccccuuuaccugcucucccaagaacauggugcgggggcagugcccuccccccaguacaggauucucaagauucggggguggguggaggagggaaacugguccaggcugaguugcggggucuugagaaaagcauuaguuuuagacccauaugaaacaaacaccuguuagacauugacgcuguccaccccauugccgcuuuucaugccaaggcgagggggauggugucuauaaauucauccgcucagcguccccuccccccgcccgugcuggagggaauggggaaggaagcacccacugcgcaugccucgcagccugggaugcugaggcugugagcggaggcgagcgucgaggacaagugauggagaggcuugcacgcccaacccuagacacaggacuccaggccccgccggagcccgagccccugggguccaguacuuaccacguugaaucaaggguccgcugaucggauccugggguccaaacccgaguccacccccgccccccgauuuugagcgccggccccaaaucucccgcuugcauauguccaaucccagugcaaggaguccaccaccgggucgacgggccuuuggaguccugcccaccccgagaucaccgucacccagaaaccccgauuccucucucucgugucccuagccggguauucaggucccg

SEQ ID NO: 191761 - RNA, 22624 nt, Homo sapiens
cgggaccugaauacccggcuagggacacgagagagaggaaucgggguuucugggugacggugaucucggggugggcaggacuccaaaggcccgucgacccggugguggacuccuugcacugggauuggacauaugcaagcgggagauuuggggccggcgcucaaaaucggggggcggggguggacucggguuuggaccccaggauccgaucagcggacccuugauucaacgugguaaguacuggaccccaggggcucgggcuccggcggggccuggaguccugugucuaggguugggcgugcaagccucuccaucacuuguccucgacgcucgccuccgcucacagccucagcaucccaggcugcgaggcaugcgcagugggugcuuccuuccccauucccuccagcacgggcggggggaggggacgcugagcggaugaauuuauagacaccaucccccucgccuuggcaugaaaagcggcaaugggguggacagcgucaaugucuaacagguguuuguuucauaugggucuaaaacuaaugcuuuucucaagaccccgcaacucagccuggaccaguuucccuccuccacccacccccgaaucuugagaauccuguacuggggggagggcacugcccccgcaccauguucuugggagagcagguaaagggguuaacgcgagcuaucccucuggccucucuaugcguucccagaggucccgaauugacguccuucccucaaaaccuccgggucuacaaaccaggacccucaagacccuucaggugcuuagagaaggaugagcuagguuauguaguccugggucggcgcaaaaaggcagcugaaagcgugagaucccgggucugagggaggaggggcuggggccugggcuucugggucugagggaggaggggcugggggccuggacuccuggaucugagagaggaggggcuggggccugggcuucugggucugagggaggaggggcugggggccuggacuccuggaucugagagaggagggacuggggccuggacuccuggguaugaaggaggaggaggggcugggggccuggacuccugagucugagggcggaggggcugggguccugaaguaugacucugcccgacucagggcuccagcgugacauggcugaagcgcaccaggccgugggcuuccgacccucgcugaccucggacggggcugaaguggaacucagugccccugugcugcaggagaucuaccucucuggccugcgcuccuggaaaaggcaucucucacguuucugggugaggagcggugcuggucgguuuccuuccggggauccagguuucugcuuccgggaugucugaggcucacuuccggcauuucagcugguucauuucugggagacuaucaccccuuuuucuuagaauuuugaugucugcucccaggaccccuuuagcaauuucuccguggcucacuucugggauccacagccccaccugcugagaaccucugcucacuucuuucacccaagaggggaacugggccccccaaaaacuacccacuuccaguuucuagaacuccauauccuucccuuauggugaaauuaucauuucuuccuuucaucuccagcuucuuuuguaguuguuguuucugagacacagucucacucugucgcccaggcuggagugcaguggcgggaucucagcucacugcaaccuccgccuccuggguucaagcaauucccugccucagccucccagguagccgggauuauuggcgcacgccaccaugccuggcuuauuuauuuauuuauuuaugagacagagucucacucuguugcccagacuggaaugcaguggggugaucuuggcucacugcaaccaccucccagguucaagcgauucuccugccucagccucccgaguagcugggauuacaggcauggauuauacgcccagcuaauuuuuguauuuuuaguagagacgggguuucaacauguuggccaggcuaaucucgaucuccugaccucaagugaucugccucccaaagcgcuuggguuacaggaaugagccaccgcgcccggcccaaacuccugcucugucccuguucuggaaugcgcaugcccaauguguaaccagcacccaugucugucccaggguuucugguucuagaacucuugcacugucuccauacagggacucccugcuugucacauccucugugugugaacuggggucuggaacaccuguggggucaugauugaguuugaauccugacuccaccgcuuaguagcugugucaucuugggcaagcaccucucuuggagucgcaguuuccccucguggaaaacauggguguugacagcaccucccucacaggauagccuugaagacuaaauuaauucuucuauguccuggcccauggcgaggucugaguguuagcuucugauauuguucuucauucauucaccauauauuuauggggcauccgguaagggccuggcccucuuuagcauggagaacacagcagauaucaacagacagaaucacgccugggcacugcgggcucacggcuuuaaucccagcacuuugggaggcugaggcaggaggaucacuugagcccaggacuuggacaccagccuggacaacauagggagaccccaucucuauuaaaaaaauaaagacaggucgggcacgguggcucaugccuguaaucccaacacuuugggaggcugagacggacggaucaugaggucaggagaucgagacccuucuggcuaacacggugaaaccccguuucuacuaaaaauacacacacacacaaauuagccuggugugguagugggugccuguaguuccaauuacucaggaggcugaggcaggagaauggcgugaauccgggaggcggagcuugcagugagccaagauggcgccacugcacuccagccugggcgacagagcgagacuccgucucaaaaaaaaauaaaauaaaauaaaaaauaaauaaauaaauaaauaaauaaauaaauaaauaauaaagacagaauccugcuuuuauagaguucucauucgaguugggggagaaggcaauaaaacagaugagcaaaacagaaggcaauaaaacagaugagcaaaauauaggguauggugacauucuauagugucaucugauauugauggugacacaugcuauggugaaugauaaaucggguagagaagagugauguggggguguugcaguuaaauaaggggguggcaggccaggugcgguggcucacgccuguaaucccagcacuuugggaagccaaggcagacagaucacgaagucaggaguucaagaccagccuggccaauauagugaaaccccaucucuacuaaaaauacaaaaauuagccgggugugguggcaggcaccuguaaucacagcuaccugggaggcugaggcagaagaaucacuugaauccaggaggcagagauugcagugagccaagauugcgccacugcacuccagccugggugacagagcaagacuccguuucaaaaaaaaaaaaaaaaaagggggugggagccggcggccaggaggaucuccugaagcugggaugcuucagcaggcuaaacugaaccucuguggucuuguugguuguauaaucuguuccaguuggcaaacagccacugccuugaacuccgaaucccucucccgcccuuacccugggacuccuugggccucaggccagucuaccaacuaaaguguuaacaugugaccauccuuggccaggcaugguggcucacgccucuaaucccagcacuuugggaggccgaggcgggcagaucacgaggucaggagaucaagaccauccuagcuaacacagugaaacuccgucucuacuaaacauacaaaaaaauuagcugggcgugguggcagucaccuguagucccagcuacuugggaggcugaggcaggagaauggcgugaacccaggaggcggagcuugcagugagccgagaucgugccacugcacuccagccugggcaacaaagcgagacuccgucucaaaaaaaaacaaacauguggccauccuuuucguguguuuaaauacauacauacauagauacauacauauuuauagaccuauaaauauauacaugcacacacauauauaugauaacauuacauggagaaaaaugcacaauuuuuuuuuuuuuuuuuuuuuugagacggaguuuuguucuuguugcccaggcuggauugcaauggcaugaucuuggcucacuccaauuuccgccucauggguucaagcuauucuccuuccucagcuucccaaguagcugagauuacaggugccugccaccaggcccggcuaauuuuuuguauuuuuaguauagacaggguuucaccauguuggccaggaugaucucgaacuccugaucucaggugauccacccgccuuggccucucagagugcugggacuacaggcaugauccacugcaccuggccuuuuuuuuuuuuuuuuuuuuugacauggagucagucuguugccaggcuggagugcaguggcgugaucucgacuuacugcaaccucugccuccuggguucaagugauucuccugccucagccuccaaguagcuaggacuacaggcgugugccaccacgccaagcuaauuuuguauuuuuaguagagacgggguuucaccauguuggccaggauggucucgaucucuugaccucgugauccgcccaccuuggccucccaaagcacugggauuacacgcauaagccauugccccuggccuuuuuuuugagacagcgucucacucuguugcuguugcccaggcuggagugcaauagcaggaucuuggcucacugcaaccuccaucuccuggguuuaagcaauuuuucugccuuagccuccugaguagcugggauuauagguucccaccaccacgccuggcuaauuuuuguauuuuuaguagagaugggguuuugccauguuggccaggcuggucuggaaugccugaccucaggugauccacccgccuaggccucccaaagugcugggauuacaggcaugagcuacugcgcccggccaaaccccaguguuuucauuuguaaaaugagaucaucuuaguacuuauuucacaugguuuggggaggauuuaaauuguuaauccuuguaaauggcaccuggaauguaguaagugcucauuaaacguuaguuaucucucugaggcuuccaaaggaguuuaguuaguaacgcagugcuguuggucguuccucauucauuccaugcccugguacuucuagaaggccuuacugagcuccagacccugcucugaauagggaucauuuuucuuuuucuuuucuuuucuuuuuuuuuuuuuuuuuugagacagggucuuacuuacuuuguuacccaggcuggagugcagugucaccaucacagcucacuucaucccugaacuccugggcucaagcgauccuccugcuucagccuuccaaguagcugggacuaaggugugugccacugcgccuaauuuuuuuuucuuucuuuuuuuuuuuuuggagaccuugucuugcucugucacccaggcuggagugcaguagcgugaucuuggaucacugcaaccucagccucccgggcuccagcgauucucgugccucagucucccaaguaguugggauuacaggugccugccaccaugcccggcuaauuuuuguauuuuuacuagagacggauuucaccauguuggccaggccagucuugaacuccuggccucaagugauccgccugccucagccucccaaaguguugggauuacaggcgugagccaccgcuggucuugaacuccugggcucaagggauucuccuccuugaccucccaaagugcugaguuuacaggagugagccaccacauccggacuguucugccuuugacagccuccccuuccagguccugccucagaauauccuccuccagggagcccucccugaugcccucgaacuguaacuuggcagcacagggcuccuccuauuucuugcccuauagcaauuaauacuuacuucauucuggucugaccucgcugagggcaggaccuggaucucucuguucccuacuagaucuugagccuccagcucagggcuccgcacugggugcucaguaaugucuggggauggcacagaacaggggcucagaggagagggcagaugauucaauggaugcccuuuccuccccacagaaugacuuucucaccgguguguuuccugccagcccccucaguuggcuuuuccucuucagugccauccagcuugccugguuccuccagcuggauccuuccuuaggacugauggagaagaucaaagaguugcugccugacuggugagguccccccacuccagcccaguaacccccaaucacucucccuucacccaguaaguuccucugucauugugguguaccugcuaaagaaaaguaaccucugagacuuacauugggucagauuaauaaaggcauggcaugaagaaaaaggaggugaggccgggcacaguggcucaccccuguaaucccagcacauugggcauugggaggcugagguggguguaucgcuugaggucaggaguucgagaccagccuggccaacauggugaaaccuugucucuacuaaaaauacaaaaauuaggccaggcaugguggcucaugccuguaaucccagcacuuuggaaggcugaggcacguggaucaacugagaucaggaguucaagaccagccuggccaacagggugaaacccugucucuacuaaaaauacaaaaaauuagcugggcgugguggcaggagccuguaauuccagcuacuagggaggcugaggcaggagaaucgcuugaacccgggagguggagguugcagugagccgagauugcgccauugcacuccagcuugggugacaagagcgaaacuccaucucaaaaaaaaaaaaaaaaaaaaaaggugugagcuuugcugggcacaguggcucaugccuguaaucccagcacuuuuggaggccaaggcaggaggaucacuugagcccaggaguuugagaccaaccuaagcaacauggugaaaccccgucucuacuaaaaauaacaaaaaauuagccaaguguggugucacuuaccuguggucccagcuacccaggaggcugagguggagaucaccugagcucaggaggucgaggcugcagugagcugagaucaugccacugcauugcagccugggcaacagagugacacccugucucaagaaaaaagaaaaauagccaagcauggugguuuacaccuguaaucccagcacuuugggaggccgagguggccagaucaccugaggucaggaguuugagaccagccuggacaacauagugaaaccccgucucuacuaaaaauacaaaaauuagccgggugugguggugcgcgccuguagucccagcuacucaggaggcuaaggcaggauaaucacuugaacccgggaggcggagguugcggugagucgaaauugugccacugcacuucagccuuggugacagagcgagacucugucucaaaaaaaaaaaaaaaguaugagcuuugcccgucucuagucauguagucuuaggcaaggaucucaucguuguugauugucaaggccuucaucuguaaaaugagguaugaauaauugcuucuuagugugcuuggaagaauuaaucaaaauccugccugucggcgggauguggugacucacaccuguaaucccagcacuuugggaggcugaggcggguggaucaccugaggucaggagcuugagaccagucuggccaacauggugaaacucugucucuacuaaaaauacaaaaauuagccgagugugguggcaggugcuuguaaucccagcuacuugggaggcugaggcaggagaauuguuugaaccugggaggcggagcuugcagugaggcgagaucacgccacugcacuccagccugggcgacagagagagacuccgucucaauuaaaagaaaaaaaaaucaugccugucauauagucaguagagugccaggagguccucaugggaguggcugcauuauuuuuauugaguuauugugaucuucaggaagggucugaaaacugggugcaggugagaugucaggucuaguucucggaugaguccucccggggaggaagguccacauuuugugcagauggccccaaagaacagacccaggaucagauguagacaauuccaagacggaggccgggcacaguggcucacacuuguaaucccagcacuucggagggcugaggcaggaggcuugagcucaggaguuggagaccagccugggcaacauagagaccccugucucuaaaaaaaaaaaaaaaaaaaaaaaaaaaaaaaaaauuccuggaacgcuagauuuacccccagucuacagagggaaagugauuugacccaaguccuccaggugacauuugcaaacuuugcaaacaaacauguugauuuaauguagcuuuagaccagcuuuuccuaaauuuaagcuuguauuggaaucaccuggauggguuguuaaaccgcugacuauggccaggugcuguggcucacaccuguuaucccagcacuuugggaggcccaaguggguggaucaccuaaggucaggaguucgagagccgccuggccaauguggugaaacccucucuacuaaaaaugcaaaaaauuagcugggcgugguggcgggcgccugcagucccagcuacucgggaggcugagguaggagaauugcuugaacccaggagauggagguugcagugagccgagauagugccacugcacuccagccugggcgacagagugaaacuccaucucaaaaacaaaacaugccgggcgugguggcucacgccuguaaucccagcacuuugggaugccaaggcaggcggaucacgaggucaggagaucaagaccaucauggcuaacacggugaaaccucaucucuacuaaaaauaacaacaaauagccgggcgugguggugggcaccuguauucccagcuacuccggaggcugaggcaggagaauggcgugaacccaggaggcggagcuugcagugagccgagauagcaccacagcacuccagccugggcgacagagcgagacuccaucccaaaaacaaaacaaaacaaaaaaaaaaacgcugauugcuggaccccacccugagagauucuggcuuguuaggucuuaaaggcgcccaggaauaugcauuucgaacaagcucccaggcagugcucccaggagccacaguuucagaacuauugccuuagaguagugauagcuggaaggaaaaaguguccccucaauagaaauaauggcugucauuuauuaaacaccuaccaacuuccauggaaagugacuuuggaagcuuggugcugccacaaugggagggggcuggagggggugacagagcucacaccuacuaaaaugacaaaaauggguuucucugucugacagccaaaagaucagcgcaggggcuggagggggcuggaagggagggagguucugaggccaggagacccaggcccagccucuguuucucuccccgcagggguggacaacaccacgggcuccgggggguccuggcagccgcgcuguuugccucguguuuguggggagcccugaucuucacacugcacguggcccugaggcugcuucuguccuaccacggcuggcuucuugagccccacggagccauguccucccccaccaagaccuggcugguaugggaggggcauagcccugcucaggcucuccugggacccgcuuaucuauuccccucucucugggucucugucccccucucucugggucucugucccucucucucugggucucuucccccucucuuucugggucucuguccuccucugucccugggucucugucccccucucucugggucucugucccccucucucucugugucuccgucccccccucugggucucuacccccgacucucucugggucucugccccccucucucucugggucucugucccccucucucugggucucuguccccugucucugggucucuguuccuuucucucuuggggucuccgaugcucuuaagucucuguguccuucucuuuggguuucugucccacugucgaccccugccccgucaacucccuggcuccggugagggguuaaugacccgguaacuccuccuccccaggcccugguccgcaucuucucuggccgccacccgaugcuguucaguuaccagcgcucccugccacgccagcccgugcccucugugcaggacaccgugcgcaaggugggccugggagcgcgcagacgggcuggggcggccggggcgggccgggggcgugaccugcccucuucuccccuuuaguaccuggagucgguccggcccauccucuccgacgaggacuucgacuggaccgcgguccuggcgcaggaauuccugaggcugcaggcgucgcugcugcagugguaccugcggcucaaguccuggugggcguccaauuaugugagucccgccaccgccaccaacgccccaccugaagggcuaagguugugagcucgccugcuaaacuugcgaguuauacgcccugccccacgacacgcccacaacccacacgcccccagcccccaagggucaauacccugagccccgcucacauacaucuauauccuaaccuccacauuuauauauauauaaaaauauauauguauauauauuuauuuauauauaaauauauaguguauauauaaauauauauauuuauuuauaaauauauauauuuauauuuauauacaaauauuaauauuuauaaauuuauauauaaauauauuuauauauaaauuuauaaauaaauauauaaauauuauaaauauauuaaauauauuuauuuauaaauuauaaauauauauuuauuuauaaauuauaaauauauauuuauuuauaaauuauaaauauauauuuauuuauaaauuauaaauauauauuuauuuauuuauaaauuauaaauaaauauauauuuauuuauaaauuauaaauaaauauauauuuauuuauauauaggcuuauauauuuauuuauauauauaugcucauaacauauauaugcucucucuauauauuuaauguugaaguuugggguauagaugcuccaguauucugagcuucacccuugaucuuccaaaguuugaaccagaauuccaggacuuagcccuggugcaaugucucacgccuguaaugccagcagguugcgaggccaaggcaggcggaucacgugaggucaagaguucaagaccagccuggccaacauggugaaaccccgucucuacuaaaaauacaaaaauuaaacaggucugguggcgcacacgccuauaaucccagcuacucgggaggcugaggcgggaggauugcuugaacccaggaggcagagguggcacugaacugagaucgcgccacugcacuucggccugggccacagagcaagacucugucucaaaaaaaaaaaaagaaaagaaaaaaaaaaagacaaaaccaaaggaguugaauggugaggaguggugggagaggccugaacuccagacugaggauccuggacucuuuccuggggguacuagggagccaugggaggguuuggagcagggaaggggcagggucagcuuuggugugggggaaagacuggagggcgggaggcugcagaggaagcuaccgugagaccuaccauuguaggucauugagacacugggcugggaugagaaaagcugcagcaagagugagaggggaagggaagaggguccccggcagagccccacgaggcagcuauguggaagccucaguuggucaaacccagcgaaggggacgaaauaucuggagaaguaaaagggaaugcaggccuugcuuuucugguuaaauauuuuuuucuucacacuuuuggacaagauucuguuuacacacacacacacacacacacacacacacucauuucuuucuucccuuccuucccucccucccucccuccuuuccuaccuucuuuccugccugccugccugccuucucucucucuuuccuuccuuuuuuucugucuccuuccuuccuuuuuuucuuugagauggagucucacucugucgcccaggcuguagugcacuggcaccgucucagcucacugcaagcucuaccucccagguucacgccauucuccugccucagccucccauaccuggcuaauuucuuuuuuuuuuuuuuuguauuuuuguauuuuuaguagagaugggguuucaccguguuagccaggauggucucgaccuccugaccucgugauccgccugccucggccucccaaaguguugggauuuacaggcgugagccaccaugcccggccucuuucuuucuuucuuucucuaucuuucucucucucccccucccucccuuucugucucucucuccucccucccucccucccucccucccucccucccuuccuuccuuccuuccuuccuucucucuuucucucucuuuccuuuuucuuucuuggaaggggucucacucugucacccaggcuguagugcaguggcgugaucaaagcucacugcagccuugaccucccagacucaagccauccucccaucucagccuccugaguagcugggacuacaggcaugugccccuaagccuggcuaauuuuuaaauuuuuuguagacauggggucuugcuauguugcacagacuggucucaaacuccgaggcucaagcuauccucccaccucagccucccaaaaugcugagauaagaggugugagccacugcgcccagccuguauauuuuauuguaccuccaagccaacugccagugacacacgcaccauuuuuuuauguacaacaacaacaacaaaaaacccuacaagagcagcuaaaccgugacacagugcuuucuuuuguguuuuucauuguuugaauuuuaucaugguauuggcaaggccacaauuuucauguauuuacacauauguauauuauuucacauauuuauuguuuuauaaauuuuacauuuauguucuguuuuucuuuuuugggggggacggaguuucacucuuguugcccaggcuggagugcaauggugcgaucucagcuccuugcaaccucugccuccccgacucaagcgauucuccugccucaggcuaccgaguagccgggauuacaggcgugcaccaccacguguggcuaauguuuguauuuuuaguagagacaggguuucaucauguuggccaggcuggucuugaacaccugaccucaggugauccacccgcuuagccucccaaagugcugggauuacaggcgggagccaccgugcccagcuguaccuuguuauuuccaccagcuauguaauauuccacugccggaguauaacaggguuuagcuaacugaucccccauggauggauuucuaggugaucgcuaguuacugacuacgauggcugacuucuuuggcucuauccucccugccugacgcaggagcaucuggggccuucccuguccuacugucccucccccaacaggccccagccccucacugugugucuccccaccccgcucccaggucagugacuggugggaggaauuuguguaccugcgcucccgaaauccgcugauggugaacagcaacuauuacaugauggugagaaggggaggggugagguucauaggccccaggucuaggguugggggguaccugggcggaaugugacggucaugcucagugaccuggaucuagacgcgccaucugggauucaucauuccacccucuuuuggggucaggaccuguauuugggucaguggcuccaucgggggcaaaccugacccuggguguuuugccauccccucuccugguccccaggacuuccuguaugucacacccacgccucugcaggcagcucgcgcugggaaugccguccaugcccuccuccuguaccgccaccgccugaaccgccaggagauacccccggugagagggccccaguggguuagggauggaggugugguccuguggccuuugggccacguggguccuggaaggcagcucacagcccacgguuuccugcagacuuugcugaugggaaugcgccccuuaugcucugcccaguacgagaagaucuucaacaccacgcggauuccagggguccaaaaaggugagacccucuccuguccccacugauggaggcagaacaauauaguggcuaagagcauguuuucuggaguccgccugacugagcugggaaccauugcuuccuugcugugugaccuucugcacguuauuacccucucugagccucagcuuccacuaaagugggauaauaauuguaccuaggggcugggcgcagugacugaugccuguaaucccagcacuuuguggggccgagguggacaauugcuuaggccaggaguucgagaccagccuagggcaacguagugagauccggucuauauacaaaauuuaaaaauuagccaggcauggugauaugcaccuguggccccaguuaaucgggagccugaaguggaaggaucaccugagccccggagguugaggcugcagugagcugagaucucaccacugcacuccagccuggcgacagagcgagaccuugucuccaaauacuaaguaaauaaaaguccuagggugcugaugauuacuaggguacuuugaacaacugacgacaccuaagaaguauauaauaaauggucacuauuuuuaugugucuggccuuccugcccccaugcuucugccaacgccaccccuagacuacauccgccaccuccaugacagccaacacguggcugucuuccaccggggccgauucuuccgcauggggacccacucccgaaacagccugcuuuccccgagagcccuggagcagcaguuucagagaauccuggaugaucccucaccggccugcccccacgaggaacaucuggcagcucugacagcugcucccagguaagggucaggggucaggggucaggggcucucagaggccgccaguguccugagacuguggaagggcaggguggggccagguggcggcugggcaggauggacucaggcacaucccgggcccuccaggggcacgugggcccaggugcggacaucccugaagacccaggcagcggaggcccuggaggcgguggaaggggccgcuuucuuugugucacuggaugcugagcccgcggggcucaccagggaggacccggcagcgucguuggaugccuacgcccaugcucugcuggccggccggggccaugaucggugagugagucuugggauggggcccccagauguggcacccgagaauccaguaucagaccuaggaccccugacaguagacagccagacccuggagcccacaccugcagagucuguagaccaggggcugcauagagcugaggaccccagacccagugcuuugggaccuggagaccucugaccuggggaaccccucaaccugggacccaagaccuauaaaccagacccagugacccccaaaucugagacucccaaaccccugagcuggacccuccgacccagagaacucagcaucacagacccagagaccccagaucugaggaccaccaaacccaggaccccuaggcccagggaccccagacuuggcaaccucagccucagaacuugaaccauucaauccucaggccuuaaugcaggcaccccaaauccauggcccuagacccagacuuccagaccuagagauucucaggccuggcaggcaucacugaauuccuaggccccaggggggucccgcugaccucccagcacccccaaaagccuugaaccuuccucggcaaguuuccuaaaaaucuccaaacuccagacugggcaugguggcucaugccuguagucucagcacuuugggaggcugagaggggcggaucaccugagaucaggaguuugagaccagccuggccaauauggugaaaccucaucuccacuaaaaaugcaaaaauuagcugggcaugguggugcaugcuugugaucccagcuacuugggaggcugaggcgggagaaucacuugaacccucagcuacuugggaggcggagguugcagugagccgagaucgcgccacugcacuccagccugggcgacaagagugaaacuccaucucaaaacaaacaaacaaacaaaaaaacaaucuccaaacucuaaaucccagacaugucuuggagaccuccagggccacuacuggggacccccaaugguccuagagauccccauaccagcaccccaauggauucccacaucuucccaucuagaaaacccccucaagucccacagaaagcacucugagguccccgugccccucgcucuuggugacccaucugaacucucccugacagcugguuugacaaauccuucacccuaaucgucuucucuaacgggaagcugggccucagcguggagcacuccugggccgacugccccaucucaggacacaugugggagguagggcggccagcccucccugguucuggggaccccugccccaucuccaaagaccguccucuccagcgccuuagugucagaagaaaaacugaggcuuggccgggcacggugguucaugccuguaaucccagcauuuugggaggccgaggugggcggaucaugaggucaggaguucgagaccagccuggccaacauagugaaacccugccucuacuaaaaauacaaaaaaauuagccaggcaugguggugugugccuguaaucccugcuacucgggaggcugaggcaugagaaucgcaugaacccgggagguggagguugcagugagcugacauugugccacuguacuucagccugggcgacagagcaagaauacaucucaaaaaaaaaaaaaaaaaaaaaaaaagaaaagaaaaacugaggcucagggagaggcagaggcuggcccagggucaccuggcaaagaaaggggacugggaugaggaccuuccuuugaugaguugguaacuggggcucaaagaagggaagugauuuucccagagucacacagcgaggaguuacagagcaagaagaugacuccaggcugggugcaguggcucaugccuguaaucccagcacuuugggaggucaaggcaggaagaucaauugagcccaggaguuugagacuagccugggcaacauaaugagaaccugucuacaaaaaacguuaaaaaaaaacaaaaaaaacaaaaccagccagucauggugguacaugccuguggccccagcuacuccggaggcuaaggcaggaggauggcuugagcccaggaguuugaggcugcagugaguuauaauuucaccacugcacaccagccuggaugacagagcaagacccugucaaaaaaggaaaagaaaauaaggacaguaaacaccaguugaguauugguguuaguccuguucuugaugaacaugaaccugagaccgcaucugugaauaucagagguuucuguuucucagggacugcccccuacccgaaaaagggcugcaugaaaagaggucccggguuagauggccucaguccacagggaggaagggacucuaacagccucuguuugcccacaguucacucuggcuacagaaugcuuucagcugggcuacucaacagacggccacugcaaggggcacccggaccccacacuaccccagccccagcggcugcaaugggaccuuccagaccaggugaggcuggguuucugggccucuccuccaagucccaagauuccuagccuugacuucaaacucauccccaccccuaaucugaacgugaaaaucaaccccauuccuacccccaacccgaaacccaugcuucccccacccccaaaucaggccauaugcauccacaaccucaaaccccaacacgaaccucaucuccagccccaacuccaaccguccucccacugccaaucccauccucaaccccaaccccaucucuaccuguuucagacucaaaaaccaccacuguccaaccccagcaccaaccccuacuccauuuuccuuccaaauccaucuccauacccaaucccaucccaacaccaccugaauucauucccauguucauccuaacuccaccccauaccaaacccuaaccccauacccaaccccaaccccauccuguacucagccacgaccccacuuccaaugacaacccaugcccaacucaucccauacccaaccucaaccccauaccccacaccaaccccaucccguacucagccacaaccccaccuccaaccacaacccaugcccaacucgaauucacuucccauacccaaccccuuccccguucuauucccaaaccacucucagucccuccuccauccccauccccaaccccagcuucaacuguggcccaaccccaaucuuguuccagucuacacaugccaucccuauccccauuuuuuuuuuuuuuuuugagauggagucccgcucugucacccaggcuggagugcaaugacacgaucucaguucacugcaaccuccaucucccagguucaagcgauucucuugccucagccuccugaggagcugggauuacaggugcccacuaccacacccggcuaaauuuuuuuauuuuuaauagagaugagguuuuuccauguuggccaggcuggucucaaacuccugaccucaggugauccagccaccucagucucccaaaguguugggauuacaggcgugagccaccgcgcccggcauuuuuuuuuugagacggagucuugcucuguacccaggcuggagugcaguggugcgaucucagcucacugcaaccucugccuccuggguucaagcgauucuccugccucagccucccaaguagcugggacuacaggcacgugccaccacggccagcuaguuuuuuguauuuuuaguagagacgagguuucaucauguuggucaggcuggucucaaacucccgaccucaggugauccgcccgccucggccucccaaagugcugggauuacaggcgugcgccaccacgcccagccccuauccccaucuuuagucucauccuucaauucucuucucuucuuuguccccauuuccauauucugccgcaaccuuaacuccacauccaccuccgcuuccagccuuauuccuggcuuucacccuacccccaucuguaaccccaacuacuccucuucccuccuccucuggcagauccacuccuccaucucucuagcccugaggggagccaagaucuugucugaaaaugucgacugccaugucguuccauucucccuauuuggcaagagcuucauccgacgcugccaccucucuucagacagcuucauccagaucgccuugcaacuggcccacuuccgggucaguuggguuccccauccacagcccccgcagggucucaguccaccugagcccccaagaccugccccuccacgguuccuuguggucgcugccauugugggucggccaucuugaauucucucuuccaaccauucuugggcuggcuggaggaggcuggaggucuggacagagauaggucaagucuguaagaucuccugagcccagcugacagacuccucuucuccucccugucccccaggacaggggucaauucugccugacuuaugagucggccaugacucgcuuauuccuggaaggccggacggagacggugcggucuugcacgagggaggccugcaacuuugucagggccauggaggacaaagagaagacggugggugcagcccucgcuugaggcuucaguuauuucuguguacucacucauccacuugcaaacguugaugggaccuacugaagccagccuccacgaggagcacaagggacaagggaugaaucggaccuggccucugacuucaaagagcucacugauggggggagacagcccagcauagugugauaucugcuuucaugguggucucacagggcacugggggugcacccaagaaggaaccccauuucuuuuuuuuugagauggagucuugcucuguugcccaggcuggagugcaguggcacaaucucggcuuacugcaaccucugccucucagguucaagcgauucucaugccucagccuccugaguagcuggaauuauaggcacccgccaccaugcccagcuaauuuuuuuuuuuuuuuuuuguauuuuuaguagagacgggguuucaccauguuggccaggcuggucucgaacuccugaccucaggugaucucccugccucggccucccaaagugcugggauuacaggcgugagccaaugcaccuggcuggaacuccauuuuuacaacguaacucugcccauuuaaccucuuugugacuugugaccuuccuuugcaccccuguacccucucugcccagaucccaccugcccugcaccucuucucccuugcccuacaccuagcccugcaccuacaagguauugugguuccauggaaggaguuuggacucuggggccagacacaccuaggaacccgccuggcucucccuggcugugugaaccuggccaaaugauuuccccucucuaagccucaguuccccaucuguaaaaugggguugauauucccaccuugcagggauguggcaaacucaguugaggccagaugugccgcaggcccagcccuaagucgacuuccugucuuuccaugaccugugaccucccuggggacugcaggacccacagugccucgcccuguuccgcguggcaguggacaagcaccaggcucugcugaaggcagccaugagcgggcagggaguugaccgccaccuguuugcgcuguacaucgugucccgauuccuccaccugcagucgcccuuccugacccagguuggggcacagggaaaggguuagagagggaagugggagaccauggaagaagggagagguuucagggaaggagggugauguugaaaaaggacccaucaaggccgggcacgguggcucacgccuguaaucccagcaguuugggaagccgaggcaggcggaucacuugaggucaagaguucgagaccagccuggccaacuuggcgaaacccugucucuacuaaaaauacaaaaauuagcuggguauggugacaggcaccuguaaucccagcuacuugggagggcugaggcaauagaaucccuugaacccgggaggcggaggcuguagugagcugagaucgcaccacugcacuccagccuggacgacagagcaagacucugucucaaaaaaaaaaaaaaaaggagggugauguugagaaaggaugcgucagcagagaagucaguugugggggggcggcaaggcagaaggcggagaggcaacgggacaacgggagcagacaaaaggggagagggucagugggguggggauaagaggaaagggcguggucagaggaggggcgugguccgagggagaagaggagagggacguggguguggguggugagacgagugaggggcguggccagauagggcguggucaggagaagggcgugguuagggagaaggaggcccggauuuacggguaaaaaaaaagccagggaugcagggagugaaguggagccaagggccggaacugcagaucucuguccugcacaugugaugggcuccuguccucagguccauucggagcaguggcagcuguccaccagccagaucccuguucagcaaaugcaucuguuugacguccacaauuacccggacuauguuuccucaggcgguggauucgggccugugaguggagcugggcgcgcuggcccccagaggaaagagggggcuggggggccugcacuccugcauaguggggguggaggggaccggagcuauuuucuucccuucacucuuuccgucuccaggcugaugaccaugguuaugguguuucuuauaucuucaugggggauggcaugaucaccuuccacaucuccagcaaaaaaucaagcacaaaaacggugagacaaacguguauacccaccaacucccucuuuccucaggaaccaggagucugggcccccagccccuccucccucagacccaggauuccaggccccagccccuccucccucagacccaggaguccaggcccccagccccuccucccucagacccgggaguccaggcccccagccccuccucccucagacccgggaguccaggcccccagccccuccucccucagacucgggaguccaggccccagcuccuccucccucagacucaggaauccaggcccuuagcccucuuguuucucagccuccaggaucccaucucccagcuuccccuggcucugaccuguucuccuuccaggauucccacaggcuggggcagcacauugaggacgcacugcuggauguggccucccuguuccaggcgggacagcauuuuaagcgccgguucagagggucagggaaggagaacuccaggcacagguguggauuucucucccgccagacuggggccuccaaggccucaaugacauccaccgacuucugacuccuuccagcaggcagcuggccucuccaaggaauaagggugaaauugccacagcuggcugacacaggacaggggcaacugguuuggcaaccccacauccaggccaauaaagaugugugagcuggg

SEQ ID NO: 191762 - RNA, 11296 nt, Homo sapiens
cccagcugaggauuuauuggcguaaaugcaaccauauaaaaacauaaguuaugaaaaacacagucacgaugugcccuccccauccccccagcccaggccccuaaaacccccuucugcgggagggagggagaggaagggggagccccgaaaccgccuaggaacgcucagccccugggcucgugcagggcgggagagccgggccucagcgcauccgguagucgguggagcaggacagcucgcacagcuggcccuugaaguccaggucgauggugaaguccaggucccgcugcagggagagguggggcaugagggcggaacccaccaggaggugguggcggggggcgggugcaggcaggcuaugcgacgaugagccgggcuccagcuuccugcccaucuccacgcugcagaccccaacugcuggucccacccuagcagcugcccugacccugccaagggacagcaccacauggacacccccaagcccacuagacucacucaggaguagagcccagcugcugucccuugcccuuggauuucuccaucaggaugauucccaucagcaaugcagugauugcuucuuucauaaaaaagaaaaccucucccaagcccacuuccuccucaggcaaacguuccagugaaacacaaugguccagccugcugucuccacuuccucuccuccccccauacccuccagcacaugaagaugagacaaagucaccaacgcccgaggacuccuccucccucuccaguauccguuucccagcuagugccguggucccgggggcugcaugagucuuuguagggggugguccuguggcugcaggacauuuaccagcccccuggccccuaccuaccagaugccaggaccaccccuucuccggagugacaaccacaaauguuuccacagacgguggcaaacguccugggggggggcggggagcggagggggcaguaaaacugcccaguugacaacugcugcugucacaggcucgugggugucccaggguccacauuccaugacuacccugagugccacccacccucgcacccaucggccgggacccacuuuuccaacccagaccacucccggcgacuccaggcuccaagccuuccauccuccugccugcucagacccaccacacuggaucucugcccagacccugucuccgagaagcccccccagcucccccggaagcccccugaucucaggugauggcagcuccugccaagugcucaggaggaaaaagaaaggggagcagaaaacaaaaagcugccuuucuccucucaugccucccagcugggcuagaaaaccccgugcacucuacugggggcugccucuugcccuggagcccaccuacaccaacaccugucugcccugcucccagccugacagaggucaccuccaacuggcaucaccaugucacugacccccuugucuagaguggaagcaccaggagggcaggguuucagccuggguccccaggcccauaacuuccggugaaugcucaagcaauccugcuguguagacaggcauggggcugaggggcuuggggacccgggaauaggcagaggugcucgcccccgccagcugcccccaucccccaccccggcugcccccauccccuacccccgcugccaccauuccucccccaccacuccccccccaaucuacacuccccgcccuagcugccacccucccacccagcugcccggagccucacguuguucuuggcguugggccgcaugccgauggugccgaagaucuccucgcccgucuucacggucagguaguccuccauguagaacaccgucugcuuccagugcguguacggggacucggggccugggggcgcgggcgggucagccggccucggccugcugccccccccaaccccacccuugcguucccucugucggaaugcccacccccaugacagcugaugggacugcuauccgcgagucaccucccugucauugagcuuuggagacagggaccgugucagccuuuuguggaugaggaaacugaggcacugcacacucaggucacuugcccaaggccacgugacugcuacauggcagagcucacacuggaacacgcguguccccaugguuccuucugcccguuucugucacccccuccacuacgugggugcgccuccgcccuggcucgggaacggcccccagcccugugggccccgccucacugguggagaagccgguccucuuguggcagcgugugaacucgauguugaaguaggccaccagggcgugcacguagucauuccgcuucacuugcaggcagaacggggaggugaaggucaggucuuccaccuugacgguauagauguccaccuccugcaggacaugagagggcgagcuccgggaugcguccccaccucgcuucauccccuccucccucccuuaagcucccagagggccugugaccucgcuguccccuuccugcuagcccucccucacuggcacccagccucggcuccuccuucacucugcauccugccuauccggcucccaauaaaccauguggguucgagcccagauuccuugcucccuccucuccaacacccaaaccuggcagugccacccuaacucuguccagaccuccuagaaugcaggcgccccacuccacugucuccccaaccccuugacaaguccaacaacaugauggcuucaaacggcaacacaaaugccaaccuaaacccugcgccaguuccccuggcucucaggaggguggcccgaguggggucccugccccuguagucuccucuccucccccacucaacaacuuacuccuccccgacaggaucccccggucagccacccagcuucacccggcucacacaucccagcucaacaaauacucaucgccguauuuuuuuuuuuuaaacagggucucagaaguaaaaaaaaacaaaaggaaaaaacaaaacaaaacauugucaccaaagcuggagugcagugaugugaucacagcucacugcagccuugaacucccaggcccaagugauccucccgaguagcugggaccucaggcacaucucggagcccagccuggccccgugcucuucugcaguggcccgcgugcaugugcauccgcucaucgcccugggguccugccuuuccgugcaugggcugugggcuuuagcugccagcuuuggguguuuccuccgccagaagccaagugccaagcaugguucucacacagcagcgcucacaaagauauuuaaaggacgaagugucuuuccugggccucuagcaccaccucuggcuggcagaucaggcucugagaccucaggccaacauucugggccccaaagucccaugccagggccaggugauggccucucuuugguuucaacccagggggcaccuggccaugcccacccccucaccuuuaugaggcaggcguuggugaccagcuguuugggguccacgacauccacuaggggcuccuuaauggccacaucuuugaugcaagacaugucgaagccauacacguucucccacccuggggaggcaggcagggagggggugagcccgcagcagcccacccgaggccccgcccgccagcucccgggccgcgcucacaguggaucuuguagucuuuguacugccgguccucgauggccgucacauacagcguggcccggucugggaagaugaggccaucgggcgccuacagaggggcagggcgaggcaugaaggguggggccuggcaacacuacccugagucuugccuccaagauguggccuccugcccuggucugggccacccucaugucgcagcggcacucaccccucgcccccuggucuauuucccacacggccgccagagggcacccaggggcaccccagucagcucccggcccuuggagguucuggggauccucagacccucccuagcugcucugagaggaaaagcacggggucccauaagccuccacaaaaucugcacacgcccugucaccccucaccuccacuccuccuccugcugccguucuagacccuccuuccacacgggccucccugcuguuccacacgcagcaagggcacaccugcccuggcugccccuccguaugcuucauccaccucuccgucaccucaccucucccggggaggccugcuggggccuaaggaccugggcuauugcgccgcuacggauuuccuguuccuacgaccucccccacaucgcaccaucucccuccagggucugucacaccuggcuugggcuguggcuuucuaacaccuugcagcuaagcccccacaguaagucccgucugugggaaaaauugagcgugguuuucgucuucuaccuggaccccagcccacgcgagcugcacccgucccgcuggggccucaccagccacuugucccgggcauagagcacgguguugagcauggacucguagaagaggcaguagcccauccacucgcugaugaugauguccaccuucuccacugggagcuccaccuccuccaccuuccccuugaugauggucaccacugcgggcggacaaggguggccacgucagcccccgggaggccugccccucaccucaccucccccgggggcuagagccuggggaccccacuucaguucagagaacugcgugagcagaagccaugaacccuucuaacaguuuuaaaauucauacaucguucuggacauuuuugaggcaggagcagaaauuuuauguggacuggguaucaggugauguuacuuuuuuuuuuuuuuuuuuuuugagacggagucuugcucugucacccaggcuggagugcaguggcgugaucucagcucacugcaaccuccgccucccggguucacgccauucuccugcuucagccucccgaguagcugggacuacaggugccagccaccaaguccggcuaauuuuuuguauuuuuaguagagacagggugucaccguguuggccaggauggucuugaucuccugaccucacgauccgcccgccucggccucccaaaauguugggauuacaggcgugagccacugugcccggccgcgauuuuguuuuuaacugggugguuuugauauaauaaguaacagcaugaucacauucucaaaacagccuuuaucuauuagauaagacacaagcagacgcauuuaccgggaaaauuacaucacagugggaauuugcuucaaauggacucgugcguucauuauaauaaucucuuuuuaaaaaucacuucaggauggcacgguggcucacgccuguaaucucagcacuuugggaggccaaaguggauggaucaccugaggucaggaguucaagaccagccuggccaacauggugaaaccaugucucaacuaaaaaaauacaaaaaaaaaaaaaguucacaccuguaaucccagcacuuugggaggccaaggcaagcaggcagaucacgaggucaggagaucgagaccauccuggcuaacacggugaaaccccgucucuacuaaaaaaacaaaaaaauuagccgggcgugguggcuggcgccuguaaucccagcuaauugggaggcugaggcaggagaaucacuugaacccaggaggcggagcuugcagugagcugagaucgugccacugcccuccagccuggcaaaagagugagacuccaucucaaaaaaaaaaaaaaaaaaaaaaaaaugcuggggauguaccuaugaugguggucaugcaaaagagcggaugccgcaacauccuggaaaguguuaaacgacaugacaagcagguguaagaagccaagggcaagaggcugguaugaaaugcuacuggcgugaaaauuaugcacgagaauguaaaugcauuuacguauguauguguuuguagguccagacuucucuggaaguuaguguugguuaaacucagaggagggcagcugggaaacagggaaggcuucucacugugggccuuccguggccaaccacgugacucuauuacucauucaagaaacuagagagugcuucuugcccuaauuuuaagacugcggugcuaagccugugauuuugacacucagauucucaggcggccggcagcccaaaagaccauggguugggagcugcugaaucuguggucaucuguagaccccacugcucuucagagggcccuggggaagcagggcaucacccccuccacucccacaaacccauccucuuucugggcucaccguggucuaacuuguuggcuuugacgaucuucaccgcauaaucagagauacuggaacacucgaucugagggcccaggaagaagggagggugagacccauccccugcccccaucaccuccauccaaucccugagcccugaugggcuccccuccaucccucaggcccggccccgccuggccacccuggagacucaccccgaugaccuugcgggccccggccuuggcagcaaacaugcagaggaugccggugcccgagccgacguccagcaccaccuuguccuugaagaggugccgguuaugaaacauggaguugcgguaagugagggugcgcaccucguccuucagcaucuccuagggcaagaauggcacagagacgccgugaggggccccauauccccagcuggagaacagcguguccugagagcucggagggccagagcucggcccucucgcuuucuuccaugcaccucaguuucccuuuuauauuuauucauuuauuuauuuuuauuuuauuuuauuuuuugagauggaaucucacucuguugcccaggcuggagugcaauggugcaaucucagcucacugcaaccuccgccuccuggguucaagugauucuccugccucagccucccaaguagcugagauuauaggugcacaccaccaugcccggcuaauuuuuguauuuuucauacagaugggguuucaccauauugcccagguuggucuucaacuccugaccucaggugauccacccaccucagcccccuaaagugcugggauuacaggcgugaaccacugcgcccagccaguuucccuuuuuaaaaaaucagauuagauggucuaaacuccaaucuuggccggacuucaccacugcuaccuaagaaccagugaacccuggcuuuuaaaaguccucaggcugggagcgguggcucacgccuguaaucccagcaccucaggaggccaaagccggaggaucacuugaucccaagaguuugagaccagccugggcaacaaggcaagauuaucucuacagaaaaauaagaacaucagcugggcgugguggcgcgcgccuguggucccagcuacuccgaaaguggaaguggggggaucaccugagccggggaggucgaggcugcagugagccaugauugcaccaaugcacucuagccugggcgacagagcgagaccgucucuaaaaauaaaaaauggcaauuuuaugcauauuuugccacaauuuuaugaaaaaggccucagggggaaaagaaaauuccuuagaaugccaccccagcuucguucugggauuucagugucuucagucagaucugaagugugcagaagcuguuagggcgggagcagccggggcgcagucccaccgccggucacuagagggcggcagagaccagugggcccugcccgaccucuggcuaaggccccaggcacgcaugcgcucucccaccccagccuucggcgcgaggccccugcagagauucaggcuaaccucggucuccaaggcaacggcuuggcgaggcgacccuaggaagugcgcagcagaggggcaggggggcggccugcggccaggggaagcagugcgcaugcgugggaaaacagguuccaccccuuccccaacauuuaagccccccuaagauuggggccuuggggacuguccccacugaccucguggaugccaaagugugcguaggagucaaaguaguaaucuuuggaugucauguccucagcguugggcuucucacugcuuuccgccuggccacaggacaccugggagggggccgaugggaucaugggucagaucugggggcuccccacagccucuuaaaccuccagcgcccuacuuuucccugaagaguaguauagaacccccaaaaucauaccaugacaacccuacagcccccgccugccaucuugcccccccaggaaccccaaaaccuaacaaccccauuuuccacuuccaggacccccccagagcaccauccaggggagcaccccgauaccucagccacgccuaccaucucuccagucucucugaccccgucucuagcucagcccacagcuggggaggggaggggaaggaaaaugggggcagacacagggaagggcaaagggggguuggagguggaguuaaggaaguagcggcgauacugggggaggccagcgggggcugugaaccuggagggguugcuacuaagugucugggggccugggguaaacugguuugaagcaagagggguaugguuagaccucaagaaagggccagauguguggcaagauauauugauguggaggucaggguggggaggggucucacaaaaggauauuuacuucuucaagaggcggcuggaggcucaucccauuagccaagguggcuacaaaauucuaggagagaguaacagggaaaaaggauuagcuacugggaguggcugugggagggcuggguggcggaaccugggcucuggccgggggguggguuuccagcaauucuccuucuugguggggagugguggcgaagggggcaaguaaugaggugggguguuuaagaaagggugggaaaagugaggggagaagaaaggggggucuccuaucccagcuguggcuggagagaugguggcccacccccacgcugccccucucuggccaggcagcugaccacacaccucccccauccaggccaggggaauuggcacccaccaccgccagcugucgcucccucucaucaccuaaucuccuccagauuaggugacacuuccugacacacacaccccuauccuagggugccaugaauagcagaagggagcggggcuggcaggauaugcccacagggcaucugccaccucugcaaaccagucucaugucugagaggauuccagaauagagguguggcacacggguacuuccccagagcuaguaccccagaccccagcuccugccuuggacucaggagccccaaacaaaaccagcuggaaccaacccccucccuuaugacccucugcccacgaagguagggucccagggaagaugggcagcuccuggacccucuaagaaugagaggacuccagaaaguggcuugggggcacgguggcucacaccugcaaucccggcacuuugggaggccgaggcaggugggucaccugaggucaggaguuugagaccagccugaccaacauggugaaacccuaucucuacuaaaaauacaaaaauuagcugggccugguggcgggugccuguaaucccagcuacucaggaggcugaagcaggagaaucgcuugaacccgggaggcggagguugcaaugagccgagaucaagccauugcacuccagccugggugacagaguaagacuccgucucaaaaaaaaaaaaaaaaaaaguggcuuggggagucaggccaucgcccccauucagacacccaucccaggcccugaagacuuccaggugcggccaagccugaggccaccucugggaaaguuauuuccuccauccauagagccccaggugcaggagacagccaagagggugggaagucauuacagugaccccugggagcugcauccugacagcugagagcugaccugccccuccagccaaugccauagguaagggguggaaggacagaggccccaucagauuacaucucuuccagaugugaccacuauccaagucuccaagaagggccacgucacaggccaugaccuacuaggcuccaagcacccucccuccagcucucccaagcuagcggggaugccuauaagaagaaaggugcugaggggguuucccacucgggccuauuucucaauaccacugaaaacuaccgccagacaaccccagccccagagggcuugaaacgcaagacugaaaccucccccacauggcugcacgagaaccaaaccucacucgaaaccauuucaggcacccacucucaggaccccagggcucaggacccugcacagggcuucaggaagaaggaggucaucucgcacccucacaaagacccgggggagauaaacggcuccaguaggguaaagcucucagccuacauauuucccacaacuccuucccagcggacauacccuccucccuccgcccgccaggaagaaauccgaggggaggugggcuucaggacacgccccaugaaaaagaugucccucccacacacccagaaauggccacaagggggugcacggcgccuauuaaugggaaaaucucuaucuagaugccccaccaccacccagagggaggucacaggggcaugccccaucccccaacuccuaaagcccugggcgagggggagaauucugggaggggaaacggggucggcgggggaccccauucuugguuuuccuccagucccuaacccagaacgcacaaaaccggguccgauaucccaacagaugcccccggagcucggaaggagguugguaaagggcugagaagcacugcuccucccaagagacuccccacaucguggagggccccaggucgaucacaccccacggcgugugcccagguccccggggaggagggcugggggcgucaggagggucggacccccuccccgccccccugggcgccccuccccggccgggggcggggccuuugucccgcacguggagcccgccgggccacuggacucggcacacccccuccccacccaccgcgcagcggccacgugggggccuggccggaagcgcccccagcccuccuccacgugggaggggggauaagacccuccgcuaggccggaugccgaaggcccuuggaagcuagggagccgucaccucaaacgauauccccggauguggaacgugcggcgcccccgugugcggcgggggaccuccaaccccauaucgccaacuuagagcccuuuccccaccacagaggcgugaaacaccgacccaaagccgccucccgcccacggcggcgcuccaagcgcucaccuccaugaugcaguucgcggccucggcugccgccaucuucacccgcaccuacuccuccuccggccgccaagacccccccuuucuccucacucccccgggaccgccuuauaccagaggguccacggcccgccuaccgcgaccccgcuggaagauuucauuggcaau

SEQ ID NO: 191763 - RNA, 8775 nt, Homo sapiens
uacuuuguaacguuuuuaauaagaaaaguuuuaaacaauuuauuuuuggcaaaaacagguagggcaaccaccaccccacagcccugaguggaauaggaagacuuggaaaagcacacgaagagggcagggacaugaggugucaucuuguagcagcuucugagaaagagcucaguccaauggcaaguucaaguccacgggugaaacagccaggaugcccuccuggaagggaaaaguggcagagcccugugagcagggcagguguuccccccauacagcagcguccacaucagcccugugagauuagagacgggaaggcgaggaaccagagagcggagggugacagacacccagacaaggggacagagacccagacagaagggcacagggaugagggggcaggguccuagcaggaggaggaaagguugagcucgaggagggucaggacacuggagugggauuagacagagauccagagagagugaagaguugggggacagagucagagauggggaagagagucuugggauuugaacaauucagagucguggcuuuguguacaaauccagauuccaacacucugcaugcuggggacuuuuccucucugcccccacaagacgaggacaauaagagccccaugagguuguaguggguuuaaaugggaucauuccauugaaaucccuagcagaggaccuggcccaccgagaaaacucaucugcuaucaauccuacuuuaaaaaaauuuuuuaagaaauuguccaggcgugguagcucagccuguaauuccagcacuuugggaggccgagguggguggaucacuugaggccaagaguucgagaccagccuggccaacagggcaaaaccccgucucugcuaaaacuacaaaauuagccggacaugguggugugcgccuguaaccccagcuacucaggaggcugaggcagggaaucgcuugaacccaggagguggagguugcagugagccaaggucgugccacugcacuccagucugggcaauagagugagacuccaucugaaaaauuaaaauaaaauaaaauaaacgagcuucuuugcugagcccaacacuuauauccauuccccucaacaugugcuaugaguucugaucuuacuguagaccggaccaccuccaguccugcuccccacccccaucgcccccauccccacaccuuccccaucucggggaacuuaagaugucgcccugcagcugcucgggccagcauccuuuagucuguccccacaucuggcccauuagccaaaucugucagcuucaccgcuaaguuaaauccagcauucuccaccgcccccgacuugggugagauccacucaccuccucccugugccccuacuucugcccucgcccccagcagucuguccccaggcagccgccagagggcgcccauuagcgccuaaaucagcgccugucccuccgcugcucagagaccuuggcuuacccagagucaaaguccgaguugucacucaccgugaccacaggguccuggcuggcccggcgccucuccuccucucaucugucgcccgcucacccuacuguagcccuacuggccuccuccucccugcuccucaaacacacuugaccagcuccugccagggaaaccgguuccauccagagccuggcuugugucccucucucagugaauacccacagcgaccccccaaggcagguaaaugagacggugcucacuggaccaguggggagagugccgcucagggagacugcgacagucgccaagccacagggccagcacgcuggagcccaauccaacucugaaaccggcacuggagauaaaguaagaaaaggagaggggaagacuucugggucuccugaagcugauguguuagaggugggagacaccaacaaagaaaaauaaaccagaagacaaguaaaacaagucaauuccaccaucuguuggaaggcccaaagugcuauggaaggaaaaguaaagcaggaagggggaaggagggcggugggagggugugcagguggcugugauugucaauggggaccugggaaggccucguugggggugaaaccagagcccaccagaaggagcaggacggaggcaggggguuccccgggagggcauccuggcaggcacuguuggaaaggcagcagguagccauauaaccucaccaacaaaaugccugcaugccaggcagugcacagagggcuuaccacauugaccccauuuuaacccucagagcgacccuuugagguagcacuacuacucucacuauuuuauuuuuugagacagggucccacucugucacccacacuggaguacaguggcgcaaucauagcucaccacagccuugaacuccugggcucaagugauccucccggcuccucugccuccugaguagcugggaguaaacgugugagcuaccaugcuuugcuaauuauuauuaauuuuaaaaauuuuuauuuauuuauuuuuugagacagagccccgcucuuguugcccaggcuggagugcaguggugcaaucucggcucacuacaaccucugccucccagguucaagcaauucucuugccucagccucccuagcugggauuacaggcaugccgggcuaauuuuguauuuuuaguagagacugaaugucaccauggucaggcuggucucaaacuccugaccucaagugauccacccaccucagucucccaaagugcugggauuacaggugugagccaccgcaccagguuuuuauuauauuauuuuguugagacacagucucacucugucgcccaggcuggagugcaguggcaugaucucagcucacugcaaucucugccucccagguucaagcgauucucaugccucagucuccucgguagcugggauuacaggcaccugccaccgcgcccggcuaauuuauguauuuuuuuuaguagacacaggguuucaccacguuggccagcuggucucaaacuccugaccucaggugauccaccugccucggccucccaaagugcugggauuacaggugugagccaccgcacccgacccuggcuaguuauuuucaauuuuuguagagauggggucuuacuauguuguccaggcuggucuugaacuccuggccucaaauaauucuccugccuuggccuccaaaagugcugggauuacaggcaugagcuaccccguccggccucucccugaguaaccucagucacugguuucacgcucacaguauuagcguacccagucguugacgccaggcauagugucugcacucaucgcugcaguccuggcauacagcaagggcucaacagaacgaacgcaguggagcugggagaauaccugaggucugagaggaaccuaagaaguccccgccccuccucuaucacaugacaguuagguaaagugaggcccggagagagaggcuucagcggcucacccagcccccgugggccuggauccagggcgugaagcugugcacgugcuccacgcugaguccggccagggugccccccagcccggccacgcgccggcucagcuccauggcuagggccaggcgggccaggggcuccggggaaggaggcgggggcccggggcaugcucggcuugggcgagagcugucaucccggcuacagaacagcuccaccaggcgggcgaaagagucggaggacaggcggaccagcuugcugcgcagggcgggguccgaggccagcuguaggguggaagaggcaggguccgcgucagcagcgcccccggggccagccaauagagggccgggaggcguggcuucccgguucaggaucguucuagaugcuaagguucuaggccaccccucauccauauuagccaaucaagccagacuccagggucucugccaaacuacccccgggauaguggccuggaacgugagucccuaagccaugccaggcccuugccucaacagccaaucagggccaaucucuacuguaacugaguuaaucuagccaugccccuggugaccuuucccaggggccaaccuagugucuacaacaaucuugcccucuaccauucaauuaauauuaaaggacgauguaccuuguccaagcuccgaagccaaucagauuccaggacacagccacaagccacaccuccucugguaguacauuuuccccuacauucuaagccaggucccuucuaugcucaguaagauuuuagccacuccccccacccccacauucauucacuuacuuccccagcuuggccagucucuuguggauaauguuucugauggccacacccucugcauuuaggccaugccccucuaaacaaucaauuaaaacaacuaauuuacgguacaguacuacccuaaccauaccccugucauucaacuauucuuuuuuuuuuuuuuuuuuaaagacagagucucacucugucacccaggcuggagugcaguggcgcaaucuuggcucacugcaaccuccaccuccugggcucaagcgauucuccugccucagccuucugaguagcugggauuacagaagcgcaccaccacaccuguccgauuuuuguauuuuuaguagagaugggguuucaccauguuggccaggcuggucucgaacuccugaccucaagucauccacccaacucggccucccaaagugcugggauuacaggcgugagccaccacacccggccucaacccuucauugaaaccuugucccagccucuuuccaccugaccauccaaagaaaauacagauccagcuucugaucccagugccccaccauuccgcaacuccuguccuugccaaggagugggacagaugcccaucaccuucugguuaaugacuucugccuccuccuccagcagggccaccagccuccgcaguauggcuuccuucucugucgaugggggacccuguaauucuggaggcagaagagaauuuggcugggggcagaacccugacuauccucccaccgccauccuucucuggggcuccucugugccucaccugggcugggcggagauuucagcugcucuuggaccagcuguuccagccgcugggccaccaaagcauagaagucuggaguagcugggccuggggugaaaagaguuaaugacagguuuccaggacauuggaaacuuacggauucucuccuucccccaacuaccuuggcagguggcaaugauucccauuuuauuuauuauuuauuuauguauugauuuugggaaacggagucucgcaauucuccugccucagccucaugaguagcugggacuacaggcgcacgccgccauaccuggcuaauuuuuuguauuuuaguagaaaugggguuucaccguguugcccaggcugaccucaggcaauccacccaccucagccucccaaagugcuaggauuacaggcgugagcaaccaagccuggccaugauucccauuuuauaaugggguaaacugaggcccagugagaaaacuugguuaaaaaugccaaaacccuuguacuuuucacuuuaugagauccucagacuggacuuagaaugucagagcuggggccaggcgcaguggcucacgccuguaaucccaucacuuugggaggcugaggcaggcagaucaccugagguugggaguucgagagcagccugaccaacauggagaaaccccaucucuacuaaaaauacaaaaaaaauuagccgggcaugguggcgcaugccuauaaucccagcuacuugggaggcugaggcaggagaauuacuugaacccgggagguagagguuguggugagccgagaucgggccauugcacuccagccugggcaacaagggcgaaacuccgucucaaaaaaaaaaaaaaaaaaaagaaugucagagcugacagggugcgguggcucacgucugcaaucucaacauuuugggaggccgacgugggagggucacuugaggccaggaguuugaggccagccuggccaacguggcgaaaccccgugucuacuaaaaguauaaaaaucagcuaguaugcuggcgugcaccuguaaucccagucacucgggaggcugaggcacgagaaucgcuugaacccaggagguggggauugcagugagucgagauugcaccccugcacuccagccugggugacagagcaacaaucugucuccaaaagacugucagagcucaacuagaccuugaagaugaucucauccaaggaaggcaaacacaagacauuacuguuaguauccccuucccucacucacuacagacaucaccaauugaucacagcacuuccucucccaagcugugaaccccuuuucaagcuagcacucccagcagccauuacuagucuguccagguucacaccuaugaggaaacuugugggucaccuugaucaaguccagugaccuccuccccaauuccuacucugcuauuggaaaaacaggggagcagggaagagaaagcauuuuccccagagucacgcaacuaaaacagccagggagaugugauugaaaaccagcccuucugccccucuaucagggguauuccuggcuacaaaaguccuaggggcagggaaguaguuauggaaggaaagagacaacaaccagauugaccaaaugcucucugaaagccaacccacagaauugacagaaaucuaacuggggaggggagaggacaggacgguucuguccugaaggcuggugcuagagacuccacacagccacccccuagcugagugaucuuaaacuagcaccuuaucccguguucugccggcuucauagaugaucauggaaaucucuuaccaggcucuaaaccauagcaggggcggaugggcagagagcaaggccgaggggacucagagggggcugcuccucgccccagggagcagggaagacaucuucgaaggcggcucaggaagucuguuggcucuucuugggcagggcuucuggagaggaggacuucagagacugaccccaccagagauccccugcaagcagucucuuuccccaacucccucccucccccgcugaggaccucucuccaaaaccccaaagacagagaauagagccagauauaaagagaggagacagacugagaccaggagcaagaguuaggagggagccucaaaugcuggccccugggggagaagggccacuccucuuaccuagguggaguuggaacaggagacccggcagccucaccacgccuaaggaaggcagcuaggacccucagcgugucuucccggagccccagcucuucagagccugccauggaggcaccugugagagagaggguuagggacuggacuccaaggguuuagcaagaaguggaggcuuggggaccaggacuugugagucccaaggaaggugcugagggccuggacuccuggguccuuuggagagugugggucugggggccuagacucuugaguccucagacgaaaaagcgaucaggaaaaagacucuucgauccaaggaaaggugguggggcugggugcccagauucgugggucuaaaggaggagggagcugggguccuggacuucugagucuuagagaaaaaggaacuggagccccagacccuuaggucucccaggaagaagaggcuuagcgccccaacuccuggauucuauaagaggcauaugccaaacuccugaaacccuuaaagcaucgggaacuaccaaucccaagagguuucagggcaaaucuuccccuagguccgcgcuucuucgccgcgcagccugcugugagguguaguuccaaaucuccgaccccugcuggaaucuagaggacccuggacccuuggauaucagagaagcgggacuggggugcccaccacuggaucccggcccccuccucuucccuccucaccccaccccucgucaacaccccgcugaccugguccggggccccaccgccgccuccuccacucaacuugcggucuccuccacugaacucguacaaacuuuauuaguucaacuuucccgcgccugcgcacugggccgggucgauaaccggcccagcguagaaagggcggaacgcugggugcacgcucaauuugcaugugacgcucccagcaugccucuggccggaaacccaaaaaagggcauaggggcgggaacagcccagcgggccgucccaucggcuuuugggucuguuacccaaagaaugauaaaguugguuuuauuucaagaagucgaucaaaaagaaagccccagcgcucuagagcucagcugacgggaaagggggugcgcagccucgaguuugagagcuacccggagcuccaagacagggguggguuccagcugcccgcacgccccgaccuuccaucguagguaacgcggaagagcccgggagagcguugguggcguccgagagcgaggagcgggaaagaggaugggucugcacggagaguggaaaggcaggcuguguacucuggggaaaguggagcaaggaaggagcuacaguggccgacgcuggaggucggcugcagaaaaacuagaaaaaguagggaggaaagaggaaaagaggaggcgucuacacugaggggguucuagagagggagggguggacuccguagauggggguaguucagucucgaaaccuggggcgugcucuguccuggaggagggaggcgggcagucggaggggaauugaauggaaguucuguguuggaaauguuuugggagaucuucuguagggggacuguggaagggggucuacauugggguaagugcaggagguagaggcuuacacgugaaucgauucugcacugaaauaacuagggaaagaggaugcuacccugaaaguggggauacuuacuu

SEQ ID NO: 191764 - RNA, 16016 nt, Homo sapiens
ucccggcgcuggcuuuuauugccuccuggcagagaggaggugucccaggccaggccaggcaggagagggcuggggccaggggaguuucagucuaugugguggaggcucagauuuggagcuggagggguuggggcgguucuuagagcugagcuuggggccaagggucccugggucugggcugggagacucagucagaaauagguauugcuuauccucugggacuaugacagccccucccugggguugggggugugacagggacagaagccgacccagggggucccugagagcccaggggcaggaggaugccugggacugcaucugccuccugcggggccuggacagggagggggccagaccacagcggccccuccuccggucauugugcgggccucugaggcuguggcaggugcgcggugcucacagcucaucguggugccgggucagguccucgccauaguugguggccugacugcccacaaacauguuccaauuacccaggauuuccgcuuugcucagccgcccauccuggagggagggucaggguucagaggggacaacacggcccugcuuucaaaagcccucccugcauccaagcgugucccgaagucucugggacccuuguucucugggccucugucccuuucucucugaaucuguccccgucuuggucccuguccuucucucuuugggucucugggucucugucccccucucuuucuggggcuccgugcccucucuuuuccucccucucucugucccucuuuuuuuaucccaccuaaaagggacccugagcuccaggcccaggucuugcuccuuucuggagucuggcccgcaaugcccacccgcuccucgcuccugccgaggccccgucacugcaccuuguccgugucgcucucgugcagcaggugguuggcuuccaccaggggcugguccugggcagggggcagcacccaguggcccaccucacucccauccaggugcccauccuuguucagaucccggaagucccggaacugcugccucuccgucugcacccacgccggcuccuccuccccaggcucggcugaguacagauccgcugggggccgggacagaggggacaaggucaggggcagcucugggggucuaguggagcugggggcugauccuggcucugauacuuccugaaccaggcccuugagcaacucacuacccucucucucgccucagcguccucuucuguuucgauggaauuaguaacaaaaccugacuuauaagcaaucauuuguguuacaggugaaauucauuugauugguugauugcaugauugauugauuucauugacacacacgugaaguagugugugcaaugggcaaggcagugccuggcacauaguaagcaaugucuaugcaggaggaacgugcgaggauguuucuggccaguuagcaggugacagagaugccaggugcagugaugacuguaauccaacacuuugggagacccaggcaggagggucauuugaggccaagauucaagaccaaccugggcaacauagcaagacccuguuucuacaaauuuuuuuuuuuuuuuuugagauggagucucgcugugauuaccccacugcacuccagccugggcaacagggcaagaccccacccccuuuuuuuuuuuaagauggaguuucgcucuuguugcccaggcuguagugcaauggcgcaaucucagcucacugcaaccucugccucccagguucaagcgauucuccugccucagccucccaaguagcugggauuacaggugcgugccaccacacccagcuaauuuuuauauuuuuaguagaggcgggguuucaccaucuuggccaggcugcucucaaacuccugaccccaugauccaccugccucagucucccaaagugcugggauuacaggcuggagugcagugacacaaucucagcucacugcaaccugcaccuucuggguucaagugauucuccugccucagccucccaaguagcugggauuacagguacccgccaccacgcccagcuaauuuuucuaguuuuaguagagacaggguuucaucauguuggccaggcuggucuugaacucuugaccucaagugauccacccaccuuggccuccuaaagugcugggaauacaggcgugagccauggcacccaccccaauuuuauacauuuugauauguuacugguuggggaggaguuaagaaauaggugccagagcccaaacaccaagguucaaauccuagcccugccucuucccauugucuucagcagaucccuucaaccccccugggccucaggugucaucuauauaauggaggauagugacagugucugccugguagagcugaggaauggaagaugaagucuuaaugggaugaaguaauugagaagauaggcugggugcggugguucgcgccuguaaucccagcacuuugggaggccgaggcagguggauaaccugaggucaagaguucaagaccagccugaccaaaauggugaaaccccgucucuacuaaaaauacaaaauuagccaggcgugguagugcacgcccauaaucccaccuacucaggaggcugaaacaagagaauugcuugaaccugggaggcggagguugcagugagccgagaucaugccacugcacuccagccugggcgacaauagcgagacucugucucaaaaaaaaaaaaaaagagauggggacagcugcuggcaucuggggccugugaccuccuuguugucagggccuguccugugcaccggagaaugcuaaggagcaucucugggcucuauccaggagacgucaguagcauccucaccccucuagaagugacaaccagaaguaucuccagaggccgcacugugccuggagucucagcuacuugggaggcugaggugggaggaucccuugagcccaggaggucaaggcugcagugagccaagaucaccccacugcacuccagccugggcgacagggcaagaccccaucuuuuuuuuuuuuuuuuaagauggaguuucgcucuuguugcccagacugaagugcaauggcgcgauuacagcucacugcaaccuuugccucccggguuccagagauucucuugccucaguccccagaguaacugggauuacaggcuccugccaacaggcccggcuaauuuuuguauuuuuaguacaccaucuuggccaggcuggucucgaacuccugacuucaugauccauccaucucagccucccaaagugcugggauuacagguaugagccacugcgccuggcccaaccccaucucuuaagaaaaaaauauaaaaauguucucucagccagguguggugauucaugccuguaaucucagcucuuugggaggccaaggugggaagauugcuugagcccaggaguucuagaccagccuggacaauauagugagaacccaucucuauuuaauaaagagagagacacacacacacacagacagacagauagaaagaaagagugacagaaagaaagaaagugagagaaggaaagaaagaaaaauguuuucucauguaggauguggucagaaaaaaauaaaagaauaaacaauguuuucaaacuuaaaaaaaaauuccuggccgggcgugguugcucacgccuguaaucccaccacuuugggaggccaagaugagcagaucaccugagguugggaguucuagaccagccuggccaacauggugaaaucccaucuccacuaaaaauacaaaaauuagccaggcgugguggcaggcaccaguaaucccagcuacucaggaggcugaggcagaagaaucucuugagcccgggaggcggagguugcagagagccgauaccacgccaccgcgcuccagccugagcaacagaaaaaaacugucucaaaaaaaaaaaaaaaaaaaaaaaauuccuuguuagcguucuccuugacuaaauuuuuugcccgcuaggggcagggacaguggcaggggcccagggagaacucagaacucaggggguauugugaggaucccccaacaucccauguaacaggaaacaguguuugcugugcaggcgcagguucaagaccagcuuccugacccccauucucaacuaaacauagccccugagccuugauuuuguagaaacuccagacccccaagaagggauuugucuguguuauugucugcuguaggcgcaaccacccauaugcaguaggugcucaguaaguguauccugggcgugacacacagcaggugcucaauagaugcuuuuugugucugguauagaguaggugcucaauaaauguuggguggcuaaaugaacucaagcagugagugccccugcccccaugucugagggccacuguucucugaugaugggugauguaccuccggcuacccccaccaacccugcccaugccugagagaggacaggcaucccaagaagaaauuggggcccacucaccgauguacuccuccaccuggacauagccaucuuuguuucuguccagguccuccaggguuuccuggaggagaaaggggcauugaggcugggggccgaugacccuggcuccugggggaggcuggaccccugggguaagagugagagguucucuuggaaauuuagcuccgggcagcugugggaggcaggcaguagagcagucucaacagguggcaugugggaaauuugcgggcuuucugggauguuaucaucaaacaggcaccaccugcauuuacggggccagagcccagaggcccuaauguccagcagugcacagguuuguugcucacaaggggagcuguccugggucccuaauaacuugcucaagccccagcaaacacccuccaaggggagaagcuccuuuauguuuagcagagccuagaaccuaccucugcuuuaugugugaacauggugcacuuuggggcuucuucugacacacuggacaccuccgcuccuuguuuuugugcccuucuggagcaaaacgacuuuuguuccccaauuuauauccaaacucauucacuauaagacugugggcugggcacgguggcucacaccuguaaucccagcacuuugggaggccgaggcgggaggaucgauugagcccaggauuuugagacuagccugggcaacauggcgagacccugucucuacacaaaauuuaaaaauuagccaggcauggccgggcgugguggcucacaacuguaaucccagcacuuuggaaggccgagguggguggaucacgaggucaggagaucgagaccauccuggcuaacacagugaaaccccgucucuacuaaaaaaaaaaaaaaaaaaauuagccgggcauggcggcaugcgccuguagucccagccacucgggaggcugaggcagaagaauggagugaacccgggaggcagagcuugcagugagccgagaucgcaucacugcacuccagcaugggcgacagagcgagacuccgucugaaaaaaaaaaaaaaaaaaacauuagccagacaugguggcuugugccugguggccucagcuucucagaaggcggaggugggaggauuacuugagcccaagaguuugagguugcagugagcugagauugagccacugcccuccggucuggguaacagaguuaggcccugucucaaaaacuaaaaaaaaaaaagaggaaggaaagaaaaaaaaagccuucuucuauagaacaaagcacauuuuggggccaggcacgguggcucaugccuguaaucccagcacuuugggaggccaaggugggcagaucaccugagguccggaguucaagaccagccuggccaacauggugaaaucccaucucuacuagaaaaaaaaauuaaaaauuggccgggcacgguggcucaugccuauaauccuagcacuuugggaggcugaggcgggcggaucaccugaggucaaaaguuugagaccagccuaaccaacaugaagaaacccugucucuacuaaaaauuagccaggugugguggugcgccccuguaaucccagcuacucgggacgcugaggcaggagaauugcuugaacccgggaggcggagguugcagugagcugagaucgcaccacugcuuuccagccugggcaaccgagggagacuaugucucaaaaaaaaaaaagaaagaaaagaaauuguauaagguggggcacaguggcugucugagggaaggcugggggccuggaccccaaaugcgagcacagggaggggaaggccagacgaggagagaucagaccccaggggacugagaguggaggugggaaaggucaccguccucugaccuguguuugcggccuggcuuccccggcaagaugcuggagaaccaggugacugccugcccccaggucggugcugggaagcaggaccugaaccggaagccuggguccccggaagggugugggggacaggguuccccagccgccacucacagcaaucacgaugucccgcaugugagggaacuccucggggugcaggaaggcugucagcuccucucgaguggccaucgaguccccauccuggucggccacccggaaacgccgcucgucccgagccagcaucuuuuuguaggucucugcauccuccacgucaugaaauucuucaccuggggaaggacaggucucagugagaugagcuuuaauggaggaaacgccaagcagguuaaaacaaagacaaaguaaauccuacugggguacaaagauuucuguggaguuaauaaguauauaucaguaggcuggaugcaguggcucacgccuguaauagcagcacuuugggaggcugaagcuggcagaucacuugaggucaggaguuugagaccagccuggccaacauggcgaaaccccaucucuaccaaaaaaauacuuagccgggcaugguggggcacgccuguaaucccagcuacucgggagucugaggcacaagagucgauugaacccaggaagcggagguugccgugagcugagacugcaccacugcuuuccagccugggcgacagagggaggcuaugucucaaaaaaaaaaaaaaaaaaauuuuagaagccuggcacaguggcucacaccuguaaucccagcacuuugggaggccgagguggguggaucgccugaggucaggaguucgagaccagccuggucaacauggugaaacuccuucucuacuaaaaauacaaaaauuugccuggcaugguggugggcgccuguaguccuagcuacucgugaggcugaggcaggagaauugcuugaacccaggaggaugagguuguaguaagccgagaccuugccauugcacugcagccuggccaacaagagugaaacuccauuccaucucaaaaaaaaaaaaaaaaaaaaaaaaguaggccgggugcgguggcucaaaccuguaaucacagcacuuugggaggccgaggugggcagaucaccugagguugggaguucgagaccagccugaccaacauggagaaaccccaucucuacuaaaaauacaaaauuagccaggcgugguggcgcaugccuguaaucccagcuacuugggaggcugaggcaggaaaaucgcuugaacccgggaggcggagguugcagugagccgagaccacgccacugcacuccagccugggcaacaagagcaaaacucccucacaaaaaaaaaaaagcauauauugauacuuuauauauaauuuguauauauauuuaaguauauaauauguuauauaacauauuauuaguauguguguguauaucuauaucuaucuaucuaucuaucuaucuauauauauauauauuuuuuuuuuuuugagacagagucucacucugucgccaaggccagagugcagugaugugaucucggcucacugcaacuucugccuccuggguucaagugauucucuugccucacccuccagaguagcugugaucacaggugcacaccaucacgcccagcuaaguauuuuuuugugguaagacgggguuuugccacauuggccaggcuggucucuaacuucugaucucacgugauccacccaccucggccucccaaagugcugggauuacaggcgugagccauggcacccaggcuauguaacauauuauauccacccaauaaauuagcuaacuugugagagauuauaugcuaagcucuuuaugcacaauauugcauuuaaucaucacaaaaaagcacauacaguggguuuuuccauguauucuacuuucugaaugcaaaaauugauucucagagagaagaaauaacugauccaagcguguggagacaggaauggcccacuaugaguugacagugggccuuuuggccccagacuaaggcugugaugggguagcuuacagggacugagauggcuugacugagaggaggggacgggcauuguaacuggagggaacaauaugggcagaagguagagguuugaagaguguggugaguucaggaaaaccacagaaaauccauuuggugcagaaaaugcagaaaaacaaagccacaggaggaaacgucccggcuggggagugggaccgucuccugggggcccaggagggggagggaggggcagagucagugcugggcaugaagaaccccgcccccggagcccuguggaggacagacuggacggggaggcuggggccagggacagagaggagaggagggagagaaugagggcuguguguguggcaggguguggggcacugaggcugggacuugggacagaaaggagggaucugagagucaggggcugaguaacuggcuuugggguucucaggaugagaggucacagaaguuaggggucaggaugacaaggcauggaaaguagguguccuuggccagggaucucaaguacccuagucauauugucacagagguggugagucccagaaugaaagcccugaagggaaccuggguagcuuaguugguagagcauuggacuuuuaauuugagggcccagguuucaagucccuguuugggugcguucaguggcuuuuagcaccuaauugugacuucauguuugaaaaaaagaucguuuuuagcaugcagcuaaauaccagaaaaauaagcagacgaaaaacaaaaaagagaagccagaggugagaaacugaagaucucacaguuaugggcuccuaaaaguggguagagccugguuaggggccagggacuccggguaaauggguucaggguucucagaaugaggcgguccagaaggucagggucacgguguauggggagcagggucgggggcucgccgcguaccgggcgcguaguggccauagguggcguugcgcagcuccucccaacccacacgcccgucgcgguccgugucguacgugucccaggccgcgcucaccgagucccguaugugccgcugcugcgugugcgcgauccacgcgcgaagcucggccagcgacacccagccgucgccgucccccgcgcgguccaugcgguccacgauccgccuagaagccggggcgggcacacgucaggcucuggucccgcccccaggccccgccccucgcacgggccacgcccccugggacacuucggauccggggcugaaaauacaguccacgguccgcgggcuaacuggggaggggcgcgggucaauuucgggaccaagcccaccggaggacccuaccccucagccuaggguccacccccaggucgagucacgcccuucuccagaacgagcgggccugcugggagcacugcgggggagggaccuacuacgaugcagggccacccucuccgcgccggccccgcccucggccugcacgugcugcaccucucgcugggccgagcugggguggugaaggggagcgcggcgucgcacugugacccuugccaagggggcccuguugcaagauugacucugaacccagacagccacggccacacccccgaucccccgcugucucaggccccgacccgccccaugccccucccccuuaccaggcugcgcgugucaauuucaggcuccucucccuccagcccugcccugugcugagccccguggcuuuccccugccugcucccggcugaaucaggcacugccugaggaccaucacccgcaaccccgggggcucagucucccucugccccuccccaugcuccuccgggcuccugugccccucccugucgcaugucaagccacuuuagguuccaucucuccccuucucuugggccacgccuaucagcucucgggccccucuccucucccuuggugacgccuugccaggccgguccucucccaaucucuaauuaacagagacuaccuggagcccuccucccugucaccgucccuaggcccccgcggcccccucccuaaagucgaaaauccgagacagcagagcccucuccaggccugccugagucaccgccccaccucccgcaccaggcggucucugcuccagucugucuagggccccacucuguccccggaaucacacccuucucugagguuccugguguuguuaagcgcuugggcuccacagccagacauuuuagguccaaauccagccacuuccucuuacuggcugugugacugugggcaagugacuuaaccucucugugucucaguuaccccucuguaaaacggaggaagaaaaaacgguaccuaccccaaaagggcgguuguggggaauaaaugaguuaggccauguaaagcacuuaggacaggacaggcgcgguggcucacgccuguaaucccagcacuuugggaagccaagacaggcgaaucacuugagaucagacguuccagaccagccugguccacauggugaaaccuugucucuacuaaaaauacaaaaauuagcagggcaugguggcacgcaccugaaaucccagcuacucuggaggcugacgcgggagaauugguugaaucugggagguggagguugcagugagccgagauaguaccacugcacuccagccugggcaacagagcgagacuccgucucaaauaauaauaacaauaauaggccgggcacgguggcucacgccuguaaucccagcacuuugggaggccgaagugggcagaucaccugaggugaggaguuccagaccagccuggccaacauggugaaaccgucucuacuaaaaauacaaaaaguagccgggcacagugguggaugccuguaauauccacuacucgggaggcugaggcaggagaauugcuugaacccaggaggcguagguugcagugagccgagaucgugccacugcacuccagccugggcaacagaguaagaccuugucucaaaaacaaacaaacaaacaaaaaacacuuuggaggccgaggagggcggaucacaaggucaggagaucgagaccauccuggcuaacauggugaaaccccgucucuacuaaaaauacaaaaaauuagccgggcgugguggcaggugccuguagucccagcuacucgggaggcugaggcaggagaauggcgugaaccugggaggcgcagcuugcagugagccgagaucgcgccguugcacuccagccuggaugacagagugagacucugucucaaaaaaaaaaaaaaaaaaaaaaaggccaggcgccauggcucacgccuguaaucccagugcuuugggaggccgagguggguggaucacgaggucagcagaucuagaccauccuggcuaacacggcgaaaccccgucucuacuaaaaauacaaaaaaauuagcugggcgugguggugggcgccuguagucccagcuacucgggaggcugaggcaggagaauggcaugaacccgggagguggagcuugcagugagccgagaucacgccacugcacuccagacugggagacagagcgagacugcgucucaaaauaauaauaauaauaacaauaauaaagcacuuaggacaaugccuggcauugccauuagugcuaagcuaaaugugcuaaccugucacugcccuucuuccuccauuucuccuucaugcaugcccauccaagcacaaucucccagccagcaguccuggggaccacugccacugucuccacccugaucugaccaccaucuugucuugucuuccaccuggacuaucgcagucgcuuccucacugggcucccugcuucuugcucccuacagucuguuccccaccucgcagccagcaggauucucucaaaaccuaagucagcucaugcccucccucaguucuacucucaauuggagaaaagccuaaaucuucaucguggccuaaaaggcuuugcauugcaugaucugacccccuuugcauggucucaggcaauccgcccgcuuuggacucccaaagugcugggauugcaggcgugagccacugcaccuggcccucucucuuuuugagacaaagucuugcucuguugcuuaggcuggagugcagcggcaugauuuuggcucacugcagccuugaccucccaggcccaagugauccucccuccucagccucccuaguaucugggacuacaggagcacgccaccaugcugggcuaauuuuuguauuuguuuuguagaggcgggguaucacuauguugcccaggcuggucuugaacuccugggcucaagugaucccccagccuuggccucccaaagugcugggaucacacacaugaaccaccaugcugaaccccuuugcuccuucucugcccucaccucccacucucuccccuuucucacugaguuccagccacacgggccucagaacuguugcucugacacuccaagcccacuccugccucagggccuuugcacuuaacuguucugucugccuggaaugcuauucacuccgauacccacauggcucaaauaccacauaccaccuucucauggaggccuuguccaaguucccuguuuaaaauugcagcuccagccgggugcgguggcucaugccuauaaucccagcacuucgggaggccgaggugggcagaucaccugaggucaggaggucgauaccagccugaccaacauggagaaaccccaucucuacuaaaaauacaaaauuagccgggcaugguggugcaugccuguaaucccagcuacucggaaggcugaggcaggagaaucacuugaacccaggaggcggagguuguggugagccgagauugcgccacugcacuccagccugggcaacaagagcaaaacuccgucucaaaaaaaaaaaaaaaagaaaaaaaagaaaaauuaccugggccugggcugggugcuguggcucacgcauuaauuccagcacuuugggaggccaaggcgggcggauugccugagcucaggagcucgagaccagccugggcaacacagugaaaccccaucucuacuaaaauacaaaaaaaaaaaaaaaaauuagcugggcgugugggcgugcacccauagucccagcuacucggaaggcugaggcaggagaauugcuugaaccugggaggcagagguugcaugagcugagaucacgccacugcacucuagcccgggagacagagucucacucugucuccaaaaaaaaaaaaggaaagaaaaaaaacuuugcuggauguggaggcguucacuuguagcuaggacuuguagcguucacuuguagcuaggacucuagcuacuagggaguacgaggcagaacaacugguugaacccgggaggcggagguuccacugagccgagaucacgucacugcacuccagccugggugacagagcgagacuccaucucaaaaacaacaacaacaaaaauaaaaauaaaaaauaaaaauacaaaauuagcugggcgugguggcuagcgccuguaaucccagcuacuugggaggcugagacaggacaauugcuugagcccaggagguggagguugcagugagccgagaucgcaccacugcacuccagccugggugacagagcgagacuccaucucaauaaguaaauaaauaaauaaauaaauaaauaaaaauugcaacucccccccaccaacaaccucuccccuccacacuuucugacucucuugcuuuaucuuucuuggaugcauuuaucucuauuugauccacuuucuacuuauugacuucuugcuguuucccucaccacaguguaaacuucaggaggacagauguguuagcuguugugacuucagcaccuagagcagugccuggcacauagcaggugcucgauaaaccuuugcaggcucaaucagugucaggaggaugcacagaagaaggcggcugcucccaucgcgccccccugcgcucaggccuggacggagaggguggacagggcuccauuccacccagcucacccugaaacucagggcucugccacucuccugcacuggccgggcuccuuaaaggccaaaccucauuuuccacaccagucccugccauuuacagagcaggaaacugaggcuuggggaggggagaugucugggacaaaagaauaaggagcgcuuagggggcagaaucuaacccagauuuugcugcccucaaagguccucuuuuuuauuguuguuguuguuuuuuagacggagucucacuuugucgcccugacuggagggcaguggugcaauuuuggcucacugcaaccuccaccucccagguucaagcgauucuccugccucagccucccgaguagcugggauuacaggugcccaccaccacgccugccuaauuuuguauuuuuaguagagacgggauuucaccauguuggccaggcuguucucgaacuccugaccucaagugaucggccugccuuggccucccaaagugcugggauuacaggcaugagccaccacgcccggucucaaagguccucuuuaggccucaauuuuaacuuaauuucuuuuucccaaggauagaagguagaauuucauuucucacaaagaaaugaaguucaguccacgccauuucucugaccccugucgauacccccgcgucucucuccuaagccccaccucuggacacgccccaaccgaaugucucucuuaccccagacgggccuggcuuuccucuggggugaguuggucgaauuccuuggccacuucccgucccaggaaagccucauggucguacuggaaguucccgugggcgucaucauggggagcgucgcucaggggggccgccuggugcacccuccccuggccaugagggccugcgucuggggauggcuuccccugggccccgugccucaguagcaacagaagcagcagaacugauggucgccacaucaucggucccuggggaguggcaaaggccaggggucaggggucacagggauggggacagacacgggauaggagaauggcgggguggagggguuaccuaggacaggacagggaguuggaaguuggcugcaagcuuucgggcucaaaaagggcgggcgaugggggaaaagagggcgggaugcuuagagguaaagccaccuauggggaggaccgaaucuucugacggagucucaggggggucccagaccugccagggggaauuacagagacagacguggcgcacaucccacgcaaggugcagggcauaguuguggccagcgagaggucaggcaggcuccccgucauugcucccaguccggacccugguccucgacccgagccgcccucccuggacagaggccccccacccacucccuuuacccuguuauccagcuucgcuccgcucuccacgcuccgcucugcguucccgcaaaugugcccaauucggccgcucuccagucaggccccgccucuggcagcgcagagccccgccccccgcccaaugagcucgcacgagcgucucacggggcggggccaaugagugcacggggugccgcgggcacuccucgccacguccacaaaggaaaccgcggccugcccggggaagaagggugggcgacaccgcagugacgcggccggggagaacuacaacuccuggcagucgucgcggcacucugccguccaccuccagcuguucuagucacaacgccucacgggaaauguauuuuucccuuucccuuugucaggaugguuuaagaaagagguguacguuccaacacuucuauaccaaacaaaacaaaacaaaacaaaaauaaacaaaaa

SEQ ID NO: 191765 - RNA, 16016 nt, Homo sapiens
uuuuuguuuauuuuuguuuuguuuuguuuuguuugguauagaaguguuggaacguacaccucuuucuuaaaccauccugacaaagggaaagggaaaaauacauuucccgugaggcguugugacuagaacagcuggagguggacggcagagugccgcgacgacugccaggaguuguaguucuccccggccgcgucacugcggugucgcccacccuucuuccccgggcaggccgcgguuuccuuuguggacguggcgaggagugcccgcggcaccccgugcacucauuggccccgccccgugagacgcucgugcgagcucauugggcggggggcggggcucugcgcugccagaggcggggccugacuggagagcggccgaauugggcacauuugcgggaacgcagagcggagcguggagagcggagcgaagcuggauaacaggguaaagggaguggguggggggccucuguccagggagggcggcucgggucgaggaccaggguccggacugggagcaaugacggggagccugccugaccucucgcuggccacaacuaugcccugcaccuugcgugggaugugcgccacgucugucucuguaauucccccuggcaggucugggaccccccugagacuccgucagaagauucgguccuccccauagguggcuuuaccucuaagcaucccgcccucuuuucccccaucgcccgcccuuuuugagcccgaaagcuugcagccaacuuccaacucccuguccuguccuagguaaccccuccaccccgccauucuccuaucccgugucuguccccaucccugugaccccugaccccuggccuuugccacuccccagggaccgaugauguggcgaccaucaguucugcugcuucuguugcuacugaggcacggggcccaggggaagccauccccagacgcaggcccucauggccaggggagggugcaccaggcggccccccugagcgacgcuccccaugaugacgcccacgggaacuuccaguacgaccaugaggcuuuccugggacgggaaguggccaaggaauucgaccaacucaccccagaggaaagccaggcccgucugggguaagagagacauucgguuggggcguguccagagguggggcuuaggagagagacgcggggguaucgacaggggucagagaaauggcguggacugaacuucauuucuuugugagaaaugaaauucuaccuucuauccuugggaaaaagaaauuaaguuaaaauugaggccuaaagaggaccuuugagaccgggcgugguggcucaugccuguaaucccagcacuuugggaggccaaggcaggccgaucacuugaggucaggaguucgagaacagccuggccaacauggugaaaucccgucucuacuaaaaauacaaaauuaggcaggcgugguggugggcaccuguaaucccagcuacucgggaggcugaggcaggagaaucgcuugaaccugggagguggagguugcagugagccaaaauugcaccacugcccuccagucagggcgacaaagugagacuccgucuaaaaaacaacaacaacaauaaaaaagaggaccuuugagggcagcaaaaucuggguuagauucugcccccuaagcgcuccuuauucuuuugucccagacaucuccccuccccaagccucaguuuccugcucuguaaauggcagggacugguguggaaaaugagguuuggccuuuaaggagcccggccagugcaggagaguggcagagcccugaguuucagggugagcuggguggaauggagcccuguccacccucuccguccaggccugagcgcaggggggcgcgaugggagcagccgccuucuucugugcauccuccugacacugauugagccugcaaagguuuaucgagcaccugcuaugugccaggcacugcucuaggugcugaagucacaacagcuaacacaucuguccuccugaaguuuacacuguggugagggaaacagcaagaagucaauaaguagaaaguggaucaaauagagauaaaugcauccaagaaagauaaagcaagagagucagaaaguguggaggggagagguuguuggugggggggaguugcaauuuuuauuuauuuauuuauuuauuuauuuacuuauugagauggagucucgcucugucacccaggcuggagugcaguggugcgaucucggcucacugcaaccuccaccuccugggcucaagcaauuguccugucucagccucccaaguagcugggauuacaggcgcuagccaccacgcccagcuaauuuuguauuuuuauuuuuuauuuuuauuuuuguuguuguuguuuuugagauggagucucgcucugucacccaggcuggagugcagugacgugaucucggcucaguggaaccuccgccucccggguucaaccaguuguucugccucguacucccuaguagcuagaguccuagcuacaagugaacgcuacaaguccuagcuacaagugaacgccuccacauccagcaaaguuuuuuuucuuuccuuuuuuuuuuuuggagacagagugagacucugucucccgggcuagagugcaguggcgugaucucagcucaugcaaccucugccucccagguucaagcaauucuccugccucagccuuccgaguagcugggacuaugggugcacgcccacacgcccagcuaauuuuuuuuuuuuuuuuuguauuuuaguagagaugggguuucacuguguugcccaggcuggucucgagcuccugagcucaggcaauccgcccgccuuggccucccaaagugcuggaauuaaugcgugagccacagcacccagcccaggcccagguaauuuuucuuuuuuuucuuuuuuuuuuuuuuuugagacggaguuuugcucuuguugcccaggcuggagugcaguggcgcaaucucggcucaccacaaccuccgccuccuggguucaagugauucuccugccucagccuuccgaguagcugggauuacaggcaugcaccaccaugcccggcuaauuuuguauuuuuaguagagaugggguuucuccauguuggucaggcugguaucgaccuccugaccucaggugaucugcccaccucggccucccgaagugcugggauuauaggcaugagccaccgcacccggcuggagcugcaauuuuaaacagggaacuuggacaaggccuccaugagaaggugguaugugguauuugagccauguggguaucggagugaauagcauuccaggcagacagaacaguuaagugcaaaggcccugaggcaggagugggcuuggagugucagagcaacaguucugaggcccguguggcuggaacucagugagaaaggggagagagugggaggugagggcagagaaggagcaaagggguucagcauggugguucaugugugugaucccagcacuuugggaggccaaggcugggggaucacuugagcccaggaguucaagaccagccugggcaacauagugauaccccgccucuacaaaacaaauacaaaaauuagcccagcaugguggcgugcuccuguagucccagauacuagggaggcugaggagggaggaucacuugggccugggaggucaaggcugcagugagccaaaaucaugccgcugcacuccagccuaagcaacagagcaagacuuugucucaaaaagagagagggccaggugcaguggcucacgccugcaaucccagcacuuugggaguccaaagcgggcggauugccugagaccaugcaaagggggucagaucaugcaaugcaaagccuuuuaggccacgaugaagauuuaggcuuuucuccaauugagaguagaacugagggagggcaugagcugacuuagguuuugagagaauccugcuggcugcgagguggggaacagacuguagggagcaagaagcagggagcccagugaggaagcgacugcgauaguccagguggaagacaagacaagaugguggucagaucaggguggagacaguggcagugguccccaggacugcuggcugggagauugugcuuggaugggcaugcaugaaggagaaauggaggaagaagggcagugacagguuagcacauuuagcuuagcacuaauggcaaugccaggcauuguccuaagugcuuuauuauuguuauuauuauuauuauuuugagacgcagucucgcucugucucccagucuggagugcaguggcgugaucucggcucacugcaagcuccaccucccggguucaugccauucuccugccucagccucccgaguagcugggacuacaggcgcccaccaccacgcccagcuaauuuuuuuguauuuuuaguagagacgggguuucgccguguuagccaggauggucuagaucugcugaccucgugauccacccaccucggccucccaaagcacugggauuacaggcgugagccauggcgccuggccuuuuuuuuuuuuuuuuuuuuuuugagacagagucucacucugucauccaggcuggagugcaacggcgcgaucucggcucacugcaagcugcgccucccagguucacgccauucuccugccucagccucccgaguagcugggacuacaggcaccugccaccacgcccggcuaauuuuuuguauuuuuaguagagacgggguuucaccauguuagccaggauggucucgaucuccugaccuugugauccgcccuccucggccuccaaaguguuuuuuguuuguuuguuuguuuuugagacaaggucuuacucuguugcccaggcuggagugcaguggcacgaucucggcucacugcaaccuacgccuccuggguucaagcaauucuccugccucagccucccgaguaguggauauuacaggcauccaccacugugcccggcuacuuuuuguauuuuuaguagagacgguuucaccauguuggccaggcuggucuggaacuccucaccucaggugaucugcccacuucggccucccaaagugcugggauuacaggcgugagccaccgugcccggccuauuauuguuauuauuauuugagacggagucucgcucuguugcccaggcuggagugcagugguacuaucucggcucacugcaaccuccaccucccagauucaaccaauucucccgcgucagccuccagaguagcugggauuucaggugcgugccaccaugcccugcuaauuuuuguauuuuuaguagagacaagguuucaccauguggaccaggcuggucuggaacgucugaucucaagugauucgccugucuuggcuucccaaagugcugggauuacaggcgugagccaccgcgccuguccuguccuaagugcuuuacauggccuaacucauuuauuccccacaaccgcccuuuugggguagguaccguuuuuucuuccuccguuuuacagagggguaacugagacacagagagguuaagucacuugcccacagucacacagccaguaagaggaaguggcuggauuuggaccuaaaaugucuggcuguggagcccaagcgcuuaacaacaccaggaaccucagagaagggugugauuccggggacagaguggggcccuagacagacuggagcagagaccgccuggugcgggagguggggcggugacucaggcaggccuggagagggcucugcugucucggauuuucgacuuuagggagggggccgcgggggccuagggacggugacagggaggagggcuccagguagucucuguuaauuagagauugggagaggaccggccuggcaaggcgucaccaagggagaggagaggggcccgagagcugauaggcguggcccaagagaaggggagagauggaaccuaaaguggcuugacaugcgacagggaggggcacaggagcccggaggagcauggggaggggcagagggagacugagcccccgggguugcgggugaugguccucaggcagugccugauucagccgggagcaggcaggggaaagccacggggcucagcacagggcagggcuggagggagaggagccugaaauugacacgcgcagccugguaagggggaggggcauggggcgggucggggccugagacagcgggggaucggggguguggccguggcugucuggguucagagucaaucuugcaacagggcccccuuggcaagggucacagugcgacgccgcgcuccccuucaccaccccagcucggcccagcgagaggugcagcacgugcaggccgagggcggggccggcgcggagaggguggcccugcaucguaguaggucccucccccgcagugcucccagcaggcccgcucguucuggagaagggcgugacucgaccuggggguggacccuaggcugagggguaggguccuccggugggcuuggucccgaaauugacccgcgccccuccccaguuagcccgcggaccguggacuguauuuucagccccggauccgaagugucccagggggcguggcccgugcgaggggcggggccugggggcgggaccagagccugacgugugcccgccccggcuucuaggcggaucguggaccgcauggaccgcgcgggggacggcgacggcugggugucgcuggccgagcuucgcgcguggaucgcgcacacgcagcagcggcacauacgggacucggugagcgcggccugggacacguacgacacggaccgcgacgggcguguggguugggaggagcugcgcaacgccaccuauggccacuacgcgcccgguacgcggcgagcccccgacccugcuccccauacaccgugacccugaccuucuggaccgccucauucugagaacccugaacccauuuacccggagucccuggccccuaaccaggcucuacccacuuuuaggagcccauaacugugagaucuucaguuucucaccucuggcuucucuuuuuuguuuuucgucugcuuauuuuucugguauuuagcugcaugcuaaaaacgaucuuuuuuucaaacaugaagucacaauuaggugcuaaaagccacugaacgcacccaaacagggacuugaaaccugggcccucaaauuaaaaguccaaugcucuaccaacuaagcuacccagguucccuucagggcuuucauucugggacucaccaccucugugacaauaugacuaggguacuugagaucccuggccaaggacaccuacuuuccaugccuugucauccugaccccuaacuucugugaccucucauccugagaaccccaaagccaguuacucagccccugacucucagaucccuccuuucugucccaagucccagccucagugccccacacccugccacacacacagcccucauucucucccuccucuccucucugucccuggccccagccuccccguccagucuguccuccacagggcuccgggggcgggguucuucaugcccagcacugacucugccccucccucccccuccugggcccccaggagacggucccacuccccagccgggacguuuccuccuguggcuuuguuuuucugcauuuucugcaccaaauggauuuucugugguuuuccugaacucaccacacucuucaaaccucuaccuucugcccauauuguucccuccaguuacaaugcccguccccuccucucagucaagccaucucagucccuguaagcuaccccaucacagccuuagucuggggccaaaaggcccacugucaacucauagugggccauuccugucuccacacgcuuggaucaguuauuucuucucucugagaaucaauuuuugcauucagaaaguagaauacauggaaaaacccacuguaugugcuuuuuugugaugauuaaaugcaauauugugcauaaagagcuuagcauauaaucucucacaaguuagcuaauuuauuggguggauauaauauguuacauagccugggugccauggcucacgccuguaaucccagcacuuugggaggccgagguggguggaucacgugagaucagaaguuagagaccagccuggccaauguggcaaaaccccgucuuaccacaaaaaaauacuuagcugggcgugauggugugcaccugugaucacagcuacucuggagggugaggcaagagaaucacuugaacccaggaggcagaaguugcagugagccgagaucacaucacugcacucuggccuuggcgacagagugagacucugucucaaaaaaaaaaaaauauauauauauauagauagauagauagauagauagauauagauauacacacacauacuaauaauauguuauauaacauauuauauacuuaaauauauauacaaauuauauauaaaguaucaauauaugcuuuuuuuuuuuugugagggaguuuugcucuuguugcccaggcuggagugcaguggcguggucucggcucacugcaaccuccgccucccggguucaagcgauuuuccugccucagccucccaaguagcugggauuacaggcaugcgccaccacgccuggcuaauuuuguauuuuuaguagagaugggguuucuccauguuggucaggcuggucucgaacucccaaccucaggugaucugcccaccucggccucccaaagugcugugauuacagguuugagccaccgcacccggccuacuuuuuuuuuuuuuuuuuuuuuuuugagauggaauggaguuucacucuuguuggccaggcugcagugcaauggcaaggucucggcuuacuacaaccucauccuccuggguucaagcaauucuccugccucagccucacgaguagcuaggacuacaggcgcccaccaccaugccaggcaaauuuuuguauuuuuaguagagaaggaguuucaccauguugaccaggcuggucucgaacuccugaccucaggcgauccacccaccucggccucccaaagugcugggauuacaggugugagccacugugccaggcuucuaaaauuuuuuuuuuuuuuuuuuugagacauagccucccucugucgcccaggcuggaaagcaguggugcagucucagcucacggcaaccuccgcuuccuggguucaaucgacucuugugccucagacucccgaguagcugggauuacaggcgugccccaccaugcccggcuaaguauuuuuuugguagagaugggguuucgccauguuggccaggcuggucucaaacuccugaccucaagugaucugccagcuucagccucccaaagugcugcuauuacaggcgugagccacugcauccagccuacugauauauacuuauuaacuccacagaaaucuuuguaccccaguaggauuuacuuugucuuuguuuuaaccugcuuggcguuuccuccauuaaagcucaucucacugagaccuguccuuccccaggugaagaauuucaugacguggaggaugcagagaccuacaaaaagaugcuggcucgggacgagcggcguuuccggguggccgaccaggauggggacucgauggccacucgagaggagcugacagccuuccugcaccccgaggaguucccucacaugcgggacaucgugauugcugugaguggcggcuggggaacccugucccccacacccuuccggggacccaggcuuccgguucagguccugcuucccagcaccgaccugggggcaggcagucaccugguucuccagcaucuugccggggaagccaggccgcaaacacaggucagaggacggugaccuuucccaccuccacucucaguccccuggggucugaucucuccucgucuggccuuccccucccugugcucgcauuugggguccaggcccccagccuucccucagacagccacugugccccaccuuauacaauuucuuuucuuucuuuuuuuuuuuugagacauagucucccucgguugcccaggcuggaaagcaguggugcgaucucagcucacugcaaccuccgccucccggguucaagcaauucuccugccucagcgucccgaguagcugggauuacaggggcgcaccaccacaccuggcuaauuuuuaguagagacaggguuucuucauguugguuaggcuggucucaaacuuuugaccucaggugauccgcccgccucagccucccaaagugcuaggauuauaggcaugagccaccgugcccggccaauuuuuaauuuuuuuuucuaguagagaugggauuucaccauguuggccaggcuggucuugaacuccggaccucaggugaucugcccaccuuggccucccaaagugcugggauuacaggcaugagccaccgugccuggccccaaaaugugcuuuguucuauagaagaaggcuuuuuuuuucuuuccuuccucuuuuuuuuuuuuaguuuuugagacagggccuaacucuguuacccagaccggagggcaguggcucaaucucagcucacugcaaccucaaacucuugggcucaaguaauccucccaccuccgccuucugagaagcugaggccaccaggcacaagccaccaugucuggcuaauguuuuuuuuuuuuuuuuuuucagacggagucucgcucugucgcccaugcuggagugcagugaugcgaucucggcucacugcaagcucugccucccggguucacuccauucuucugccucagccucccgaguggcugggacuacaggcgcaugccgccaugcccggcuaauuuuuuuuuuuuuuuuuuuaguagagacgggguuucacuguguuagccaggauggucucgaucuccugaccucgugauccacccaccucggccuuccaaagugcugggauuacaguugugagccaccacgcccggccaugccuggcuaauuuuuaaauuuuguguagagacagggucucgccauguugcccaggcuagucucaaaauccugggcucaaucgauccucccgccucggccucccaaagugcugggauuacaggugugagccaccgugcccagcccacagucuuauagugaaugaguuuggauauaaauuggggaacaaaagucguuuugcuccagaagggcacaaaaacaaggagcggagguguccagugugucagaagaagccccaaagugcaccauguucacacauaaagcagagguagguucuaggcucugcuaaacauaaaggagcuucuccccuuggaggguguuugcuggggcuugagcaaguuauuagggacccaggacagcuccccuugugagcaacaaaccugugcacugcuggacauuagggccucugggcucuggccccguaaaugcagguggugccuguuugaugauaacaucccagaaagcccgcaaauuucccacaugccaccuguugagacugcucuacugccugccucccacagcugcccggagcuaaauuuccaagagaaccucucacucuuaccccagggguccagccucccccaggagccagggucaucggcccccagccucaaugccccuuucuccuccaggaaacccuggaggaccuggacagaaacaaagauggcuauguccagguggaggaguacaucggugagugggccccaauuucuucuugggaugccuguccucucucaggcaugggcaggguugguggggguagccggagguacaucacccaucaucagagaacaguggcccucagacaugggggcaggggcacucacugcuugaguucauuuagccacccaacauuuauugagcaccuacucuauaccagacacaaaaagcaucuauugagcaccugcugugugucacgcccaggauacacuuacugagcaccuacugcauaugggugguugcgccuacagcagacaauaacacagacaaaucccuucuugggggucuggaguuucuacaaaaucaaggcucaggggcuauguuuaguugagaaugggggucaggaagcuggucuugaaccugcgccugcacagcaaacacuguuuccuguuacaugggauguugggggauccucacaauacccccugaguucugaguucucccugggccccugccacugucccugccccuagcgggcaaaaaauuuagucaaggagaacgcuaacaaggaauuuuuuuuuuuuuuuuuuuuuuuugagacaguuuuuuucuguugcucaggcuggagcgcgguggcgugguaucggcucucugcaaccuccgccucccgggcucaagagauucuucugccucagccuccugaguagcugggauuacuggugccugccaccacgccuggcuaauuuuuguauuuuuaguggagaugggauuucaccauguuggccaggcuggucuagaacucccaaccucaggugaucugcucaucuuggccucccaaaguggugggauuacaggcgugagcaaccacgcccggccaggaauuuuuuuuuaaguuugaaaacauuguuuauucuuuuauuuuuuucugaccacauccuacaugagaaaacauuuuucuuucuuuccuucucucacuuucuuucuuucugucacucuuucuuucuaucugucugucugugugugugugugucucucucuuuauuaaauagagauggguucucacuauauuguccaggcuggucuagaacuccugggcucaagcaaucuucccaccuuggccucccaaagagcugagauuacaggcaugaaucaccacaccuggcugagagaacauuuuuauauuuuuuucuuaagagaugggguugggccaggcgcaguggcucauaccuguaaucccagcacuuugggaggcugagauggauggaucaugaagucaggaguucgagaccagccuggccaagaugguguacuaaaaauacaaaaauuagccgggccuguuggcaggagccuguaaucccaguuacucuggggacugaggcaagagaaucucuggaacccgggaggcaaagguugcagugagcuguaaucgcgccauugcacuucagucugggcaacaagagcgaaacuccaucuuaaaaaaaaaaaaaaaagauggggucuugcccugucgcccaggcuggagugcaguggggugaucuuggcucacugcagccuugaccuccugggcucaagggauccucccaccucagccucccaaguagcugagacuccaggcacagugcggccucuggagauacuucugguugucacuucuagaggggugaggaugcuacugacgucuccuggauagagcccagagaugcuccuuagcauucuccggugcacaggacaggcccugacaacaaggaggucacaggccccagaugccagcagcuguccccaucucuuuuuuuuuuuuuuugagacagagucucgcuauugucgcccaggcuggagugcaguggcaugaucucggcucacugcaaccuccgccucccagguucaagcaauucucuuguuucagccuccugaguaggugggauuaugggcgugcacuaccacgccuggcuaauuuuguauuuuuaguagagacgggguuucaccauuuuggucaggcuggucuugaacucuugaccucagguuauccaccugccucggccucccaaagugcugggauuacaggcgcgaaccaccgcacccagccuaucuucucaauuacuucaucccauuaagacuucaucuuccauuccucagcucuaccaggcagacacugucacuauccuccauuauauagaugacaccugaggcccagggggguugaagggaucugcugaagacaaugggaagaggcagggcuaggauuugaaccuugguguuugggcucuggcaccuauuucuuaacuccuccccaaccaguaacauaucaaaauguauaaaauuggggugggugccauggcucacgccuguauucccagcacuuuaggaggccaagguggguggaucacuugaggucaagaguucaagaccagccuggccaacaugaugaaacccugucucuacuaaaacuagaaaaauuagcugggcgugguggcggguaccuguaaucccagcuacuugggaggcugaggcaggagaaucacuugaacccagaaggugcagguugcagugagcugagauugugucacugcacuccagccuguaaucccagcacuuugggagacugaggcagguggaucauggggucaggaguuugagagcagccuggccaagauggugaaaccccgccucuacuaaaaauauaaaaauuagcugggugugguggcacgcaccuguaaucccagcuacuugggaggcugaggcaggagaaucgcuugaaccugggaggcagagguugcagugagcugagauugcgccauugcacuacagccugggcaacaagagcgaaacuccaucuuaaaaaaaaaaaggggguggggucuugcccuguugcccaggcuggagugcagugggguaaucacagcgagacuccaucucaaaaaaaaaaaaaaaaauuuguagaaacagggucuugcuauguugcccagguuggucuugaaucuuggccucaaaugacccuccugccugggucucccaaaguguuggauuacagucaucacugcaccuggcaucucugucaccugcuaacuggccagaaacauccucgcacguuccuccugcauagacauugcuuacuaugugccaggcacugccuugcccauugcacacacuacuucacgugugugucaaugaaaucaaucaaucaugcaaucaaccaaucaaaugaauuucaccuguaacacaaaugauugcuuauaagucagguuuuguuacuaauuccaucgaaacagaagaggacgcugaggcgagagagaggguagugaguugcucaagggccugguucaggaaguaucagagccaggaucagcccccagcuccacuagacccccagagcugccccugaccuuguccccucugucccggcccccagcggaucuguacucagccgagccuggggaggaggagccggcgugggugcagacggagaggcagcaguuccgggacuuccgggaucugaacaaggaugggcaccuggaugggagugaggugggccacugggugcugcccccugcccaggaccagccccugguggaagccaaccaccugcugcacgagagcgacacggacaaggugcagugacggggccucggcaggagcgaggagcgggugggcauugcgggccagacuccagaaaggagcaagaccugggccuggagcucagggucccuuuuaggugggauaaaaaaagagggacagagagagggaggaaaagagagggcacggagccccagaaagagagggggacagagacccagagacccaaagagagaaggacagggaccaagacggggacagauucagagagaaagggacagaggcccagagaacaagggucccagagacuucgggacacgcuuggaugcagggagggcuuuugaaagcagggccguguuguccccucugaacccugacccucccuccaggaugggcggcugagcaaagcggaaauccuggguaauuggaacauguuugugggcagucaggccaccaacuauggcgaggaccugacccggcaccacgaugagcugugagcaccgcgcaccugccacagccucagaggcccgcacaaugaccggaggaggggccgcuguggucuggcccccucccuguccaggccccgcaggaggcagaugcagucccaggcauccuccugccccugggcucucagggacccccugggucggcuucugucccugucacacccccaaccccagggaggggcugucauagucccagaggauaagcaauaccuauuucugacugagucucccagcccagacccagggacccuuggccccaagcucagcucuaagaaccgccccaaccccuccagcuccaaaucugagccuccaccacauagacugaaacuccccuggccccagcccucuccugccuggccuggccugggacaccuccucucugccaggaggcaauaaaagccagcgccggga

SEQ ID NO: 191766 - RNA, 14150 nt, Homo sapiens
guuaccuguaggagagauccgaggcccagccgccauucagucccccgacuuauucccuuaccuccccugccugaaaaaugaugagaacacacugauucgggcccaaacucguguuauauuaucgagguggaaaacagccauauguauuaggaggggaaacugaggcagaccacaggacggggcuccagagggaggacaacuaggcccagaaccccuucuggaggcucagagaugccaguguuccaggaggucucacagcaugaaaggggccugacuacauucgcuuuuagcagucggaauggcggauggucaggcgguggcuggaaucacauuuacauccuucaaaucagcauccugggccuccccuggggugggcaggaggaccccggugucgucuccacgaagggagauccaaggggcugaggagagagagagagggagaggucaucagaaucucugaggcgcucugggucugacuggcgucccccauuugugugugugucucacacacucuuccucagucucuauccccuuccuucugggccuuugucuccccuucucccaauuuuccguccccccucuuucuacaucuuugccucccuccucugggucugucucccccucccucuguccgcaccucucucuguccccucugggucucuguucccccgucucugggucucugucuccgucccccucucucugcaccucuguucucccaucucuggguuucugucuccaccucucucugaucucuguccccccucucugggucucuguccucccaggucugugugccccucucuuggggucucugucccucucucagaggcucuuccucccgcugccccccaccuggcagcccacuccucauccuucuccacaacagagcuccuccuacagccgcugccgugaguagcaagacaccgaugacgauucccaccacgagcacggaggacuuggcuggagauucugcagccagagaacgcugugagauguggagcagccccuccaccccacccagucaggacacagaacuggggcgcucccagucccucccagccucggagauuccagcaccaagugucugaugggcagaggcgaggccaggcaggcgaucugggcagacugcccccagguuggacguaagaaccagcuacagcacgagcggccgcggucacaccggcaauggaucagcagcggcaaggcggggcugugccagugcaguggggagaggcaggcagagcagugggaagucagucucaugggcccgggcaguagcaaagcagcaggcagucagucuuggugaggacgggcauagcagacaacgaauggucagauuccaggaagacccgcagcagcagcagcagcagcagcaggauggaagauggucagacucagggaggacuggccaugguaguuaacagcucuucagacucagugaggccagaagcagcaggagacggaaggcaguuggccuugggaaggacaagccaucagguuuugggggcacugacaggcgugagguucaaggcagucagauucaaggagguggcagcaguggggaggaaggucagacucaggaaggaccggcgcagcagugagacaaggcaacgggaaaccaggagcaucaccaccuggcgggaccucacccagcuccacccugaggggcugcgccagccccgcgugcugcacaaugcagcaguaguggugcucaucgccacuuuugacuguuagugacgacgaggcguggaaggauccgucacuguuggggccgaagucacccuggccggugccagcggccagcccauuccgcaggaaccgaaguugcagcuccggaggguagaaggagaaggcgcugcagguaagcacggaaaagccagggcugcugggucgggccuucaggcgcauggaggggggcucugcaggaaaucaggcagacaggccuaagucgcgagcccaccacucccagagccagggcuggauagggacagaaagaggccuccauguuugcacugugcuaaccgcagauaauacagugguaaaaggggaggcacuuccuaggugacagagacucaaccuguccaccccgaagguguccccucaagaugucaccuccuugggcugggcauguuggcucacgccuguaaucgcaacacuuugggaggccaaaguggguggaucaccugaggucaggaguucgagaccacacuggccaacauggugaaaccccaucucuacuaaaaauacaaaaauuagccgggcaccuguagucccagcuacucaggaggcugaggcaggagaauugcuugaaccugggaggcagauguugcagugagccaggaucgugccacugcacuccagccugggcgacagagugagaccccgucucagaaaaaaagaaaaaaaaaaaaagauagaggauaauuaugaaaaauuccacagcaacacauuugaaaauuuagaugaacugaacacauuccugauaaauacaaccuucuaaacugacacaagaggaaauuuaaaacgucuguaguccuauaacuauuuaaauuuuuuuuuuuuuuuugagauggaaucuugcucugucucccaggcuggagugcaguggcgcgaucucggcucacugcaagcuccgccuccuggguucacgccauucuccugccucagccuccugaguagcugggacuauaggugcccaccaccacacuuggcuaauuuuuuguauuuuuaguagagacgggguuucaccgucuuagccaggauggucucaaucuccugaccucaugauccauccgccugggccucccaaaguguugggauuacaggugugagccaccacgccuagccuuuuguuuuugagauaagagucucgcucugucacccaggcuggagugcaguggcacgaucucgacucacugcaacccccacuuccuggguucaagaguuucuucuuccacagccucccgaguggcugggacuacaggugcaugcaccaccaugccggguaauuuuuuuauuuuuaguagagacgguguuucaccauauuggccaggcuggucucaaauuccugacauugugaucuaccugccucagccucccaaagugcugggauuacaggcaugaugcaccacacccggccuauuuaaaauuuuuaauccauaguuuaaaacuuuccaaaaacuaaaauuccagguccagaagacaucaauuagugaauucuuccaauguagaaaugauucuauuccuacacuaacucuucaggccauaaaacagaggaaacacucucccagcauauuuuaugaggucagcaucaucuugacaacaaagcacauuauaagaaagagaacuuggccaggcgcgguggcucacgccuguaaucccagcacuuugggaggccgaggcaggcggaucacgaggucaggagauugagacuaucccggcuaacacggugaaaccccaucucuacuaaaaauacaaaaaauuagccgggcgugguggccggcgccuguagucccagccacuugggaggcugaggcaggagaauggcgugaacccgggaggcggagcuugcagugagccgagauugcgccacugcacuccagccugggugacagagcgagacuccaucucaaaaaaaaaaaaaaaaaaaaaaaaagagagcuuaaggccaaugucucucauaaauauagauucaggacaggugugguggcucacaccuagaauccuggcgcuuugggggguggaggcaggaggaucacgaggucaggaggucgagaccagccugaccaacauggugaaaucccaucucuacuaaaaauacaaaaaaauuagccaggcaugguggcguguaccuguaaucccagcuacucaggaggcuaaggcaggagaaucgcuugaacccagaaggcggagguugcauugagccaagauugcaccauugcacuccagccugggcgacagagcaagacugucucaaaaaaaauaaaaaauuaaaaauuuuaaaaaauuuaaaaaaagauucagaacucuuaaacauaauauuagcagacaggcugggugcaguggcucacuccuacaaucccagcgcuuugggagaaugagguggaucacuugaacccaggaguuggagaccagccugggcaaacaguaagacguagucuccacuacaaauaaaaaaaauuagccagugugguggaugugccuguggucccaccuacucuggagacugaggcaggaggaauccuugagcccaggaguuugaggcuggagugaguuaugaucacaccuggguauagccacugcacuccagccugggcgacagagcaagacuccgucuaaaaaaaaaaaaaaaaauucauaaacuuuauaaaauguauaaauugaagucgauaaacugaacuucacugaaauuaagaauuuuuguucauccaaagguuucguuaagggaaugaaaaaagguugggugcagugguucaugccuguaaucccagcacuuugggaagcugaggcaggaggaucacuggaagccgggaguucaagaccagccugggcaacauggagaaaccccgucucugaaaaaguuuaaaaauuaacuacgugugaugguacacaccuguggccccauccauucaggaaggguaaggugggaggaucgcuugagcuugggagguugaggcugcagugaacucuaaucccgcuacugcacuccagucuaggcaacagugcaagugccugucucaaagaaaaaaaaaaaaaaaagccgggugcaauggcucaugccugcaauuccagcacuugggaggucaaggcagaaggauccuuacgcccaggcuuucuuuuccuuuuuuuuuuuuuuuuuuugagacggagucucugucgcccaggcuggaguacaguggcacaaucuugggucacugcaaccuccgccuccuggggucaagcgauucuccugccucagccuccagaguagcugggauuacaggcgcacaccaccacgcccagcuaauuuuucuauuuuuaguagaaacaggguuucaccauauuggccaggcuggucuugaacuccugaccucgugauccgccugccucagccucccaaagugcugggauuacaggcgugagucacugugcccggccaagcccaggacuucuagaccagccuuggcaacaaauaccccaucucuacaaaaaauagaaaauguuagccaggcauggugacguguaccuauagucccagcuacuuguaaggcugaggcgggaggaucucuugagcuugggaguccaaggcuacauggcgcuaugacugugccacugcacuccacuccagucugggcgacagagcaagaucccagcucaaaaaagaaaauaaaaggcaaagauuucagcaacugccuaggacugggcauuacugcccaaguuccuuucagggaggguggaucugggcaaucgugggucuuggcugggaucuugguuuugguugcucagcagaaaacacauuugcugcuucaggaaagcacagcagcuucucccuccuggagcugccucucuggcaagucggcagaauuugcugcaccgucagguggaauggagggaccgggcugacggccaucagcaguucuggcuucugcuuuauguucacuauucuuuucagcaaaucuguaucuuccugugucgugcucacagccacgugccuucagccucaagguacuuccaauauagacuaaauccaagcacagaaaaucugucuggccuuugguucuguuuaacaaaauaccaaaccaggucaggcaugguggcucacgucuguaaccccagcacuuugggaggcugaggcaggcagaucaccugaugucaggaguucaagaccagcuucgccaacauggugaaacuccaucucuacuaaacauauaaaaauuagcuaggcauggcagcgcaugccuguagucccagcuacccuggaggcugaggcaggaggaucacuugaauccaggaggcggagguugcagugagcugagaucaugccauuguacuccagccugcgcaauaagagugaaacuccaucucaaaaaaaaaaaaaaaauccauccuggccaacauggugaaacccugucuguacuaaaaauacaaaaauuagcugggugugguggugugugccuguaauuccagcuacuaaggaggcugaggcaggaggaucacuugaaccugggagguggagguugcagugagccgagaucgugcuacugcacuccagccuggugacagagggagacgcccucucaaaaaaaaaaaaaaaaaagcccgggcgcgguggcucacgccuguaaucccagcacuuugggaggccgaggcaaguggaucacaaggucaggaguucaagaccagccugcccaacauagugaaaccccaucucuccaaaaaaaauacaaaaauuagccaggcaugguggcacgcaccuguaaucccagcuacucaggaggcugaggcagcagaaucgcuugaaccugggaggcggagguugcagugagccaagaucgcaacacugcacuccagccugggcgacagagcaagacuccaucucaaaaaaaaaaaaaaaaaaaaaagauuaaggcaauggccauugcuauccgcuaaaaccaucaggagaaaaccugacaaagaacuucauaacaacacccgaauccagugguccacagaacagcacagaagcaagcagauguuugcagccuaugcacacagacauacgcaccaacuacccagaaaguuuucuugccauaaaaauugaaccagaaucugaccaagcuucuagauggagcugcuccuuuaaagaagagaaggaggacuauuuccagcaacaucacaggaugcaaagggcaaaauccagucuaggagaaacucaauaggacauaaacugacuuucuucaaaccacaauuacagggggaaaaaaaacaaaaagaaaaugggaaaccuguaaaucaaaagacacucaagaucacaaguaacucaaauuaccugaaaaugaaucacagaccuaacuguaaaaugcaaaacuuuaaaacucuuaaaauacacaggagaagaucuagcugacuuuggguuuggugauuacuucugagauuaaacaccaaaagcauaauccacgauagaaaaaaaaaaaagaauaaacuggauuucaucaaaguuaaaaacuuuugcuuugugaaaggcacaguuaaaacaaugaaaagacaaccuagagaguggaagaaauauuugcaaaacaccuaucugguaaaaaauuggaauccggccgggcgcgguggcucaagccuguaaucccaguacuuugggaggcugaggcaggcggaucaggaggucaggagaucgagaccauccugccuaacacagugaaacucugucucuacuaaaaauacaaaaaauuagccgggcgugguggugggcgccuguagucccagccacucgggaggcugaggcaggagaauuggugcaacuugggagguggagguugcaaugagcugagaucgcgccacugcaccccagccugggugacagagcgagacuccgucuccaaaaaaaagaaaaaaacaaaaauacggccgagcgcgguggcucacgccuguaaucccagcacuuugggaggccgagguggguggaucaccuggggucgggaguucgaaaccagccuggccaacauggugaaacucugucucuacuaaagauacaaaaaauuagcagggcgugguggcuugcgccuguaaucccagcuacuugggacgcugaggcaggagaauugcuugaacccgggaggcagaaguugcagugagccgaguucgugccucugcacuccagucugggcgacagaguaagacuuugucucaaaaaacaaacaaacaaaaauagcuaggccugauggcgugcaccugugguccuaccuacuggggaggcugaagugggagaauuacuugagcccaggaaguucagacugcagugagcuaugauugcaccacuggacuccagucuggugacagagcaagacccugucucaaaaaggaaaaaaaaaaaaaaaaagaaagaaagaaaaauucaacaaucagaaaaagacacugaaaagacaacaaaauguguggaccuugcuggaugcugauucaaacuuuaaaaaacauuuacagucaggaauaugggaacaaaaacuggacaucugaugccauuaaagaguuaauugguuguaggugugaugaugguuuugguauuaauuuuuuuuaaaugcccuuaccuaguagaguuacauacuaaaggacuuaucaacaaaacagucuggcugggcacggugacucccgcacuuugggaggcugaggagggcagaucacuugagguggaggguucgagaccagccuggccaacauagugaaaucccgucucuacuaaaaauacaaaaauuggccaggcgcgguggcuuaugccuguaaucccagcacuuugggaggccaagguggguggaucacgaggucaggaguucaagaccagccuggccaauauggugaaaccucaucucuacuaaaaauacaaaaauuggcugggcgagguggcgggcaccuguaaucccagcuacucaggaggcugaggcaggagaauuguuugaaccugggaggcgaagcuugcagugagccgagacugagccacuacacucccgcaugacagagugagacuccaucucaaaauacaaacaaacaaagaaaaaaacacugugaugucugagauuuaccaaagcuugaugugaagugggguggggaagugagugaggaugugcgugaaauucaaaaaaccauggguugauaauuauuaagucucagugaugggaugcucgcuuccuuccuuccuuccuuccuuuccuuccucuuucucucucccucuccucucucuuucuuuccuucuuucuuugagacagagucuugcuuuguugcccaggcuggagugcaguggcuugaucucggcucacugcaaccucugcuucccgggaucaagugauucuccugccucagccucccgaauagcuggaauuacaagcacccaccaccgcacccggcuaauuuuuguauguuuaguagagaugggguuucacucuguuggccaggcuuaucucaaacuccugaccuuaagugaucugcccaccucggccucccaaaguguuggaauuacaggcgugagccacugcaccuggccaccauauuuuuuuucuuuuugagacagggucuggcucugucaucugggcuggagugcagaguugcaaucaguucacuacagccucaaacuccugagcucaagcgauccuccugccauagccuccccaguggcugggacuagaggcacauaccaccaugccaggcuaauuuuuugaguuuuuaguagagaugcggucuuacuauguugcccaggcuggucuugaacuccugggaucaagcaauccaccugccucggccucccaaaguucugggauuauaggcgugagccaccgugucugguccguuuuauacuauuguuucuacuuaagugugguuugaaacuuucccuccuuaagccaggagugguggcucaugccuguaaucccagcacuuugggaggccaagguaggcagaucacgagaucaggaguucgagaccagccuggccagcauggugaagcccccgucucuacuaaaaauacaaaaauuagccaggcaugguggugugugccuguaaucccagcuacucgggaggcugagguaggagaauugcuugaaccugggaggcggagguugcagugagccaagauugcgccacaguacugcagucugggcgacagugcaagagucugucucaaaaacaacaacaacaacaacaaaggccaggagcaguggcucacgucuguaauuccagcacuuugggaggccgaggcaggcagaucacgaggucaaaagaucgagaccaucccggccaacaugguaaaacccugucuuuacuaaaaaaaaaaaaacaaacaaaaauuagccaggcgugguggugcacgccuguagucccagcuacucgggaggcugaggcaggagaaucacuugaaccugggaggcggagguugcagugagccgagaucgcgccauugcacuccagccugggcgacaagagcgaaacucugucucaaaaaaagaaagaaauuuucccuacuuaggaaagaaagaagacaauuaaagaaaaacuaccugguugagucucaacuucuccuuuguggcacuuggaaugaauaucugugcacauccccagcugguaucuaucuuuguccagcagccugggagccacagagggugaaugugugucacuucccucuuugcucaaggcccagagcagcgccuggcagugcaaaugcucuuggccaacaguugaaugaguggggaucugggggccuccggggaggaaacagugaacucugcccuacagagcugaggaaaggcuucucagaggaagugauauccagcccugaccuugaagaauaaggagggcuggaguauaugcagagagggggaaggguggaacagagaggugccaggggaaacuggaugagcaaaugcccagagggaggagauugcuuauguuggguggcuggagcguagacucugauggcugcguagagacaagugcugcugcgugggucugaugaggacauuaaggcaaggaaggccaagcacaguggcucacaccugucaucccagcacccugggaggccaaagugagagaaucacuugaggccaggaguuugagucuggccugggcagcauagugagaugccaccucuacaacaaauuuuaaaaauuagccagguauggccagacgcgguagcucacuccuguaaucccagcacuuugggaggcggagguggguggaucacuugaggucaagaguuugagaccagccuagcuaccaugacgaaaccccaucucuacuaaaaguauaaaaauuagccagacaugguggaugugccuauagugccagcuacucaugaggcugaagcagcggaaucccuuaaacccaggaggcggagguugcagcgagcugagaucacccugcuucacacuagccugggcaacagagauugugcggaaaaaaaaaaauuagccaguuauggugguaugcaccuguaaucucagcuacucaggagaccaaagcaggagaaucgcuggagccuaggaguucaagaccagccugggcaacauagugagacaccgugucuacaaaauauaaaguuagccaggugugaugaugcugggcuguggucccagcuacuugguuggcugaggugggaggacugcuugagccugggagguucaggcugcagugagccgagauggugccaccacauuccagccuggggugacagagcgagaaucugucucaaaaaaaaaaaaaaggggggagccaggagcaguagcucaugccuguaaucccagcacuuugggaggcugaggugggcggaucaccugaggucagggguuugagaccagccugaccaacaugaagaaaccccgucucuacuaaaaauacaaaauuagccgggcaugguggugcaugccuguaaucccagccacucgggaggcugaggcaggagaucacuugaacccgggaggcggagguuguggugagccgagaucgcgccauuacacuccagccugggcaacaagagcgaaacuccgucucacaaaaaaaaaaaaaaaaagaaggcaaggaaggaagccaggaguuuguccuggggggcgcuggggagccaugggagggcugaguguagaaggaccccugaggaaugggggggcagagcgugggcugcagugggaggcugauggaggguccuggcaggggaacugaggcaggugggcaugacgggagagaggacagaacagccugcggcugcagauccggcucacccuuccacuccagguuuccgcggccccucuccaggugcucccgcaggcggugcgggcaggagaauagcaggaaggugagcuccuuguuggccgccuuguccugcugcugccaccgcugacugauagccagggccucgggccaguccccaccccaggugcccugcuugaggucgaaauucaugaacuccucgccguucagggcgaacuuggcggugggcaccgagguguugucagggcccaguucacagcccagcaggcccugcagaguguagggaccuggggcgcccaaacacagguaagcggggccccggagcauggacccggccccuugccccuccagaccggaaucucaccuuuuccccccaaagcuuugaaagcuuccagaaagagcuucuccuugauccucagaucuguggucucuuucucccaauaccaggacaccugguuuucccagacccaagcuccacagggcuccgccucgccccgcaggcuauuguagcucagguacugcugcgggcccagccagccggacacccagaaggcaggaguccccggggcaggcgaggacaccgcgguaaggugguacaggagggagagguggcuuucugcagacagaaacagagcugaagggagcacacgggcggggaacuagacugcagugggacagauacccagggagggagaagaaucuauuauggagggagggggacagauucagagagaggggacagaaacccggggggggggggacagagacccagagagagagagacaagagacccagaaagagagggggacagagacccagagagagagagggaaacagacacaagaggcgacaggugguucccagccucaggcccagcaggagacguugagaaaguuaauugagcggagaaggcagcgccaggggcucgcggggaacucgggucccgcuggcuucgccccugccugccuggggccgccucccgccgcccgccugcagcagggcccuggcccggagcggcccucaccugcgcccaggcucccaggaaggagaaagagcaggagccccagcgcccagggcugaggccgcgggacccccaugcugagaggacgaccuggggcgggagggggcacgugacuccucccgacccccggcccgccccuuccucccgggacaccgcgggcacggccgggaccaggacgccgaggaggggcucugcgggcucgguccagacugacaacaaugcccuccucguaccugaagaacuuucaccccugaacuggaucucaguugguuaauuaauuacagacacuugauaggcugagagucccggccccgagcuccgccacgccccuuccgccccccucaggccccagccccuccucccucagaccccggaguccaggcccccaaccgcucuucccucggacccaggaguccgggcccccaaccgcucuacccucggacccaggaguccgggcccccaaccgcucuacccucggacccaggaguccgggcccccaaccccuccucccucggacccaggaguccaggcccccccggccccuccucccuccucccucagacccagcguccagacccccagucccuccucucucagacccaggaauccaggcccccaccccuccucccucagacccagugucgagacccccagccacuccucccucagacccaggguuccaggcccccagccccuccucccucagucgggcccuggucggcucacguucccuucagccucgcucccuuccugccugcggcccuggccggcuccuggcucccgugacuggagaccccaguuccucucucacauccugugggaggcugcugcucccugacuccaagaacauccagccccaccccccaguugcagggcacaccccaggcccuaggcccagccuguuuguuucucaaaacgcuugugguucuucuuuuuccuucucugugguucccguuuuuuacuuugagggugucugccgcucagggaauucuugacaaaacugggaaaggaacucgaugccuccggaguccacaacuuggaggucucuggauccuccuccuaccccucuguauccccguggccuucccuagcgcucgcuguuaaucaaaaucuucuggaagccuccuuaguuccuccuucaagcccuucccccggcauccccuuaaaaaauuccugcaggugcucuuuaauauccuuc

SEQ ID NO: 191767 - RNA, 14150 nt, Homo sapiens
gaaggauauuaaagagcaccugcaggaauuuuuuaaggggaugccgggggaagggcuugaaggaggaacuaaggaggcuuccagaagauuuugauuaacagcgagcgcuagggaaggccacggggauacagagggguaggaggaggauccagagaccuccaaguuguggacuccggaggcaucgaguuccuuucccaguuuugucaagaauucccugagcggcagacacccucaaaguaaaaaacgggaaccacagagaaggaaaaagaagaaccacaagcguuuugagaaacaaacaggcugggccuagggccuggggugugcccugcaacugggggguggggcuggauguucuuggagucagggagcagcagccucccacaggaugugagagaggaacuggggucuccagucacgggagccaggagccggccagggccgcaggcaggaagggagcgaggcugaagggaacgugagccgaccagggcccgacugagggaggaggggcugggggccuggaacccugggucugagggaggaguggcugggggucucgacacugggucugagggaggaggggugggggccuggauuccugggucugagagaggagggacugggggucuggacgcugggucugagggaggagggaggaggggccgggggggccuggacuccuggguccgagggaggagggguugggggcccggacuccuggguccgaggguagagcgguugggggcccggacuccuggguccgaggguagagcgguugggggcccggacuccuggguccgagggaagagcgguugggggccuggacuccggggucugagggaggaggggcuggggccugaggggggcggaaggggcguggcggagcucggggccgggacucucagccuaucaagugucuguaauuaauuaaccaacugagauccaguucaggggugaaaguucuucagguacgaggagggcauuguugucagucuggaccgagcccgcagagccccuccucggcguccuggucccggccgugcccgcggugucccgggaggaaggggcgggccgggggucgggaggagucacgugcccccucccgccccaggucguccucucagcaugggggucccgcggccucagcccugggcgcuggggcuccugcucuuucuccuuccugggagccugggcgcaggugagggccgcuccgggccagggcccugcugcaggcgggcggcgggaggcggccccaggcaggcaggggcgaagccagcgggacccgaguuccccgcgagccccuggcgcugccuucuccgcucaauuaacuuucucaacgucuccugcugggccugaggcugggaaccaccugucgccucuugugucuguuucccucucucucucugggucucugucccccucucuuucugggucucuugucucucucucucugggucucuguccccccccccccggguuucuguccccucucucugaaucugucccccucccuccauaauagauucuucucccucccuggguaucugucccacugcagucuaguuccccgcccgugugcucccuucagcucuguuucugucugcagaaagccaccucucccuccuguaccaccuuaccgcgguguccucgccugccccggggacuccugccuucuggguguccggcuggcugggcccgcagcaguaccugagcuacaauagccugcggggcgaggcggagcccuguggagcuugggucugggaaaaccagguguccugguauugggagaaagagaccacagaucugaggaucaaggagaagcucuuucuggaagcuuucaaagcuuuggggggaaaaggugagauuccggucuggaggggcaaggggccggguccaugcuccggggccccgcuuaccuguguuugggcgccccaggucccuacacucugcagggccugcugggcugugaacugggcccugacaacaccucggugcccaccgccaaguucgcccugaacggcgaggaguucaugaauuucgaccucaagcagggcaccugggguggggacuggcccgaggcccuggcuaucagucagcgguggcagcagcaggacaaggcggccaacaaggagcucaccuuccugcuauucuccugcccgcaccgccugcgggagcaccuggagaggggccgcggaaaccuggaguggaagggugagccggaucugcagccgcaggcuguucuguccucucucccgucaugcccaccugccucaguuccccugccaggacccuccaucagccucccacugcagcccacgcucugcccccccauuccucagggguccuucuacacucagcccucccauggcuccccagcgccccccaggacaaacuccuggcuuccuuccuugccuucuuuuuuuuuuuuuuuuugugagacggaguuucgcucuuguugcccaggcuggaguguaauggcgcgaucucggcucaccacaaccuccgccucccggguucaagugaucuccugccucagccucccgaguggcugggauuacaggcaugcaccaccaugcccggcuaauuuuguauuuuuaguagagacgggguuucuucauguuggucaggcuggucucaaaccccugaccucaggugauccgcccaccucagccucccaaagugcugggauuacaggcaugagcuacugcuccuggcuccccccuuuuuuuuuuuuuugagacagauucucgcucugucaccccaggcuggaaugugguggcaccaucucggcucacugcagccugaaccucccaggcucaagcaguccucccaccucagccaaccaaguagcugggaccacagcccagcaucaucacaccuggcuaacuuuauauuuuguagacacggugucucacuauguugcccaggcuggucuugaacuccuaggcuccagcgauucuccugcuuuggucuccugaguagcugagauuacaggugcauaccaccauaacuggcuaauuuuuuuuuuuccgcacaaucucuguugcccaggcuagugugaagcagggugaucucagcucgcugcaaccuccgccuccuggguuuaagggauuccgcugcuucagccucaugaguagcuggcacuauaggcacauccaccaugucuggcuaauuuuuauacuuuuaguagagaugggguuucgucaugguagcuaggcuggucucaaacucuugaccucaagugauccacccaccuccgccucccaaagugcugggauuacaggagugagcuaccgcgucuggccauaccuggcuaauuuuuaaaauuuguuguagagguggcaucucacuaugcugcccaggccagacucaaacuccuggccucaagugauucucucacuuuggccucccagggugcugggaugacaggugugagccacugugcuuggccuuccuugccuuaauguccucaucagacccacgcagcagcacuugucucuacgcagccaucagagucuacgcuccagccacccaacauaagcaaucuccucccucugggcauuugcucauccaguuuccccuggcaccucucuguuccacccuucccccucucugcauauacuccagcccuccuuauucuucaaggucagggcuggauaucacuuccucugagaagccuuuccucagcucuguagggcagaguucacuguuuccuccccggaggcccccagauccccacucauucaacuguuggccaagagcauuugcacugccaggcgcugcucugggccuugagcaaagagggaagugacacacauucacccucuguggcucccaggcugcuggacaaagauagauaccagcuggggaugugcacagauauucauuccaagugccacaaaggagaaguugagacucaaccagguaguuuuucuuuaauugucuucuuucuuuccuaaguagggaaaauuucuuucuuuuuuugagacagaguuucgcucuugucgcccaggcuggagugcaauggcgcgaucucggcucacugcaaccuccgccucccagguucaagugauucuccugccucagccucccgaguagcugggacuacaggcgugcaccaccacgccuggcuaauuuuuguuuguuuuuuuuuuuuuaguaaagacaggguuuuaccauguuggccgggauggucucgaucuuuugaccucgugaucugccugccucggccucccaaagugcuggaauuacagacgugagccacugcuccuggccuuuguuguuguuguuguuguuuuugagacagacucuugcacugucgcccagacugcaguacuguggcgcaaucuuggcucacugcaaccuccgccucccagguucaagcaauucuccuaccucagccucccgaguagcugggauuacaggcacacaccaccaugccuggcuaauuuuuguauuuuuaguagagacgggggcuucaccaugcuggccaggcuggucucgaacuccugaucucgugaucugccuaccuuggccucccaaagugcugggauuacaggcaugagccaccacuccuggcuuaaggagggaaaguuucaaaccacacuuaaguagaaacaauaguauaaaacggaccagacacgguggcucacgccuauaaucccagaacuuugggaggccgaggcagguggauugcuugaucccaggaguucaagaccagccugggcaacauaguaagaccgcaucucuacuaaaaacucaaaaaauuagccuggcauggugguaugugccucuagucccagccacuggggaggcuauggcaggaggaucgcuugagcucaggaguuugaggcuguagugaacugauugcaacucugcacuccagcccagaugacagagccagacccugucucaaaaagaaaaaaaauaugguggccaggugcaguggcucacgccuguaauuccaacacuuugggaggccgaggugggcagaucacuuaaggucaggaguuugagauaagccuggccaacagagugaaaccccaucucuacuaaacauacaaaaauuagccgggugcgguggugggugcuuguaauuccagcuauucgggaggcugaggcaggagaaucacuugaucccgggaagcagagguugcagugagccgagaucaagccacugcacuccagccugggcaacaaagcaagacucugucucaaagaaagaaggaaagaaagagagaggagagggagagagaaagaggaaggaaaggaaggaaggaaggaaggaagcgagcaucccaucacugagacuuaauaauuaucaacccaugguuuuuugaauuucacgcacauccucacucacuuccccaccccacuucacaucaagcuuugguaaaucucagacaucacaguguuuuuuucuuuguuuguuuguauuuugagauggagucucacucugucaugcgggaguguaguggcucagucucggcucacugcaagcuucgccucccagguucaaacaauucuccugccucagccuccugaguagcugggauuacaggugcccgccaccucgcccagccaauuuuuguauuuuuaguagagaugagguuucaccauauuggccaggcuggucuugaacuccugaccucgugauccacccaccuuggccucccaaagugcugggauuacaggcauaagccaccgcgccuggccaauuuuuguauuuuuaguagagacgggauuucacuauguuggccaggcuggucucgaacccuccaccucaagugaucugcccuccucagccucccaaagugcgggagucaccgugcccagccagacuguuuuguugauaaguccuuuaguauguaacucuacuagguaagggcauuuaaaaaaaauuaauaccaaaaccaucaucacaccuacaaccaauuaacucuuuaauggcaucagauguccaguuuuuguucccauauuccugacuguaaauguuuuuuaaaguuugaaucagcauccagcaagguccacacauuuuguugucuuuucagugucuuuuucugauuguugaauuuuucuuucuuucuuuuuuuuuuuuuuuuuccuuuuugagacagggucuugcucugucaccagacuggaguccaguggugcaaucauagcucacugcagucugaacuuccugggcucaaguaauucucccacuucagccuccccaguagguaggaccacaggugcacgccaucaggccuagcuauuuuuguuuguuuguuuuuugagacaaagucuuacucugucgcccagacuggagugcagaggcacgaacucggcucacugcaacuucugccucccggguucaagcaauucuccugccucagcgucccaaguagcugggauuacaggcgcaagccaccacgcccugcuaauuuuuuguaucuuuaguagagacagaguuucaccauguuggccaggcugguuucgaacucccgaccccaggugauccacccaccucggccucccaaagugcugggauuacaggcgugagccaccgcgcucggccguauuuuuguuuuuuucuuuuuuuuggagacggagucucgcucugucacccaggcuggggugcaguggcgcgaucucagcucauugcaaccuccaccucccaaguugcaccaauucuccugccucagccucccgaguggcugggacuacaggcgcccaccaccacgcccggcuaauuuuuuguauuuuuaguagagacagaguuucacuguguuaggcaggauggucucgaucuccugaccuccugauccgccugccucagccucccaaaguacugggauuacaggcuugagccaccgcgcccggccggauuccaauuuuuuaccagauagguguuuugcaaauauuucuuccacucucuagguugucuuuucauuguuuuaacugugccuuucacaaagcaaaaguuuuuaacuuugaugaaauccaguuuauucuuuuuuuuuuuucuaucguggauuaugcuuuugguguuuaaucucagaaguaaucaccaaacccaaagucagcuagaucuucuccuguguauuuuaagaguuuuaaaguuuugcauuuuacaguuaggucugugauucauuuucagguaauuugaguuacuugugaucuugagugucuuuugauuuacagguuucccauuuucuuuuuguuuuuuuucccccuguaauugugguuugaagaaagucaguuuauguccuauugaguuucuccuagacuggauuuugcccuuugcauccugugauguugcuggaaauaguccuccuucucuucuuuaaaggagcagcuccaucuagaagcuuggucagauucugguucaauuuuuauggcaagaaaacuuucuggguaguuggugcguaugucugugugcauaggcugcaaacaucugcuugcuucugugcuguucuguggaccacuggauucggguguuguuaugaaguucuuugucagguuuucuccugaugguuuuagcggauagcaauggccauugccuuaaucuuuuuuuuuuuuuuuuuuuuuugagauggagucuugcucugucgcccaggcuggagugcaguguugcgaucuuggcucacugcaaccuccgccucccagguucaagcgauucugcugccucagccuccugaguagcugggauuacaggugcgugccaccaugccuggcuaauuuuuguauuuuuuuuggagagaugggguuucacuauguugggcaggcuggucuugaacuccugaccuugugauccacuugccucggccucccaaagugcugggauuacaggcgugagccaccgcgcccgggcuuuuuuuuuuuuuuuuuugagagggcgucucccucugucaccaggcuggagugcaguagcacgaucucggcucacugcaaccuccaccucccagguucaagugauccuccugccucagccuccuuaguagcuggaauuacaggcacacaccaccacacccagcuaauuuuuguauuuuuaguacagacaggguuucaccauguuggccaggauggauuuuuuuuuuuuuuuugagauggaguuucacucuuauugcgcaggcuggaguacaauggcaugaucucagcucacugcaaccuccgccuccuggauucaagugauccuccugccucagccuccaggguagcugggacuacaggcaugcgcugccaugccuagcuaauuuuuauauguuuaguagagauggaguuucaccauguuggcgaagcuggucuugaacuccugacaucaggugaucugccugccucagccucccaaagugcugggguuacagacgugagccaccaugccugaccugguuugguauuuuguuaaacagaaccaaaggccagacagauuuucugugcuuggauuuagucuauauuggaaguaccuugaggcugaaggcacguggcugugagcacgacacaggaagauacagauuugcugaaaagaauagugaacauaaagcagaagccagaacugcugauggccgucagcccggucccuccauuccaccugacggugcagcaaauucugccgacuugccagagaggcagcuccaggagggagaagcugcugugcuuuccugaagcagcaaauguguuuucugcugagcaaccaaaaccaagaucccagccaagacccacgauugcccagauccacccucccugaaaggaacuugggcaguaaugcccaguccuaggcaguugcugaaaucuuugccuuuuauuuucuuuuuugagcugggaucuugcucugucgcccagacuggaguggagugcaguggcacagucauagcgccauguagccuuggacucccaagcucaagagauccucccgccucagccuuacaaguagcugggacuauagguacacgucaccaugccuggcuaacauuuucuauuuuuuguagagaugggguauuuguugccaaggcuggucuagaaguccugggcuuggccgggcacagugacucacgccuguaaucccagcacuuugggaggcugaggcaggcggaucacgaggucaggaguucaagaccagccuggccaauauggugaaacccuguuucuacuaaaaauagaaaaauuagcugggcgugguggugugcgccuguaaucccagcuacucuggaggcugaggcaggagaaucgcuugaccccaggaggcggagguugcagugacccaagauugugccacuguacuccagccugggcgacagagacuccgucucaaaaaaaaaaaaaaaaaaaggaaaagaaagccugggcguaaggauccuucugccuugaccucccaagugcuggaauugcaggcaugagccauugcacccggcuuuuuuuuuuuuuuuucuuugagacaggcacuugcacuguugccuagacuggagugcaguagcgggauuagaguucacugcagccucaaccucccaagcucaagcgauccucccaccuuacccuuccugaauggauggggccacagguguguaccaucacacguaguuaauuuuuaaacuuuuucagagacgggguuucuccauguugcccaggcuggucuugaacucccggcuuccagugauccuccugccucagcuucccaaagugcugggauuacaggcaugaaccacugcacccaaccuuuuuucauucccuuaacgaaaccuuuggaugaacaaaaauucuuaauuucagugaaguucaguuuaucgacuucaauuuauacauuuuauaaaguuuaugaauuuuuuuuuuuuuuuuuagacggagucuugcucugucgcccaggcuggagugcaguggcuauacccaggugugaucauaacucacuccagccucaaacuccugggcucaaggauuccuccugccucagucuccagaguaggugggaccacaggcacauccaccacacuggcuaauuuuuuuuauuuguaguggagacuacgucuuacuguuugcccaggcuggucuccaacuccuggguucaagugauccaccucauucucccaaagcgcugggauuguaggagugagccacugcacccagccugucugcuaauauuauguuuaagaguucugaaucuuuuuuuaaauuuuuuaaaauuuuuaauuuuuuauuuuuuuugagacagucuugcucugucgcccaggcuggagugcaauggugcaaucuuggcucaaugcaaccuccgccuucuggguucaagcgauucuccugccuuagccuccugaguagcugggauuacagguacacgccaccaugccuggcuaauuuuuuuguauuuuuaguagagaugggauuucaccauguuggucaggcuggucucgaccuccugaccucgugauccuccugccuccaccccccaaagcgccaggauucuaggugugagccaccacaccuguccugaaucuauauuuaugagagacauuggccuuaagcucucuuuuuuuuuuuuuuuuuuuuuuuuugagauggagucucgcucugucacccaggcuggagugcaguggcgcaaucucggcucacugcaagcuccgccucccggguucacgccauucuccugccucagccucccaaguggcugggacuacaggcgccggccaccacgcccggcuaauuuuuuguauuuuuaguagagaugggguuucaccguguuagccgggauagucucaaucuccugaccucgugauccgccugccucggccucccaaagugcugggauuacaggcgugagccaccgcgccuggccaaguucucuuucuuauaaugugcuuuguugucaagaugaugcugaccucauaaaauaugcugggagaguguuuccucuguuuuauggccugaagaguuaguguaggaauagaaucauuucuacauuggaagaauucacuaauugaugucuucuggaccuggaauuuuaguuuuuggaaaguuuuaaacuauggauuaaaaauuuuaaauaggccggguguggugcaucaugccuguaaucccagcacuuugggaggcugaggcagguagaucacaaugucaggaauuugagaccagccuggccaauauggugaaacaccgucucuacuaaaaauaaaaaaauuacccggcaugguggugcaugcaccuguagucccagccacucgggaggcuguggaagaagaaacucuugaacccaggaaguggggguugcagugagucgagaucgugccacugcacuccagccugggugacagagcgagacucuuaucucaaaaacaaaaggcuaggcgugguggcucacaccuguaaucccaacacuuugggaggcccaggcggauggaucaugaggucaggagauugagaccauccuggcuaagacggugaaaccccgucucuacuaaaaauacaaaaaauuagccaagugugguggugggcaccuauagucccagcuacucaggaggcugaggcaggagaauggcgugaacccaggaggcggagcuugcagugagccgagaucgcgccacugcacuccagccugggagacagagcaagauuccaucucaaaaaaaaaaaaaaaauuuaaauaguuauaggacuacagacguuuuaaauuuccucuugugucaguuuagaagguuguauuuaucaggaauguguucaguucaucuaaauuuucaaauguguugcuguggaauuuuucauaauuauccucuaucuuuuuuuuuuuuucuuuuuuucugagacggggucucacucugucgcccaggcuggagugcaguggcacgauccuggcucacugcaacaucugccucccagguucaagcaauucuccugccucagccuccugaguagcugggacuacaggugcccggcuaauuuuuguauuuuuaguagagaugggguuucaccauguuggccaguguggucucgaacuccugaccucaggugauccacccacuuuggccucccaaaguguugcgauuacaggcgugagccaacaugcccagcccaaggaggugacaucuugaggggacaccuucgggguggacagguugagucucugucaccuaggaagugccuccccuuuuaccacuguauuaucugcgguuagcacagugcaaacauggaggccucuuucugucccuauccagcccuggcucugggaguggugggcucgcgacuuaggccugucugccugauuuccugcagagccccccuccaugcgccugaaggcccgacccagcagcccuggcuuuuccgugcuuaccugcagcgccuucuccuucuacccuccggagcugcaacuucgguuccugcggaaugggcuggccgcuggcaccggccagggugacuucggccccaacagugacggauccuuccacgccucgucgucacuaacagucaaaaguggcgaugagcaccacuacugcugcauugugcagcacgcggggcuggcgcagccccucaggguggagcugggugaggucccgccagguggugaugcuccugguuucccguugccuugucucacugcugcgccgguccuuccugagucugaccuuccuccccacugcugccaccuccuugaaucugacugccuugaaccucacgccugucagugcccccaaaaccugauggcuuguccuucccaaggccaacugccuuccgucuccugcugcuucuggccucacugagucugaagagcuguuaacuaccauggccaguccucccugagucugaccaucuuccauccugcugcugcugcugcugcugcugcgggucuuccuggaaucugaccauucguugucugcuaugcccguccucaccaagacugacugccugcugcuuugcuacugcccgggcccaugagacugacuucccacugcucugccugccucuccccacugcacuggcacagccccgccuugccgcugcugauccauugccggugugaccgcggccgcucgugcuguagcugguucuuacguccaaccugggggcagucugcccagaucgccugccuggccucgccucugcccaucagacacuuggugcuggaaucuccgaggcugggagggacugggagcgccccaguucuguguccugacugggugggguggaggggcugcuccacaucucacagcguucucuggcugcagaaucuccagccaaguccuccgugcucguggugggaaucgucaucggugucuugcuacucacggcagcggcuguaggaggagcucuguuguggagaaggaugaggagugggcugccagguggggggcagcgggaggaagagccucugagagagggacagagaccccaagagaggggcacacagaccugggaggacagagacccagagaggggggacagagaucagagagagguggagacagaaacccagagaugggagaacagaggugcagagagagggggacggagacagagacccagagacgggggaacagagacccagaggggacagagagaggugcggacagagggagggggagacagacccagaggagggaggcaaagauguagaaagaggggggacggaaaauugggagaaggggagacaaaggcccagaaggaaggggauagagacugaggaagagugugugagacacacacacaaaugggggacgccagucagacccagagcgccucagagauucugaugaccucucccucucucucucuccucagccccuuggaucucccuucguggagacgacaccgggguccuccugcccaccccaggggaggcccaggaugcugauuugaaggauguaaaugugauuccagccaccgccugaccauccgccauuccgacugcuaaaagcgaauguagucaggccccuuucaugcugugagaccuccuggaacacuggcaucucugagccuccagaagggguucugggccuaguuguccucccucuggagccccguccuguggucugccucaguuuccccuccuaauacauauggcuguuuuccaccucgauaauauaacacgaguuugggcccgaaucaguguguucucaucauuuuucaggcaggggagguaagggaauaagucgggggacugaauggcggcugggccucggaucucuccuacagguaac

SEQ ID NO: 191768 - RNA, 23406 nt, Homo sapiens
ugcccacuaucaacaggaaauuaauuuuauuuuuaaauccaaggggccagaacaaaugagacaccuacccuuggaggacaaacucaaguggccaagguugggggaggggaugacagcaaggggcugggcaggaacgcguccaaacacagcagauggagaggacgaccucuucacuccggcgcagccuccaucaaauacccauucuccggagccagguagccgucgccgcccucagacuccauguacaugucucggcugucguugcccagacccuccagcccguuguccuggccaccgcccccaccucgggccucaucccugccccgcucacugccccgcuccccccguuugugcucgcggucacggucacggucacgaucccggucccggcgccgcucgcgcucgcuccgguggcuccgccgucgcucccggucacgaucccggcccuuuuccucuggaccgucagggccgucaggcccgagcuccccuggaggcccaucaucagggggcgcgucacccgccucggagggcuccgccaugucgccaccgccgccacgcagcuccuccuugcgcucccgcucccgccgggcccgcucccgacuccggcugcuucgccgcuuccggucccgguccuuguccuugcuccgcucccuggagcgccuccgcuccuccuugucgcgacuccgugagcgccuccgccggucccgggagcgggagcgucgccguucucgcuccuugucucgcucccggcuccgcucucugcgcucccgcucacggucccggucccggucccugugcggaagcggggaggggccgggccuggaugaggugggcagaccuguguggcugggcuccccccgugaccgccccccaccccaggacaccggucgcccaaucuuaccucucaucguagcgggaggugucaucgcggccugaaugccggauguucacaucagccccuccucuucugguaccaccgaggccuccuccuggggcagggcagacggacagagggugaaucugggcagggacagggcccggaggagcagaaaugagccgacuccaagagcaaagggcaggaaggcagccccuggcuuaguguucacagggccggguccccccgugcaguucaucccgcgcacucccaucacaagacagccacgucuucucuaauuaacucacacaaagcguucgcuaggcaacagccguuacuggaacccaugucuggccccaaagcgcaucaucuuaaccauagcgcacuucacagccuccucaaaacccucccuuccaaucauccucgcccucacagaaacccgaagccaaugaucuuuccacccaaaaaugugaucugcuuagaagccuuugcuggcgucccccagccuaagguccaaacuccucgucaacuggugguagaggcagcaagagcgggcccugcuagcgucugagccgcggcucuuggcugcgugucccaggccuuucccaguguccccacgcucaccuuccugccagugucugugcauucuccuugcccuggacuggucuccccuuccuucucuggugaacucacgcucacccuuaacgcuagcccgaacauccuuucucgggaagucucuccucacaguccuauguacucacaguugcagaaacgcuuccuuccccuggaguuucagguuugcuaccugagucgaccccuaccugccucucccaccagacugcagggcaccggaaccgugggcaugcccagcucuugcucacgguaccagcagguggcgcugcagcugguauagaaagguggaugugugugugucaagugaauagauagaugaacagccccaaggcacagaugauaaccucaugguucugauggggaaacaaucucagaucaagucacuggcccacagugacucagcaaagaaggugcagaacugggcugucacugccgucugcugcaaaaccugccuucucaagcgcuccucuaucucgcacugccuggaaaagcuuccgugaggcagggcugaguucuguauagaaaagaggcugcagggagacauucuuauagaagcaggcagcggaccaggcaccugccaugucacaggcacagggcagcuagacuagccuuuccuauauucaggucaugacccagaaaugagucccaucaucaaucugauggguugcaaccaacaucuuaagaaacaaaacagcagaauacaacuauauacuuacuacauagaaaaaacuguuuccucaaacuuuagguuacaguauuucugcgggugcaccgagucaagauguuauuggcuaacaccaacaaaaaguuugaauggcaauugaacuagaagauucugagauucuggaaagacugagauucuagcauuuucccgccccaacaggaaacagcagagcuauaagaacccacuccaccccagagagaccagaguaagguaagaacaugccugguaagcuccgaggcucagcagcugagagcguggucucccuagcacaggcgaguccagagccaggacacagggcugggaggcaggacaggagccccaaguggcuacuacugccugggugucugcccagggaccaucaucuucucugacaacugucacucagcuuugcaggauucaguccucaauaagcaugccugagcaacaggaccccaggcccaacacugagucaaucaaaugugcccaccccgaaacaagagacucauccaggacugaguguaaagcuggggccuguggccugcugcgcugggccagugcaaagaggcaugggaccgaccuagcugcauggaggcaaacgaggcagaagcaagcugugggcugucacacaucacaggugggucgccccaguuuuuuuguuuuuuguuuuuuuuuuugagacagagucuugcucuggcacccaggcuggauggaaugcagugacucuaucuuggcucacugcaaccucugccucccagguuuaagcaauucucugccucagccucccgaguagaugggauuacaggcacccgccaccacgcccaguuaauuuuuguauuuuuaguagagaugcgguuucaacaucuuggccaggcuggucucgaacuccugaccucaugauccacccgccucggccucccaaagugcugggauuacaggcgagccaccacgccuggccugguugccccagcucuuaacagcgucagcuaccagguucucagguccacggacaucacauaccuccgaacuccaaaggaugcccaugauucuacaucaacagggcccuuuauguuucaggaagcucaaguuuauuucugauacuugcagccaaacugaccuugccugagacagcaaaugacaaugaggagaccgaaugcaggaggcucagagggcagaggcugccucuguguugcucaacuagaagcccggcacacagcuggugauccaauagguacuugcugaaucaguaaaagagugaacaagagcaacagcaagcagcagaagcagaugagcgagugacauuuacaaccccagcaugcgucacugccaagcugggcgcccaguacacugagcucagugaacucgggguuauuuccacuaagaggaguacaaugaggcaggaaaaggggacccccagcuagcaagggcggacgccagcaugugggcucaggccucuccaggcuggugccccugcuccucacaguaacccagaacgaggaggcaggcagcugucagaaaugugauggccacaagagagagaagccggagaugaggacgcgaugggagaggugggccggcaggagacagagaagcagaaagcagcagagaagggagaacaaggccaccaggcccagggcccccgagagcccgucgaaggcaggaugugcucaccuagccgccggggccuccagcccuucacgguucggccccucuccacguccacaaggacccuccugccaucaaucuucuugccaucugcguguuuguaagcggcuguaacagauguggggagggggaggggagaggaguccccagaggguccucuagucaggacaggcccagcucuacagaauccccgccccguguccccaucaucacgcacacgcacacgcccaacagacagccaggcaacugacagccagaccaacccucucccaaaccggugaagggccugcuccaucucagcgucugcuuccucucagcgccccaaccacuccuggucgggggagacguccacccucacccgccacccccuaggcuccccggcccuuccucucccacaugauggaacagcccccucccgccagggcggccaaaaucgcugcaaagaaacugaagguuaacuccacgcuggacucugcugugggggagggggcuccuccacaaccccaagcaugcacccugagacaccaagccggggcaggaggcccagcugggacgcuccgcaccccagaccacaccgguuuuuucuguuuuuguuuuuuuuggaggggggugaguguggggggaacagacaucagaacagaaaaugaaccagaagggggugggagaaaucuucaggaaauggcagggagcagagaggcggguuauacacucccagggggccuggcggggccccugcagcaggggagaggggcaguggaggaagcauggggagccgugcggugcuacugaaaaucccugccuuaccugagacgacugacucugccuccccccagcccugccccaucucgcccuccacacccccggcucaacacgugcugggagcgcaccccagccugagccugccaggaaaggggagucguagaggggagacgggggagaggcucacugcugcucucgggcagcgcguagcagaaggcaagccugaggcccuggccugugaucaacguggggcugucaugaaggccaaaaaguccccguucccccacccagcccuggccuagggggcuguccucaaccaaccguaauacccugccccgccccagcccgcucccccccaaauaacaaccagaggaagagaaaaaggugccauuuaccgaugccggccuugcggguguccaaaccgagcgggauggggggggcucggcaacuccugggggccuggcgaggaggcgggcuucccgggggggggacacgggaccgcuuaccuggagcccccaagcuuaccugagcacgcgcacagaccccacacccaccaccacggggucagcuaaagcuacagggaggggaagugggggguucuagggagccaggagagggagaggaaccacaucuccuguaccaccuggagacaggcagaggacgugguagaccccaaagaaaucucaaggaggccuuagagugggggagacgaggauuaucauccaagcugggcgcuggaaagcccuggacuaucucgugugaauuuacaaagaaggcuagggaggccucagaaaccuguccgcccucaccaauccccgagucacacugaacuaggcacacagcccacccccuccgaggaccaggagugacuucuccaccuccaaauccaugcucccucccaccagcugcgucugcagaggcuggcacacagggguccaggagacggugcugcccgugcucugaggaggggccgcuuggccccugaacccacgggaggggaguggggaaaggcauuuaaggaccaggaucaaagucaagcgaaggaaccccgcucggguucagagucccaaaccccaaaacaggcccaucccgggaggaacagcaaagaaaacaugugauuguguucgucuaggccucucucucucuuucccucucucaagucucuagacaguggaagguucuuuaguaaaaaccuacgacaccuucagcugcuagcagccuaccccuuggucccucccacaccccaagccccaauuccaugcacuuuagggagcuccugaccaccucuggagagcugcuggacaccacagccagcccccucgggaggccucaaccacaguaaggaagacagaaagggggcagagcaccccaaaacuagcagccaaaaagacucuccagggccagcacaguagcagccccauagaaagcacgggggcagggagggaaggcugaagggcuccaguggagcccuggccuggagcccugcccucgguguuccugccaccucgccgcugacaucacgaagccgggucaucagaggcuggguggaacccaagcggagaggccgccgccuuucccaccagguucauccuuccccuccugggaucagcaagauucucagagagcauacggaucggggcaggagggacaaagggcacccaaacaaggaaagggccaugggugcggggaggcuacgggggcgacuggggugggaggaggggcgccucgcugcuccugagcugccuggcuaagcugggcuggugugcggugcugagugaucuuacccaugauacaaacccuuauaccaaccauacacugagguguuguaaggggagcguaagcaucagcugcaagccagcugcgugguggcugcagugacaauaagaacagucaauuaauacggcggccccuggacacgccgcagcccugcccacccucccccacccaucccugcccauguggacgccgcggcagccucaaagggggcuuuggaacuguaggggcaggcgcucaacaugccuaucaccccacugcccgcugaggaacaggguggggggccaggguuggggaagcggagggucggguggcccagccccaguucuacuggggggggaagagagggcagguucaaaggccaguccucauugcaaccuggccacccccaacuucaguggggggaaugggggagguucccccaaaauccgaccccuccccccaccuccagcuggccccagccccccacccaguucccucuuugccccugagguucaacgugugacacuuaccuccccagguucacacacacacacacguugugggggauuugguuuuuguuuuuuaaaaaacacguauauaaaaaaaaaaaagauacaucagaaacagagggaggaggagaagagacaucgcuaaugucagguguggcagggugggggaggggacagacugggaggggcuggggcagcagagaagugagagcaggucagagggcagggcucggcgggagguacucacagugcaugucucgcucguguucguacucgaugaaggcauagccacggggcuuuccugaccgcuuacuguagaccauguguaucuguggggcacauggggacaggggugaguccugccacagggcggcuccgccccaccaaccccacaacagccugcacaccaggcccugggccggaugaggccucagacccucucuguccuucaagagcccugagugacuuauguucuaauggcaggagcagaggacacagaggcggcuuccuggagaaaaugacacuuaagcuaagaccuaaagaaagaagagagaugaaggaagacagugaggugucagccugucagguggaauagcaguaacuccagagguccaagggcccgggggcaggagggcaggaggcuggggaugcgcuucggcagggcuggcucauguacugaugacagagagucccaggagaugaagccacaaaggugggcaggcccggggucaucaagcgccccaaugccaggccgagaaguguggucgcugaggagcugggaaggguguugagcaaggaagggccaauguggguggucuacguggagucaggaggacacaaauggaauuagggaaacaggagggaguugugaaugccaaugggacgggaauucuuuuuuuuuuuuuuuuuuuuggagacagagucuugcucuguugcccaggcuagagugcaauggcucaaucucagcucacugcaaccugcaccucccggguucaagcgauucuccugccucagccucccaaguagcugggauuacaggcgugcgccaccacaccuggguaauuuuuuguaucuuuaguagagaugggguuucaccauguuggccaggcuggucuugaaauccugaccucaugaucugcccuucucggccucccaaagugcugggauuacgggcgugagccacugugccuggccaaggacagggaaguucuaagggaaaaagaaaggacacgugcacagccagggaggcuugagagaacguggcacgaugagggaugcgucccaucccgaggauggcagcaagagaagggaggagauggggugggguggagguccaugaggccacacagcuuggggaagagcccuggaaggccagaugguggcagcuggaccuguccuaacaugcuagggacccaugggaugcugucagcagagauggggucagcucuggaugucagaaagaccccuuggggaccaugucagggagaacaacgggcaaggcagggcuguugagacagagguggccagaaugaaccagggaagauuucugggagguaacagcauuugagcuggucccuaaaggauggcuaguucgccauucacaucacuaccaguuggcgaccaaccuguaucauggaugaaccugggaccccacagccuccaaaacacaaccaagauuccugacuugaauggaucagagggacaaggguggggccaagguugucacugggcugugcaaggcagaacaacguguguguguguguguacacauauauacacaugcacauacacacacacacacaggcacgagacaccacacucggcuaaucuuuuguauuuuuguagagacgggguuucgccauguuggccaggcuggucuugccuccugaccucaggugaucugccugccucgcccucccaacaugugggauuacaggcgugagcuaccacgcccagccuacaauacuuuuuuuuuuuuuuaagauggagucccacucuguugcccaggcuggaguacaguggugugaucucggcucacugcaaccuccgccuccuggguucaagcaauucuccugccucagccuccucaguagcugggauuacgggcgcccgcuaucaugcccagcuaauuuuuguauuuuuuuuuuuuuuguacagaccagguuucaccauguuggucagacuggucucgaacuccugaccucagguuauccgcccaccucggccucccaaagugcugggauuacaggcgugagccaccgugccuggcccaacaauacuuuuuuuuuccuuuguguggagaacggggucuugcuauauugcccaggcaggucucgaacuccuggguuuaagcuauccucccgccucugccuccuuaagagcugagauuacaggugugagccauugcacccggccugacauguauaaauauuuuuaaaagacguaucagaaacagagcagggagaagagacauggcuaacaucaguuuguguguaggauggccucaagcccucacuacugcccagugaaggcaugcgucucccauguuagauaaaggaaaucagacacagagcacuucagugacuuaaaagaagauugguaaaacaaagccuuccucuaaaacgggacucagcauagguauucugccaagacccagagaguagauauuuccagcuuggacggccguauacuguugcaacaauccaacccugccuuacaacaguagcagccaaagacaauguguaaacaaacagaccugccuggcugagcagcaggaaaacuuuaagucuguaguuugccaaccccugcucucaaccaaccaccagcagucauuacuucucauuuuacuucugcugcccaaggucugcugcauggagauacagucaggaugcauaaauccaggcccugaaauggugugagccaugcucagggcugggaccucucucccucccucucaggauacagccccuccuccaugcacccccaauucaaacacccugacccacuccacuuacucuuuugauagguccguacaccucaaacucucuccggagcuuggauucuguugugucauaauucuacaaggagauggauaugacguuaaaugggagaacagagcugucccacagccccuggaacauuccccuguaccuagccuauuugaccuuugugccagacccaggcucucagcagcgugggguuccaggagcuaggagcuggggacuuaccacucucgccacgaagagagucuugaaggcaucccccugagcauugggaucauugugaggguccccugugcaggaagaaaggaauuuuauaaguugaagguguccauggucucagguagcaaaacaaauacgaugggcagaggccaagaagaaaacgguggcauugggagaggccccuaacuggaggaacauggguggugaccuggcaaccucagggacgccccucucugaaccuguuucucugaggcacagugggcuuuaucagaguggcugagagauaauccaggcugcugaggagaggagguaaggcugacuucaagcugacaggaugugggcaggcccaacugccauuucagaccuacauaaacccuaagggcccuaucgcucccagaugcaaggugauccaaacaguaauagcccaacugggccucccuggagaugcagcugaugcccccagguucugagcucccuccuguaggcagggccacacugccaccuacuggacacagacugcaacuacagcccacaggaaaaccugagaccaagcugccccaaggcuaagaaugagagccaggaaagcaaacacuaaguaagcucugcuuuccugucugugcccugugucucuaaaaaggaacccaggaacugacuagcgucagaucagauucucacuccagccucacuacugugaggcaaacuguucuaccuggcuacuaaggaauaacaaucuccaaagaaaagagccaggaaucuccuaagaaaccaauuucauaggugauccugcugggucaggccugggaauaaguccuuuucaccaaauaugguggcuccagcacauaaugacccugacuccugccggggccuuaaggacacucugccgguucuuccaugguauaguguuucccucggaagcccugucacauucugggagagcaugagaaaaggaauaacauuaacccauuuaugccagagguugcaauuuuuugaauugcagacacgugugaaaaaucagacccuggugaugacccgagcaguaggauauaaauaacucccacaugcuuagcguuccaauaauggaacauuagacauauaauuuacugaacacguacuauggcccagacacagugcuggacacugauauuuauuuauuacuauuuugcaaauggaaguaaaacagaacaaacucgagacacagaaaaagggagguguuaaaguggcgaagggccaaggcagacuucaccucucaccccgggcacuugaacuaccaggcuccuuccccgaacccucgggugcuaccuuuucaggaagacaguguggguguugccagaagcuagagaaauaaagucucagauuuuuuuuuuuuuuaaacagagucuugcucuguugcccaggcuuaaagugcaauggcgcaaucucgucucacugcaaccucugccuccgagguucaagcaauucuccugccucagcuucucaagcagcugggauuacaggcgugcaccaccacauccagcuaauuuuuguauuguuaguagagaugggguuucgccauguuggccaggcuggucucgaacuccugaccucaggugauccgcccuccucggccucccaaagugcugggauuacaggcaugaaccaccgcgucccgccagauuuguuucuuaugagagaauuuaacuacaaguauaaacuaaggucaagaugacuuuaaggaauguacuuuuuuugagauggagugucacucuuguugcccaaggucagugcaauggauggcgagaucucggcuuacugcaaccuccgccucccggguucaagcgauucuccugccucagccucccaaguagcugggauuacaaacacacaccaccacacccagcuaaucuuuuguauuuuuaguagagacgggguuucacuauguuggccaggcugguuucgaacuccugaccucaggugaucugccugccucggccucccaaagugcuggcauuacaggcgugagccaccgcaccuggccuaagaauauuuuagaaaacagaagccuaagccacaauuuaagggaaucgcuaucugggacaaauggaaacgucugaaaacaacuccaucucagcguucucuccacccacuccucaaguuccuugccaggcugggcacaguggcucacaccuguaaucccagcaauuugggaggcuaaggcggacggaucaccugaggucagguguuugagaccagccuggcaaacauggcgaaaccccgucucuacuaaaaauacaaaauuaccagggcaugguggugugcgccuauagucccagcuacucgggaggcugacgcaggagaauugcuugaaucugggagguggagauugcagugagccgagaucauaccacugaacuccagccucggcaauaaagcgaaaaaaaaaacaaaaaacaaaaaacguuccuugccauaccuuaucccugagcguuguaauuuucuauggccaggucucucaaucugcacuggcuuuuuuuuuuuuuuuuuuugcaccagcuaacucucauucauucaauagguaauucuuuuuauucgccgauguuugugcucuuguaaguaaguaauucuuaagcaucuacuaugugccuggaaaugcuauaguuguuggggauuucgcaguaaacaagacaaaaaaaggugcugggcgcaguggcucacagcuguaaugccagcacuuugggaggccaaggcaggcggaucacuugugaccaagaguucaagaagaccagccugaucaacacagcgaaaccucaucccuacuaaaaauacacaaaaaauuagcugggugugguccagcuacucaggagacuaagacaagagaaucgcuugaaccagggaggcgaugaagguugcaguaaaccgagaucgugccacuacagucuauccugugcaacagagugagacugucuccaaaaaaaaaaaaaaaaaggugucuacccucaugggguucauaugcuaaugaaagagguaaauaaggagauccuaugaucacaucagaugacgacagagaauagaaacgggugacuuuacaaggcagguuagaaaaagccucacaagaugcuaacauuuaaugaagagcugaaagcugucacagcagcaaggaaacacacccggcaacgccagacagcaggcauucuaacaguuacuguggagcaugacagugggaccaaugaaugcugcagggcuggggaguggacgaaggccaaacaacagcugagcuuccugaagggcagccagagggaaaccaccccagcacacugugugaguucccuggagcacuugcuuacccggggugggggggccacaaaugugacuaaagguaaaaagcaaaugcagcaaagcaaugguacccccaaguccugaagauagagaacaaaagcucaaagaagguagcacagacccaaugccgggcagcgccccacagccagcguaugcgugcagcgcccugacggcagcucucccucaggacaucacugguugagggcucaucuaaguagcagcccagagcagagacucaacggaagugggucguggaguugggaauuaggcuuugagguacucgaggucccaucuuggaacucucacucuuuggaagcgugcuugccucaacaagccuccauuucuuuaucuuaaaaaugggaguagcaaccccugcugcacuuggaagcugugagaaagucaguaacaccaaguacaagcgcucagcaaggaggcaccguccccuugacgggagcuguucauugugacaaggcacagcaagcuucuauagcuaugaguggaggcucucaagggcacagaaacccuacugaacuugauccauucuuuuauuucuuuucuauuauggagaaguucaagcauuuaauggaggcagagcaguauaacgaacucccaugagcccgcuuccauuaucaacacguggacggacuuguuucaucccuauccucccacagcccacugcauuuuuuugagacggagucuugcucugucaccccggcuggagugcaguggcaugaccucagcucaccccaaccucugccuccugaguucaagugauucuccugccucagccucccaaguaguugcaauuagaggccccugcuaccacacccagauaauuuuuauauuuucaguugagacaggguuucaccauauucaccacucgaaccuggaucacucaaguaauccucccaccucagccucccagagugcugggauuacaggcgugaaccaccacgaccggcuggauuauuuuaaaugaaauuccagauagcacaccauuuuggucucuaacaaaggcuuuuaaacaucauaaccacagugccacuauuacaucuuagaguuaacauuuacuaauuccuuaaccucaucuaugauccaguguucaaauuccucaauuggaacuuuuuuguucgcccaauuggaacuuacuuguuuguuuuuugagaaggagucuugcucuuauugcccgggcuggaguguaauggcgcuaucucugcucacugcaaacuccgccucccggguucaagcaauucuccagccucagccucccgaguagcugggauuacaggagcccacuacaaugccuggcuagguuuuguuuuguuuuuguuuuuguuuuuguuuugguauuuuuaguagagaugggguuucaccauguuggccaggcuggucuugaacuccugaccucaugugaucugccugccucagccucccaaagugcuggacaacaggcaugagccuccgugccuggccuggaacuguuuuuuuuuuuguuuuuuuuuuuuuugagauggaaucuuguucugucacccaggcuggagugcaauggcgugaucucggcucacugcaaccuccgccucccagguucaaaggauucucuugccucagccucccgaguagcugggauuacagguacacaucaccacgccgggcuaauuuuuguauucuuagcagaaacaggguuucaccauguuggccaggcuggucucgaacucccaaccucaggugacccaccugccuugaaggauuacaggcgugagccaccacgcccggguggaaccguuuuuaaaaagcauuucuggccgggugugguggcuacgcccuguaaucccagcacuuugggagaccgaggcgggcagaucaccugaggucgggaguucgagaacagccugaccaacauggagaaacccugucucuaaaaauacaaaauuagccaggcaugguggugcaugccuguaaucccagcuacucaggaggcagggaaaucgcuugaaccggggaggcagagguugcagugacccuagaucguaccacuacacuccagccugggcaauaacagcaaaacuccaucuaaaaaacaaaaaacaaaaaaugaaaaacacuuuuggcugggcaugguggcucacaccugaaaucccaacacucugggggccgaggcagacagaucaccugaggccaggaauucaagguugcagugagcuaugacugcaccacggcaguaaagccugggcaacacagcacgacccugucccuaagaacaaaacaaaacacaacaaaaaaaaaagaggcugagcacaauggcugacaccuguaauccagcacugagggaggcugaggcaagaggaucacuugagcccaggaauucaagaccagccugggcaacauagugagaccccgucucaguuuuaaaguuuuuccaaaaaagaaaaaaaagaagacccacaguggaugugguugguuaagauauagacaaacuaggccggcugcgguggcucaugccuguaaucccagcacuuugggaggcugaagcagguggaucaccugaggucaggaguucgaggccagccuggccaacauggugaaaccccaucucuacuaaaauuacaaaaauuaccugggcaugguggcgcacgccuguagucccagcugcucagaaggcugaggcaggagaaucacuugaacccaggaggcggaaguugcagugagcuaagauaguaccacugcacuccagccugauugagagagcgugacuccgucucaaaaaaaaaaggaggggggugaccaggcacgguggcucaugccuauaaucccagcacuuugggaggccaaggugggcagaucacaaggucaagagaucuagacgauccuggucaacaugcugaaaccccgccucuacuaaaaauacaaaaauuagcugggcguggugacgcacgccuguagucccagcuacuugggaggcugaagcaggagaaucacuugaaccugggaggcggagggugcagugagccaagauugcaccacugcacuccagccuggcgacagagcgaggcugccuccaaaaaacaaacaaacaaacaaacaaacaaaaagacauagguaaacuaguuaagacugugacuguguugucuaggcaagaggugaccuggguggugaugauggacaugaaaagaagggucagauuugugacauuuagaaaauaacacaaauaggucuuggugagaggcugagcaaaagguuagaaaagguguuagaaacaaacugcauggcaaaaaaugaggucaugaccggcacagcugaaugucuaugucccagagaaaacacccaaaggaaaccagguugguggcgagggaaaaccccugugguuuggacacugagucugagaugccucugaggcaggacaucaagacagcguuccgacagccaauguccaaagagugcaccgccagaugucucugucacgcuucugcguaagcaccgugaggaaauccugcacuccaggauuuggaggaaagggauucaucaaaguucacagguauaggaggaaaaccugucuucucacuagagucauguucugagaagugcgucguuugaugaugaugucgauaugccaacaugagauggcacuuccacgagccuagacagcauaccuaacacuccugggcuagagggugcgucccacugcuccgaggccaagcguguuacuacaccaaauacuacagcaauccuaacacaauaguaaguauuugugcaucuaaacguuaucaaagcauagaaaggguacaguaaauagacgguauaaucuuuuuuuuuuuuaagacagauuuuugcuuguugcccaggcuggguugcagugagccgacgcgaucccggcucacugcaaccuccgccuucuggguucaggagauucuccugccucagucucccgaguagcugggauuacagacgcucgccaccacgcccagcuaauuuuuguacuuuuaguagagacaggauuucaccacgcuggccaggcuggucucgaacuccugaccucaugauccgccugccucggccucccaaaguacugggauuacagcgugagccacagugccuggcaaaauaugauauaaucuuauaggaucaccaucacauccacgguccccugcugagugaaacacugcuaugcugccugugacuguacaguuuucacuuucagaauaaagagccacuggagguugacaucugacccucuuaugaguuugguuaauggcaacaacacaccugucuuguacuccaauuccuccucuauguggaggggauggaacauccucagcccaaggguuggggaccuaagguuagagccaggacagaccacuaucccacaacccaccacuucagccugugacacccagcuggguugugggagccccuuaacuguccucccaugcaggaggagcccaagguaccaggggucucccuuccugccaacuuuuacccuauguucugcugcugaaaagccuaaaccaaaaacagugcuugugaaguggcaggggcuaaacaaaugaacuaacaacccuguuccccacaacacaggccuuagggagacagcaggguccuggguaugaccugggaagaauacagaggguuugggagaggagagagccaaaugguggaugagagacuuacacauuuuaagcucugucuccacuucuugcugucgccgcucaaucuuuucccgucucugucaggagaaaggggagguggagaagugaaugcagauagaagugcccuagugucaaggaucaucuggagacagugguaaaacagggggucaggaagcaaaaaugacauacuuuccucuccaugcgcuccucucggguuucagcacgaguuggaggaggggcaucucgaggguccugggaacaagaagagaggugacagggugggaaggacugggggaaauggcaagggacacucaccaaggaaauaaacagguuaacccucccacccccacccccuacaaaaauaaacauccacgcacacuuccccugacacaguggagggaggggaguggcacagaucaaagcaaggucugcagccacgcacaguggcuuccacuuguaaucgcagcacuuugggaugaugacacagggagaaugcuugagccuagggguuucagaccagccugggacaacacagugaaacaccaucuccacaaaaaauuuaaaaauuagccagguguaaaggccgggugcagugcacacgccuguaaucccagcacuuugggaggccgaggcaggcggaucaugaggucaggagauccgagaccauccugacuaacauggugaaaccccaccucuacuaaaaauacaaaaaauuagccgggcgugguggugggcgccuguagucccagcuacucgggaggcugaggcaggagaauggcaugaacccaggaggcggagguugcagugagccgagaucgcaccacugcacuccagccugcacaacagagcaagauuccgucucaaaaaaaaaaaaaaaaaaaaaaaauccugucucaaaaacuaagcaugguccauggaccaguacuaucuaaacuguugcuggacugugauaaguacagaaaccaggacuaaguguucaggaacuucuacaguaauuucacaauuugauguccacugacucuuaauacaaauuuggucuuuuauucuguaggucuuuuuuuuuucugagacgaaguuguggucuguugcccaggcuggugugcaauggcgcgaucugggcucacugcaaccuccgcuucccagguucaagcgauucuaagcccugcuuuccccccugugcccgucucucuaaaaggaacccagcaacugacuagaaucguucaagcgguucuccugccuaagccuccugagugaguaccugggauuacaggcacacgacagcauguuggcuaguuuuugcauuuuuaguagagacaggguuucaccauguuggccuggcuggucuugaacuccugacuguagaucuuucuuuaaaaaguaauucuaucauauuuaucaaaagcaaacagauuggaaacaguaucuguccuucaccaaagacaguuugaaaagcacugguacaggugacaucuagcuuuauaguauuuaggaaacacccugucuuccauauuuaggaaagacauugcuucucacagcuccaaguaucacucacauugaacaaagugccagaggaugugaugggaguggagugauggcagggcccugcuuaugagugccagugaggaugaccaggccuaaagcaacauaagcugacagaacagggcuccaaagcccacaacugcacacccucugagggccaaggcagcucuuaaaggucucaucaaccacacauuaaauaggaacuggcugguagggugcaguggcucaugccuguaaucccagcacuuugggaggccaaggcagacagaucacaaggucaggaguuugagaccauccugaccaacauggugaaaccccgucuuuacaaaaaauacaaaaauuagccaggcaugguagcgcgugccuguaaucccagcuacucaggaggcugaggcaggagaauccuuugaacccgggagguggaaguugcagugagccuagaucacgccacugcacuccagccugggcaacagagcgauacuccaucucaaaaaaaaaaaaaaaaggucgggugcgguggcucacgucuguaaucccagcacuuuggaaggccaaagugggcagaucacaaggucaggagaucaagaccauccuggcuaacacggugaaaccccaucucuaaaaauacaaaaaauuagccaggcgugguggcgggcaccuguagucccagcuacucgggaggcugaggcaggagaauggcaugaacccgggaggcggagcuugcagugagccgagaucacgccacugcacuccagccuaggcaacagagcgagacuccaagucaaaaaaaaaaaaaaaaaaaaaguaccuggcucccaggcaugguggcucacaccuguaaucccagcacucugggaggccaagggggguggaucaccugagguuagggguucgaaaccagccuggccuacauggugaaaccccaucucuacuaaaaauacaaaauuagccaggcgugguggugcaugccuguaaucccagcuacuugagaggcugaggcaggagaacugcuugaaccggaggcugcaguuggcuaaaaucacgccacugcacuccagccugggcaacagagcaaaacugucucauaaauaaauaaaugguaacuggcacaugaccugcaucaucaaagggcaccuaccacccgccugugcccauuaaguuaauuggccaguaauaucucucaagugcggguucaccaaggguggcaaaucccacugaagacauaccuuucuguuaucuacgaaauucugcucugcaacucccucgccuccagcugcccuuaccuacccaaugcuagaacguucuucuuguaacuuccgacugugugccagcuuuucucaggugugcucugaugcaccuaagagaugacccuugucaucccauuucacaaauaaaaacacagagguccaggagccuaagucauucauuccuauuuaucccaaaggugcagagcuaagauccccaucugcaguuuuaagcccuccaauacucaauacugggugcuaagccuuuaugaacaucaucuuauuaacaauaaaaguaguaaacagaguaacaaaggcugacaugugcugacugcuuggugccaagcccccugacauacaguuugccauuuaauucuccaccaacauuauaagggugcuaccacuauccccuugcuaaagauaaagaaaccaaugcauuaagaggauacaacauuugcccaaagucagagcugauaaaugguguggguuaggcaugaauccucaaccacuacucacugaauuuucacaaaaauucuacaaaagguguacuaucaaccccacuuuuuuuuuuuuuuuuuuuuugagacagucuuguucuguugcucaggauggagugcaguggcgcgaucucggcucauugcaaccuccgccuccuggguucaagugauucccgugccucagccucccaaguagcuggaauuacaggcaccauguccggcuaauuuuuguuauuuuuagcagagacgugguuucaccauguuggccaggcuggucuucaacuccucaccucaagugauccgccugccucggucucccaaaguacugggauuacaggcgugagccaccguaccgggccacaaccccacuuaaaaaaaaaauuuuuuuuuugagagacgaaguccugcucugucacccaggccggaguauaguggcacaaucacaaagcacuccagccuccgacuccugggcucaagcaauccucccaccucagccuccugaguagcugagacuacagacgcacucgaccacacccgacacccggcuccaaccccauuuaaaacagagaaacugaggaucacaaagguuaagccccucgcuuaaaucacgcagcuggcaaaauggccagaagcuggacucgcaaauccaacccguugcuccccagaacccaaaccauuccuggccugcucagugaacucaccucaaacucucgaauguacggcgcaaugccacaauaagguugauugugguguuuuucauguggcaguuucuccagggguggcagguauggaauagggucacggggggcaaagagggccagaagguugggcggcaggaacugggucaucuugccaagucugagagcagaagcaggacagccuuagguuagaucgggucugcacagagaaagccccuguuacuccuugacucucaaaauaagaaagacaggagaaaagucucggaauuaaaacaggcucuguaagggcagagaacaguccuguguugcggagaaaaggguacgucuugguggggguggaggugaaaggccgguaaagaaaacaaaaauaacggcuggaaaaggguuccugaagagugaagucucagaguccucugacacgagcuguggggcggagagguucccugggaauuucuggggaaaucaaggacccgaggagggaggcccagagcagcuguggcugcucgucccgugccguggagggcaaauuacgagaugcaguuugcaggguccuggggaucggaaguuuccaagcaaagaaagagaaacauaaggagcgaagccccaaaaccaagugcuuguggguaacagaccuggaccccgcaaaaagcgaaaggaauuauggguaaggguccaggacaacauagacaaacgaaaaagaaaaaaggccacacaccgcaagggccuguggguagggaaccacgagggcgcugugggaagcgggcgugggugcccagagauuucgggguccgggaaagggaugcagaagggaccuguggcggggacgcgggaaaggggccuggccgcggggaagaggaccgggcccaccgcuggggcuucuggguagcggccccgcaccccgucgggccacucagucacacucacucaccgcguagcgcccuccucgcucuggcgucuguccggaggcucgcggcggcugcggcagccccucagcaacaacaacuccugcuucggcuuccacuccgggggcguccacguccgucugauuccgucgcccgcuaagcgagcgcaccaggccgcugcucagccacccgcgcggccuccgauagcgacuggagcagggggugggucccggccgcaaaucccuccgccguccucacugcgcacgcgccgugcggugccaacaacaacccacacacuaggacccggcgcugccgcgggcacagcgcacgcgcgaggucacuaccccgccuuugggcaccuugaguaccucagccgcggggggcuggcuucugcacugcgcgcgcgcgcuugccccaagccgccccuccaccucccgcuuuccgcgccgaaccgc

SEQ ID NO: 191769 - RNA, 25229 nt, Homo sapiens
ugggauucuuaaauauagauguauuuuuuucaucucaucuccggacacacuccaaucacaccccuccugcccuccccucucaacugcaaaccaagcggugcagacacagcacagcacacaugaggggcccucccuuucaccaaagcugaaggcagggcacaguuuggggauggaagagccucgagguaaauguggggguucuagaacccagugaccucaguucuggaucaugggaaagggaucaguaugcaguaacgugguaagguuccagaucuagaagccaggaccuagaaccuagugguuucacagugggcagagcaguugggaauaagccagguuaggggugggggaagacagccagcucuguccucugcaggcggauucccuggagggagaucucagauuuagaaaggaagaguaggaucugguccagaaagggccagaaagacaggaaggcaucuggacugagacuguguguccuccagaaggaaugagcagccaagugguucuaccaccucuugcuuggccaaaguguaggggaugacaggagccggauggagggauccuccaggcagagccuggcucugacaugccagggagggcuagaacaucccucccagagccccacuucuggaguugaaauggaggaccaucugcucucaguuaccuucaaacucugaaagugccccggcucuggacuugaucgccccauucgcagggacaccacgugguuuccagaacuugguggcccgcaugccgggccugagcguggccugcucuguaugcuguagaauuuguaagccacacggggggcucuaaaagccccagaccugaaagcaccaugccagguuuccuaaaaccucuggcaccaccgcagaguaauggcagauuccuggccucugggaagcgguccaggcccaggggacuccagggcgcugauuaugcauauucuggagccagagaaaggcacggcuuuguggauucuggagugcaggaacuuggaaacuggagcuggaggggguggaguguuuggcggacugggugggggcacugcggggccacacccagugcagaucuggagcggggguuuaggagcagcaccccucugcauccucucucuggagcagagaggcaggacaggcggggagugugguggggcggacuuaguuacgcuccucgcccagggagcugguggggcugaggggcucgcucggggugcugagugagcuggagguggccguguccacagaguugcgcuugcugccgcugguggaggaggugcaggacgcucggcgcggccacucuggugcacggauguugcgccgguccuuggcggccuccucguccucaucguagcgcucgccgucuuccuccagcggcccguuccggggauccuccucguccucacucuggugcgggcuggagugucgugacagcgagggcgacgguggcaccgaggcuggccguggguagcgguaccccugggccugcauacggcgaugugggugcaaaccagggugagcugaggaccucacagucccacccaggcauccagccaccucuaggccuucccacuccaggagggacccccaccccaccgaagcccagcccuuuagcuccuggcuaagcagaaauccaggguccacucaccgcauccgccucguugggcucguaggugaagugcucuggaaaggccuuggacagcgccauguggcgcgcagacauauaguacuaggggaaaggaggagagggggcagaggaugugagagccaggccccacccccaggcagaugaugggggucuuggccacacccuuuaugcagaugagcacacugcugcaccccauacaaauaauccaucuaucugacuccaccccuuauguagauaagcagaccugugaauggacaguuucugagccauaccccucaaacaggggccgaauucucaagugagucuccucuuuggccacacccuuaugcaaaugagaacgccugaccaauguucuuuuuuucuuuuuaaacacggucuuguucuguuacucuaggauggagugcaguggguuugaacaaggcucacugcagccucaaccuccggggcucaagcgacccuaccaccucagccuccccaguagcugggacuacaggcacgcaccaucacgcucggcugauuuuuuuuuauuuuuaguaaaaauaaaauguugcccaggcuggucucuuaacuccugagcucaugcgauccuuccuguuaggccucccaaagugcugggauuacaaccaugagccaccaucgcgaucggccugguucauugcuuaaagggacagcaacuguuacaaguaggaugagacccugcacccugcaccaaagaccccuagccaggagcugcugauuugccaggagaggauaggaaaguggggguccuacccggccuagguauuuccaguccagaaggucggagaggcgcuccgugcgguuccgcuggaugauacgcugccgccggcucugcugacagaaacuguagaggaaggaggugagcugcgagcaggaaucauccaggcugcggaaccgccggucaagaauguagauaccuguggaggccaggacccagguucagaaaacauccuggggagaucuucauggucuccaggacucuguggcaccaggaccccuccucucccagcggcccgagagcccccccauuuccuggugccccuggucuccaagggugcaagcuccuccuucccaggauccaggagucacuguucucaagcccccuuccagaauccucaggggccugggcgcugaccguaagcugaggggucugcgauguguuccuccaugaagcagccgaagccggagagauugguggagauacuggggauucccauaaccgugcacucagcugcgggaaggcaggagagagacccacuuagcuucccucaucgccuaccgucuuaaucgcaauagacgccucaacaccgcccucuacuggcgccuguaccaagugccaggcgcugugcggagcgucgcugagcccccacaaccaggcugugcauuucccuauuucucagaggggacgcuaagaggcucagaaaagagaauuacuugcucuugcuccaagaugcgggaaaguccauaguugggagauaaggaugcuaauuuauugagcaucccaauauccauuugacuuaacucucacaaccuguaggaucgggccaagguccaucauucuacuuaauugucacaaccuguaagauccuuucuugugccaguaucuuguacggacuuagucuauuuugaugggggguaagauaaggucucucauuauuaguaucccuguguacagagcaucuaguacgucuuguuuaauaccuuuaacaaccuugagaaauaguucaaggaauguauuauaauuuuuugauggauuuuuaugcuuuuuuuuuuuucuuucgagacagggucucacucugucacccaagcuguagugcaguggcacaaucucggcucacugcaaccuucaccucccggguucaagcgauuuucgugccuuagccacccgaguagcugggacuacaggcacacaccaccaugcccaguuaauuauuguauuuuuuaguauagacaggguuucaccauguuggccaggcaggucuugaacuccugaccucaggugauccauccgucuuggcuucccaaaguggucaaauuauaggugugagccacugcgccuggcccaaugcuuuuuuuuuuuuuuucucgagacaaggucucacuuuaucacccaaccuggaggacaguggcuugaucauagcucacugcagccuugaccuccuaggcucaagcaauccucccaccucagccacccaagaggcugggacuacgagcacacaacacuacgcauggcuaauuaaaaauaaaaaaaaaaaaggccgggcacgguggcucaugucuguaaucccagcacuuugggaggccaaggcggguggaucacgaggucaagaagagaaaaaaaaaaaaaccauccuggccaacauggugaaacccugugucuaauaaaaauacaaaaauuagcugggugugguggcaggcgccuauagucccagcuacucuggaggcugaggcaggagaaucacuugaacccgggaggcgguugcagugagccaagacugugccacugcacuccagccuggcaauagagcaagacucugucucaaaaaaaaaaaaaaaucuuuuauagagacagggucucaccauguuguccaggcuggucuugaacuccugagcucaagcuauccucccaccucagccuuccaagaugcuaggauuauaggugugagccacugccccugaccuauaauuauuauuauuauuauuuuagacagggucugacucugucgcccaggcuggagugcaguggcgcgaucucagcucacugcaaucucugccucugggguucaaacgauucucccaccucaacuucccgaagggcugggauuacaggugccugccaccacccccagcuaauuuuuguauuuguaguagagauaggguuucaccauguuggccaggcuggucucaaacucauguccucaagugauccucccaccucggccucccaaaguguggggauuauaggcgugagccaccaugccuggccugaucuauaauucuuauguaaguuuuccuaaaaacaucuguaaacugcaaaaauaggcacuaaauauaauacaucugucaggcauggugggaugcaccuauaaugacagauacucaagaggcugaggcagaagcaccugaaccuaggaguuccaggugagccuuggcaacagaguaauaaccccaucucaaaaaagaaacaaauaguaaaauguauuaaauauauauuuaugauauaguuugacucuguguucccccccaaauuucaucucaaaauguaguccccacgugucgagggagggaaaugauuggauuacgggggugguucccccgccgcuguucucaugauagugagugaauucucacgagaucucaugguuuuauaaauguucguuuuuccugcacccucacauacuucucccuccugccgccaugagaagaagcuucuuucuuccccuucugccaugacugaguuuucugaggccucuccagacauguggaacggugagucaauuacaccucuuuccguuauaaauuacccagucuuggauuuuuuuuuuauagcggugugaaaacagacuaguacuaucuaucaaucuaucuauaaaacaaggccuauggaaaaagggaauuggggcugaccgcgacuccuaauuaucaugcaagcacaguuugcaggacuuguuaaauuacuaauaaauuaggaaauggcacuaauuuagcuuuaauuuuuuuuuuuuuuuuuuuuugagacggagucucgcucugucacccagagcacagcacugccggagugcaguggcaugaucucagcucacugcaaccuccgccucccaaguucaagcaauucucugccucagccucccaaguagcugagacuacaggugcguaccaccacaccuggcuaauuuuuguauuuuuaguagagacaggguuucacuauauuggccaggcuggucucaaacuccugaccucaugaucugcccaucuuggccuccccaagugcugggauuacaggcaugagccaccacgcccagccuuauuuagcuuuaaaaacacuggcuaaugugaaccaacaagaggaagguggaguugaugggcacugggaacgucuuacgaggagacuuggccacacucggcuguauuugugaauugugcauuucauugccacuauuuggggggccacugcuuucugggagaaagcagugugaacugugacauccaguucacuaguccucaaaacccagucuucuaguuucucaauacaugagcuauuguaucacaaaagcacgcgcuguagcagaacaggugauuaccauuguuccuguuuugcaaagaaggcaacaggcucagagaaggccagugccucgccccaagacaugcuagcucugacuaggaugccaugaccacgcuguccccugcccacuacacucacccgguguguagccccaaggcucauaguaggaggggaagacuccaaggugacagccacggacaaacuccucauaguccacagggagcagggggcuuguggaggagaggaacuccggguggaaaaucaccugguagugaaaaagaaggacucagcccaagugccuuauuuagcuaagcccugagaucccaagguggcccagagaggguaaaaagcuugucuagcaucacacagcauguguuuggcaggaccaauguucaaacccaggucugccugccucagaagccaggguucuuucuaaccacagcaauaccuuugauaaaacuuauaggggaauggagugugugaggcccaggacccaaccccuucccucugccgugcccaacccagcccugaccaaaugcccucaccuucacccugucggcacugcuauugaagaggccgauucggcggaugguggucaggauggggucugaggagucauccagcauauugugggugcacacaggggggaaagacugccgcugcaggagccacaagaaggguaaggggucauggaagggacagagaacucccuacuuccucaugagccaugcggacccugggggagccaaggagaccacaaaugcaccggacguggggcaacaaacccaagugaucaccaggaguuguggauucccacuaguacaaccuguaaagguuuucuuucuuuucuuuuaaauuauuauuauuuauuuuugaggcggagucucgcucugucgcccaggcuggaaugcaguggcacaaucucggcucacugcaagcuccaccucccaggaucaugccauucuccugccucagccucccgaguagcuggaacuacaggcgccuaccaccacgcccgguuaauuuuuuguauuuuuaguagagacgagguuucacuguguuaaaucaggauggucuagaucuccugaccucgugauccaccugccuuggccucccaaagugcugggauuacaggcgugagccauugcgcucagccuaauuuuuuuuuuuuuuuuuuuuaauagagaugggguuucacuauguuggccaaguuggucucgaacucaugggcucaagcgaugcauccguuuuggccucccgaagugcugggauuacagacaugagccaccacaccuggccuggaaauguuuuccuucccuuaaccaccaugagcuucaaagaacuagaauucccagcugucuuugaggcaaagccguguuagcaacucccuuaccuccaaggacuaugaggaguugcagcuaccuuguucuguacucugggcucuauuauuaaagaaacccaaaggaaauauaacuauccccagucaauggggguggagacugugccaauauggcagcaagcuuuggagacugcugggaguuguaguuuccuuaugaaaauucacuuccaaccaccaggcgugguggcucacgccuguaaucccagcacucugggaggccgaggcaggaggaugacgaggucaggagaucgagaccauccuggcuaacacggugaaaccccgucucuacuaaaaauacaaaaaauuagccaggcgugguggugggugccucaggaggcuggggcaggagaacggcaugaauccgggaggcggagguugaagugagccaagaucgcgccacugcacuccagccugggcgacagagcgagacuccgucucaaaaaaaaaaaaaaaaaaaaaaaagaagaaaaaagaaaauucaccuccaacccuaacaaaggcccaaagaaaccacaauuuccaagagucucuggagcaagacagagcuagugugauaggaaguccugaggacugcugggguguauaguucuuagcaacuguuccaucauagcucauuaaagauuuuacuuaccaccacucuacugagucuaggggcccgagaaacuacaacucccagcaucccgauggcagaaacauucauaaugaggugggcugcuuuagggacuauuggaaauuauagguuagccaaaagcaguucacguuuuguuucuacaacuuagcugucuggguuuccauuccccaggaaauggcuccccaauguagaccacaaguacugaagucccuggaccccagagaaugaaagaacucuaacucccagaagccucuggacaagggaagcgucaaugccccagaaagccagcaggggcugcugggaguuguaguuuuuugggccccuagacucaauagaaugacgguaaguucucauuuuauaaaugccaauucucucugaaguuagggaucuaaagcagcuacaauucccaggggugucuggggaccaacacacagccucuggaaauaagaaaccgcagcugcugagaguuugcaauguuuucuggagaaugcugggugcuuuugcucaccuccugacugcgucccuaaaguggcccgauaaaacuaccacucccagcaguuuuagggguagagguggagccgugugcagcaaggcccaaggagagcugagaguuguaauucuuuuauggcugucuugaccuuuucuuuucuuucuuuuccuucuuucguguguguguguauguguccgccucgcucuguugcccagucuggagugcaguggcauaaucauagcucacugcagcggcauaaucauagcucacugcagccuugaccuccugagcucaaggcauccucuggccucagccucccagguagcugggauaacagguguaugccacuaugcccagcucauuuuuguauuuuugguagagacaggguuucaucauguugcccaggcuggucucaaacuccugggcucaagcgauccucccaccucagccucccaaagugcugggaauacugacaggugugagcuaccaagcugggccuugacuuucuuuuggggguggguggggggcuagugugggaucuggcucugucccccaggcugguguacaguggcacagucauggcucacugcagccucagccuccuggucucaagugaucuuccugcuuuggccucucaaagugcugagauuacaggcaugagccaccacaccuggcccuuuauuacauuucuacacuuccuuuuaaacuucccuuugggcugggaacagggacucacgcuuguaaacucagcacuuugggaggcugaggcagacagaacacuugaggucaggagcuugagacuggccuggccaacauggugaaaucucguuucuacuaaaaauauauaaauuagcugggugugguggcaugugccuguaaucccagguacuugggaggccaaggcaggaguauugcuugaacccaggaggcagagguugcagugagccgagaucgugccacugcacuccagccugggcgacagagcgagacuccaucucaaaauaaauaaauaaauauaauaaaaauaaauaaacaaauaagcuuccuuuugcucauugaccccagaaucccagagaaaccacacgucccagcaacccucguggcagaauaagccacagaaaacagcccacccuaagugccucgccuccagcaacugaaguugcacgagucagcacgugcccuucuguggaccucagaauagaucccuucauaaagggcugcaggagaaagcaggacucccagcaaucucuggggucugagcuggccuggcaagcugccucuggggcugccaggaacugcuaucucucugcacagagguccaauccauaccugcguugcaaagauggcucucuucaucauagugaagucuuccuuauccagcaucuuguucaugucgggaaggcucccacugcaaggcaagcaggggcaugcaugugagaacggaguaaugagagggguuagucagggccuaggagggcacagggcugaggguggggcacucacaccaguaaggauucauaaagcuuccucccgaacuuuuccuucaccguguuggccgugucccuggaggaagcagagcaacagggucacauacacaccagcugccauuuacuguuaggcuucuuuaguuaguuuguuuguuuauuuugagacggaguuuggcucuuguugcccaggcuggaaugcaauggcgugaucucggcucacugcaaccucugccucccagguucaagcaauucuccugccucagccucccgaguagcugggauuacaggcaugagccaccgcgcccggcuaauuuucuauuuuuaguagagacgggguuucuccauguuggucaggcuggucucaaacucccaaccucagguaaucugcccaccucggccucccaaaguacugggauuagaggcuugagccacugugcccagcaguuuauuuauuauuauuauuauuauuauugacagaguuacucugucguccaggcuggagcgcaguggugcgaucuuggcucacugcaaccucugccucucagguucaagcaauucuccugccucagccuccugaguagccgggauuacaggcaccugccaccaugcccggcuaauuuuuguaacuuuaguagagacgggguuucaccacguuggccaggcuggucucgaacuccugaccucuggcugguaauuggccaccucggccucccaaagugcuggaauuacaggcaugagcugccgcgcccagcuacccuuagguuucuaggauagcaaggaaacugaggugugagcagggaagccgugcccuggggccuccaggcuggaggauggggacccagggggcaggcccuggaaggcuuaggacccacgugccugacaucagcuguguggucagggacagguggccuucccucucugacugcagugacucauuuuucagaggaggaugaaaauagaaucaaccucagagguuugcgaugaggacccaaugaugucaugccaaaaaguacacauggcaagccuuccagaaaugucagcuauuauuaggacuuguacuuguccugcagauggcaaugcuaagccccauuuuauacgaaaagaaaguaagauucugagaaaggaccacuuaggcacacaaguaaagcuagcagugucacacaacagccccacggucacuccuccacuuaaaauccucccauagcucuggccucauuuauuuuucuuucuuugucucuuuuucuuuuuucuuuucuuuuuuuuuuuuuuuuuuuuuuuuuuuuuuuuuuuuuuuuugagacagagucuugcucugucgcccaggauggcgcaaucucggccacuuucuagguucaagaaauucuccugccucagccuccugaguagcugcaauuacaagcgugcgccaccacaucuggcuaauuuuuauauuuuuaguaccgaugggauuucaccacguugaccaggcugaucucgaacuccugaccucaagugaucugcccuccucagccucccaaagugcugggauuacaggugugagccaccgcgcccagccucuuucuuucuuuuuuuuuuuuuuuuuuuugagaccgagucucacugucacccaugcuggagugcauuggcgcgaucuuggcucacugcaaucucugccucccggguucgagcgauucuccugcuuagccucucgaguagcuaggacuacagaugugugucaccacgcccugcugauuuuuuuuauuuuuaggaaagacgggguuucaccauguuggucaagcuggucucaaacucccgaccucaggugauccacccgccucggccucccaaagugccgggauuacaggugugagccaccacgcccgacuucuuuuuuauuuuuuugagacagagucucacucuguugccuaggcuggagugcaguggcgcaaucaugccucacuacagccucaaccuccagggccaaaaugauccuccugccuccuguagcuggcacuacaggugcccuccaucuugccucacuuucuaccccuucucuaugagacaugucacuccagccccaugggacuccccaccgcgucucaaucaugccucggggccuucgaguuugcuguuccucagauacccacagggcuugcucccucgucaccuuuccucgucucugcccaauaacacuuucucaguguggccuguccugacaaccccgucucauauuccaguucugcuuuauuuuugcccaaaaguaaauuccgucuacaggauuuucuagaauacaagcuccaugaggaaagggaucuuaucuuucugguucacagcuguauucccaggaccuggaauacaugaggagggcaggucacuugaggucaggaguucaagaccagccuggucaacguggugaaaucccaucggugcuaaaaauauaaaaauuagcuagcacauaguagaugcucagugaguaucucugcuaaugaaugaacgguuuuacagaugaagaaacugagcuuugcugggaggcggagguuacagugagcugagauuacgccacugcacuccagccugggcaacagugagacucuguuucaaaaaaaaaaaaaaaucagagaaaagaaaaagaaacuaagccaggcgcaguggcucaccccuguaaucccagcacuuugggaugccaaggcggcuggaucaccugaggucagguguucaagaucagccuggccaacauggugaaaccccaucucuacuaaaaauacaaaaaaaggcuaggugugguggcucacgccuggaaucccagcacuuugggaggcugaggcaggcggaacaccugaggucaggaguucaagaccagccuggccaauauagugaaaaccugucucuaauaaaaauaaaaaguuagccaggugugguggcacaccccuguagucccagcuacucagaggcugaggcaggaaaaucgcuugaacccaggaggcagagguugcagugagccgagaucaugccauugcacuccagcuugggcgacagagcaaaacuccaucucaaaauaaaaaaaaaaaagagggccgggugcgguggcucaugccuguaauuccagcacuuugggaggcugaggcgggcagaucacgagaucaggaguuugagacuagucuggccaauguggugaaaccccaucucuacugaaaauacaaaaauuagccaggcaugguggugugcaccuguagucccagcuacucgagaggcugaggcagaugacuugcuugaacccaggagguggagguugcagugagccaagaucgcaccacuacacuccagccugggcgacagagugagacugucucaaaaacaaacaaacaaacaaacaaacaaaacaaaaaacugagacucuaggagaaacacaggacccaaagcaugcaucugggagugggcugcgccaggggccggagcgagggcugcuaaccaaagcuguuugcgcacagcuuggccuuugaggguuuccacguugaaauuguugguccgcgcuggcaugaugaagaaggcaaccacugucugcucgcugccguucaccugcgcagaaagaaaggagggggaggccaggaucaugugggggaagccuggaaccagccagccuuucugucaagaccacugggauccugccauacccauuccugucaaggagaauuauaggacaguccccaccuggacucugaccuucuuucugggucucuauacuccccucacggccccccaccauacucaggggcuuuccuacccccaucuuccuggcuucuuggguuucuguucuguaauuuuuuguuuuguuuuguuuuguuuuguuuuugagacagcgucuuuuucugucgcccaggcuggagugcagugauaugaucuuggcucacugcaaccuccaccucccgggcucgcgugauccuccccguucacccucccgaguagcugggacuacacgugugagccaccaugccuggcuaauuuuuguauuuuuuguagagaugggguuucaccauguugcccaggcuggucuccaucuccugggcucaagugauccucccgccuuggccuccaaaaguguugggauuacaggugugagccacugugccuggcuguucucccuaguuauaaacugcuuugcuugcccucccuguccccucauagcccaggccucacucugagcagauaguugagccgagccaaugccuccaggaagacgucagcacccuuguuggagaacucauagcggccggcgauaaagaaguauaaggucuuguccaaguugaaguccagaugccuaaagaacccacaaggcacgguaaagcccaaagcccucacccgcuagcccuggccucaaaacuacaaaucccagaagcuaugggugggggggcagaggaugucuuagguaauacagaggcaucacggggccuccugggaguuguaguucuucucuuuagauggagauuuccuuuaauccugagcccauuguuccagcgcucaagaauuaaggaggccgaauacccaggugcccccucccucagacccaggagucugggcccccagcugcccccucccccagaccuagaugguuaggcucccaacgcccuccucucuuaagaccuagguauaugccccacguacccauaaaaauggccccgcacaaacuccuggauucgagccuugcucugagcauggagguucuggaacucaugcauggcagaaaacuucuucacauucagcccauugggggucacaauaucugggauugggggugagggucccauguuuuauuuguucauucagaucaauguugugguugaaugaauaaaugaagaaaacacccuuugccuuuugcaauuuuuuuguuucaagagcguuccuaugagguccccccucccaccuuuuuuguuuguuuguuuguuuuuggagacaggguuucucucugucgcucaggcuggagagcaguggcacaaucacagcucauugcaucccugaccuccugggcucaagcaauccucccuccucagccucccgaguagcuggcacuacaggcgugcacuaccacacccggcuaauuuauuuauuuuacuuuuguagugauggggucuugucauguuacccaagcugaucucaaacuccuggcuucaagcagucuuccugcccuggccuccuaaagugcugggauuacaggugugagccaccaugccuggccaguucccuuggugacacaccuacccugacuccaagaugccuucuugccuaauauuacuugcuuagguucacaagcacaaguauaagucuccucagcuacugcaaauggcuaacagggaucugauccacacuggugauucugggaaaguuguacuucuuuuguuuccucuuagcccacccugagauggaaaugauuaaacauccccaaaguccugcuucuccuaggauauauccucuacuuccaagcuucuuacagggacccaaucauuucuucuccucauagaaauuaaaguauaucaacgaaaaacuacaacccccaucagcgccuagggcaaaguucuggaacauauagagcuaaccagucaaaggccuucugggaguuguaguucucaccuuauacucacugagaacggauacuaagggcugggaagaaugcccaguucugaccuaaccuuucucaaaagcaaaguccacugaucuuccauucccuuucauaagaccaaucuacauuagccaauuacagaauuuuaucauaucugaaauuaauaugaaagaaauuauaccucccauuagccuccagaguauauagucagagagccucaaauacaggucaccacccccacagccuucugggagcuguaguucucuauucuuuagguaaaaaaaugguaacugaugguccccagcuuaggacuuaggaugguccaaguuaugauuuuucuuuucgagacagaguuucgcucuuguugcccaggcuggagugcaauggcacaaucuuggcucacgacaaccucugccuccuggguucaagagauucuccugccucagccucccgaguagcuggguggcugggauuacaggcgccugccaccaugcccaccuaauuuuuguauuuuuggcagagagggggucucacaauguuggccaggcuggucuugagcacaugaccucaggugaucugcccaccucagccuuccaaagugcugggauuacagguguaagccaccgugcccagccaaguuaugauuuuucaaccuuaugauggugugaaaguuacauacauccacaugaguccaauuuuggauuuugaugagauauucaacacuuuuuuuuuuuaauuuuuugagauggagucucgcucuguuguccaggcuggagugcaguggugugaucucggcccacugcaaccuccgccuccuggguucaagugauucuccugccucagccucccgaguagcugggauuacaggcacccaccaccacgcccggcuaauuuuuguauuuuuaguagagauggaguuucgccauguuggccaggcuggucucgaucuccugaccucgugaucugcccgccuuggccucccaaaguguugggauuacaggugugagccacugcgcccagccuauucaacacuuuauuauaaaauagguuuguauuaaaauuagccaggcgugguggcaggcgcguauagucccagcuacuugggaggcugaggcaggagaauggcaugaaccugggaggcggagcuuacagugagccaagauagcgccacugcacuccagccugggcgacagagcgagacuccgucucaaaaauaaauaaauaaauaaaaauaaaauaaaacagauuuguauuggaugauuuugcccagucguaggcuaacauaaaguguucugggcacauuuaagguauacuagccuaagcuaugauguucaguagguuagguguauuaaaugcauuuuuuuauuuuuugagacagggucucacugugucacccaggcugugacagggucucuccaggccacccaaaucaugcaauggcacgaucacagcucacugcacccuugaccuccuaggcucgagcaauccucccaccucagccuccugaguagcuagggauacaggcacacaccaugucuggcgaauauuuuagacagggauucgccauguugcccaggcuggucucaaauucccgggcucaagugguucuccugccuuggccucucaaagugcugagauuacaggugugagccaccaugcccagccgaaauacguuuucgguuuaugcuauuucaacuuacagugggcuucuugggcugaggagcaacuggcuuuggcauagacagcugccuaccucauucacgucuggggacuucagcccagccccuaccugguuuccucuugagcaagugcugugccucgauggcggugaucugggacacaguagugaagacgugagcgcagugggcugccgcccuuuccaugcaguaucggugguagaucugccucuccccugcuuccuuguccacguugaacugggugggaggggacagcaguccgguuagaaggauuggggagaagacucuggagguccagacacuggggucccaagagaaauuggugcugggggcuggauuccugggucugagguaggaggggucuggggacuuggacuccuggauccugggagaagagggggugccauccccuugggccccccagagcuuuggguuuuccuggcauacucgcagucccccaucugccacggucccagcucacguucuccagguuguuguagaaguccacggcaccggcacacagguagcgccccagcagcguggcauggguggugaagaugguugcuacaggcagucgccgggcacgacacaggcagaguccaacgccugccaaccacucauggaagugagcaaccacauguggcuucuccucacucugugccaggaacugugggcaacagggacagggccacugucuccacgaguguugggaaaagaaucggcaauccccaguagggacaaggacucggggagaggucaaucugucaccacuacugcacagagugggcagcggcccacugcagcaaucccaaccggacagggaccuguaaaucccugaggcagcccaggcuggucuugaacuccugggcucaagugacugccuccucagggguugacaggaacugaggauuuuuuggccaaccaucuaaguccuggcaggguuagauuggacagacugaaguuuucauguucccagguccuggacauaguuuccaaagaccccuugucucaaggguacgcugucugcacccaacauuggcaaagggacuacaacucccagaaugccauaggagcagccaguuccucaauuauuugucccagggcaugagaaauuaagcuucuuuuuuuuuuuuucuuuuucuuuuuuuuuuugagacagugucucacucuguggcccaggcuggagugccgugaugcaaucucagcucacugcaauucccgccucccagguucaagcaauucuccugucucagccucccaaguagcugggauuugggauuacaggugcccaccaccacacccagcuaauuuuuuuguauguuuaguaaagacgagguuuggccaucuugaacuccuggccucacgugaucuucccccaucggccucccaaagugcugggauuacaggcaugagccaccgugcccagccuggaaacuaagcuucuugagccucuuaaaaccuagaagggggucaaaaccaggucaggcuggggauucaugagcauccagggcagcaucugagagcugaguccagcaauaucacacuagagaacuacaacuccuagaauuccucgggcaagcccgccagccucacuuugaggcugauuccaagaaucccuaugcuuggaagacuagaguaaaugaaguuggcaucgagaguagagccugggcccuuggauguucauguccucaaaggccagagcuaauccuuggauuaaaggacccuaugacucccagaaugcccagggagaagcccauccucuggcccaggggcugauggucauuguaguuucagguauggguggaaugugucagacggggccuaccucacccaggaaccagguggucagaaagccaaagaggacagcgucguuggccucgcggucguaccacggcacuccgauguugcagguaucccagagcucucccuuccagcgcuccagggcccaagcugaggcacccacguccaggagcaccaccagagggccucccucgaucagccagcgcccgaaauacaccugggaugggguuggggaggcaccauagggaggcucugggcuucagccucauaucuucacucauccgugguucucccauuugcaggcagaugucuauagacuuaagccucagcucucuuaucuucuguuuccauaucugcugcuaauuucucaccugcugccuuagccuuacuucucuauuugcaugauuuauuccugcuacacauuuuuuccaucucuguugcaauauuuuccgugcccccugcuuacuuucuuucuuucuuuuuuuugagauggagucucacucuguggcccaggcuggagugcaguggugcgaucucagcucacugcaaccucugucucccggguucaagcaauucuccugccucagccucccaaguagcugggauuacaggcacccgcucccacaccuggcuaauuuuuuuuuuuucuugagacggagucuggcucuguugcccaggcuggagugccguggcaugaucucggcucacugcaaccucugccuccuggguucacaccauucuccugccucagccucccgaguagcugggacuacagcggcccgccaccacgcccggcuacuuuuuuuuguauuuucaguagagacgagguuucacuguguuagccaggaugaucuccauuucccgaccuugugauccgcccgccucggcgucccaaagugcugggauuacaggcgugagccaccgcacccagccuccuguuuaauuccuguaacugcuacccuucucccacucgcugccuccuuucucugcuuauaaccacauaugucacauguccugugucuaugcccccacugcccugucuggccacucugcaaaucauuuccccuaccugcugccuuguuucuguacuugcugccacauuucucuuaccaaccaucugcaucucccacugucuuuucuuucugaugcuaauuccuuccacgggaugcuucuuuuuuguuuucagacagggucucgcucuguugcccaggcuggagugcaguggugugaacaugguucacuauagccucaaccucccuggcucagucaauccucccaccucaccuccuacaggcgugggccaccaugccaggcugauuuuuuaauuuuuuguggagauggggucucacuauguugcccaggcugaucgugaacuccugcguucaagcaguuuucuugcuuagccucccaaaguguugagauuagaagugugagccaccuaaagcaggcccuuuuuuauuuucagagacggggucuugcucuguccuccagccuggaagggaguggugcaauuacgguucacugaagcuucgaucucccaggcucaagcaauccuuccaccgcagcuucccacguagcugggaccacaggcacaagguaucacaucccggcuaauuuuuaacuuuuuuguaaggacaggguuucaccauguugcccaggcuggucucaaacuccuggccucagccuaccaaagugcugggauuacaggcgugagcuacugcacccagccuguaaugauucucuuacuguucaugcugccacuuuucuuccccaugaugccuuguuucuguuccuuucaucacauaucugucaccugcgaccucuuuccucuauccauaggcccauuuuguaguccacagccuccuuccuuccuuccuugcuuccuuccuuccuuccuucccucucucccuccuucccucccucucuccuuuuucuuucuuucuuccauuuuuuuuuguuuguuuuuguuuuugacagggucucacuccggucacccaggcuggagugcaguggugcaaucauggcucacugggcugggcgcgguggcucacgccuguaauccuagcucuuuggggggccgaggcgggcggauugccugagcucaggaguuugagaccagccugggcaacauggugaaacccugucucuacuaaaauacaaaaaauuagccgggcguggcagcaugugccugaggucccagcuacuugggaggccgaggcaggagaauugcuugaacgcgggaggcggagguugcagugagucgagauuguaccacugcacuccagacucagcgacagagugagauucuaucugaaaaaaaaaaaaaaaaaauuauggcucacuacagccuccacaucccauccucccaccucagccuccugaguaacugggaucacgagcacgcaccaucaugccuggcuaauuuuuuguauuuuuaguagagacagaguuucgccauguugcccaggugggucaggaacuccugggcucaagcuauccucucaccucggccucccaaagugcugggauuccaggcaugagccaccgcccucggccacgccacacauuucuaacauagcccauccucuguccgugccccagggcugcauuuuucuagccacugccguguuucuaagacuugcugucucacuucugccucugccacauuucuccaguuggcuguuuuccucccugagaccauggcuuugguucugggccugcugccacagcaguggagaagcagccccgcuccucgccgaccuggcuuuuugcugccuggagccucgcucugaggucccucccccucccagcuguugucugcccuuuugcugggggggggggggggcuauucuuaggcccccagcacgugggaagcagcugcccucaggaagcgacugggcuguucuggguucccuuagggacacagucggaccugaauggauuccagaccccaccccaaaccagaggcugugaaugaguaaaggaaccacagugccucuccauccccagccuggaccugucugucccuuagcccugccgccugauggcuuucuccuuggacaacagcgugccgccugauggcuuucuccuuggacaacagcgugucucuuuccgucuucacccuggggcccuggaacucccccuccucucuaaucccugaucugcccaucucagacucuguccugugggucuguccacugaccucuccucucuuccccgauauuccaugcuucucucuccuucuaggacuggcuuucugaaacaucugguggccucucuucuguccccagucuauuacucuugccuguggcuccauccacccuucucccuuggucugccugucccccucacucuccaagcuuggcuguuaguaacaauaaugacgaugaucauaacaaugacaaucaccgcccacacaaugugcuaccuucaugccaagaacucuacuaaccacuuuguccuuauuaacuguuuccuccucccagcaccgcuagaagguagacgcuauuagcauguccauuagccaaggacacacaggcagcaaguggagggugaacuugaacuucaagcuccagaauccugcuccuuccugaccucaggcccacuucuccccagcucugccuggcuggcuggcauucuuuucugagacagagucucgcuccgucgcccaggcuggagugcaguggcccaaucgcagcucacugcaaccuccgccucccggguucaagcgauucuccugccucagccucccgaguagcugggauuacaggcacccgccaccacacccagcuaauuuuuguauuuuugguagagacgggguuucgccauguugaccaggcugucuuucgaucuugcucucuuucucucugggucugaggaccuuggccucuuggaucuccgucucagucugucucauacuugccaucugucuguccauucgcccaugucugggauccacccacccacuuccaggcccugcaucugucuggguguccuaucacgccuccuuccuguguccaagccugccucgcucucuggcuggggcuguccacccugcacccucuccgucuguggcucccaccccgauggcaggcuguccacccgcuucugcccugggcugggccacgucccaccuugcagcccuugcuguucauggaauccaguguccucuucagggccggggugggggccuccagcaguuccaccuggguccucacgcccugcuccguguacggccccaccaggaaguaguugucgccccauucguccccugucaccuucgccuucgucugcagcaccguguagaugccacccacugugggcccaagcgugugagggcaggccccggccgagguccauaguucuggggccugggguggggugggccggggauguagggggcacucaggccccagaccucuagcucagggggaagaggggacugggagcccauaguuuggaguagggguuggaagcuuggaugaggggaacacgagggcuggagggcaguccuccugggucuaagggagaagggggcuggggucaggacccugaaggaggagggggcucaggcuagacuucugggucugagagagaaggggcugggugccgggaccccuuggucugaaggaauuaggcacuggggcucuaaggauggcagagcugaggacugacuacccggacucagguucccgaguucccagcucacaggagcuggguuuaaaucgcagccaggcuccaaaacccagugagggagacccccucauggccaauccagcuucucaccauugcccaagagaagccugcauggucauucccugcccccagggaccuugcugaccugccucccaauuuccucucccugacuagggacaccagcaugcagggcucugccucucccaugacccuaucccagacccaggagccccagcccccagccuccucccauccuggagcccaggcccuggcgauacccggcuggguguucacgggcccccucuccuccugggagacacagucccuuucuccuccaagacccagcaaagcaaccccccagacccugcucuuugaggugugagauuggcuuguuccuggggauuucagccccagccuucuccaaggccagaaccucagcuuucugaagcccaagacacagaaaugcaggcuccuagccccucccauccuagggcccagccucugacuaacuuaggacuucccagccuuccccuauuccaguacgcaugugucccaggccaugggcuccucuacuccuaggaacuaauagcucaggcccucagcuccuucaaagcccaggcauucauuacagucuccagcccgucccaucuuuauucuuaagcagccagauccucagguccucccaccgccgcucaggccuccuaucucccagucagcucucucucaaaucuggaguuuuauccccuagaccaugcuguuagggucauaggucugaaaccccggcagcuucccagguuugcacgcagaaaucccauccccccauccccuucccuguucaggacccagguaucuagucucucggaagccugccuccaggaccuaggagucucauuuuagcgcccucuucccuaggacccagaacccgggcuuccagccuccuuucaucuuaagucaaacgaaccaucccucucccacccaccuccggcuucccagccccuccucaaggacacagccuccuugcccaggucacaaggguuccccuaguagccccguccuccuacaacucagaguuccgggcccccauccacuacuguccuucucgucaagggccccgacgccuggcgugcucacccuuguuagccaccucccaggccacuucgaagagcacugcguucuccaggucgaauucauccucccaguccuccaguccuggcagugaggacauggacaaagugcgguuuaaaggcauggcuggcgcaggaaggggggcuccggggaucuccagguagggaccccggaggugucuagggaaugcaccagguagggugcggggccgaguagcuggugcccgacgggaagcuugcaagacgcucggcuuccuauugcaagaccgcaccccugccccgaagcguugggaccuaggcagaaggaggccgcagcgucacugagcccacuggcgccccugcagugaaaccucgcagccgccagga

SEQ ID NO: 191770 - RNA, 17775 nt, Homo sapiens
uuuguuggaaguggagaguggagggucagaagggaguggaccaguucaggucccagagggaauccucccucccucugagccgucuuucuucuccucccuauuucgcagauaucccgagauuagguccccagcuuccaaagagaggaucagguauguuuagagauuggccagagaggcaagguaccgaggcaucaaugugagcagccucuccaggcaccuggugaggagaacaagucucccggaucccaggcaggugggcaguggaguucuaggccgcugggggcuggguguuugaagugcacaguccugaguucugaugccugggugcuggagaauuagauauuugggggagagagaagcggacuugcggacccccgugggaagcuggaaacaggcuacuagaucccgacaggagugggugcugggauucgggcugccuggguccggaagcaaauuuaaagguaaggaucaggccgggcacuguggcucaugccuguaauccuagcacuuuggaaggccaaggcgggcagaucaccugaggucaggaguccggcaccagccuggccaacauagugaaaaccgguaucuacuaaaauacaaaaaaauuaggcagaauagcggacgccuguagucccagcuacucgggaggcugaggcaggagaaucgcuugaacccaggagguggagguugcaguggccgagauggcgccacugcacugcagccugggcgacagagcgaggcucagcugucucuaaauacauaaauaaauaaauaaauaaauaaauaaauaaggcuaaagauuaggugcuggugggcaggauccauugggauguugguucugauccugacuccucauucuugcuucugcagaaugucucaggauaaugacacauugaugagagagugaguagggaaacagauggguagggguggagguggaaagggcuggggaccccgugcacucggcucuggcuucauaaccauguuugcagguucagcaccaucggccuugcaggaaggggcuggggaccuggacuccuguguccugaagggauggggcuagggugcagacuucugggucugaaagagaagggguugggggccccagacuccugaauccugagacaggagggaccugggaucucugggucccggcuucugugggccagugccaggagaaagggcccuauaacugguggagcaggcucagguucugcaccuccugugaccucacaggugcccagaacccaagcugagauaggggcaggaugggggaaggagggacucucuugggcaaccgagguucccugugcacugucaccaugggccugugucucucucagcauccuggggcaugagcucgcugcuaugaggcugcagaagcuggaacagcagguauugugcccaggaaucucaccacuccaacucuuccgccuucugugccuccccaggggccucuccaccaggucuugcucuaggacucccagcccguguuggcugucucucauccuugaguuuucccacugagaaaugagaaaauaggaauuuggggccgggcagggcagcucacggcuguaaucacagcacuuugggaugcugaggugggcggaucacuugaggucaggaguucaagacaagccuggccaacacggcgaaaccccgucucuacuaacacacaaaaaauuagccaggugugguggcaggcgccuguaaucccagcuacucgggaggcugaggcaggagaaucguuugaauccgggaggcggaggcugcagugagcggagaucgugguacugcacuccagccugggcgauagagccagacucugucucaaaaagaaaaaaaaaaaguaagaaaggaaaaagaaaagaaaauaggaauuggggguucuaaagaagcaaacaaacccuugugaugaauuucuaaggaacaaggcuucuagaaggcaggacuccuggguccugggggaugagaggacagggugucaggacucuuggaucugaguccaacgguggaauaagggaggagcugcugaagaacugagggccuggacgugugggccccaguggaggaagggguucacgaacucucgcgccgaugcgagcccuugccccaggccccaccucacuucugucuucccaucugguuccugucccggacacccaccucucccaucuccccagcggcggcuguuugaaaagaagcagcgacagaagcgccaggagcuccucaugguucaggccaauccugacgcuuccccguggcuuuggcgcucuugucugcgggaggagcgccuuuuaggugacagaggugaccaaagaccccugggggcguucgccuggaggggaggggccugugggagucugugggcggggccuaguggaugaagggguggagccuuaggguggggacuuggcaguggaugggggcgggccuuggcccaggagagcuuuagaacagggccugugggcgcccaggggagaggcuugugggggccccccgcggcaggaccugugagggagggguucggggcagggcuacagagcgcaggggcggggcaugguacaacuagcaggggaaaggggcaagagaaugugaugauugggcuuggcagagcucggugguggagccugggaaagccgggacccccaccccaaacccgggauugcggagacggggucuagggguccggggcggggcgcggucucauuacgagagccuggcgcgagauucuuuacgugcggagcccgcaacaauccagcggcagggcugugcuuguuugaggcuuaggaugcaguuugggaccugggucucaagguuugggcgguccgcgaaacagggugauuuuuuuuucuuuuuugagacggaguuuagcucuuguugccaaagcuggaguacaauggcaggauaucggcucaccgcaaccuccgucucccggguucaagcgauucuccugccucagccucccgaguagcugugauuacaggcaugcgccaccaagcccggcuaauuuuguguuuuuaguagagacgguguuucuccauguuggucaggcuggucucgaacucccgaccucaggugauccgccugccucggccucccaaagugcugggauuacaggcgugagccacggcgccuggcgggggugauauuugggagcccagugacgggguggauuuugguugaggaccggaauuuguagaucguuuucaugggcucgcugaaccuucucccaggccuugggaacccuuuccuccggaagaaagugucagaggcacaucugcccucuggcauccacagugcccugggcaccgugagcugugguggagacggcaggggcgagcgcggccucccgacaccgcggacagaagcagguauuugcgaguccaccgaccuccuagaccccagaacuccguccccacuaaaacccaggagucuggugccucaauccaucuguccaaaauacucaggagcucaggaccgcacccacuccuuccucacaccaaggaguucagguccugagccgccuccuccugcagcauccagaaauccaacucuccccuccuuccuuccucaguguucaggaaucucggucuccaguccccuuucuuauccuggcucccagacaauuccgaugcagaauuggaggaagucuccguggagaaugguuccgucucucccccaccuuuuaaacagucuccgagaauccgacgcaaggguuggcaagcccaccaacgaccugguaauuuaggggacauuggggugaaaccugggaucuccugguucaugcagcaaaucuuccccuuucuuaggcagcagcuucacugaaguauaauucacaaaccauacaagucacccauuuaaaguucacaauuccaugguuuccaguacacggucgccccucgguaucugcaggugauguguuccaggaaccccacagauaccaagauccgcagacgccaaagucccuuauauaaaaugguguaaaauuugcauauaaacuaugaacauccccccauauacuguaagucaucucuagauaacuuauaauaccuaauacaguauaaaugcaauguaaauauuuguugcuguuguuguugggagggagucucacucugucgccuaggcuggagugcaguggcgugaucuuggcucacugcaaccuccgccuccuagguucaagcuauucuccugccucagccucccaaguagcugggacuacaggugcgcaucaccacgcccagcuaauuuuuguauuuuuaguaaagaugggguuucaccaugcuggccggacuggucuuaaacuccugaccucaugauccacccaccucagccucccaaagugcugggauuacaggcauaaaccaucaugccuggcccguaaauagcuguuauauguuauuuaaaaaaauuuuuaaaaauaaagugccuguaauuccagcacuuugggaggcugaggcugguuggucacuucaguccaggaauuugagacgagccuggccaacgugacgaaaccaugucucuacuaaaaauacaaaaauuagccaggcaagggggugcaggcuuguaaucccagauacuccggaggccaaggcaagagagucacuugaacccaggaggccgagguugcagugagccgagaucaugccacuguacuccagccugggugacagagcaauacucugucucaaagaaaaaaaaaauugguucuguuauuuauugucaucuuguuguuuuucaauuucuuuccugaauauuuugggucagcaguggggauguggagccuguaggauacgagaagcuaacuauauuuauauaauucugcaaccgucaccacaaucaauuuuagaacauuuguaucaccccagauagagauccugcaucauggcugggcgcgguggcucacgccuguaaucccagcacuuugggaggcaaagguggguggaucaccugaggucaggaguucaagaccagucuggccaacauggugaaacccagucucuacuaaaaauacaaaaauuagcugggcgugguggcaugcaccuguaauccuagcugcuggggaggcugagguggaagaauugcuugaacccaggagacagagguugcaguaaacugagaucaggcuacugcauuccagccagggugaaagagcgagacuuugucucaaggaaaaaaaaaagaaagaaagaaauagugcaucaauuagcagucaccccuuuuccauuuaccccagcccuuggcaaccaccaaccuccacugucuucuuagauuuggcuauucuguacauuucacacaaauggaaucguauacauauguggucuuuuguauguggcuucuuucuucaauuccuuuuuuuuuuuuuuucuugaggcagagucuugcucugucucccaggcuggaaugcaauggcgcgaucucagcucacugcaaccucugccuucuggguucaagcgauucuccugccucagccucccgaguagcugggguuacaggcgcgugccaccaugcucggcuaauuuuuuguguuuuuuaguagagacaggguuucaccauguuggcacagcuggucucaaacuccugaacuugugaucugccugccucggccucccaaagugcugggauuacaggcgugagcuaaugcaccuggccucuuuugcuuugagauggugugucacuauguugccuaggcuggucuugaacuccugggcucaagugauccucucaccuuggcuucccaaagugcugggauuacgggugugagccaccgugugucuucauucaccucauucaccuaaugauuuuuuuuuuuuuugagacggagucucacucugucaccuaggcuguguggggaaaagaaagagagaucagaucguuacuuugucuauguagaaaaaggaagacauaagaaacuccauuuugaucuguacuaagaaaaacuguucugcuggcugggcgcgguggcucacgccuguaaucccagcacuuugggaggccgaggcgggcggaucacgaggucaggagaucgagaccacagugaaaccccacguuuacugaaaauacaaaaaauuagccgguugcgguggugggcgccuguagucccagcuauucgggaggcugaggcaguaaaacggcgugaacccgggaggcagagcuugcagugagcugagaucgcgccacugcacuccagccugggugacagagcaagacuccgucccccccccaaaaaaaaaaagaaaaacuguucugcuuugagaugcuguuaaucugcaacucuugucccaacccugugcucacagaaacauguguuauauugacucaaguuuuaagggauuuagggcugggcaggaugugcuuugguaaaaaugguuuugcaggcaguaugcuuugugaaagucauugccauucuccauucucuauuaaccagaaacauaacacacuguggaaggcugcagggaccccugcccaaggaagccugggcauuguccaggauuuccccgacugagacagccugagauauggccucgugggaagggaaagaccugacggucccccagcccgacacccguaaagggucugugcugaggaggauuagugagagagaaaggccuccaugcgguuaagauaagaaggaggcaucugucuccugcacgucucuggaaauggaaugacucaguguaaaaccgaccauacauucuauucugagauaggagaaaaccaccuuauggcuggaggcgagacaucauggcggcaauacugcucuuuacugcacugggauguuuauguaaaguuaaacauaaauccagccuaugugcacauccaggcacagcaccuuuccuuaaacuuauuuaugacacagagucuuuuguucacauguuuuccugcugacccucuccccaccaucacccuauagucacaccaaauuccccucaccaagauaguaaagauagugaucaauaaauacugagggaacucagagaucagcgcuggugcggguccucacuugcggagcacugguccccugggcccacuuuucuuccucuauacuuugucucugugucuucuuucuucucucagccgcucgucuccaccuugcgagaaauacccacggguguggaggggcaggcccccuucaggcuggagcgcaguggcacgaucucggcucacugcaaccucugccuggcuggguuuaagcgauucuccugccucagccuccugaguagcuggaacugcaggugcacgcugccacgcccugcuaauuuuuguauuuuuaguagagaccgguuucacuauguuggccaggcugauuuugaacuacugaccucgugauccgcccaccuccgccucccaaagugcugggauuacaggcaugagccaccgccccuggcccaccuaacaaauuuuuuuuuuuuuuuugagacggagucucgcccuguugcccaggcuggagugcaguggcacaaucucggcucacugcaagcuccgccucccggguucacaccauucuccugccucagccucccaaguagcugggacuacaggcgccggccaccacacccggcuaauuuuuuuuuuuuuuuuguauuuuuaguagagacgggguuucaccauguuugccaggauggucucgaucuccugaccucgugauccgcccgccucggccucccaaagugcugggauuacaggcgugagccaccgugcccggccauaaaauuuuaagguucauccgugugguaguauuaucaguacuucauuccuuuuuauucccuuauaauauuccauuguggugacguuuccuuuuauuuucaugagauggccaaugauuucaaugacagaauuauuaucaccccaaacuccauccccccaucuucagucucugugaugcuuugucugagauaaggaaaaggaaagacccuaaccccucccuguccuuagauccaggguaaucagaaacucuggcccuuguagacuuccgugcaccuggaggaggaggagguuguugcaagugagggcgcugagucaugaguagggacugagaacccaggaguucuggccaucucuggcuagcacugaugauggugucccacacuccugggauccagcuguccugagcuuaguccaggcuucuuucauccuuuaggugaagggguggguugccccuccacaccuguggguucguuagguggaacgagagacuuggaaaagaaaaagacacagagacaaaguauagagaaagaaauaaggggacccagggaaccagcguucagcauauggaggaucccgccagccucugaguucccuuaguauuuauugaucauuuguggguguuucuccgagagggggaugugucagggucacaagacaauaguggggagagggucagcagacaaacacgugaacaaaggucuuugcaucauagacaagguaaagaaucaagugcugugcuuuuagauaugcauacacauaaacaucucaaugcuuuacaaagcaguauugcugcccgcaugucccaccuccagcccgaaggcgguuuuucccuaucucaguagauggaacguacaaucggguuuuauaccgagacauuccauugcccagggacgggcaggagacagaugccuuccucuugucucaacugcaagaggcaugccuuccucuuauacuaauccuccucagcacagacccuuuacgggugucgggcugggggacggucaggucuuucccuucccacgaggccauauuucagacuaucacauggggagaaaucuuggacaauaccuggcuuuccuaggcagaggucccugcgcccuuccgcgguguuugugucccuggguacuugagauuagggaguggugaugacucuuuaggagcaugcugccuucaagcaucuguuuaacaaagcacaucuugcaccgcccuuaauccauuuaacccugaguggacacagcacauguuucagagagcacgggguuggggguaagguuauagauuaacagcaucccaaggcagaagaauuugucuuaguacagaacaaaauggagucuccuaugucuacuucuuucuacacagacacaguaacaaucugaucucucuugcuuuuccccacauuagggacccgugcagagggugagagugacucccaggauaugggagaugcacacaagucacccaauaugggaccaaacccuggaauggauggugacuguguauaugaaaacuuggccuuccaaaagguaggaaaaugcacaaucacucaggauauuggaagaagagggcuagccucggaccucuggugaggguggggcuaaaauucugccacccaaucagaagcucuuuuuccugguggugauuaagcuggcagagacuugugugugugcgugcgugcgugcgugcgugcauguguguguguguaccauucaucaaaucagaggauuugacuugacauggacauggccauuaaaauacagcuuaugguaugguggcucacgccuguaaucccagcacuuugggaggcugaggugggcagaucacuugaggucaggaguucgugaccagccuggccaacguggugaaacccugucucuaguaaaauacaaaaauuagccaggugugguggcgcacgccaguaaucccaacuacucaggaggcugaggcaggagaaucacuugaaccugggaggcggagguugcagugagcugagauugcacuccagcccgggagacagagugagacuguccaaaaaaaaaaaaaaauaggugcagccauggaaagacagcgagcuucagaaagggcagaacacugaucgaaaagggccaguugcaggccaggaacggugacucacgccuguaaucccagcacuuuggaaggccgaggcaggcagaucaccugaggucaggaguuccagaccagcuuggccaacuuggugaagccccgucucuacuaaaaauacaaaaauuagcugggcgugguggcgaaagccuguaauccuagcuacuugggaggcugaggcaggagaauugcuugaaccugggaggcagagguugcagugaaccgagaucgagucacugcacuccagccugggcgacagagcgaaacucugucuuaaaaaauaaaagaaaagggccaacuggcacucacuuugguguuggugaaagugcaguagaugguuucucuugaggguagaucugggcuguauuauguuaucuagaucaaacuaacagccauuuuaacggaaugggccuugcuuucagaaaggaauuuuccaaucagcagguggaaugcguguggcugcagaggaaagcgaauagacuggccagucaacagaggagggcgugacuggguggacugaaugagauuuuugaccaauaagcagaaaauguggaugggcaagggcgggacccuagggcugggauggucaaucaguaguaagcaaggcugggccggugguugucccucgacuuuaaauuuggugccugggcuaggaagaagacuuggaaaagaagagagaggccucugagucuacagggacgaacuccucagcagcacacaacgaagaguuguccaaggcccugaaaggcgaggguggcacggacagcgaccauaugaggcacgaagccuccuuggcaauccgcucccccugcccugggcuggaggaggacauggaagccuacgugcugcggccagcgcucccgggcaccaugaugcagugcuaccucacccgugacaagcacggcguggacaagggcuuguucccccucuacuaccucuaccuggagaccucugacagccugcaggugcaguaagccagcccaacagcuuugggaguaagcccccaccucccaggcaaaaucccacuccuuucugagcuaggucaagaccagccuggggcugggcacaguggcucacgccuauaaucccagcacuuugggaggcugaagcggguggaucaccugagguccggaguucaagaccagccugaccaauauggugaaaccccgucuccacuaaaaauacaaaaauuagccgggagugguggcaggcgccuguagucccagcuacucaggaggcugagacaggagaaucgcuugaaccugggaagcggagguugcagugagccgagauugcaucacugcacuccagccuaggcgacagaggaagacuccaucucaaaaaacaaaaaaccaaccaacaaacacaaaaaagaccagccugaacaacauggcaaaaccccgucuuuacaaaaaauacaaaauugguugggcauggugguaugugccuguaguccaagcuacucgggaggcugaggugagaggauugcuugagccugggaguucaaggcugcagugagaugugaucacgcuacugcacuccagccugggcgacagaguuagacucugcauaaaaaaaaaaaaaaaaaaaaaaaaaaaaaaaagggcugggcgcgguggcucacacuuguaauccuagcacuuugggaggccgaggcgugcagaucacaaggucaggaguucgagaccagccuggccaacaaggcgaaacaucgucucuacuaaaaaauacaaaaguuagccaggcgugguugugggcgccuguaaucccagcuacucaggaggcugaggcaggagaaugcuugaaacucgaaggcggagguugcaaugagcugagaucucacaccacugcacuccagccugggugaaagagcgaaacuccaucucaaaaaaaaaaaaaaaaggccgggcacggugguucacgcuuguaaucucagcauuuuggaggccaaggcagguggaucauuugagcugacaaguuccagaucagcuugggcagcaagguggaacccugucucuacaaaaaaaaaaaaaaaauuagccaggccugguggugcccaccuguagucccagcuacuugggaggcugaggcugagggaaaauggcuugaguccaggagguggagaucuugugucaaaaaaaaaaaaauagucuggacccucccucacugagccuuucuugcuauaagcuaucaggccucacucaauccugagauaaauccugcccccagcaaccaggucccuccccugguuugucuuuccagauccaagccccacuucucucaaucuagucuuucuggccuuuacccugcaaguauggucuccucuccucgggguauccucucucccccuagaaagagguuuuuugcccuacucagagccaaccaaacccauuuuucuuggugaaacgccuaccaaaguccugcugcaauauugcaagugagggugcuccccauucuccaaagccagacccuuccugggcuaagcuucaacucuggacccauaggcagaaggaaugaggaggagauauuaagauaggaagcuuccauucaggacccagcugauggcuucccucagugagaaccacauuucccaguaagucuuuuuuuuuuuuuuuugagacguagucuugcucugucgcccagugcaguggcgcgaucucggcucacugcaagcuccgccucccagguucacgcuauucuccugucucagccuucugaguagcugggacuacaggcgcccgccaccacgccuggcuaauuuuuuguauuuuuaguagagacgggguuucaccguguuagccaggauggucucaaucuccuuaccucgugaucugcccgccugggccucccaaagugcugggauuacaggcaugagccacugugcccggccucccaguaagucuugagaagcuuguugugccaucacuggcuccucuaucaugggacaugacguuuccuugucuuuggaccccuggcucuaaccagcuuccagaaguccauuuuucuuucauuauuuuuuauuuuuguuuugagauggagucucagucuauugcccaggcuggagugcaguggugcgaucucagcucacugcaaccucugcccccuggguucaagcaauucuccugccuuagccucccuacuagcugggacuauaggcacgcacuaccacgccuggcuaauuuuuuuuauuuuuaguagagacgggguuucaccauguuggccaggcuggucucgaacuccuguccucaagugaucugcccgccgcagccucccaaagugcagggauuacaggcaugagccaccacacccagcauccagaaguccauucuaauggacuguuccucucauccauagcgcuuccuccuggcugggcgaaagagaagaaggagcaaaacuucuaauuaccucaucucccuggauccuacacaccuaucucgggacggggacaauuucgugggcaaagucagguggguagagcucugacauguggugaggagcagguagcagggagcuuagggacagggggacuccauuucccagcaggccacagagcauaccuuccaccugcucagggaccagaagaacugaaggguuuggaacguaggcuggcauuuaaggcauuugacuccuugacaggcaagggacugggauuccuaacuuucugugggaaaagaggccuggaaugugugaauuauugcauccaaaaagguagagggaguggcgagguggcucacgccuauaaucucagcacuuugggaggcagaggcgggaggaucacuugaggucaggagcuugagaccagccuggccaacauggugaaaccccgucucuaccaaaaauacaaaaauuagccaggcauaguggcgugaaccuguaaucccagcuacuugggaggcugaugcaggagaaucacuugaucccaggaggcagaggucuugguaagcuaagauugagccacugcacuccagcuugggcaacagaaaaaaaaaaaaaaaaaaaaaaaaaagaggguuccuaaagggcccuuuaaauaaaauagggaggcuacauaaaguacauggcucacccaagaaaugagggggccugggaccauggaugcuggaaacaugguuguuucauuuauuuaauuauuauuauuauuauugagacagaguuucacuuuuguugcccaggcuggagugcgauggcguaaucucggcucacuacaaccuccgccucccagguucaagcaauucuccugccucagccuccugaguagcugggauuacaggcaugcaccaccacgccuggcuaauuuuguauuuuuaguagagacgggguuucuccaugucugucaggcuggucuugaacucccaaccacagaugauccacccgccuuggccucccaaagugcugggauuacaggugugagccaccguacccggccucauuuauuuaauuauuuauuuuuauuuauuuauauauuuauuuagagacaggguuucauucugucacccaggcuggagugcaguggcaagaucacggcucauuggaggcuugaccucuggggcucaggugauccucccaccucagccucuugagagcugggaccauagacacaaacugccacgcccaacuaauuuuucuauuuuuuguagagaaggaguuuugccauuuugcccaggcucaagcuauccuccugccucugccuccugaagugcugggauuacaggugugagccccugugcccagccaggaacaugauucuuagacauucggacauagucuuagacauaggggauugaugggaagagucgaugcgaugagugacacuuacucaaagaguaacacuuaguauuuuuauucuauccauucccuuccuggagcagauccaaugucuucagcaccaaguucaccaucuuugacaauggggugaauccugaccgggagcauuuaaccaggaauacugcccggaucagacaggagcugggggcuguguguuaugugaguguccuggggaugagagaaugggguaggauagucagaagaaggaaccaggccaacuggaauguaauacccccaggagcccaacgucuuaggauaccuggggccucggaaaaugacugugauucucccaggaaccaacagccagaaccagcgaaucaauguccagccacuaaaugugagucccugacaucaggaaucucugggucaauggagaaggggcuggggccgguccuccuagaucccagaggaggaagaagaagaggaggaagaggaggccaguggguugcaggugucacaugaagccugaaggacuuuguuagccuuccaugucucagggaguaaaagacuagagacucaaaacauuugcaucuggagaaaaaagguuugaugguagguuaacaaacuuaccaaaaaggggucugauccagacuccaagagaggguucuuggaucucaggcaagaaagaauuuggggccaguccguagagucaagugaaagcaaguuuauuagagaagaaauaaaagaauggcuacuccauaggcaaagcagccuugaggccagcugguuggcuauuuuuaugguuauuucuugauuauaugcuaaacgagguggauuauucauuaauuuucugggaaaggggugggcaauucccagaacugaggguuccugcuucuuuuagacucucucuuucuuucuuuuuuuuuuuuuuugagacagagucuugcucugucgcccaggcuggagugcaguggcgcgaucucggcucacugcaagcucgaccuccccggcucacgccauucuccugccucagccuccugaguagcugggacuacaggcgcccgcuaccaugcccgucuaauuuuuuauauuuuuaguagagccgggguuucacuguguuagucaggauggucucgaucuccugaccucgugauucacccgccucggccucccaaagugcugggauuacaggcgugagccaccgugcccggcaguaaccucucuuacaagcaaaauuuauucaaagaccugugcuaacauucuuaaauaucuguuagccauaauaaagaaaucaguguacuuuacguuuuuagcucccacaauuuacccuaaauauuugcccuggcaugcuuguaccgguccaagcaagcauuaggucauagccuguuccucuuccuuauuugaagguguuuuuaccuuucucaacauuccacaaguuacuuccuccuuacuuuguauucuucugcuuuucccucuuuuaaaaaguucuaaguugcuagccaauugggacaaauacagaacgugaggucccguuccagccaauggaaacccuacacggcaguaggguggaugcgccagguuauaaaugacccugucuccuuuguucaguguacucucauggcaaaacuccuggugaguguacccuuucugcagaaaguuaaaaaauggccuugcugaggaaauuaaauuuaugcucaagugcuauuucuuuacugcaccggggaacaagcauuucuaacauugugauaccaguccugucaaacuccugucucauccugugacuaagaaugccuaaccuccugggaacgcagcccagcaggucucauccucauuuuacccagccccuguucaagauggagucgccccuguucaagauggagucgccccuguucaagauggaguuucgaaagccucugagaaaaccacagccccuucuuuaccuucuaggaacaggagucgcuacugagucguuaccaacguggggacaaacaaggguugcuuuuguugcacaacaaaaccccgucgugggacaaggagaacggugucuacacgcucaauuuccauggucgagucacucgggcuucggugaagaacuuccaaaucguggaucccaaacaccgugagcuccuggaaaccaguuuagccgggccaggugggguggggguuagggugugaacggaagggaacuacaucucccaucaucacuugagcguuuuucuaggcagggcagaugccacccuauugcaaagccuauugggaauuguaguuuacacacccucaggguuucuggcuuaguaagggcaccgcucagccucuuaaaagucuccauucucggccuggcgcgguagcucccgcuuauaauccuagcacuuugggagaccgagguggguggaucaucugaggucaggaguucaagaacagccuggccaacauggugaaacccugucucuacuaaaaauacaaaaauuaggccgggcacuguggcucacaccuguaaucccagcacuuugggaggccgaggcgggcggauacgaggucaggagauugagaccauccugacuaacacggugaaaccccgucucuacuaaaaacacagaaaaaauuagcuggguguagugguggucaccuguagucccagcuaaucaggaggcugaggcaggagaauggugugaacccgggaggcggagcuugcagugagccgagaucgcgccacugcucuccagccugggcaacagagcgagacuccaucucaaaaaaaaaaaaaaaaaaaaaaauuagccggacgugguggcacaugccuguaauccuagcuacuugggaggcugaggcagaagaacugcuugaaccugggagguggagguugcagugagccaagaucaggucacugcacuccagccugggcgacagagcaagacucugucucaaaaaaaaaaaaaaaagaaaaaaaaaaaaaaaaagucucaguucucgaagcugggagaugagagagucaggcuaaggcuuuguuccugauucacuucucagaagaacaucuggugcuccaguucggccgagugggcccagacacauucaccauggacuucugcuuuccauuuagcccgcuccaggccuucagcaucugcuuguccaguuucaauuagaagcuggcuguugaauaacucaauaaaauaccauacccuugccagc

SEQ ID NO: 191771 - RNA, 23234 nt, Homo sapiens
uggagccaugcauuuguuccagaaaguguauuuggauggaaccggaacauggaacaggacacacagcaggaugcggagcagugucagaugaggccagaaaggugggugggacuggucuucaggggcuccagaugaggcugaggggcugggccuagguccuggaguggggucagcucugggacccuucuggggcuguguggggaaggggcugggggccaagagguccaggaggaggcuggcgaugagauggcuggaagccagggguucagggaggcccaggcuccugguaucaggguucaccggcuauacugaggauccccugccccuggcacccagcuguggaggggacacugucuuugaggcaucacugguuccacaaaagguaggggaaggucuugagggaccaccccaugcccucauuaaucaaccagaagcuuggcccggagcagcagcggggauuccaguagcugugggcauacaggaugcuagggcggccacaacccaggcagcugaggccgagccaccuaggaacgcaggcucagagcagacccucuugggacagacggagaaggggagggggcgggcuucucuaaguuaagccgaucacugagcaccucacuggacacgagagaaggcaagccccucggaggacagaagggaagagccacagacuuggaggcugugaaaguggagacagguggaccugggguggcagcaaugcgugaaaugccaggccgugcccccgccccaggagcccaacaugacaccagcccccagggaagcugacugugccacuucauccagcgcccaucagucgccuuggagcaucaggaauccugagggcuggggucccggaggaucacagaugcuggggcaccucaaccucagggagccgcucgagaaguuucuuuucugaaguguccaccuccuucuggucaccggcuggagcugggacagguacaucgucuggaaauggagggagggaaugguggcacaggacauccgaaccccuccucccccaggaccccagaggcccagccccuccucccucacacccagggguccagcccccagccccuccucccucacacccagggguccagcccccagccccuccucacucacacccaggggucccagccccuccucccucacacccaggggucccagcccccagccccuccucccucagacccaggaguccggacccccagucccucuucccucagaucugggagucugggcccccagucccucuucccucagaucugggaguccaggcccagccccuccaaccucagacccagggguccagcccugcagccccuccucccuggacuagggccagcaccugugucuggguggaacuugagcugccccucagggugggcagccggggccuuguggccuugcugcugcugcugcugcugcuuccgcugcuccaugugcagcacagccugugggagguggggggucacacagacaagagggugugaugcuggcauugcaagugcucaggccucaguccccaaacggagacuucacagcagccugcuaaguggucacggccaaccccuucuccgugggccucaguuucucucuuucauugacagucgggcuuaauaauagucaaggauccaguucucccuccagucacagcuugggucuugcuuugggacagggaaacccucacccaucccuggcugagucugccuuucucccccuccugggccuuucccuccucacuuacagccuuaaugcccuuaucucacauggcagccacagagccgucagagacgggaaaacgucugcccuuacucaagauggcggugaauacuugaggcucccccagugauuaacaugguggccacaggccuucccagcuucuggacacccauggggacacggacacgggcagccagagauucaguggauggaagcagcuucccccgcugucaccugcugcagcucucucuucugggccuccaggcggcccugggaccgcccuagagccucugucuccuggcugaggcgcugggccuuggcauucagcucugccucccgggcagccagcuccucuucaaagcgccucagcucuuccucgguguaggcagggugcaucuccacugucugcagggcaggcacaggggccaucaggggcacagguccaaccucggcccacccauguuggagaggguugugccaaugggggagguguagaggaggcugggaggccagggccaugugggugggcaaagaagcccaagugggaggugggagugggauaaagaccgagagacaaggccgggcaccauggcucccaccuguaaucccaggacuuugggaggcgaaagugggaaggaucacuugacgccaggaguucaaggucagccugggcaacggagcgagacccugucucuacagaaaauuggcugggcaucuugaaaaauauauagaaauaggccaggcaccauggcucacaccuguaaucccagcacuuucggaggccgagguggguggcucaccugaggucaguaguuugagaugagccugaccaacauggagaaaccccgucucuacuaaaaauacaaaaugagcagggcauggugguacaugcauauaaucccagcuacucaggaggcugaggcaggagaauugcuugaaccugggagguggagguugcaaugagcugagaaugcaccauugcacuacagccugggcaacaagagcaaaacucuguauugaaaaauaaacaaacaaauaaauaaauaaauaaaacagagaccuagauuagcugggcauggugguaugugccuguagucccaguuacucaggaggcuaaggaaggaggaucaccugagcccaggaauucaaggcugcagugaacuaugauuacaccacugcacuccagccugggugacaggagacccugucucaaaaaauauuaauaaauaaauaaaagaaugagcuagauuagcuaggcaugcuggcaugugccuguagucccagcuaauagggaggcucaggcaggaggaucacuugaggacaggaguuugaggcugcagugggccaugauaacaccccugcacuccagccuggguaaucccagcacuuugggaggcugagaaggguggauagcuugaguccaggaguuucagagcagccuggccaacaugcaaaacccugucucuaccaaaaaauacaaaaauuagcuagguguggugcgguggugcaugccuguaaucccaccacuuagggaggccaggucagguggaucgcuugaguccagcaguucuagagcagccuggccgauauggcaaaaccccaucucuacaaaaaauacaaaaauuagccaggcaugguggcucacgccuguaaucccagcuacucaugaggcugagaugggaggaucgcuugaauccaagaggcggagguugcagugagccgagaucccaccacugggcuccagccuacgcgacagagcaagacccuguuucagaaaaaaaaaaaaaaaaaaaaaaaucacaccucuaaucccagcacuuugggaggccaagguggguggauaaccugaggucaggaguuugagaccagccuggccaacauggugaaauccugccucuacuaaaaauacaaaaaucagcugggugugguggcacgcaccuauaaucccagcuacucaagaggaugagccaggagaauugcuugaaccugggagguggaggcugcagugagccgagaucgugccacugcacugcagccugggcgauggagugagacuccgucucagaauaaauaaauaaauaaauaaauaaauaaauaaauaaauaagaguccuagagacaggggaaaacagagacccagagauagagaugcagugacccaggagaauggacggggacccagagagaaagagaaggggccuaagauucugaaagaaaggucauggcuagaagagagagagguucaggaccccgaguaucccccauguucucaccucccagcccuccccgguguccccaaacuccuuccucugaguggaugcgaggaacuccuccagggucacgaggcgguccugguugguguccaccuggggagccagauaagggugagugacagagcugggggcccguccucucccccgccuggcccccaccucacauucuucaucacaugcucccgcaugcgcagucgcuccuccuccaucucccgcaugucguccuccucauucuuugggucguacacuuucuccagcugcaggagcaagcgagaggcagacagcauugagagguccccagcgagcucauucccgacaacuucaacucccagcaguccuuugggcacgcuaccacuccugggagccguuuuugccccaggggcugaugggaguuguaguuuucacugagcucccauccagggggauuuaaggggacugcaggaggaaacaaguggcugauuugggcgucccuccaggugcccgaggcuuccaagaugcucaccuccuuggugaagagugccuccagcuccugcucauccaggacaccaucacuguugauaucugaagggaagaggauagcaagguaucucaggggaccgaggacgggauguguaaggucccuggugaagaaauuuugggcugauguggggucuguuaucagaggacagguaacuacgggucucccgcgguggaacgguggcccccaggcuuuaguaccccacuagacccguugcuagggccacugccuagcgaccaggggguugagaauggaauagaucaaagggaggguucgaggaaacaugcuugggucacugucaugcaggauucucuggcccuggcauucagugcucuggacacagagucagcuccaggguuaucagggaccucugccucccagacaaccaggccagugccgacuccaguugugaggggagccucuccuaccaacguagaccccacagcugcagggcuucaggcucggucagccacacuuccuguccucaccaccggcccuccuuccucggcucccucagacaagcacaaccuuccuccugaggaggaggccaggaacccucaucuugcaaauccagugguuaauuuccaccugcaucugacuugacuuucugcccuuggcuuccagaacaugauucuguccucucuggcugccccuccaccuccuuugacggcuccauccucuuccugaccuccacaugcuaguguggcccagggcucaggccugggggucucuucucugccuaaacucuggaucugcgcuguccaguacaguagccgcuagccacaugggcuguuuaaauguaaauugauuaagauuaaagaaaauguaggggccaaauuuaggggcucaugccuguaaucccaguacuuuggaaggcuaaggcaagaucauuugagcacauuaaguucgagaccagcuuagaaaagauggcuagaccccgucucuacaaaaaaaaaaaaaaaaguaaaaaauugggccgggugcgguggcucacgccuguaaucccagcacuuugggaggccgaggcaggaggaucaccugaagucaggaguucaagaccagccuggccagcauaguaaaaccccgucucuacaaaaauacaaaaauuagccaggcauaaugccaagugccuguaaccccagcuacucaggaggcugaggcaggagaauagcuugaaccugggaggcggggguugcagugugccaagaucaugccauugcacuccagccugggcaacagagcaagacucugccucaaaaagaaaaaaaaaauuuaaaaauuggcugggcaugguggugugcaccuaugaucccagcuacucuaaggguugagguggaagaaucacuugagcccaggaggucuggguugcagugagccaugaucacgccacugcacuccagccugggugacaaagggaagccccaucucuaaaaauaaaaaaaaugaaaaauaaaaaaagguauagggaguugcucugaaccuauucuggucuguagggacugccugauuaaaaagauuaaauaagguuuuuauuuuuuuauuuuuuagagacagggucucacucugucacccaggcuggagugcaauggugugaucguagcucacugaagccuugaacuccucggcucaagugauccucccaccucagccucccaaguagcugggacuacagaugcacgccaccacacccagcuaauuuuuguauuuguuuucauagagaugggguuuugccauguugcccaggcuggucuugaacuccuggucucaagggauccagccgccuuggcuucgcaaagugcugggauuauagggguaagccacugcgccgggccuauuuauuuguuuauuuauuuuugagacagagucucgcucuguugccaggcuggagugcaguggcaugaucucagcucacugcaaccuccaccuccaggguuuaagugauucuccugccucagccuccugaguagcugggacugcaggugcgugccaccaugcccagauaauuuuuguauuuuuaguagagacgggguuucacuauguuggccaggauggucucgaucucuugagcuccugaucugccugccuuggccuccgaaagugcugggacuacaggcgugagccacugagcccagccuauuuucuauuuuuuagagacaggguuucacucuguugcccaggcuggagggcacugguaugaucauagcucacugcagccuugaauuccuggacucaagugauccucccaccucugccucccaaggagcugggacuacagaugcacgccaccacacccagcuaauuuuuguauuuuauuuguagagauggguuugugccauguugcccaggcuggccuugaacuccuggacucaagggauccacccaccucggccucccaaagugcugggauuacaggcgugagccaccgcauccagcccaaauguccucucuagagcugugcugggacuccaguacagcagccacuagccacauggggcaauugaaauagaaauuaauauccaguagaaugaaaacuucaguuccucaccauuaugcuaagugaaauaagccaaacacacacacacacacacacacacacacgacaaauaccaaaagauucuacuugcaugaaguaccuaaaauagucaaaaucauagagacagaaaauagaauggugguugcuagagagcaggggaaagaaggggagggcgagugguuuaauggauacgguuucgguugugcgagaugaagagcucucagaauugguugcaugacaguguaaauauacuuaauacuauugaacuguacaauuaaacaucuuuaaagcugggcgcaguggcacacaccugcagucucagcuacucaggugacugaggcaggaggauuguuugaggccuggaguuugacuccagccugggcaacauagcaagauccugucucaaaaaaaaaacaaaacaaaacacgggggguggugcccggugggauggcucaugcuuguaaccccagcacuucgggaggccaagauagguggaucgcuugagcaaaggaguuugagaccagccugggcaacaugguaaaaccuugccuuuacuaaaaauuaaaaaaauuagccaggcauagugguacgugccuguggucccagauacuugggaggcugagggggaggaucacuugaaccuggguggucaaggcugcgagguaguacacgucacuaccugagaccccauuacagaaucuucuaauucuuuuuuacuuucuauugcuuuuugagacagagucucacucuguugcccaggcuggagugcaguggugugaucucagcucauugcaacccccgccuuccgccucccggguucaagcgauucuccuaccucagccuccugaguagcugggacuauaggugagcacuaccaugccuggcuaauuuuuguuuuguuuuuuaauuuuuguauuuuuaguagagacuggguuuugccauguuggccaggcuggucuccaacuccuggccucaagggacccacccgccuaggccucccaaaguguugggauuacaggcgugagccaccacacccggccuagaaccuucguugauucugagaugcacuuuuguguucuucuauuuuaucaccccugaaauagggauguaucuuuauuuauuuaacuuuuaauuuuuauuuuuuucuuuguuuuuuugagauggaguguugcucugucacccaggcugcagugcaauggcacgaucuuggcucacugcaaacucugccucccggguucaagugauucucccaccucagccuccugaguagcugggauuacaggcacucacgaucaugcccagcuaauuuugguauuuuuguggagaugggguuucaccauguuggccaggcuggucuugaacuccugaccucaggugauccucccaccucaaccucccaaaaugcugggauuauaggcgugagccaccacgccuggucuauuuuuuuuuuuuaaauagagacagggucucacuuuguuguccaggcuggucuuaaauuccugggcucaagccaucuuccaccuuggccuaccaaagugcugggauuacagacaugagccacuacacccagcccaggacgcaucuuguuuucaaugguacguuaauuuaauuggcagcuuacguaaaaugcuagcaccucucauacuguacagucucguggaguuacuaaaguaugguaugaucugugugccugaucacuggcucugagggggagguacuuuguuuuguuuacaguuguauccacggggucuugacaaagcuugguccuuagagggaacuuaggaaagguuugcugaaugaaugagucaggccuugcuaagcuuaucugaccggcuacagauucugggacagggugcuuggcauaccugagggggcuuggcaaccccaggccacauuuccagacaggaagagacagacugaggggagugugccuuugauccaccauagagaaagggcuuucgaggccgggcgcagugacucacgccuguaauccuagcacuuugggaugcugagggggcagaucacacgagguugggaguucgagaccagccuggccaacauggugaaaccccaucucuacuaaaaauacaaaaguuagccgggcaugguggugcaugccuguaaucccagcuacucgggaggcugaggcaggagaaucacuugaacccgggaggcggagggcaggggguugcagugagccgaggucaugccacugcacuccagccugggcaacagagcaagacuccaucucaaaaaaaaaaaaaaaaaggaaaaagaaaaagagaaaggguuuuccaggcuucuggaggccugguucuuagggaacaacccacuccuagcgacaggguucccagaguggaccagggcuucuccugggcugcugugggcagagggcccaggccuagccaagccugguuugcuuacagaggacaccagcuguccuuagaaccccgaggucugguguuugcuagaaaagaggcccaacccuuccaugcagauccuagccuuguagucgggagaggcagggcugucuggucaaccaggggacauaggcuuggcucuugggccugacuaagcccuccugggacagacacaccccucuuagcauucagguccuagaagggucagaaucuaggguucauccuggcucuggaacucccuccccaccuuaccaugcaguaugaagaaggucuugggguuaaaccuguugggguccaguccauccagcuccucccacaccuccuucaacugggcuuggcugcccuguggaggggagagccaggagcucaugagcaagaagucuggaugccaugggauaaaaccaaauaucccuuuacccucauccaacaaacaucaucucccucaagcaagaaaacuaagaaaacuacaacucccagcagacccuggggcagccagguacaguaacagggaguuuuuuugccucaagggccccugggaauuguaguucuuuaacugcuuucuugucuugcguuugaacuggaugugguagggaguggaugggcacaaaugggguccucacaggcacguugacuuuagggugcucgcggugccggcgcuguugcucuuccagcuuccucuccgccuccuuucucugcuccucucccagugacuccagauaacgccgucucucguguuccuuaagcaucucguagcgcuugaacucuucaugaugggcugcgucguacugggcaaggucccggguggccuggggaaaggcacagggucauuccccucugcccccucugcccagcccccaauuccagccuguaaauggcaggcccuuggcccugaaccuggcugagggcagccccagccucuaccugucuuucuuacgucucguguccuaaugucccuuuuuuuuuuuuuuuuuuugagagggagucuugcucuguugcccaggcuggagugcgguggcacaaucucugcucacugccucacuucaaccucugucuuccggguucaagugauucuccugccucggccuuucgaguagcugggauuauaggcaugugucaccaggcccagcugauuuuuguauuuuuaguagaaacgagguuucaccauguuggccaggcuggucucaaacuccugaccucaggugauccgcccacgucagccucccaaagugcugggauuauaggcgugagccaucgcgcacagccugaugucgcccuuuuugguuuccaugacugcuccugccccauaacacacuuucuucucuuuauucaaaacagauugggacgguuauacaauagcaacuucaacccaccucuuucaaguccuccacaaucuccagaucuuggaggaauaaguaaauaggaacaacauauguggugaacuuaguauuuauguauuucagguacagcuagguggccaagaacauaaggucagacuaggagaggugggucacgccuggaauccuagcacuuugggaggcuagggugggaggaucacucgagcccgggaguucaagacuaacucacauaacacagcgagaccuugugucuacuaaaaauuuuuaaaauuagccuggugcgguggcuugcaccucuggucccagcuacucaggagggucaggugggaggauugcuugagcccaggagguugaggcugcagugagcugugaucaugccacugcacuccagccugggcaucagagcaagacgcugucucagguaaaaaaaaaaaaaaaaaaaguaaaaauaaaccaaaaaaagaacaagagguuucuaacuauuuugcccagcguucaaaucuaggcuuugcuuugugaccaaaucucauaagcucugugacacugggcaaguuacucagccucuuugugccucaguuuccaccucuguaaaauggaguuaacaauaccagguugaacaguauacuccccccacacucccaaauucauguccaccuggaaucucagaaugugaucuuauuuggaaauagaguguuugcagauguaauuaguuaagaugauggccugcuagauuacgguggguaucacuauaagaagagcugggugcgguggcugacacuuguaaucccagcacuuugggaggcugaggcggguggaucaccugaggucaggaguucgagaccagccuggccaacauggugaaacccugucucuacuaaaaauacaaaaauuuucugggcgugacggcaggcaccuguaauccuagcuacucgggaggcugaggcaggagaaucgcuugaacccgggaggcggagguugcagugagccgagauugugccauugcacuccagccugggggaaaacagcgagauuucgucucaaaaaaaaaaaaaaaaagaaaagaaaagaaacgacucagcccucuaccagccuccaaccucagagaacaccagcaggaauggugagcuggcucacgucugggacucuguccccuucuccccuuccgcaaagcuacccucaauccucugccuccggacccacucccauuaccgucuggaucagcagcuccaggucgcgggccucgaauguaugcugguucugaggguccagguguucaaacuguuucaggagauucagaugauccaccuguacaucuggaagagagggaagaguccaacaccugagggcauguucuuucagaacccccaucuugggccagacaugauccaaagaagucacggacagcacuagggaagcccagaagacagcuugaaccuggggcaaucagggaaggcuuccuggaggaggugaucccacgacugagucugaugcuuacaauaauaaccauaauaaaaacuaacauguagugccuacuuacuagaugccaggccaugcccuaagcacuuuaacuguauuaauucauucacuuuccacaaaauccugacaacaaggguuuuaugauuauccccauuuuaugaaugugaaaacugagaccccuugagggguugugacuggucuaggguaccagcuagcaaguggcagagcaaggaugggaaccagccauuggacauccaaaaaccaugacacucaaccauuucuuuuuuucuuuuccuucuuuuuuuuuuuuuuugagacaggguuucacucugcaguggcaggaucucggcucgcugcaaccuccgccucccaggcucaagcaauccuccugccucagccccgaguaacugggacuacaggugcaugccaccacacucggcuaauuuuuguauuuuuaguagaaacagaaacaggguuucaccauguuggccaggcuggucuugaacuccugaccucaggugauccacccaccucggccucccaaaguguugugauuacaggugugagccaccacgcccagccucaaccacucuuuaaaaaaaacaaacaaggcugggugcgguggcucacgccuguaaucccagcacuuugggaggccaaggggggcggaucacaagaucaagagauugagaccauccuggccaacauggugaaaccccaucucuaauaaaaacauaaaaaauuagcugggcaugguggugcgcaccuguagccccagcuacuugggaggcugaggcaggggaaucacuggaaccugggaggcggagguugcagugagccgagaucacgccacugcaccagccuggugacagagugagacuccgucugaaaaauaaauaaauaaaauaaauacauacauacaaacaaaagaaaaacaucaaaauuuuugauaaagcaucaaccaaucuuagggguuaaauugcacgcuccuaaguuucuauguugaaguccuaagccccaguaccucagaaugugaccugauuuggagacuaggucuuuacagagggaaucagguuaagaugaggucauuacugugggcccuaauccaacaugauuggugaccuuauaaaaggcagaaauuuaugacugggcacaguggcucaugccuguaaucccagcacuuugggagacugaggugggaggaucacuugggcucaggcauucgagaccagcgugggcaacauggugaaaccccaucucuacaaaaaauauaaaaauuagcugugugcaguggugugugccuguagucccagcugcucaggaggcuaaggcaggagaaucacuugagcgugggagggggaggaugcagugagccgagaucgcaccacugcacucuagccuggaggauagaagugaaacccugucucaaaauaauaauaggccgggcgcgguggcucacaccuguaauccuagcacuuugggaggccaaggcggguggaucaccugaggucaggaauucgaaaccagccugcccaacauggcaaaacuccaucuguacuaaaaauacaaaauuauccaggcgugguggcgcgugcuuguaaucccagcuacuuaggagucugaggcaggagaaucgcuugaaccugggaggcagagguugcagugagcugagaucgcgccaccgcacuccagccugggcaacgagagcaaaacucugucuuggaaaaaaaaaaaaauaauaauaauaauaauuaauaaaaaauaauaauggaaggagaaauuugggccaggcacacagagaggaaagauggugugaaaaugcagugagaagacggccaucugcaagccaaggagaggggccugguacagauccucccucauagccccagaaggaaccaacccugccaauacuuucacuuuggacucugacugcaggccaugagacagucaaguucuguugcugaagcaccuggucagugguacuugguuacagcggccucagcaaacaagugcagccucccucauaugggaguuuccaaguagucaggaagggguaggguuuccaggcaggaaaggacagcgcacacgcugccaacacacacuuaccgcacgcaugucucccgaggcuucuaggggcccaggccugcgcugugcaaugcuggacccaaaaugaaucagccuggcccuggccuccaguggcccuugguuagguggggagaaagacacacacacacacacacacacacacacacacacacacacaccccuuggucaagugggcagaaagacacacacacacacacacacacacacacacacacacacacacacacacacgggcagcuagaauuugggagaccuaggcugcaguggaggcagcuccggcccuggcugagcccagaggagugacaggugugcaggacacagguacaaacugaaucucaaauucauuauuugugccagggacguguguugagccgcuauuccaggcugacccagcgccggccgcuauggacacagcaggaaucaaaugaugacagaauucugacucuuggaggccaggcgggguggcucaugccuguaaucucagcaauuugggaggcugaggcggguggaucaccugaggucaggaguuugagaccagccuggccaacauggugaaacccugucucuacuaaagauacaaaauuagccagguaugguggcgggcaccuguaaucccagauacucaggaggcugaggcaggagaaucgcuugaaccugggaggcagagguugcagugagccgagaucgcgccacugcacuccagccugggcgacagagugagacucugucucaaaaacaacaacaaccaaaagaguucugccucuuggagcacccagucuagagagacagagaacaggcgaccaagggaugaacaaaggaauaccaaggacacaaauaacacagaggcuccuucacacaggacagccggggcggugacacccugaggaggugacauuccaggggagauggaagguccauggaccaggcaaagagcccugagaaagaaugucacgggagagcggggcgaacggacaaaggucccaaggcugcacgccagcaauuucuaaaaaugcugacgcaagaaggucagggugcauacgggaagggcaggguugggcggguguggccaagguccacccaggcuccgagcagacaagaggaacaugaaugcgggccugagggcacuggggugccgggggcaggcucugggcagaggagggacgggaagagccuggguguuguggcagcuggauacuggugcccuaaaagauauccacauccugauccccggaaccugugaaugcgugaccuuuccgggcuaagggguccuggcggaugggauuacauuaaagaccuuaagaugggggccaaggcugguggcucaggccuguaaucccagcacuuuggaaggccgagacaggaggaucacuugaagucaggaguucaagaccagccuggccaacauggcaaaaucaaguaucuacuaaaaauacaaaauuagccaggugugguggcacacaccuguaaucccagcuacuugggaggcugaggcaggagaauugcuugaacccaggaggcggagguugcagugagccgagaucgcgccacuguagugcagccugggagacagagcaagauucugucucaccaaaaaaaaaaaaaaaaaaggccaggcgcgguggcucacaccuguaaucccagcacuuugggaggccgaggugggcggaucacgagguuagagaucaagaccauccuggcuaauacagugaaauuccgucucuacuaaaaauacaaaaaauuagcugggcaugguggcgggcgccuguagucccagcuacuugggaggcugaggcacaagaauggcgugaauccaggaggcggagcuugcagugagccgagauugcaccacugcacuccagccugggugacagagcgagacucugucucaaaaaaaaaaaaagaaagauauuagcugagcaaggaaaaacagugugaccugauaaaucucccgauuuuaucgcuguacuuaugcaagaguaucacacugaaauguguaagggugaugagauggugacuguggugaagucccaaacgugagugacaaagcaaauggagcaaauguuaacuagagaagccaggucagggguguuugggaguuuucuguacuacucuuacaacuuuucuaaaaguuugaaguucuuucaacuuuuuuuuuuugagaugggaucuuguucugucgcccaggcuggaguacaguggcgcagucauggcucacuauagccuugacaucccaggcucaacgauccucccaccucagcuuccuaaggaggugggaccacaggcaugcauuaccaugcccagcuuauuuuuuaauauuuuuuauagagacaggggucuugcuauguugcccaggcugguuuugaacuucugggcucgagugauucuccugccucaaaaaguguuggaauugcaggcgugagccacugcacccggccucuaccagaauuuuaaaugacaauuuuuuuuuuuuuuuuuugagucagaguuucacucuguuguccaggcuggagugcaauggugcgaucucggcucacuacaaccuccgccucccggguucaaccaauucuccugccuuagccuccugagcagcuaggauuacaggcgugcaccaccaugcccggcuaauuuaguauuuuuagcagauaugggguuucaccauguuggccagauagucuccaauucccgaccucaggugaccugcuugccucagccucccaaaguacugggauuacagccgugggccacugugcccagcccaugauaaagauuuuuaaaaacaacaaauggaaacagaauauaaacaaacaacauuguaauguuaauauuaaaucaugcugggaggaacacuggggcaaucucccacgcacauuucagcacauuucgcagcggggagggaggccucaccugccuagcacacaaccaccuggaggccgggagugaggccacccuuccccaccccucccugccugucccucccgcccugccccugcucacugggauccugcucggcguccaucuuggccuugagcagcauccgcagccgugacaccuccugucgcuugagcucauccagcuuggugcggacgugguggcugacaaaguccagcucucggcucagcuucccgcucugacaggagaggagacccuggucagccugggggccugcucucugucuucucuggaagcuucuuauaagcuuucucaugccccagucuuauacugccccuucccugcuuauagucccccagcuccucagagucuccaggaaggacagcucccagcccgucagccuggcauucaaggcccugcccaccugugcugccccaucuccugucauucaucaagccacauguuuaggggccaggugcggugggucacgccuguaaucccagcacuuugggaggcugaggugggaggaucucaagaucagccugggcaacauggcaagucccugucucuagaaacaauacaaaauuagccgugcaugguggugagacccagguccaugagaaggacagauccugauacgaggguucaguguccuacucagugaaauggggacaaugauggugcuccuagaggccugauaugggaguucauggugauguaagggacaccagcaccucccuuauuuugaauucuuccucuguagaaggcaccauaggagcauucuguugacgcagcccucccacaacacuugcuaaggagugucaccaugcucuuccaaacccuuuacacaucuuccuuuggaaaauccaaaccccaaaauccuucccuuggaaaauccaaauccgaacugugcagcagguucuaugaugucucccauuuuacagguggggaaacugaggcacggugaggggaggccccauagcugguaagcggcggagcugcgacugaaagccugcccacgggacucugcacuaaacacguauucuguguuccccaaagcucuucccagcuugugaccccaagaagcaacuucucccugagucuuacuuuggugauuuucaaauacaggcacagcuggagccauguggccccuuugaagaaaccaguauggucaggcaugguggcucaugccuguaaucccaacacuuugggaagccgagaugggaggaucacgaggucaggaguucgagaccagccuggccaacauggugaaaccccgucucuacuaaaaauacaaaaauuagucaggcauggugguguacgccuguaaucccagcuacuugggagguugaggcaggagaacugcuugaaccugcgggguggaggugcagugagcugagaucgcaccaucgcacuccagccugggugacagagcaagacuccgucucaaaaaaaaaaaaaaagaaaccaguccuccccugaacucugcccucccagcacguaccccucccacagcccccacucccccagccgcaccuugauguccuccgcauuggcagccugcagcuucucucggaaaugcccauccgucuccaguacaucgaugaccuccuggagguaccggugguaguacaggccuguguccugaggcaacaaggacagacauagcagccccugcucccauccccauccccacccucacuccuguuacugcuauggccugcucccuggggcagcugacaagggacucaguuuuuaccuuuucccacauaugcagcaaagaugaaaugaaaaucacaucagugaacacccagcccaauacugcccagagugggugcucagaguggacaugacuuguugggaagcugugaaucauacuuuuauccauccauccaaccauccauccauccaugcauccacccauucauccaugcauccacccacccauccauccauacaucccacccacccauccauacauacauccuacccacccaucuauccacccaucauccauccauccauccacccauccauccacucauccauccauccacccacccacccauccauccauccauccacccauccauccauccacccacccauccauccauccauccauccauccacucauccauccauccauccacucauccaccugcccauccauccacccaccuauccauccauccauccaucuauccauccauccauccacucauccacccacccauccauccacccgcccauccauccacucauccauccauccacccacccauccauccauccacccacccauccauccauccacucauccacccacccauccauccacccgcccauccauccaaccacccguccauccauccauccacucauccacccacccauccauccacccgcccauccauccacucauccauccauccacccacccaucgauccauccacccacccauccauccauccacucauccacccacccauccauccacccgcccauccauccacccgcccauccauccaaccacccauccauccauccauccacucauccacccacccauccauccacccgcccauccauccaacugcccauccaucuacccacccgcccaugcaugcauucauucauucaacaaacauucaccaggccccuaucauaugccaggcacugugaacaacacagacaaaagucccaggccuccuagucccacccccgucaugcguagcugggugggacuuuacucucccugggccuucuaugcucuuacuauuuauaaaauaggcaauauauccucugccucccagaguuguggugaaaagcaaauaagauaaguuggaaaaaauaaauaaauaaaauuacaaaagagagaaggccaggcaugguagcucaugccuguaaucccagugcuuugggaggcugagguaggaggaucacuugagcccaggaguucaaggcugcagugagguaugauccugccacugcgcuucagccugggcaccagcacaagacccugucuauuaaacauauauauauauauauacauucuuuaccucuuuaccuagucucacaagaucccacaugauccacauaaucccccucuccccucccucucacucucccugcuccagccacagcagccuccuugacguccucaacuugcucugcuuucuccuaccaaguggccuuugcucaugcuguucccucugccuggaaugcucuuccccucacuuccucucuuccuugcucuugacuuaacauaucucuccaguucagaacucaguggcucacaccuauuaucccagcacuuugggaggccgaggcgggcaaaucacuugaacucaggaguucgagacuagccugggcaguauaaugacacccugucucuaucaaaaauacaaaaaaaauuagcuaggcaugguggcacaugccugcagucccagcuacuccagaggcugaggcaggaggaucgcuugagucugggagauggagauugcagugauugcaccacugcacuccagcuugggugacacagcaaaaauaaaaaaaaaaaaaaaaaagaaaaaggaaaagaaaaaaugagguggcucaugccuguaaucccaccacuuugggaggccgaggcaggcagaucaagaggucaagagaucgagaccauccuggccaacauggugaaacuccgucucuacuaaaaauacaaaaauuagaugggcgugguggugugcgccuguagucccagcuacucgggaggcugaggcaggagaaucaccugaaccugggaggcagagguugcagugagccaagauugcaccacugcacuccagccuggugacagagcgagaaagaaagaaagaacucaacucacgccucccuuccucccugacugucaccccugguguucacucucauagagcccugcccuuugucuuccaucucccagugagcagggauaguccaugggcauggggcaugcacauggcugggcccuaacaacuaugcaacacauaggcaacacuaugcccggcucauagaaggugcucaggaaacauguggaauggaagaaaagaaaugggacucaacaaagccuuccugggucugcaaggauuucacagaauagaggccuaacuugcagcguggggaccaggaacaugcaaugauccguuccaggggguaaugacuagcccauucuuuguuuuuugagacagucucagaaaacagagucucagcucuguugcccaggcuggagugcaauggcgugaccuuggcucacugcaaccuccaccucucuugguuccagcacgagaauucgugccucagccucccagaguagcugggauuauaggcgugagccaccacgcccagcuaauuucugcauuuuugguagagaugggguuuugccauguuggccaggcuggucuugaacuccugaccucaagugauccgccugucucggccucccaaagugcuaggauuacaggcaugagccacugcgccuggccugaccagccuauccuuauggggagcuauaggaagauucggaccacaagacacucacugaccuucaggaucuccaaaguuccaaaucccuuaagaccaaagcuuuuauuggguuugauaaacacauguaggaauuaauaaacaagcaguucacccgcccuucuguaauuuaaacuacaacucccaagagcaccaugaagucagaauaccccagcuagccaacaucaacugcuacugggaacuagcaacauggugcuacugggaaauguaguuuuguuuguuuguuuucaaauuccuucuuggguggagagaaucuuaaaaaaacagacguuuaguuggggcgugaugcagauuuuccacaccucagagucagggaccuccaguuuuucaccaagucaaaccccugcugcugggaggaauggugggcaaaaaacaagcuacaacuguagggccaggaagucacuggagcauccgcccuacgggcaccggggucugcaggagcuguaguaccacugcaaacaccuggcuggauagcagggcagggccacucacgggacucucagucgcaggggucuccuccuuguugggcgccccucgcuccagggggacagccagcacggcgcgaagcaggagcagcagcagcagcggcaacagaaggaggguuccucggggcccagagggaggcauggcaguguggucugugggggauggagggcuggauaaugcauaaugucugucccaagccucuuccuccccuggaaccaggaguucgggcccccagcgccgcccccacuuccaagaaucaagacacaagcauuuuguuacccaggccccaggauuccaggccuccggccuucccuuccuccgacacaggagucugggcccucagacccagggguccuggcucccaacacgcuccucucucacacucaggaauccgggaucucggccgccuccucccccagacccaagaguccagggucccagccuccucuuuucccaggaccuaaaguacuggcacccagugcauccuccuccgggacccaguuuuccagcccucuggcccccauccucccuaggacccaagaguaugggaacccuggccucucaccucuccuucaccgcagagggcguuuuccagggcgggcaaggaccuccggugcguucuuggugacuuccccccuagaccacgcccacuuauccacagaggccccgccccaaagaggucugauugguccacgcuggcucuguagcuuucauccacguccagcggccccgccccuugccgaagccgcucgcauuuucgugaaagccucgcuucuuucucggaaucccagccucuugacgccacauuucccgccuaugccaaaagagagagaaggcuuucaaagauaacuacaacucccugccggccgggggaaaaauaacuuccgc

SEQ ID NO: 191772 - RNA, 23234 nt, Homo sapiens
gcggaaguuauuuuucccccggccggcagggaguuguaguuaucuuugaaagccuucucucucuuuuggcauaggcgggaaauguggcgucaagaggcugggauuccgagaaagaagcgaggcuuucacgaaaaugcgagcggcuucggcaaggggcggggccgcuggacguggaugaaagcuacagagccagcguggaccaaucagaccucuuuggggcggggccucuguggauaagugggcguggucuaggggggaagucaccaagaacgcaccggagguccuugcccgcccuggaaaacgcccucugcggugaaggagaggugagaggccaggguucccauacucuuggguccuagggaggaugggggccagagggcuggaaaacugggucccggaggaggaugcacugggugccaguacuuuagguccugggaaaagaggaggcugggacccuggacucuugggucugggggaggaggcggccgagaucccggauuccugagugugagagaggagcguguugggagccaggaccccugggucugagggcccagacuccugugucggaggaagggaaggccggaggccuggaauccuggggccuggguaacaaaaugcuugugucuugauucuuggaagugggggcggcgcugggggcccgaacuccugguuccaggggaggaagaggcuugggacagacauuaugcauuauccagcccuccaucccccacagaccacacugccaugccucccucugggccccgaggaacccuccuucuguugccgcugcugcugcugcuccugcuucgcgccgugcuggcugucccccuggagcgaggggcgcccaacaaggaggagaccccugcgacugagagucccgugaguggcccugcccugcuauccagccagguguuugcagugguacuacagcuccugcagaccccggugcccguagggcggaugcuccagugacuuccuggcccuacaguuguagcuuguuuuuugcccaccauuccucccagcagcagggguuugacuuggugaaaaacuggaggucccugacucugagguguggaaaaucugcaucacgccccaacuaaacgucuguuuuuuuaagauucucuccacccaagaaggaauuugaaaacaaacaaacaaaacuacauuucccaguagcaccauguugcuaguucccaguagcaguugauguuggcuagcugggguauucugacuucauggugcucuugggaguuguaguuuaaauuacagaagggcgggugaacugcuuguuuauuaauuccuacauguguuuaucaaacccaauaaaagcuuuggucuuaagggauuuggaacuuuggagauccugaaggucagugagugucuugugguccgaaucuuccuauagcuccccauaaggauaggcuggucaggccaggcgcaguggcucaugccuguaauccuagcacuuugggaggccgagacaggcggaucacuugaggucaggaguucaagaccagccuggccaacauggcaaaaccccaucucuaccaaaaaugcagaaauuagcugggcgugguggcucacgccuauaaucccagcuacucugggaggcugaggcacgaauucucgugcuggaaccaagagagguggagguugcagugagccaaggucacgccauugcacuccagccugggcaacagagcugagacucuguuuucugagacugucucaaaaaacaaagaaugggcuagucauuacccccuggaacggaucauugcauguuccugguccccacgcugcaaguuaggccucuauucugugaaauccuugcagacccaggaaggcuuuguugagucccauuucuuuucuuccauuccacauguuuccugagcaccuucuaugagccgggcauaguguugccuauguguugcauaguuguuagggcccagccaugugcaugccccaugcccauggacuaucccugcucacugggagauggaagacaaagggcagggcucuaugagagugaacaccaggggugacagucagggaggaagggaggcgugaguugaguucuuucuuucuuucucgcucugucaccaggcuggagugcaguggugcaaucuuggcucacugcaaccucugccucccagguucaggugauucuccugccucagccucccgaguagcugggacuacaggcgcacaccaccacgcccaucuaauuuuuguauuuuuaguagagacggaguuucaccauguuggccaggauggucucgaucucuugaccucuugaucugccugccucggccucccaaaguggugggauuacaggcaugagccaccucauuuuuucuuuuccuuuuucuuuuuuuuuuuuuuuuuuauuuuugcugugucacccaagcuggagugcaguggugcaaucacugcaaucuccaucucccagacucaagcgauccuccugccucagccucuggaguagcugggacugcaggcaugugccaccaugccuagcuaauuuuuuuuguauuuuugauagagacagggugucauuauacugcccaggcuagucucgaacuccugaguucaagugauuugcccgccucggccucccaaagugcugggauaauaggugugagccacugaguucugaacuggagagauauguuaagucaagagcaaggaagagaggaagugaggggaagagcauuccaggcagagggaacagcaugagcaaaggccacuugguaggagaaagcagagcaaguugaggacgucaaggaggcugcuguggcuggagcagggagagugagagggaggggagagggggauuauguggaucaugugggaucuugugagacuagguaaagagguaaagaauguauauauauauauauauguuuaauagacagggucuugugcuggugcccaggcugaagcgcaguggcaggaucauaccucacugcagccuugaacuccugggcucaagugauccuccuaccucagccucccaaagcacugggauuacaggcaugagcuaccaugccuggccuucucucuuuuguaauuuuauuuauuuauuuuuuccaacuuaucuuauuugcuuuucaccacaacucugggaggcagaggauauauugccuauuuuauaaauaguaagagcauagaaggcccagggagaguaaagucccacccagcuacgcaugacgggggugggacuaggaggccugggacuuuugucuguguuguucacagugccuggcauaugauaggggccuggugaauguuuguugaaugaaugaaugcaugcaugggcggguggguagauggaugggcaguuggauggaugggcggguggauggauggguggguggaugaguggauggauggauggaugggugguuggauggaugggcggguggauggaugggcggguggauggauggguggguggaugaguggauggauggauggguggguggauggaucgauggguggguggauggauggaugaguggauggaugggcggguggauggauggguggguggaugaguggauggauggauggacgggugguuggauggaugggcggguggauggauggguggguggaugaguggauggauggauggguggguggauggauggauggguggguggauggauggaugaguggauggaugggcggguggauggauggguggguggaugaguggauggauggauggauagauggauggauggauggauagguggguggauggaugggcagguggaugaguggauggauggauggaugaguggauggauggauggauggauggauggguggguggauggauggauggguggauggauggauggauggguggguggguggauggauggaugaguggauggauggguggauggauggauggaugauggguggauagauggguggguaggauguauguauggaugggugggugggauguauggauggauggguggguggaugcauggaugaauggguggaugcauggauggauggaugguuggauggauggauaaaaguaugauucacagcuucccaacaagucauguccacucugagcacccacucugggcaguauugggcuggguguucacugaugugauuuucauuucaucuuugcugcauaugugggaaaagguaaaaacugagucccuugucagcugccccagggagcaggccauagcaguaacaggagugaggguggggauggggaugggagcaggggcugcuaugucuguccuuguugccucaggacacaggccuguacuaccaccgguaccuccaggaggucaucgauguacuggagacggaugggcauuuccgagagaagcugcaggcugccaaugcggaggacaucaaggugcggcugggggagugggggcugugggagggguacgugcugggagggcagaguucaggggaggacugguuucuuuuuuuuuuuuuuugagacggagucuugcucugucacccaggcuggagugcgauggugcgaucucagcucacugcaccuccaccccgcagguucaagcaguucuccugccucaaccucccaaguagcugggauuacaggcguacaccaccaugccugacuaauuuuuguauuuuuaguagagacgggguuucaccauguuggccaggcuggucucgaacuccugaccucgugauccucccaucucggcuucccaaaguguugggauuacaggcaugagccaccaugccugaccauacugguuucuucaaaggggccacauggcuccagcugugccuguauuugaaaaucaccaaaguaagacucagggagaaguugcuucuuggggucacaagcugggaagagcuuuggggaacacagaauacguguuuagugcagagucccgugggcaggcuuucagucgcagcuccgccgcuuaccagcuauggggccuccccucaccgugccucaguuuccccaccuguaaaaugggagacaucauagaaccugcugcacaguucggauuuggauuuuccaagggaaggauuuugggguuuggauuuuccaaaggaagauguguaaaggguuuggaagagcauggugacacuccuuagcaaguguugugggagggcugcgucaacagaaugcuccuauggugccuucuacagaggaagaauucaaaauaagggaggugcuggugucccuuacaucaccaugaacucccauaucaggccucuaggagcaccaucauuguccccauuucacugaguaggacacugaacccucguaucaggaucuguccuucucauggaccugggucucaccaccaugcacggcuaauuuuguauuguuucuagagacagggacuugccauguugcccaggcugaucuugagauccucccaccucagccucccaaagugcugggauuacaggcgugacccaccgcaccuggccccuaaacauguggcuugaugaaugacaggagauggggcagcacaggugggcagggccuugaaugccaggcugacgggcugggagcuguccuuccuggagacucugaggagcugggggacuauaagcagggaaggggcaguauaagacuggggcaugagaaagcuuauaagaagcuuccagagaagacagagagcaggcccccaggcugaccagggucuccucuccugucagagcgggaagcugagccgagagcuggacuuugucagccaccacguccgcaccaagcuggaugagcucaagcgacaggaggugucacggcugcggaugcugcucaaggccaagauggacgccgagcaggaucccagugagcaggggcagggcgggagggacaggcagggagggguggggaaggguggccucacucccggccuccaggugguugugugcuaggcaggugaggccucccuccccgcugcgaaaugugcugaaaugugcgugggagauugccccaguguuccucccagcaugauuuaauauuaacauuacaauguuguuuguuuauauucuguuuccauuuguuguuuuuaaaaaucuuuaucaugggcugggcacaguggcccacggcuguaaucccaguacuuugggaggcugaggcaagcaggucaccugaggucgggaauuggagacuaucuggccaacauggugaaaccccauaucugcuaaaaauacuaaauuagccgggcaugguggugcacgccuguaauccuagcugcucaggaggcuaaggcaggagaauugguugaacccgggaggcggagguuguagugagccgagaucgcaccauugcacuccagccuggacaacagagugaaacucugacucaaaaaaaaaaaaaaaaaauugucauuuaaaauucugguagaggccgggugcaguggcucacgccugcaauuccaacacuuuuugaggcaggagaaucacucgagcccagaaguucaaaaccagccugggcaacauagcaagaccccugucucuauaaaaaauauuaaaaaauaagcugggcaugguaaugcaugccuguggucccaccuccuuaggaagcugaggugggaggaucguugagccugggaugucaaggcuauagugagccaugacugcgccacuguacuccagccugggcgacagaacaagaucccaucucaaaaaaaaaaaguugaaagaacuucaaacuuuuagaaaaguuguaagaguaguacagaaaacucccaaacaccccugaccuggcuucucuaguuaacauuugcuccauuugcuuugucacucacguuugggacuucaccacagucaccaucucaucacccuuacacauuucagugugauacucuugcauaaguacagcgauaaaaucgggagauuuaucaggucacacuguuuuuccuugcucagcuaauaucuuucuuuuuuuuuuuuugagacagagucucgcucugucacccaggcuggagugcaguggugcaaucucggcucacugcaagcuccgccuccuggauucacgccauucuugugccucagccucccaaguagcugggacuacaggcgcccgccaccaugcccagcuaauuuuuuguauuuuuaguagagacggaauuucacuguauuagccaggauggucuugaucucuaaccucgugauccgcccaccucggccucccaaagugcugggauuacaggugugagccaccgcgccuggccuuuuuuuuuuuuuuuuuuggugagacagaaucuugcucugucucccaggcugcacuacaguggcgcgaucucggcucacugcaaccuccgccuccuggguucaagcaauucuccugccucagccucccaaguagcugggauuacaggugugugccaccacaccuggcuaauuuuguauuuuuaguagauacuugauuuugccauguuggccaggcuggucuugaacuccugacuucaagugauccuccugucucggccuuccaaagugcugggauuacaggccugagccaccagccuuggcccccaucuuaaggucuuuaauguaaucccauccgccaggaccccuuagcccggaaaggucacgcauucacagguuccggggaucaggauguggauaucuuuuagggcaccaguauccagcugccacaacacccaggcucuucccgucccuccucugcccagagccugcccccggcaccccagugcccucaggcccgcauucauguuccucuugucugcucggagccuggguggaccuuggccacacccgcccaacccugcccuucccguaugcacccugaccuucuugcgucagcauuuuuagaaauugcuggcgugcagccuugggaccuuuguccguucgccccgcucucccgugacauucuuucucagggcucuuugccugguccauggaccuuccaucuccccuggaaugucaccuccucagggugucaccgccccggcuguccugugugaaggagccucuguguuauuuguguccuugguauuccuuuguucaucccuuggucgccuguucucugucucucuagacugggugcuccaagaggcagaacucuuuugguuguuguuguuuuugagacagagucucacucugucgcccaggcuggagugcaguggcgcgaucucggcucacugcaaccucugccucccagguucaagcgauucuccugccucagccuccugaguaucugggauuacaggugcccgccaccauaccuggcuaauuuuguaucuuuaguagagacaggguuucaccauguuggccaggcuggucucaaacuccugaccucaggugauccacccgccucagccucccaaauugcugagauuacaggcaugagccaccccgccuggccuccaagagucagaauucugucaucauuugauuccugcuguguccauagcggccggcgcugggucagccuggaauagcggcucaacacacgucccuggcacaaauaaugaauuugagauucaguuuguaccuguguccugcacaccugucacuccucugggcucagccagggccggagcugccuccacugcagccuaggucucccaaauucuagcugcccgugugugugugugugugugugugugugugugugugugugugugugugugucuuucugcccacuugaccaaggggugugugugugugugugugugugugugugugugugugugugucuuucuccccaccuaaccaagggccacuggaggccagggccaggcugauucauuuuggguccagcauugcacagcgcaggccugggccccuagaagccucgggagacaugcgugcgguaaguguguguuggcagcgugugcgcuguccuuuccugccuggaaacccuaccccuuccugacuacuuggaaacucccauaugagggaggcugcacuuguuugcugaggccgcuguaaccaaguaccacugaccaggugcuucagcaacagaacuugacugucucauggccugcagucagaguccaaagugaaaguauuggcaggguugguuccuucuggggcuaugagggaggaucuguaccaggccccucuccuuggcuugcagauggccgucuucucacugcauuuucacaccaucuuuccucucugugugccuggcccaaauuucuccuuccauuauuauuuuuuauuaauuauuauuauuauuauuuuuuuuuuuuuccaagacagaguuuugcucucguugcccaggcuggagugcgguggcgcgaucucagcucacugcaaccucugccucccagguucaagcgauucuccugccucagacuccuaaguagcugggauuacaagcacgcgccaccacgccuggauaauuuuguauuuuuaguacagauggaguuuugccauguugggcaggcugguuucgaauuccugaccucaggugauccacccgccuuggccucccaaagugcuaggauuacaggugugagccaccgcgcccggccuauuauuauuuugagacaggguuucacuucuauccuccaggcuagagugcaguggugcgaucucggcucacugcauccucccccucccacgcucaagugauucuccugccuuagccuccugagcagcugggacuacaggcacacaccacugcacacagcuaauuuuuauauuuuuuguagagaugggguuucaccauguugcccacgcuggucucgaaugccugagcccaagugauccucccaccucagucucccaaagugcugggauuacaggcaugagccacugugcccagucauaaauuucugccuuuuauaaggucaccaaucauguuggauuagggcccacaguaaugaccucaucuuaaccugauucccucuguaaagaccuagucuccaaaucaggucacauucugagguacuggggcuuaggacuucaacauagaaacuuaggagcgugcaauuuaaccccuaagauugguugaugcuuuaucaaaaauuuugauguuuuucuuuuguuuguauguauguauuuauuuuauuuauuuauuuuucagacggagucucacucugucaccaggcuggugcaguggcgugaucucggcucacugcaaccuccgccucccagguuccagugauuccccugccucagccucccaaguagcuggggcuacaggugcgcaccaccaugcccagcuaauuuuuuauguuuuuauuagagaugggguuucaccauguuggccaggauggucucaaucucuugaucuugugauccgccccccuuggccucccaaagugcugggauuacaggcgugagccaccgcacccagccuuguuuguuuuuuuuaaagagugguugaggcugggcgugguggcucacaccuguaaucacaacacuuugggaggccgagguggguggaucaccugaggucaggaguucaagaccagccuggccaacauggugaaacccuguuucuguuucuacuaaaaauacaaaaauuagccgagugugguggcaugcaccuguagucccaguuacucggggcugaggcaggaggauugcuugagccugggaggcggagguugcagcgagccgagauccugccacugcagagugaaacccugucucaaaaaaaaaaaaaaagaaggaaaagaaaaaaagaaaugguugagugucaugguuuuuggauguccaauggcugguucccauccuugcucugccacuugcuagcugguacccuagaccagucacaaccccucaaggggucucaguuuucacauucauaaaauggggauaaucauaaaacccuuguugucaggauuuuguggaaagugaaugaauuaauacaguuaaagugcuuagggcauggccuggcaucuaguaaguaggcacuacauguuaguuuuuauuaugguuauuauuguaagcaucagacucagucgugggaucaccuccuccaggaagccuucccugauugccccagguucaagcugucuucugggcuucccuagugcuguccgugacuucuuuggaucaugucuggcccaagauggggguucugaaagaacaugcccucagguguuggacucuucccucucuuccagauguacagguggaucaucugaaucuccugaaacaguuugaacaccuggacccucagaaccagcauacauucgaggcccgcgaccuggagcugcugauccagacgguaaugggaguggguccggaggcagaggauugaggguagcuuugcggaaggggagaaggggacagagucccagacgugagccagcucaccauuccugcugguguucucugagguuggaggcugguagagggcugagucguuucuuuucuuuucuuuuuuuuuuuuuuuuugagacgaaaucucgcuguuuucccccaggcuggagugcaauggcacaaucucggcucacugcaaccuccgccucccggguucaagcgauucuccugccucagccucccgaguagcuaggauuacaggugccugccgucacgcccagaaaauuuuuguauuuuuaguagagacaggguuucaccauguuggccaggcuggucucgaacuccugaccucaggugauccacccgccucagccucccaaagugcugggauuacaagugucagccaccgcacccagcucuucuuauagugauacccaccguaaucuagcaggccaucaucuuaacuaauuacaucugcaaacacucuauuuccaaauaagaucacauucugagauuccagguggacaugaauuugggaguguggggggaguauacuguucaaccugguauuguuaacuccauuuuacagagguggaaacugaggcacaaagaggcugaguaacuugcccagugucacagagcuuaugagauuuggucacaaagcaaagccuagauuugaacgcugggcaaaauaguuagaaaccucuuguucuuuuuuugguuuauuuuuacuuuuuuuuuuuuuuuuuuuaccugagacagcgucuugcucugaugcccaggcuggagugcaguggcaugaucacagcucacugcagccucaaccuccugggcucaagcaauccucccaccugacccuccugaguagcugggaccagaggugcaagccaccgcaccaggcuaauuuuaaaaauuuuuaguagacacaaggucucgcuguguuaugugaguuagucuugaacucccgggcucgagugauccucccacccuagccucccaaagugcuaggauuccaggcgugacccaccucuccuagucugaccuuauguucuuggccaccuagcuguaccugaaauacauaaauacuaaguucaccacauauguuguuccuauuuacuuauuccuccaagaucuggagauuguggaggacuugaaagagguggguugaaguugcuauuguauaaccgucccaaucuguuuugaauaaagagaagaaaguguguuauggggcaggagcagucauggaaaccaaaaagggcgacaucaggcugugcgcgauggcucacgccuauaaucccagcacuuugggaggcugacgugggcggaucaccugaggucaggaguuugagaccagccuggccaacauggugaaaccucguuucuacuaaaaauacaaaaaucagcugggccuggugacacaugccuauaaucccagcuacucgaaaggccgaggcaggagaaucacuugaacccggaagacagagguugaagugaggcagugagcagagauugugccaccgcacuccagccugggcaacagagcaagacucccucucaaaaaaaaaaaaaaaaaaagggacauuaggacacgagacguaagaaagacagguagaggcuggggcugcccucagccagguucagggccaagggccugccauuuacaggcuggaauugggggcugggcagagggggcagaggggaaugacccugugccuuuccccaggccacccgggaccuugcccaguacgacgcagcccaucaugaagaguucaagcgcuacgagaugcuuaaggaacacgagagacggcguuaucuggagucacugggagaggagcagagaaaggaggcggagaggaagcuggaagagcaacagcgccggcaccgcgagcacccuaaagucaacgugccugugaggaccccauuugugcccauccacucccuaccacauccaguucaaacgcaagacaagaaagcaguuaaagaacuacaauucccaggggcccuugaggcaaaaaaacucccuguuacuguaccuggcugccccagggucugcugggaguuguaguuuucuuaguuuucuugcuugagggagaugauguuuguuggaugaggguaaagggauauuugguuuuaucccauggcauccagacuucuugcucaugagcuccuggcucuccccuccacagggcagccaagcccaguugaaggaggugugggaggagcuggauggacuggaccccaacagguuuaaccccaagaccuucuucauacugcaugguaagguggggagggaguuccagagccaggaugaacccuagauucugacccuucuaggaccugaaugcuaagaggggugugucugucccaggagggcuuagucaggcccaagagccaagccuauguccccugguugaccagacagcccugccucucccgacuacaaggcuaggaucugcauggaaggguugggccucuuuucuagcaaacaccagaccucgggguucuaaggacagcugguguccucuguaagcaaaccaggcuuggcuaggccugggcccucugcccacagcagcccaggagaagcccugguccacucugggaacccugucgcuaggaguggguuguucccuaagaaccaggccuccagaagccuggaaaacccuuucucuuuuucuuuuuccuuuuuuuuuuuuuuuuugagauggagucuugcucuguugcccaggcuggagugcaguggcaugaccucggcucacugcaacccccugcccuccgccucccggguucaagugauucuccugccucagccucccgaguagcugggauuacaggcaugcaccaccaugcccggcuaacuuuuguauuuuuaguagagaugggguuucaccauguuggccaggcuggucucgaacucccaaccucgugugaucugcccccucagcaucccaaagugcuaggauuacaggcgugagucacugcgcccggccucgaaagcccuuucucuaugguggaucaaaggcacacuccccucagucugucucuuccugucuggaaauguggccugggguugccaagcccccucagguaugccaagcacccugucccagaaucuguagccggucagauaagcuuagcaaggccugacucauucauucagcaaaccuuuccuaaguucccucuaaggaccaagcuuugucaagaccccguggauacaacuguaaacaaaacaaaguaccucccccucagagccagugaucaggcacacagaucauaccauacuuuaguaacuccacgagacuguacaguaugagaggugcuagcauuuuacguaagcugccaauuaaauuaacguaccauugaaaacaagaugcguccugggcuggguguaguggcucaugucuguaaucccagcacuuugguaggccaagguggaagauggcuugagcccaggaauuuaagaccagccuggacaacaaagugagacccugucucuauuuaaaaaaaaaaaauagaccaggcgugguggcucacgccuauaaucccagcauuuugggagguugaggugggaggaucaccugaggucaggaguucaagaccagccuggccaacauggugaaaccccaucuccacaaaaauaccaaaauuagcugggcaugaucgugagugccuguaaucccagcuacucaggaggcugaggugggagaaucacuugaacccgggaggcagaguuugcagugagccaagaucgugccauugcacugcagccugggugacagagcaacacuccaucucaaaaaaacaaagaaaaaaauaaaaauuaaaaguuaaauaaauaaagauacaucccuauuucaggggugauaaaauagaagaacacaaaagugcaucucagaaucaacgaagguucuaggccgggugugguggcucacgccuguaaucccaacacuuugggaggccuaggcgggugggucccuugaggccaggaguuggagaccagccuggccaacauggcaaaacccagucucuacuaaaaauacaaaaauuaaaaaacaaaacaaaaauuagccaggcaugguagugcucaccuauagucccagcuacucaggaggcugagguaggagaaucgcuugaacccgggaggcggaaggcggggguugcaaugagcugagaucacaccacugcacuccagccugggcaacagagugagacucugucucaaaaagcaauagaaaguaaaaaagaauuagaagauucuguaauggggucucagguagugacguguacuaccucgcagccuugaccacccagguucaagugauccucccccucagccucccaaguaucugggaccacaggcacguaccacuaugccuggcuaauuuuuuuaauuuuuaguaaaggcaagguuuuaccauguugcccaggcuggucucaaacuccuuugcucaagcgauccaccuaucuuggccucccgaagugcugggguuacaagcaugagccaucccaccgggcaccaccccccguguuuuguuuuguuuuuuuuuugagacaggaucuugcuauguugcccaggcuggagucaaacuccaggccucaaacaauccuccugccucagucaccugaguagcugagacugcaggugugugccacugcgcccagcuuuaaagauguuuaauuguacaguucaauaguauuaaguauauuuacacugucaugcaaccaauucugagagcucuucaucucgcacaaccgaaaccguauccauuaaaccacucgcccuccccuucuuuccccugcucucuagcaaccaccauucuauuuucugucucuaugauuuugacuauuuuagguacuucaugcaaguagaaucuuuugguauuugucguguguguguguguguguguguguguguuuggcuuauuucacuuagcauaauggugaggaacugaaguuuucauucuacuggauauuaauuucuauuucaauugccccauguggcuaguggcugcuguacuggagucccagcacagcucuagagaggacauuugggcuggaugcgguggcucacgccuguaaucccagcacuuugggaggccgagguggguggaucccuugaguccaggaguucaaggccagccugggcaacauggcacaaacccaucucuacaaauaaaauacaaaaauuagcugggugugguggcgugcaucuguagucccagcuccuugggaggcagaggugggaggaucacuugaguccaggaauucaaggcugcagugagcuaugaucauaccagugcccuccagccugggcaacagagugaaacccugucucuaaaaaauagaaaauaggcugggcucaguggcucacgccuguagucccagcacuuucggaggccaaggcaggcagaucaggagcucaagagaucgagaccauccuggccaacauagugaaaccccgucucuacuaaaaauacaaaaauuaucugggcaugguggcacgcaccugcagucccagcuacucaggaggcugaggcaggagaaucacuuaaacccuggagguggagguugcagugagcugagaucaugccacugcacuccagccuggcaacagagcgagacucugucucaaaaauaaauaaacaaauaaauaggcccggcgcaguggcuuaccccuauaaucccagcacuuugcgaagccaaggcggcuggaucccuugagaccaggaguucaagaccagccugggcaacauggcaaaaccccaucucuaugaaaacaaauacaaaaauuagcugggugugguggcgugcaucuguagucccagcuacuugggaggcugaggugggaggaucacuugagccgaggaguucaaggcuucagugagcuacgaucacaccauugcacuccagccugggugacagagugagacccugucucuaaaaaauaaaaaaauaaaaaccuuauuuaaucuuuuuaaucaggcagucccuacagaccagaauagguucagagcaacucccuauaccuuuuuuuauuuuucauuuuuuuuauuuuuagagauggggcuucccuuugucacccaggcuggagugcaguggcgugaucauggcucacugcaacccagaccuccugggcucaagugauucuuccaccucaacccuuagaguagcugggaucauaggugcacaccaccaugcccagccaauuuuuaaauuuuuuuuuucuuuuugaggcagagucuugcucuguugcccaggcuggagugcaauggcaugaucuuggcacacugcaacccccgccucccagguucaagcuauucuccugccucagccuccugaguagcugggguuacaggcacuuggcauuaugccuggcuaauuuuuguauuuuuguagagacgggguuuuacuaugcuggccaggcuggucuugaacuccugacuucaggugauccuccugccucggccucccaaagugcugggauuacaggcgugagccaccgcacccggcccaauuuuuuacuuuuuuuuuuuuuuuuguagagacggggucuagccaucuuuucuaagcuggucucgaacuuaaugugcucaaaugaucuugccuuagccuuccaaaguacugggauuacaggcaugagccccuaaauuuggccccuacauuuucuuuaaucuuaaucaauuuacauuuaaacagcccauguggcuagcggcuacuguacuggacagcgcagauccagaguuuaggcagagaagagacccccaggccugagcccugggccacacuagcauguggaggucaggaagaggauggagccgucaaaggagguggaggggcagccagagaggacagaaucauguucuggaagccaagggcagaaagucaagucagaugcagguggaaauuaaccacuggauuugcaagaugaggguuccuggccuccuccucaggaggaagguugugcuugucugagggagccgaggaaggagggccgguggugaggacaggaaguguggcugaccgagccugaagcccugcagcuguggggucuacguugguaggagaggcuccccucacaacuggagucggcacuggccugguugucugggaggcagaggucccugauaacccuggagcugacucuguguccagagcacugaaugccagggccagagaauccugcaugacagugacccaagcauguuuccucgaacccucccuuugaucuauuccauucucaacccccuggucgcuaggcaguggcccuagcaacgggucuagugggguacuaaagccugggggccaccguuccaccgcgggagacccguaguuaccuguccucugauaacagaccccacaucagcccaaaauuucuucaccagggaccuuacacaucccguccucgguccccugagauaccuugcuauccucuucccuucagauaucaacagugaugguguccuggaugagcaggagcuggaggcacucuucaccaaggaggugagcaucuuggaagccucgggcaccuggagggacgcccaaaucagccacuuguuuccuccugcaguccccuuaaaucccccuggaugggagcucagugaaaacuacaacucccaucagccccuggggcaaaaacggcucccaggagugguagcgugcccaaaggacugcugggaguugaaguugucgggaaugagcucgcuggggaccucucaaugcugucugccucucgcuugcuccugcagcuggagaaaguguacgacccaaagaaugaggaggacgacaugcgggagauggaggaggagcgacugcgcaugcgggagcaugugaugaagaaugugaggugggggccaggcgggggagaggacgggcccccagcucugucacucacccuuaucuggcuccccagguggacaccaaccaggaccgccucgugacccuggaggaguuccucgcauccacucagaggaaggaguuuggggacaccggggagggcugggaggugagaacaugggggauacucgggguccugaaccucucucucuucuagccaugaccuuucuuucagaaucuuaggccccuucucuuucucucuggguccccguccauucuccugggucacugcaucucuaucucugggucucuguuuuccccugucucuaggacucuuauuuauuuauuuauuuauuuauuuauuuauuuauuuauucugagacggagucucacuccaucgcccaggcugcagugcaguggcacgaucucggcucacugcagccuccaccucccagguucaagcaauucuccuggcucauccucuugaguagcugggauuauaggugcgugccaccacacccagcugauuuuuguauuuuuaguagaggcaggauuucaccauguuggccaggcuggucucaaacuccugaccucagguuauccacccaccuuggccucccaaagugcugggauuagaggugugauuuuuuuuuuuuuuuuuuuuuuucugaaacagggucuugcucugucgcguaggcuggagcccaguggugggaucucggcucacugcaaccuccgccucuuggauucaagcgauccucccaucucagccucaugaguagcugggauuacaggcgugagccaccaugccuggcuaauuuuuguauuuuuuguagagaugggguuuugccauaucggccaggcugcucuagaacugcuggacucaagcgauccaccugaccuggccucccuaaguggugggauuacaggcaugcaccaccgcaccacaccuagcuaauuuuuguauuuuuugguagagacaggguuuugcauguuggccaggcugcucugaaacuccuggacucaagcuauccacccuucucagccucccaaagugcugggauuacccaggcuggagugcagggguguuaucauggcccacugcagccucaaacuccuguccucaagugauccuccugccugagccucccuauuagcugggacuacaggcacaugccagcaugccuagcuaaucuagcucauucuuuuauuuauuuauuaauauuuuuugagacagggucuccugucacccaggcuggagugcagugguguaaucauaguucacugcagccuugaauuccugggcucaggugauccuccuuccuuagccuccugaguaacugggacuacaggcacauaccaccaugcccagcuaaucuaggucucuguuuuauuuauuuauuuauuuguuuguuuauuuuucaauacagaguuuugcucuuguugcccaggcuguagugcaauggugcauucucagcucauugcaaccuccaccucccagguucaagcaauucuccugccucagccuccugaguagcugggauuauaugcauguaccaccaugcccugcucauuuuguauuuuuaguagagacgggguuucuccauguuggucaggcucaucucaaacuacugaccucaggugagccacccaccucggccuccgaaagugcugggauuacaggugugagccauggugccuggccuauuucuauauauuuuucaagaugcccagccaauuuucuguagagacagggucucgcuccguugcccaggcugaccuugaacuccuggcgucaagugauccuucccacuuucgccucccaaaguccugggauuacaggugggagccauggugcccggccuugucucucggucuuuaucccacucccaccucccacuugggcuucuuugcccacccacauggcccuggccucccagccuccucuacaccucccccauuggcacaacccucuccaacaugggugggccgagguuggaccugugccccugauggccccugugccugcccugcagacaguggagaugcacccugccuacaccgaggaagagcugaggcgcuuugaagaggagcuggcugcccgggaggcagagcugaaugccaaggcccagcgccucagccaggagacagaggcucuagggcggucccagggccgccuggaggcccagaagagagagcugcagcaggugacagcgggggaagcugcuuccauccacugaaucucuggcugcccguguccguguccccauggguguccagaagcugggaaggccuguggccaccauguuaaucacugggggagccucaaguauucaccgccaucuugaguaagggcagacguuuucccgucucugacggcucuguggcugccaugugagauaagggcauuaaggcuguaagugaggagggaaaggcccaggagggggagaaaggcagacucagccagggaugggugaggguuucccugucccaaagcaagacccaagcugugacuggagggagaacuggauccuugacuauuauuaagcccgacugucaaugaaagagagaaacugaggcccacggagaagggguuggccgugaccacuuagcaggcugcugugaagucuccguuuggggacugaggccugagcacuugcaaugccagcaucacacccucuugucugugugaccccccaccucccacaggcugugcugcacauggagcagcggaagcagcagcagcagcagcagcaaggccacaaggccccggcugcccacccugaggggcagcucaaguuccacccagacacaggugcuggcccuaguccagggaggaggggcugcagggcuggaccccugggucugagguuggaggggcugggccuggacucccagaucugagggaagagggacugggggcccagacucccagaucugagggaagagggacuggggguccggacuccugggucugagggaggaggggcugggggcugggaccccugggugugagggaggaggggcugggaccccugggugugagugaggaggggcugggggcuggaccccugggugugagggaggaggggcugggggcuggaccccugggugugagggaggaggggcugggccucugggguccugggggaggagggguucggauguccugugccaccauucccucccuccauuuccagacgauguaccugucccagcuccagccggugaccagaaggagguggacacuucagaaaagaaacuucucgagcggcucccugagguugaggugccccagcaucugugauccuccgggaccccagcccucaggauuccugaugcuccaaggcgacugaugggcgcuggaugaaguggcacagucagcuucccugggggcuggugucauguugggcuccuggggcgggggcacggccuggcauuucacgcauugcugccaccccagguccaccugucuccacuuucacagccuccaagucuguggcucuucccuucuguccuccgaggggcuugccuucucucguguccagugaggugcucagugaucggcuuaacuuagagaagcccgcccccuccccuucuccgucugucccaagagggucugcucugagccugcguuccuagguggcucggccucagcugccuggguuguggccgcccuagcauccuguaugcccacagcuacuggaauccccgcugcugcuccgggccaagcuucugguugauuaaugagggcaugggguggucccucaagaccuuccccuaccuuuuguggaaccagugaugccucaaagacaguguccccuccacagcugggugccaggggcaggggauccucaguauagccggugaacccugauaccaggagccugggccucccugaaccccuggcuuccagccaucucaucgccagccuccuccuggaccucuuggcccccagccccuuccccacacagccccagaagggucccagagcugaccccacuccaggaccuaggcccagccccucagccucaucuggagccccugaagaccagucccacccaccuuucuggccucaucugacacugcuccgcauccugcuguguguccuguuccauguuccgguuccauccaaauacacuuucuggaacaaaugcauggcucca

SEQ ID NO: 191773 - RNA, 23624 nt, Homo sapiens
ugaagccagcucuccacacauauacuuuauuuccacagucccauuuucccaugcugaaccuggcgucuucgcccugacuuuucccacaccugucagcacuggggggcucuuggggaguaaggagcuacagagacagggacacaggaugcguggagagccugggagauggagaugaggagagagagccggaaacaggaggugggggauccacagggggccagggcucagcagacagggaaggggcagauauggagacaagacggacagacacugaccaggaagcccagagaacaggagaucaggagucagagggaaaagcagugucaggagcagagagaaaggaaccgggagacacaggugaggcggugaugaagggcagaugaaaacaguugaaggggcaaaaagacagaggccugccacugggagaaaaagacagagacccacaaggcaaacaggggaaguagagacacaaaaaaagaccccacagagagccagggcagggugggggcugcgugccccucguguuagccccgggagucuuugcugguggaggagcccgggccagugcuggaggcagggccggugcuggagacguggucucugcuggacccgaggccuccgcucgaaucagacgcugugccuccgcucuccacaccacccucuguguuuucuccgccccugcuggaccccacguauccaguggagcccagguagcugcuggcgcugacgggucugaaggucacguggcccccacucgaggcacugguggagccgaaggucacguggccaguguuggggucaccgugcgugauguggcugggcaaaugcccagugcuggagcugaggccgccaaaagugacguggccaagagagccacggucucugcuagucuuguggcucaaaauggacccggggauggcaugggggugccuggugggcaccaggacgguacuggagccggcccucugggugcuggccagguccacgcucagggugccguccagcuucgcggcggcggcggccagguccuucuggcgcugcgccuccgccugcuccuggagcuccaccugcagggaaggugaacugggccccgacacacacugaggccuggccccacccccgcaggccccacucucaccagcuucuccacuuggcucagcagcuccucccugcucaugggguagucaucgcuggccucaaaacccggggggucuucucuggggaggggaaggaaaauuggaaaagacuagaccucagcccucaaaaaggccagcggcccuuccugcuaaaccccgggagccucagccauucucccaccagccccgagugcccuucccuucuggggcacccggggccccauccucccacacaggugccaagccccuacuccuucuggcugccucgaagcacauacuucauauucuaaccccccagggccacauccgccagccaguccccaaaagccccccaaaacucucuauccuguguguucccucugcccccauggaagccccguccccucugcgucccuccugcccugcgccucacagagugucagggggcugaaguggggccaucuucuucggaagguccuccaggcucuggcccagcacuaggagggcagcgucggccagggaggugaagcucuggagagugugggagccugcggucagcugggccacccccgagaccggccuccugucccggcucccugccgucucccaccugggcauguaggaaggccugcacugucaggagcuccaccagccgcuucucaaugaggcucaggaagaggcccaugucccggucucccaugcuggucuugaccccaaggaggucaucgaucaugcugcugucgcaaugggccuuggugaagaggagcuggauaucugcgucauggagggccgguugucagggaucuggcaccgccagcugggugccagcccucuccccacucagguccucacugccccauucuacagagacugcggucaaggcucagagaccaaaagggagucacccgagcucagccagccaggcagggggacggcacugcugugcaucccucucucccugacuuguccuucaaagucagccucaagugucacugccuccaggaagccuucccagugaccccagcagagccagccucaugagugugagauccaggcaguggugaggggccugcacuuggcuugacacgcugcugcucuuccuaucuugaaaaucucagcaauuuuuuaacaaggggccccucauucugcacugggccccacaaauuauggucuugcaccccagacugaguuagggccuucucucgcccccagugccugggcguccucuguccuagccccugagugaugagugcccagugcgcaggucaguccccuccagggccucuccccacugugcccacaucaccuagcacagggcucggaucagccaucacgacagcaggaaggaggaccugcccauaucugagcuccuacgguaugccccgaggaggcucuccagcucgcuccccaccaccccccaccuuucucuccauccgucaucccuucuaauucucaugacaacccugcaaaguaggcacugccauccccauucccagagcggaaggaggaagccacacaccaagguucacaauugguggagcugagauucaaacccaggacaggcugggugcaguggcucacgccuguaauccagcacuuugggaagccaaggcaggcagaucauuugaggucaggaguuugagaccagccuggccaccauggugaaacccugucucuacuaaaaauacaaaaaaacuagccgggcaugguagugcaggccuguaaucccaguuacuggagaggcugaggcaggagaauugcuugaacccgggagauggacguugcaguaagcccagaucacaccacugcucuccagccuggcugacagcgugagauuccaucucaaaaaaacaaauaaaagcuaacaauaaauguuuuaaaaaagagaaaagaaacaggacagccugacuccugagugcucugcauggcuacuuccugaaaaauaagaaagaugaggcccggcgcaguggcucacaccuguaaucccagcacuuugggaagccaaggcggguggaucaccucaagucaggaguuugagaccagccugaccaacauggcaaaaccccccuccacuaaaaauacaaaaauuagcugggugugguggugugugccuguaaucccagcuacugggaggcugaggcaggagaaucgcuugaaccaggagggggagauugcagugagccgagaucgugccacugcacuccaaccuggggaacagagcgagacuuucucaaauuuuaaaaaauaauaauaauaauagaaaaaaaggaugcacagguggaugcaacauacccacagaagggauuaaaaaaaaaaaaaagaaacucagccaggagugguggcucaugccuauaaucccagcacuuugggaguccaagacaggaggaucacuugaguccaggaguucaagacuagccuggacaacauaguaaaauccuaucucuaaaaaaaaaaagggccgggcacaguggcucaugcauauguaaucccagcacuuugggauacugaggcgggcagaucaccugaggucaggaguuugagaccagccugccaacauggcgaaaccccgucucuacuaaaaauaccaaaauuaguugggcgugguggcgggcaccuguaaucccagcaacucaggaggcugaggcagaacugcuugaaccuggguggcagagguugcagugagccgagauugugccacugcacuccagccugggcaaaagagcgaaauuccucucaaaaaauaaauaaaugaaaaaaaucuaaaaaaauuuuuaaaaaggaaacucuagaccccuaccucauaccauaaugcaaaucaauuugucauaagucacagacuucaaugugggaguucaaacaaugaaacuucuaggagaaaacacagcauaaugccuuuguaaccucaggacaggcaaaaauuucuuaggcaggccacaaagucauuaacuacaaaaagaaaauuucauaaauuagauauccucaaaacuaagaaacuucaguucaucaccaaaaaaaaugaaaaggcaagcuacaguauaagagaaaauauuuaccaaaagucuaguaucuagaauauacaaagaacuccuucaacucaguuauagcaagacaaacccaauuuuuaaaaaaacaagugcacaagauugaacaggaacuuuacaaaaacaucugaauggccaauacgaugcucaauauuauuagucaccagggaaaugccaauuaaauuaauagagagaguacggcacacacguuagauggcuaauauuaaaauggcugacggccaggcacgggggcucacgccuguaaucccagcacuuugggaggccgaggcgggcagaucacgaggucaagagaucgagaccauccuagccaacgugaugaaaccccgacucuacuaaaaauacaaaaauuagcugggcgugguggcgcacaccuguagucccagcuacuggagaggcugaggcaggagaaucgcuugaacccaggaagcggagguugcagugagccgagaucaugccauugcacuccagccuggugacagagcaagacugcaucucaaaaacaaaacaagauaaaaaauggcugacacuaggaagugguggaaaagguguggaucaucggggacucccauaugcucgcauaggugagagcauaaaaucuugcgaccaguguggaaaacuguucggcauuuucuaauaaauaucaacauauaccuacccuaagacccaucggucccacugcuaggcauuuauagacagagauguacauggaugauccauggaugaauacuggguagauggauggauggguggaugauggauaugggacaguuggagggacagcaucuguuuuuuaguguuuugugaaacaaguggaauaaugcauaagugccuugcacagugaaugacacauaauaaacauugcuauuauauuuuaucaucauuuucuuuacaaauaauaacauuuuugguaacuaagacuaagaagaaauuugguaacuaagacuaagaagaaauuugguaacuaagacuaagacuaggaagacaaaagucaaaugucauugcagauagauggaugaacagauggauguggggcuguuggaggcagauggacagauagacaauggauggauugauggacaugggacagauggagggauagacccuggauggauggauggacaugggacaguuggagggauagacccugcauggauggauggacaugggacaguuggaggaauagauccuggauggauggauggauggauggauggauggauggauggauggauggauauacggacagauggauauaggacagaugaagggguagauccuggauggauagauaugggacagaugaaggaauagacccuggauagauagauggauaugggacagauggagguauagaaccuggauggagagauagauauaggacagaugaaggaauagauccuggaugaaugauggauacaggacaguuggaggaauagacccuggauggauggauggauggguggaugaauggauggauggauggaugaauggauggauggauauaggacagauggagggguagguccuggauggguagauagauauagaacagaugaaggaacagacccuggauagauagauggauaugggacagaauggagggauagacccuggauggagagauagauauaggacagaugaaggaauagauccugaauggaugauggauauaggacaguugaagggauagacucugaauggauggauggauauaggauaauuggagagacagacguugaauggauggauggauggauggauggauggauggauggauggauggauaugggacaguuggagggaucaacccuagauggauggauggaugcauugauagauggauggauggauggguguaggacaguuggagggacagaugauggauggauagauggacaugggacaguuggagggauagacccugguuggaaagauggacagauauggggcaacugauaagcaagugaaccagguuguccaugcaaugccuccaagccccgcgggcugaugguguccuuccaaguggagaagccaggcucgggagggggcgcccaugggugcucaccagccuugagcuucuccagcuguccccgcacauccuggaagcgggccucaaggcgcucagccuccgagugcaccuuguccaugcgcugcugcaacaccuucugcugcugcuccugcagcaaaugcuggucauccuugcuggcacgugcgcucaccaaagccuccugcaucuguggggacagggcugaaugcugggccagauggcagccucgggaguuggggguguggagcuaggaagaagcaggaggcaggcugagggagggaagggggcggggaggccgggaggagaggaggagauggagagggcaggccucacucaccuccuugaucucuuccugcacaugcuccagcuccaaguucugcucguugaugaaguugaacucagcaaaguugcgcuccucgacugggagaguugggcaaggcggggcccagagagagggagacagagaaacagagacagagagaacagagacagagaggcauacagaaggccaaagaaagugaagaugaggaaggccacacagaaaccaaggcagagagacgaacagagaggagucacagagacaaagaggugugggaagauacggcaggugggacacagaaauacacagcaaggcagagagggaaagccagagacucggcaauagcaagggagauggggagaugcaggcggggagaacgguagauauggguaaggagagaaacagagagggacaggguugagggaaggauguggagagugaccccaggcccaggaguuaggaggggguggggaggggcagagacagggccacgguaagacgccaguggacgcgggcggcgggucccaggcaugacgccuuguuccuccagcacagauggaggaguuccccagggccagagcugaggccagccugcacuggacucagggggugccggggucccgggccuccucccuccacccagggccccacucacucuccagauacuucugcaccaacaggucagggucacucucccccaucagcugggacaguuuauucagggcguccucguagcaaagcaccagccucuccugggaggucuuccagacgcccucggccaccuccccggcuaggggaagagagaacagcaggucggccuccuggguggccuccaacacagagaccuccugggugagggggagcgaaguguggucccaccuggggcacgaaggugugcugcaggugccccaggggcggccaggcccuugagaugcaaaggcagcagccccagccucacccugcuuuucacgcuucuccaggacaucgggauccggcugccggucguuguucuugagcuugaggaaguggugcagcugcuccaggugcaagaucugccgcugcaggaccugcgccuccaucucgcucugggccuccucuuucuccgcgcgcucccgcagcaagcccaucuuggccuucgccuccucccugcgggggucagccggggucaggaugacuggaggcuggacuggggucggccugggguccuggggaugggcggggucagccagagguuguggggggugagguggagucagcuggugucccagaugggcagggccagccuggggucacaggaauggggcugaaucagguugcaguuauccuguggucacaaaaagcagagaacuggcugggcacgguggcucaggcuguaaucccagcacuuugggaggcaggaggaucaccugcagucaggaguuugaaaccagccuggccaacauggugaaacuccaucucuacuaaaaauacaaaaauuagccagaccugguggugcaugccuguaaucccaacuacuugggaggcugaggcaagagaaucgcuugaaccugggaggugaagauugcagugagcugagaucgcaccacugcacuccagccuggguggcaagagcgaaacugucucaaaaaaaaaaaaaagacagaagcaagaacuucaaaagagugcgacaucauauuagaaacacaacacaaaacucucggugugcugcuggcucacguucuuucagcagccugcucuccucauccuucagaguguacugucucucucuagguaaacucucuguucucuauuugccuucaguaaauucucuuuguuggcuaaaucagucucuuggcagaauucuuucucccaaguaagacuaaaaagcgaggauuccuguacuucccgguggcagguaguuuuccuuuuggagugauggaaauauuucagaucuagacagaaguggugcgguugcacggccccgugaauguacuaaaugcugcuacauucuacgcuuuaaaauggugaauuuugccacguuuguuuuaacagagagagagaaagagagaaaucacagagacccuaaggccgacccaggccacagcugaugucgaucagggaccaugagaaaacagaagccagagaagaacuuaguagaagguaagaaagcauuuggagcaaaagaagagggcgaagcugagaaagagacagggauggagugagagagagagcauggagcucaugagagccccagagagggagagagaagccaacaccuaaagcagcuucagcuccucaacuccuuacagugugccucuaucugaagguggcccgagaggaucucugucccuugcaaccaaugcugacgaauaacaaauucgccagaugcuuccaggaacccugcugcacuauauaugugcuagaugcgcuuuuuuuuuuuuuuucuccugagacggagucucacucuguugcccaggcuggaaugcaguggugcaaucucggcucacugcaaccuccgcccccagggcucaagcaauccucccaccucagccucccaaguagcugggaccacagacacccgccaccaugcccagcuaaguuuuuauauuuuugguagagaugggauuucaccauguuggccaggcuggucucgaacuccugagcucaagcaaucugccugccuuggccucccaaaguguugggauuacaggcgugagccaccucgcccagccaguagauacauucuuaugugcuagauggggucaguagagguuaauuuacaugcccaagaaaaagaacagggccgguggggugcaauggcucaugccuguaaucccagcacuuugggaggcagaggcggguagaucaugagcucaggaguucaagaccagccuggucaagauggugaaaccccaucucuacuaaaaauacaaaaauuagccagccacggugccgggcaccuguaaucccagcuacucgggaggcugaggcaggagaauuguuugaaccugggagguagagguugcagugagccaagauagcgcaacugcacuguagccugggcgacagagccagacucugucucaaaaaaaaagacagaacaggaccuugccaguggagguggggaacugguggcggggagagagaaaaaggggauauuaugggagaaaaaauagguucugacguguuucaugaguccugaaccuucccaucacugccuuauggaaaggugcguccugagucaucugggucccgccaucccaggauacccgcagucucuaccugacggcguaggcagagguggaggagaggauaagggugcugaccaggugaugcaggugguggaucuccuguggggggaggagaaaaaaaucagugccacuucuuacaaccccauugcucgaagucuuuccuuuuggccccgugcuucuccaauaaggaguaaagcucuugagccuuccaaauguggacccuccucauuagcgacugcccaugaaagggauuuuaaagaggugugaagucaaauugauaagcuggaucaaaaggcucuuucuguagauaagcagaaacuaagaaaauauuuaguaaccuacggggacuggguggaaaugagguggaggagauggagaggaaaugacguuucccuaggagaccuuuuggaauaguuugauuugagaaccuuguuaauguuuuacauauucauaaaggaaauuaaaucaauaaagagaggagagaaaacuaaaacugaaugcaaauggaagcaagugaacuuuauuuaaaaauaauaauagggccaggugcgguggcucaggcccauaaucccagcaguuugggaggacgaggcgggcagaucaccugagcuugggaguucgagaccagccuggccaacauagagaaacuccaucucuauuaaaaauacaaaauuagggccaggcgcgguggcucacgacuguaaucccagcacuuugggaggccaagacgggaggaucaccugaggucgggaguuugagaccagccugaccaacauggagaaacccugucucuacuaaaaauacaaaaaauuaaccaggcgugguggugcaugccuguaaucccagcuacuugggacaaugaggcagaagaauagcuugaauccgggaggcggagguuguggugagccgagaucgugccauugcacccuagccugggcaacaagagugagacuccaucucaaaagaaaaaaaaaaagaaagaaagaaagaaagaaagaugaaaugaggaaugcucaggaaaaagcuggugauauuggaauggaaucagagguaucaaugugaacucacuauuguaaaauaugucagccaggcgcaguggcucaugccuguaaucccaauacuuugugaggccaaggcaggagaaucaccugagcccaagaguuugagagcagccuggacaacauaguaagaccccaucucuacaaaacauaaauagaauuuuaaaacauauaaaauaugugugcuuccuagcucucuccagaggaagggccucaaagcaaugacacccaaguagcaacagagucucuuagugccaggcuggugguucacgccuguaaucccagcacugugggaggccgaggugggcggaucacgaggucaggagaucgagaccauccuggcuaacacggcaaaaccccgucucuacuaaaaauacaaaaaauuagccgggcgugguggcaggugccuguagucccagcuacucgggaggcugaggcaggagaacggcgugaaccugggaggcggagcuugcagugagccgagaucaugccacugcacuccagcacuuuagccugggugacaaagcgagacuccgucucaaaaaaaaaaaaaaaaagaaaacggucucuuagugccucaacaccuacucuucccuagaaagaaccgggacuccucagaaaaauggccaaccccagggauggggcagaacaagguccagauuacccagacuaucuucgugugccagaaagugaggaaguacucccaaaaagugaugggguauguccaaaggccacagaagccagcuugaaggggcucccacuaaccaaaucuggggcaauuugaauauuaaaaugaauggcaguuacggaucaucaucuauaaagucagaauacacuaaugcucacugacaacacucaaauauacagggggagaaagagaaguguuuccuuuuugcuuuuuuuuuuuuugagacagaguuucacucuuguugcccaggcuggagugcaauggcacaaucuuggcucacugcagccuccagcucccugguucaagugauucuccugccucagccucccaaguagcugggauuacaggcgugcaccaccacaccuggcuaauuuuuuguauuuuuaguagaaacgggguuucaccauguuagccaggcuggucucgaacuccugaccucaggugauccgccugccucagccucccaaagugcuggaauuacaggcaugagccaccacacccagccgagaaguguuuccuuaaggaaaaugcgaucuuauaaaugugggagaaaugacagagucuuuuaaauuacccuguugcagccauuacaguaauaaccauucagggaagaaucauucauggaugauaaaauugauggcaguagcugcuggcuguggcugcacacuccauggagccgguaggagcccugacccuucugaguugggaugggagcuccccgugugcagcugcagccaccagaaccacagcugcagacccaggccuucugcuccacagagcaggcaggauccccgcccuccugggcgggacuacagcugcccaaacugcugcuguggaucugagccucucugugcucuugcagggagccaggagcaggcaggaucugcccucccgggugcagcugcagcugcccaacccgcagcuacagacccgggccucccacuccagggagcaggcagcagccggggacaagcgaggguccugccccuuccgaguugguggggugggagcucccagagugcagcugcagccacccucccaaccacaggaccuaggcaucucugaaguucucugcagccuguacccugaacggcccaggaaagcaccaccgcaccccccuccccaccccgaucccugcaggcucgagcgugucugcuccugcugcuuggccucucuccucucucacacccacucugaucucagagagggguugggguccagcccagugccaugaauggcagcaggaggcaggcagauuccugggcagaagagggcaaguacccgguaaggucccuccuucaagccagggagggccugaaggcugggggccagguugccaguacugcaaaaugaguggggacuugcaacgucuccuccaggccugcccauggccacccauggagcuacccucucugcugagagcuucagaggccugcagagacaucugaacaaucugccugcggagaggaaccacccucuccagggccuccucacugcugauagcugaacacuggacgagacgaccugccugcagaggagcugcccccugcaggucuccucugagcuguccuaacacucgguaaagcuccucuucaucuugcucacgcuccacuugucugccuaccuccuucuuccuggacacaguacaagaacucgggcaaaggcaccacuggccaaggagguuuccagccagaaaagugacgccguaaauaucccguaacaaaaugauugagugaaggugugucaggggacaagauauuuacacagucucagagaaucuccccacagaccacuuauucacuacaaaaaggaaaacucuuccuggcuagccaagugaucaaagacaacaucacuagucaugggacaaguugacaucaggugccuccugagaucuugcacaggaaggacacacuaucacugcugugacauuccccccaaagugcagaugccaagucuaaucaugaagaaagaucagauaaaccggccgggcgugguggcucaugccuguaaucccagaacuuugggaggcugaggcggguggaacaccuuaggucaggaguuugagaucagccugaccaacauggagaaacccugucucuacuaaaaauacaaaauuagccgggcaugguggugcaugccuguaaucccagcuacucaggaggcugaggcaggagaaucacuugaacccgggagguggagguugcagcgagccaagaucacgccauuacacuccagccugggcaacaagagugaaacuuaguaucaaaaaagaaaaaaaagaccagauaaacccaugucaggggacaucgcacaacacaaacggccuggaugcuuccaaaaugucaacgucauggagaaaaaaaagcccaagggacugacccagaugaacagagccagaacaaccaaaugcaacgugagauucuggaccggagccuagaguaggaaaaucaaguucacuguaaaggacaucacugggacaaucagugaccuugacauauggacgguuuagaauucuaacaauguuaaccucccugacuuggauaacagcacuguguuuauguaaggaaauggcguuguucuuaggaaaugcucucucaaguacuuaggagcauaaugucuacaacauauugucaaacaguucagcauucaggauaauaaauuauucucagcaaaacaauaauuacacacaccaauaguaagagugggggagaaagagaaaauaaauguggcaaauuaucaaacugggugaaagauauauaggaguucuuuguauaauucuugcaccuuuuucuguaauuugaaauuauuuccaaaugaaagucaagaccggacgcaguggcucacgccucuaaucccagcacuuugggaggccgaggcaggcgaauugccugagcucaggaauucaagacuagccugggcaacauggugaaacccugucccuacuuaaaaaaaaaaaaaucggccgggugugguggcucacgccuguaaucccagcacuuugggaggccgaggaaggcggaucacgaggucaggagaucgagaccauccuggcuaacacagugaaaccccaucucuacuaaaaauacaaaaaauuagcugggcgugguggcaggccccuguagucccagcuacucgggaggcugauacaggagaauugcuugaaucugggaggcacaggcuguagugagccaagaucacuucacugugcuccagccuggacgacagagugagacucaucucaaaacaaagaaagaaagaaagucaaaagagaggggacagggcugguucuucaaagauccccguggaauguauaauaaauggucuugcuugcucauagauugcccugggugauacuauucagaaugacauucugcuuucuacaacuauaaaugaggccacuuuuuuguuggaaauguccuccaacauuucccaggccuccaugccuuuuggacuaaagcaagccuaccgcucuagucaaucccauacuugaggccugagugcuagagcaggaagggcaaacagcuguggggaggaccugcgcaggggucccugucuccuccccuggauuucagggccacugaccuucuucagcuugcgguccacguucagauagcgguuccugucgauccgcagcagauccagcuccucccgcagggccgcauuccguaccagcugguugucaaagugacaggugaccugggaguagaaagguggauggaagagugggucugaagccaagucugccugccuccuccaagcucagccaaggaggagacacuuaucagagguugggccggccuguuuccugagaaacagagguucuuugggguucccgaaaucaauguccacuccccucuaaggacccaucauucuccuuuccuugggaaccuccaucccuccagaauccuguguccugacacauaugugcacacacugcccagcauuuccagaauccaaugaccaugcccaguucuucccauaaccgcacaauucaggucgagggaccaggaguuugacccucacccuguccaacugguuuucuaggauccugauccuucgccugaucuugaccuucugauccaggaugaaucccggggaccugacauucuuacuguggguaaagauccgcgucucccacuccuggaucuacaagaaagaggaugguaccuguuuuugguugccugaaugugggagagauugaauggcccagggaaaaugagucacuaagcauggcaaacaucugcugucccugucaccccagaauaacaucuacccuucugcugacacuauccagcccuccaugugguucuggugggccuuccaaccacaguguaucacccuaucagccacaugacccaggucuggacacucacagggauuggccuagagaugggaaugugaccccauggagcuagccugacuccuuuccguuuuuuuuuuuguuuuuuuuuuuuuuuuuuuugagacagagucuugcucugucucccaggcuggagugugcaguggcgcgaucuuggcucacugcaaccuccaccucccaggcucgagcaauucuagugccucaaccucccgaguagcugggauuacaggcacguaccaccacacccagcuaauuuuuguauuuuuaguagagaugggguuucaccauguuggccaggcugaucuugaacuccugaccucaagugauccacccgccuuggccucccaaagugcugggauuacaggcaagagccacugcacccggcccugacuccuuuccugauagucugggggaagcacaugagauggaaggaugggauuccaggacuucuccugucauggccccaccacagggaggguccugggagaaugaggccaguggacagaaguggagaugagagucggagagacggugagaaugaacuugaugacauuaguagcccugggucugcuuaugccuaagaccagcuuccaaucuguccucauuucuguauucaucuguacuuauuggggugugcucugucucucccagcaaacuggggguuccaugaggacacagagucuuguguuuucucccuguccgagacaaagaagguauucaacauaacaugcagacuaaauagauaaaugaauugcucaacacuucaauuugugcucuguuauggguugaaucaugucccauaaaaacucauauguuggccgggcacgguggcucacaccuguaaucccagcacucugggaggcagaggugggugaaucagcugaggucaggaguucaagaccacccuggccaacauggcgaaaccccaccucuacuaaaauacaaaaauuagcaaggcgugguggcaggcaccuguaaucccagcuacucgggaggcugaggcaggagaauugcuugaacccaggaggagagguugcagugagcugagauugugccacugcacuccagccuggggaacagaacaagacuccaucucaaaaaaaaaaaaaaaaaaaaccaaaaaaaaaccucacauguugaagucuuaacccccaguacuuuagaaugugaccuuauuuggagacagagucuucauagaaguaauuaaaaugagguaauuaaggugggcccuaauccacuacgacgagguguucuuagaaaaaugggaaauugcugggugugguggcucaugccuguaaucccaauacuuuggaaggcugaggcaggaugaucucucgaagccaggaguucaagaccagccugggccacaaagcaagaccccaucucuacaagauacaaaauaaauuagcugggcaugguggugcacaccuguaguccuagcuacuugggaagcugagguggcagaucccuugagacaaggagcucgaagcugcagugagcugugauugagccacuguacuccagccugggugacagagggagauccugucucaaaacaaaacaaaacaaaaaaggaaauuuggacauagauacgcacacagggagaaugccacguaaggauaaagacagaggucaggugugguggcucacgccuguaaucccaacacuuucggaggcugagauggguggauaacuugaggucaggaguucgagaccagccuggccaacauggcgaaaccccaucucuacuaaacauacaaaaauuagccaggugugguggcacaugccuguaaucccagcuacuugggaggcugaggcaggagaaucgcuugaacccaggggguggaggcugcagugagcugagagauugggugacaugucuacaagccaaaguacccaagacugccagcaaaccggcagaagcagagagagagaggcauggaacagacagauucucccccacacugcucagaaggaaccaaaccugccuacaucuugaucuuggacuucuggccuuuggaacuaugagaaaacauauuuuuguuauacgagccacccaauuuguggaacuuugucauagcagcccuaacaaacuaauccacguaccaaagauaccccagaaggcugcagcaaacuuaagacucagcaugaggauguuuuaaauuuuugaggaagaccuugauauuggucagauaccacaugaacugcuagcuuaaggcaguucacaaguucaacaugagagggcgcuaucauccuuuugaagaugucacaucuuugugagacuggauuuucagcaguugcugcaauaaaagccaaauacccaauuguuggugggcgcagugucucacgccuguaaucccagcacuuugagaggccgaggcgaguggaucaccugaggucaggaguuugagaccagccuggccaaaauggugaaaccccaucucuacuaaaaauacaaaaauuagcugggcguaauggcacgugacuguaaucccagcuacucggguggcugaagcacgagaaucacuugagccuggccugggagguggaggcugcaaugagccgagauugcaccacugcacuccagccugggugacugagcgagacuccaccucaaaaaagaaaagaaaaagaaauguccaaaauguugacacugggggaaaaugcagcaaaguguacaagggaugucucugcauuauuucuuucaacugcacaugaaucccaacaaaauuuucuuucuuucuuuuauuuuuucuuuuuuuuagagacagggucucacucugucacccaggccgagugcaguggcaccaucauagcucacugcagccuccaccucccaggccaggcucaagcaauccuccugccucaguaauugcuuuaugaaagaagagaugacauacgguaaaacugcacauauuuaguguucaaugugggaugggcacgguggcucacgccuguaaucccagcacuuugggaggcugaggugggcagauccccugaggucaggaguucgagaccagccuggccaacauggcgaaaccccgucucuacuaaaaauacaaaauuagccaggcaucguggcaggcacccguagucccaacuacccaggaggcugaggcagaagaguugcuugaacccaggagguggagauugcagugagcugagacugcgccacugcacuccagccugggugacagagcgagacuccaucucuaaauaaauaaauaaacuguguaauuguuauguuuugacauaaaauagugaaaauauccaucgccccuaaaaguuuccucaugcccuuuuguauuuccucaccucauccucuuccugcagucgagucuccccccagcaaucacucaucuguuuucugucacuauagauugguuugauuuucuagaauuuuauauuaauggaauuguauaguaaggacucuuuuggggaucaaagggguaucugguuucuuucacucagaguaguuauuuugagauucacccauguuguguguaucaauagccgguuccuuuuauucaugagucacauuccauuccauguauagaccacaauuugcucguccacucgaccaccgauggacauuuggguuguuucaguuuucgauuuuacaaaucaaguuggguuguuaugaauauucauguacaauucauuauauggacaugugcuuucuuuccucuuggcuaaacaucuaggaguggaaugucugaaucauauugucaaguauacguuuuguuuuuuggcaacugccaaacugggccaggcacgguggcccacaccuguaaucccagcacuuuggaaggccgaggcagguggaucacuugaggucaggaguucaagaccagccuggccaacauagugaaaccccccaucucuacuaaaaauauaaaaauuagcugggagugguggcacacaccuguaaucccagcuacucaggaggcugagacaggagaauguuugaacccaggagacagagguugcagugaguugacauugugccauugcacuccagccugggugacagagcgagacuucgucaaaaaaaaaaaaacaaaccugccuaacugugcaaacuguguaccaaaaguagugugccauuccacauucccaccaguggaguaugagaguucugcuuccucuacauccuucccgcaacacuugguauggaccgucuuuuuaauggaguuugggaaaguucuuaauauauucuggauacaaguucucuaucagauacgugcuuugcagauauuuucucccagucuggaccuugucuuuucauuccuugccuuugccaguuucugcagaugggauuccuugacuuggggacuccuuaccuguggccgcaucacugguuuuuguuuuuuaaagggguuccgagccaggcacaauggcucacgcuuguaaccccagcacuuugggaggccacggugaguggaucaccugaggccacgaguuugagaccagccuggccaacauggcaaaaccucaucucuaccaaaaaauacaaaaaugagcugggcuugguggcacgugccuguaaucccagcuacucaggaggcugaggcaggaggaucgcuugaaccugggagguggagguugcagugagccaagauccugccagccacugcacuccagccugggugacagagcgagacuuugucuugaaaagaaaaagaaagugggucucucucuguugcccaggcuggagugcaacggggcaaucacagcucacugaagccucaaacuccugggcucaaguagcucugcccccucagccucaagacacgcaccacugugcccaacugacaaauugguuuuuucaaugaaggcuagaccagaauuuagcagaaugaaucccacauuaaaaaauguauauauauauauauauuauuugcugaaacuucuguuucagauauauuaauauauguguguguguauaucuguaugcaucuugguguguaugaacuacaccucaugagucauggucauaaaaacuugacagaucacuggccuagaaaaaucacauuguuugcaaggucaaauagcaaggucccaaaacagaugggauucgcaaccugucuagacuguggcauuaccaccguccuuguuugcagaugaagaaacuagggcccagagaggggaaaaccugccugcccccgaucacagagcuccgauggcagagccaggacucuaaugcagguuuuggggacucuaacaugcgaaccuuuccugcuuaaccacaccaguccuguuuuugaaugccugggacugugcuaaagcagcaaacaucuauguuuccacugaacacaacucuaccagauggaugcuuucaauagccccgauuuuuuuuuuuuuuugagacagagucuugcucugucaaccaggcuggagugcagcggcgcgaucuuggcucacugaaaccucugccccccggguuuaaacgauucuccuggccgagcacaguggcucacgccuguaaucucagcacuuugggaggccgaggugggcggaucacaaggucaggagaucaagaccaucuuggcuaacacaguaaaauccugucucuacuaaaaauacaaaaaaaguagccaggccugguggugggcaccuguagucccagcuacucgggaagcugaggcaggagaauagcaugaaccugggaggcgaagcuugcagugagccgagauugugccaaugcacuccagccugggcgacagagcaagacuccgucucaaaaacaaaacaaaagaaaaacuauucuccugcuucagccucucgaguagcugggauuacaggcaugugccaccaugccuggcuaauuuuuguauuuuuuguagagaugggguuucaccacguuggccaggcuggucuugaacuccugaccucaagugaucugcccgccucagccucccaaugugcugggauuacaggcaugagccacugugcccggccuaauagccccaauuucacaugaggaagcuaaggcucagggagguuacaacacuugcccguaagcaggauccguagaaccaccucucaaaccccaccugcuuguccagggcccuggucugcuccugcagcuccucgaucuccgccugcaccugggcccggcccuucagcaggcgguccauguucuccagccgcugacugucccgaagccgcuugaccugguucugggcugcgcugaucugcaccuggagaucgccccguaccuccuccaagcgccggaucuccucacuacccaggcagggagguggaagaggggccaguaagggggcagaacucagcaucacuaaaggcaggacccaggaguccagucuucagccccucugacccccuccuccccagcucagggcccaggcgcccagcucacaguugcuuguugaugcgcugguggacuuccuugcuguaggcccgccucuccccuuccaucacuuugcauugucgcugcagccuacucagcucccaauccacugagaacagggccagccaagggacucagcagggauccuggccaccagcuccucccaacccaggaccuaggaauucugcucccuuuggggucucacaaacugcaacugaacugcagauccagcccccaacaccccucuaggaaugcaccucaguuccgggaucccucgagcuuccucaucccuucauacccaaaacugaacucaggguuuuuuuccccuaaaacccacucccaucccaccagagggcacuucuggaaggccucugggucuucugggaccugggcacaccaccuggaauugggaaggcucuugcucccucccuccuuuucugccccaccaucagcagcccucagccccauccucuugccuccucccucucucaacccauccccugggcucagccucauccucuccuaccuggaccaucaccccaaccuuucucucaacuuccagccuuccugcacagucccagagggucucucuacacccacagccaacccuaccccacccacagcagacccuaccccucauaggccucccaugaugccccaguaccugcaggacaaagucucagcaccucagccugggaucccagaccccaagugaccugaccuuacccaccucuccagucuugcccguaugcuccccaucuccaaaggcccaguaguuuucaaucagcgggugauucugccuuccaaaaacauuuggcaaugucuggagacuuauuuuuuucuagacagggucucgcucugucccccaggcucuagcgcaguggcacaaucucagcucacugcagccuccaccucgcaggcucaagugauccgcccaccucagccucccgaguagcugggauuaugggugcacgccaucacaccuggcuaauuuuauuuuauuuuuguagagaugaggucucacuguguugcucaggcuggucuugaacuccugggcucaagugauccuccuuccucagcuucccaaagugcugggauuacaggcaugagccagcaugcucagccuagagacauuugucauugucaugacuuguggagaagggagggggcuacugguauccagugaguagaagccauggacacugcuuggcauccuacgacacacaggacugcccccacaacaaagaauuaucccaccccaagagucaacaguaccaagguugagaaagccuacucuagccacauucugucaucucuguagaaacacccuuccuuccuucuccccuuggcaauuccuacagggaguucuggg

SEQ ID NO: 191774 - RNA, 62253 nt, Homo sapiens
gagccugcggcgugcagugugaggggcgggacccggcugccggcggugggucuagcugggggaggucgggccaugcuggugggccagggcgcggggcugcuggggcccgcgguggucaccgccgcgguggugcugcugcugagcggcguggggccggcgcacggcucggaggacaucguggugggcugcgguggcuucgucaagucggacguggagaucaacuacucgcucaucgaggugagcgcccgccccgccgcccggcgccgagucgccgggccggugguucagccucucugggccgcgcuggccucgucucugacaccgggcgguguggaguccuuggagcccuuaccucuuccgaggcuaugcuguccgcgggcucccugcagccccuccccagucgcgcuggaggggagguucuuaucauggggucgucuaaggacugaggggugccagaccucagguucuucaaaaccccgacuccagauccgcggaacacagaccccagauccucaaaacccagacccuaaauucccuggagcccagacuccauuucuuuaaaacuuagaccugagaucuccucgaaucagacccccugaaacucagauuuccccaaacccacauuccagaaccuagagaccacaugucuuaucccccaaacuccacagcccagaaccccccgaaguucuaauccacugcuccuccaaaccccgcggcaugauuuuaaagagcaucaauucccaucccauagauucugaccuaguagaucaguauuggcaacccuagggccggaaagcuauuuuuuauuucuccggcuccccuccacuucugaaaauggagaguugccagcugcccugauugccuuaaugaguaguuaauggaauuacccuagagauuuguaaagguuuuuuuuuuuuuuuuuuuuuuuuuuuuuuuuuuaauuaaguuguaaaguccuguuaaauguuuaucagcccggugggauuaugacccagaaagguucccguaaagaggaaagggauggauggagguaggggcagaaugucauuugucccgguagaugggaggggaccagagcaaggccugggccucauuuuugggcggggauuuauggugggguaggacaaggaagaggaaaagagcgggugccucggagguaauuuaggagaaaacgaaggaagaggcugggaaaugccaaagagagggauuggggaauaagaccccaaagaucgucugaaagcaccuuugagcuguuccagggcuggcagugaagggugaagcucuguguucugcaaagcgggcugcugaggauugggggagggguagggagucaguuccacaccccaucagcucugcgaccugcccuugcucuagguuucaguuuuuguaccuauaggaugguguugggagagaaacaguggaacccagcagauacauuucuuuaacaagcggauccgugaucuucuucaaggccccguuguuugcugcuuuuucaggcugaagaggucagaggucaggcauugaaugaauacccacuggcagcggcagggcuccuaggauuuccuggguacauguuucugggugcccaugccaccuccuaggucugcacuggggacaggacacguucagggugguauggcuguagacggcacagggcauuucagaagcugaaaugcaagaggccaguaaggccucuugcaacuuguaguuuccagggguucuggaaggaaggaaaagacaggcaccccccuccacccucacccucauacuaauagugaccuugagagcagagaacagguuuugugacccauuucaaaguguguuccuuaagcccaagggcugccuguccagauggugugggacacucauucuuucguaaguaauucagauucugaaaucagacauuucauacuggccaucuugauguagauuacauugccauccuguguccugauuguacuuuaugaaagauguagaaauaaucaugauauuucacgguuauuucuugauuguguuuuuuguguuccuaugcaacugccgccauucuucucuagcuuucucccauccugaguguuuuuacaucguguucauugagucaacaacuauuuacugagccccggcacauacugaagccuuguccccaguguggauauagcaguacagugaacagaacagacaaaacuccauacucucaugagacugacauuuuguucucuaacagggaccuuacuguuaaaaaaaaaaaauuauacugguugcuaauacuuuaacaaucagcagguuucacauuaaaaacuggguucuuuauuucucuggaaaaccagccgaucuuuaggcugccacccuuggcuuggguuuuguagugaucugaauccuuuuggaugaaugucccuugauguugccucccuaaccggucuaggcuggugaauuuccagucccugcacuaaaugcaugcaucugaaucucuuugucaccuguagcaaauucacugaguaccuagaguaagcaagacacugucucaggcacuggggaaugaaguuguggucacugaccucagagaacuuuacauacaggcuuaaccuuauuucacacgaguccuuucccaaauguucaaauguucguuuuaugaguuagucacuuuguacaucuucuuagcugguaagauucgacuguuucauugcggcucgugucaugguuuguuucauggucauagagcauuaacauuuuggaggugaggcuuuuaggugcaucagacccaacugcuuccuuuuacagacauggaaacugagccucagagugguugagcugugcagguacauuuaggaaauuuuccuugagcccaguauguucccuacguauuacacuguguugccuuuuucuucagagagagauauuaaacaguaauacaaacugcuuuuuccauuuuacuuauuuuauuuuguuuuauuuugaggcagggucucacacuguugcucaggcuggaguauaguggcaccaucauagcucaccaaagccucugacuccuggccucaagcaguccuccugccucggccuccugaguagcugaggcuacaggcacgugccaucaugccuagcuaauuuuuuuucuaguagggaugagguguggcuguguuguccaggcuggucuccugggcucaggugauccuccuucuuuggccucccaaagugcugggauuacaggcaugagccaccaugccuggccgcaaacugauuuuucuuugaauccauauucuguagcaggugcuuaauaugcauugaugugaaucuguacaaccacaugaaaaggagcggcucugugucuacaccugaagaaaccgaacacgagcuugcccaaggccacacaacacguggaagacucagauggcauuugggcaucuuacuggguuaacacuucgugucugguaaugcucagaauguaagaguuuuagagaguccuugaagagaggacagauauuaaaugucuuuuuagucucuuuuucuucagagaaugaaaguaaugagaaaauuaaguuucuagaugaauguugcuccaaguauuugaaauuauucagaguuaguaaggaagauuucuggcccucauuccagaccuuuaguugagaaauagaggugggccccaggaauuugcaauuuauuuuacuuuauuuuuuuuuauuauuauuuuugagacggagucuugcucugucucccaggcuggagugcuguggcaugaucuuggcucacugcaaccuccgccuccugaguucaaacaauuuuccugccucagccucccaaguaccugggacuaccggugccugccaccaugccuggguaacuuuuuuuguauuuuuaguagggacaggguuucaccuuguuggccaggcuggucucaaauuccugaccuuaagugaucugcccaccucagccuccugaagugcugggaguacuggcaugagccaccgugcccagccaggaauuugcauguuaauaagcaccuuacuaauggcaaaguuugcaaauuuguuuuagacccggaaacuuacacgagcaaccuagagacagccacuaaaauaaacaggaaagcauugaaaaauaaggcauuguaauaggcuguaggugguuucuaaucugaaaaacauugagucacaugauuugggagagaguuuguugauuucccucuguccccaguaaugccccguguuaaaagcugguauauaguagguccucagugaauguauacugacugagugcauucagguguaacauguguaguuaauucccaaaggcaauguuaugauuucuguuuuccuuccuuccuuuccagauaaagcuguacaccaagcaugggacuuugaaauaccagacagacugugccccuaauaaugguuacuuuaugaucccuuuguaugauaagguaagaggggacugcuugucacuuaugaugggaagucacuagugugccucaccaggcugcauuaaccaugcccuuuccuacacuagcaaaugcucaucuguuuuguaaauuauuaguggaauaugauaauccuagucacauuuggagggagacaacuuacaaacugccuugacgaauacaguggcucucucuguguuuagggccauuuggcaaugucuagagacguuuuuguugugacaucuguggcugugcgcuacagucacccagugaguaguggccaggcguggagcuaaaugcgcuacagugcugccuacgacagcccagaugucaguagugccagggcugagaaacccugauuucauggaacccguuacuugcaagcagcuuaaaguauuguuaaaacaauuguacaaguaauacaugaauucaugaacuuugugaaaaagaaagucaaggucuuuagaaguaugugaaauaaauuuguacccuuuucccuccaauuuuaccucccucuguagugauaaccucugauaaucugauaaagguuuuuuuuguuguuuuuuuuuucuucuuuugagauggagucucgcucugucgcccaggcuggagugcaguggugugaucuugccucacuccaaccuccaccccccagguucaagccauuuuccuuccuaggccucccgaauagcugggauuacaggcaccugccacuacacccagcuaauguuuuguauuuuuaauagugacgggguuuugccauguuggccaggcuggucucgaacuccugaccucaagugaaccaccugccucagccucccaaagugcugggauuacaggugugagccgauguuuccggcccucuuauaaaauuuugaugggcauccuaacagauugcuuucuauuuauaguuauucagguauccacggguacacaugcauauguauacauggaaauacacacaagcacacaugcacaucgauauguauccacaaacaccucuauacaaucccauccucccaccuauaaaccuuuuauuuggaaauacagauucauaggaaguugcaaaaauagucaauacacauaguuuugauuuugauauauuuuuuaauacaaaugaaaucaaacaauaggauuuauucugcaguuucauuuuuuccccuguguuaaugcuuucaauaccagagggacauuugguuuuuuccucuugcaugcuuucaacauuagcauagauagaucuacugacuuuuuuuuuuuuuuuugagacagagucucacucugucagccaggcuggagugcaguggcgcgaucucggcucacugcaaccucugccuccuggguuucugccucagccucccaaguagcugggauuacaggcacccaccaccaugcccagcuaacuuuuuuuguauuuuuaguagagaugguguuucaccauguuggccaggcugguuuugaacuccugaccucaggugauccgcccaccucagccucccagagugcugggauuacaggcaugagccaccaugcucagccuacugacuucuuuuuaaucgcugcauagugugucagagucaaacccaaacuguaauuuauuuaacuacuuggacauauagacuuuccccaauuuuaaaauaauaguaauuuuaacauaacacaccaggaaauauucuugaacuuaacucuucauccagaaugcauaggacugauuucuagagauggacuagcugggucuguccugaaaucuauuuaauuaauuuuuaaauaguaucaguaucagucucaagaaaccaggaggcuggacgugguagcucaugccuguaauccuagcacuuugggagguugaggcagguggaucgccugagcucaggagugugagaccagccugggcaacauggugcaaccccgucucuacuaaaauacaaaaaaauuagccgggugucacguggaugccuguagucccagcuacuugggaggcugaggcaggagaaucgcuugaacccaggagacggagguugcagugagccaagaucgcaccacuucacuccagccugggcaacagagcgaggcuccaucucaaaaaaaaaaacuaaaacagaaacaaagaaaccaggguugauaaguaaaaucuaguuuuauuuauugaauuaaugaguuaauguauuguuuagagacaggaucucccuccgcugcccaugcuggagugcaggggcacaauuaugguucacugcagcacugaccuccugggcucaagugaucuuccugccucuuccuccuaaguagcuaagacuguaggcgccugccaccacacccagcugauuuuuuaagaacauuuuuuguacagauggggucuugcuauguugcuuaggcuggucuugaacuccuggccucaagugacccuccugccuuggccucccacaguguugggauuauaggugugagguacugugccuggccaaaucuaguuuuagggggugacuuuaguuccugaagauacaugcuaacuugugcaacuguaggcaugugagggcuuaaugggagacucaauuaauagaauuauaguauguuuaguauuaaaagacagugaguggcugaaccuagugucuuuagaacucaugaaugggcuucagcacugucuucugauuguuuagaugaaaacuucugguguucagcuucagcuuguagcuucugaagagaaucagugcucaguaccauguagaagaacaaggcuuacucuuagaauuucauuuccgguguaaaaaaauuuuagauuaaaugauaacacuaaacuaaauuuagccagagucacaauucucauuucuugaaauuacauuuucuuuuuuuccuuuuagggggauuucauucugaagauugagccuccccuaggguggaguuuugguaaguuaacugaaucacuagacauucuuuguaaaagauuagaugauaugccgaauauuaauuuaggcuagcagagugcauaaacuauuaaaauauuaaggaucauuuccaguauggaagaggguuuguauuccuccccuccuugcccccaucacucugguuuaguucggauuuaccuuaaucuaccuuaagacuuucugucaccuuugaaaaauagacaucuuuucuucuaccuuucuggaaacucuucccuugcaguuucacucauuacguggccguggaacaguauagaaaucaagaguggggacuugguucccgucccaggauggcuucuuuuuuagcccucucaguuuuuuaauuuuuuauggaauuaauugaaacauuuaaagauugugagauuugucauaaaaauccagauuuaugucccaugagaugagaagacugucagccuuauaccuuaccaguuaaauaacuuugggcaaguuacuucccccgugucagccuggcuccucacugucgagcaaggguagauauagucccugccccacuggguacuuggaggauuaauaaaccaauacugaguguucagaggggcuggcacguaauuagcaaguacucaguauucagaaacagcccuucugcacacaucccaacaaaagcuccaaacuuuccucauagaacuaacugccuucaagcauagcuggggaguuggggaugggguugagaucagaagagagggucuguuuugauguaguuuacauuuuugaagaggagagacucuugauguuucaguagagcaggugugggugaccccaguccauggcuuggggagaggaguagggaucaccguuguugauaucaggcuugcucgugcauuagacaaggaagaauuuagcaccugccaucgccaaggcuaaaaugaggcucaggcagcugacagcuaauuuggcucugugagagcagcucuuuuaucaguuuauagucagggguaggguggggggugccuggcugguacguuccagaaagcuggagaggaaugcagcccugcucauggccaaagcagaaguccagauugguggccuggaggaguguuguguuugccaccccccacgcuacccccaacuggugcuguugauaagcuuuuuaauugaauuauacuuucagaaaagugccuuggaugaauuuucacuaagugaacacacccauguauccaccauccagaugauaagauagcacuucaccagcaccccagaaguccccauccugggugcucauuagccaucccgccccacccuccaggugaccaccacccugaccuucuacaaauuagagauccauuuggucuguuuugaacuuuauacaaaugcuaucaugcagggaacuuuuuaauauccaguuucuuucacucaacauuaugaacuuuaucucuaucauuuguagcuuuaguucauucucuuugcuguugagaauucugaugcauaaauauaaaauuauuuauauuuuauaaaauauuuauauuuuauuuuauuuuuuucuuuuuuuugagacugagucucgcucuguugcccaggcuggagugugaucucaguucacugcaacuucggcccggguucaagcaauucuugugccucagcuuccucaguagaugagauuacaguugugcaccaccacacccagcuaauuuuuguauuuuuaguagagaugggguuucaucauguugacccaggcuggucucgaacuccugaccucaagugaucugcccgcuuuggccucccaaaguguggggauuauaggcaagagccaccacgccuggccuauauuuauauuuuauauucauauuuuguaucagugaucucuucuacuguugauggccauuugaguugcuuaccgauuuuggccacuaagagcagugcuccugugaacauucuuguauguauauuuugauacaugugucugcauuuuugcugaguguaucacaggaguaaagucgcugagccauagagcugauacaugcucagcuuuagguguuugcaaacauccaaaguggaugcaccaguuuguguucucccagcaguguacaaggguuuccauugcuccacauccuaaccuacacuugguaucgucaguuuuuuuuaauuuuagcccuucuggugggggugugguauuaucucacuguggccuugauuuacauuccacugauggccaaugagguugcacacuuuuucguauguuuauguuuguuugccaugggcuagcuauuuuuguaagauuccuguucaagucuuuugcccauuuuuuauuggagucuuugugugugugugugugugugugugugugcauguacgcgugcaagcacguguguaauucaucuuaacugaaaaucucaucucaugguuuuccauuuuuuucucuacucauuacuccauauucuuccuaaccuuucaaaaacucaaccuuaaccccuauuaugaugaacucuucaguuaaaaaauggaguuaauugcugauauugaaaaaucaagagaugguauauaaaauccagauuuccaguuuuucggagaaguuggaagcucuggcaaagcaugguagugguuggcagacuugaguggcgguugucuccuuucaauuugccacagucccccugaggaugcuccgcucacuucgaacccaugaggccccuguggcccuggaguuuguguuccugguuuaacauggcugagcucauguccuuggucagagaacagauccagagccagacuuuuaggguugaacuggggcucugucacucagaagcucugugaucuugggagcuccuuuaaccuuucugugccuuaauuuaccccucaguaaauugcagcuauuacugccugucucuuaagauaauugugaggauuaaaggcacucagcucagugccuggucggugaugagcauucaggaaauaaaauuauuuggugcucacugaauuuucccuggaacucugagauauaacuuagcugaaaggcguuguaaaauuauuuuauacucuaaacacgaauucccucuggggcaggaaaccaggaggcuagggggauaggggugagagggagacuuuucccagaauacuuuuuuguaccuuuggauuuggaaacacacgaguguauuaaguguucaaaaguaaaaugaaaccugaauaauaaaaauacguucuacuuagguucacuguaccccaaaacuaagcuugccuuugugucuugugccccgguuuccuccccugcuucguuccucagagccgacgaccguggagcuccauguggauggagucagugacaucugcacaaaggguggggacaucaacuuugucuucacuggguucucugugaauggcaagguuugucuuuggaacuugauuauuuuuccuguucacucuauaauguauacuaaauccuuuuuuaaaaaaaugcaggauauuuuaaccuggggacuuugaucccacaagggacccauggauaaguggcaagugagccugugaacucuguacuucauccguguagaacgcagcagguguauuuaggagugagauugagguugcuggucauccccucugcucccagagcauaggcuguugguguuuuuauuuuuuuauuuuuuauuuugagacagggucuugcucuauugcccaggcuggagugcaguggugcaaucuugacucacugcagccuccaccucccagguucaagugauucuccugccucacccucccgcuccuucacccucccgaguagcuaggauuacaagugugugccaccaugccuggcuaauuuuuguauuuucaguagagaugggcuuuugcuguguuggccaggcuggucucaaacuccugaccucaggugauccgccugccuccaccucccauagugcugggauuacagguguacgcugugcacccagccgcuguuagcguuuaugucagggauggccuuuuacagggaugccgaauuggaaggacgcacucucuaagccuuguggcaucuugcugucccugugggugaauugaagucagcuucucccagagagagcgugcaucugcuuccgacacuuaccuaggaggauuccuauuauuuaaguucugagauuuuuuuggaccgccacgguggugugaauuuagaguccuaacgggugugugcccagcucccgcgauucagauucucaggggagagucauuucucuuccacccgcccugugccugagguugagaugugcuuccuuccuuccuguccuucucuucaugauggacuucuuucuccucuaccuuugcggugacggggaggcccuuccaucccagcuguaugugugggcuucuuguuagagauggggaucuuggguaguuuuuucuuuaucgaugguuugcaaaauaauggugaaucuuuuuuuauuuuuauuuuuauuuauuuauuuuuuugagacagagucucgcucuguggccuaagcuggagugcaguagcgcagucucucucaccacaaccuccaccuccuggguucgagcaauucuccugccucagccuccccaguagcugggauuacaggcgugugccaccugacccagcuaauuuuuauauuuuuauuuuuauguacauuuacuuuuuuuuuuuuuuuuuuuuuuuuuuuuuaagauggagucucccucugucgcccaggcuggagugcaguggcgcgauugcagcuuacugcaaccuccgccuccuggguucaagugauucuccugccucagccucaggaguagcugggauuacaagcaugugccaugacgcccagcuaauuuuuguauuuuuaguagagacaggguuucaccauguuggccaggcuggucucaaacuccugaccucaaguggucugccugccucagccucccaaagugcugggauuacaggcgugaaccaccacacccacccagaccaauaauggugaaucuauaacugaugaugucuuagauucauugaaauagagucuuauuuuacuguuacuguucccucuccuaccucauccccaggaaacauauccaugauuuauagcaucuuuucaaugggauucuugacccaaagaggguuccugggcuccaccugggaguuguaagcaggacugccagugcuuugagaggagggugcuuugcugggugggcccuaacuuucuucuccauggcagguccucagcaaagggcagccccuggguccugcgggaguucaggugucucugagaaacacugggaccgaagcaaagauccaguccacaguuacacagccuggcggaaagugaguagcguccugucucuuaguguugccuuagagccgggcucugacaggggucauggagcuggguuugggaguuuggauucagggaguucuggguucagauccugauucagccucuuaacuuugggugaguucaugcccgucagagugcugaguuccccacaugugaaauggaauccauuugacccaucuugccuagcauugaugagaugauuaaauaugaguucauacuggccaggcauauuggcuugcgccuauaaugccagcacuuugggaggccaggaugggaggaucacuugaguucaggaguucgagaccagccuggacaacauagggagacucaaucuccacaaauaauuuaaaaaauuauaucaaguagagucccacgggggaagaaaauuagcugggugugguggcaugcuucuguggucgcagcuacucgggaggcugaggcgggaggauugcuugagccuggaagguugaggcugcggugagccgugaucaugugccacugugcuccagccucggcagcagagcaagacccugucugaaacaaacaaaaaaagaguuaauacccauaaagcaccugcuucaaggccuggggcuuagugggucuucauuuagcagcucagccuggcucuggagccugccagcccgggcuugaaucccagcucccccauuugcuggcugguugaccuagggcaaguuccuuaaccccucugugccucaguuuccucuuuuguaaaugaagauaauuguggaaccuaucuccuaagguacuggaaagaugaaauuaauauuauuacuucaagcugccuggcauauuagcucaaacagguuagcucaguuaugauuagaaaaaaucauuaucauuauuauaucaaaacugcuuuguaguuggagcagaugccuagcugaccuugcugagucagauuuaaagcauuuauuuaauggauguauauaguugaguuguaaauguuaacagauaugccaagauuaauaccagaauaguucaaacugauaauuccgaaagcguucaaaucauuacuaacuccguuaauauacaaacugaguaaauugcaaaauagaaguuuauaaugagucugucaguaaguuauucaauuuuaaaguuauuauuguugaaacuaguuuucauuuuugaaauaacauuuacuucugcuugacuggugccucuccagcccugguguguagcaggaauauggagcuguaauuuuuuuucugggcuaguaauuugguguugaccuuacuagaaaaaaauagugucuugagccuucugaauaccuuucaucugcacuaacugaaacaaugaaacauguagcacugggcuauuaugaaaaugaaauagaagcucaaucuuaccaauacuuguaguaaugugauuuccaagcccuauccaguuauugcaggcaagauuugauacaauaaaauaccacagaagaagaaaucaaaugcguuuucuaguucauuucaccggacuuagccuucucauuugucaguugccuuacaaauuugaagggauaaacauguuaguauacuggcagcagcauuuccagcuuuagcucggcucacucugguguuagucugucuauggcuaguagaguaauuuucaucagcugcugguuucuuaucucaguugcuuugugcaaaaacccagaaugacuuaucuguguuucucuaaagccuuuuuucugggauucaaagcuugucauaguuuacccugcccugugucauuugcaucaucuugggucagcgucccccucagccugugcaucuguucuguucuuuuucaccccacuucucccuucccauguguuuccuuggacacuucuguccccuucuccuugucaguucaugccugucaccucugucaaacacagucgaauguucugugacuggucccugcugugcuacaaggauugguuuuaugccagaaauccuugagauuaagggagacguaagcacuccucuuuccgaucagcacauggagcaccccucuugacacacaguaagugcucaauaagcgcucuuuuaugcagauuuguacagugaaggauugaauuucauucaugcucauuuaacaagcuaauggaaguuugcgauaauuccaacauuguuuucuugugcugccaacauuagucauagaauuagaaauacuuggguuguuuggagaaaguuaaaugguuauuuuuuaugucuuagguuugcauuuuuuaaaguucugccuggagauuaugaaauccucgcaacucauccaaccugggcguugaaagaggugagugacagcuacgucuauagccaugccaauaauaugcuggucuugggacaaauguagggcuuuucaauuuaggauaugaaaagaauuuaugguuccuccaggacuagaugaagaaccaauggugcuguuguuuaguuugguaguuauuuauaagguguaacuccucacuguagcagauguugcuuguguuaguuucaguuuuaggugacaguguugucuuccugcugugaaauagaucuguuuuauuaacuauagcuauuuuaaacuaaaucaacaacagaaggcccugacgagauuuauuuguuguucuuuuuucagccugaaacagaaaucuguaaauauacuaaacauucuagaaacugugguacgcgugaccaaggagaauguaugagaauguuuauugcagcuuuguuuguaauagcaaaauauuguaaacaaccuaaaugccuuuuaagagaagaauggauugggguuccaucauacaauaggcugcuguaugucagcaguaaugaaugaaccagagcuacauauaucaauguaacuacauuuaaaaacagaguugaaggaaauaugauuuuaaauacuugugauaaucauuuauggauacagucuuuuuuuuuuuuuuuuuuaaagacggagucucgcucuguugccaagacuggagugcaguggcaugaucuuggcuuauugcaaccucggccuucuguguccaagcgagucuccggcuucagucuccugagcagcugaauuacagggaugugccaccacgcccagcuaauuuuuguauuuuuaguauauaugggauuuugccauguuggccaggcuggucucgaacuccuagccucaaaugauccaccagccucgggcucucaaaaaaguggugggauuacagguauaaaccagugcacucggccagauacagucuuuuuuuuuuuuuuuuuuuuuugcaacagggucuugcucuguugcccaggcuagaguacagugacauauucauggcucauugcagccucugguuccuggccuuaagcgauccuucaccuuggccucccaaggaucuggaacugcaggcaugugccacugccccuagcuaaggauacagucuuuuuuuuuugagaugaagucuugcucuuguugcccaggcuggagugcaauggggcgaucucggcucauugcaaccuccgccucuuggguucaagcgauucuccugccucagccuccugaguagcugggguuacaggugccugccaccaugcccaguuaauuuuuguauuuuuaguagggacagggaggauacagucuuauguagaaaaauuauaaagacauguaugggaauagcagaugcuguucaaaaugauacugacuucuagagaaagagggaggagggggacuucgggguacgccagcaucuugaauuguauuuuuuuaaauuucuuuagcugguuagaagguauguaaguguucuuuagcauaucuuuuuuuguuugacugaaauaguuuauagucaaagaucaaaaaaggaacuccaccuaguaggugagguucuguaauagccgugaaagaccaaauugaaauaagacuuaagggacaucuugacauguuagcuucuguguuaguauugaagcuguaucucauuuuugcuaaagaagcauuggaaucaguauuucagcuucuacucuaucuguuuuauuauuauuuuuacucuguagguuuuacgcacuuauaauugaugauaguuucacaccuagaugucucuucuuacuguuuaugacuuuugguuuuggggguuuuucucuucugcagcaacauuuaaaaauauuuuauucaaggcugggugcaguugcucaugcuguaauuccagcauuuugggaggcugagguggguggaucacuugaggucaggaguucgagaccaaccuggccaacauggugaaaccgcaucucuacuaaaaauagaaaaaaauuagccaggaaugguggcauacaccuguaaucccagcuacucgggaggcugaggcaggagaaucgcuugaaccugggagggggagguagcagugagccaagauugcaccacugcacuucagcuugggugacagagugagacuccaucucaaaaaaaaaaaaaaaauuuauucgaaaugaaagagcuuacacauuuauaaauagaagagauuuugagguuuacauuguauguuaauugucugcauagaagaaucugaguuuauuaauaugagauugggauuuucaaguaaagcauguuguuagaagucaggauaauguuuauccuccugggguguuagugaccggaagcaagugugagggcacuucuggcuugcuggugcucuucuguuggguaaccagugcccaauuugugacaagcccugugcugcgugcuuagaaucuguacacuuuucucuguguuuauuguaccuuaacaaaaauguuuaaaaauauacacauauugugaaaagaacaacuuaaggcaaauuaaacagaguuuaauugagcauagaacaauuugucaauugggcagcccccugagccagaauagguuuacagugacuguggcacuguugcgugauuggaaaggguuuauggacagaaaaagaaagugacggacagaaaguggaagugagguacagaaacaguuggauugguuacagcuggacguuugucuuauuugcacaugguuugaacaguuggcugccugugaguaguugaaggguggcugcuugaauugggugagacuuggcaacacguacagagaaaccuuuaggccaaacuuaaaauauguaaggaggcagcuuuaggcuaaucuucaguuaacacuguauaucauuaaaaauagaaaaaaaggcaaaauaugcucauuaaaaaaauuggaacauauagaggaauauaaagcaguggaaacaaauuuuggaagcuggaaaaguauacaaguaaaauagcaccauauagacaaaaucauuauuguuuacauuuugccacauuuccuuucacuucauuuugggcauuaaaaaauaaugauaagccaggcacgguggcucacaccuguaaucccagcacuuugggaggcugaggcaggcggaucaccugaggucaggaguucgagaccagccuggccaacacggugaaacccugucucuacuaaaaauacaaaaauuagccgggcgugguggcgagcgcuuguaauccccgcuacuugggaggcugaggcaggagaaucucuugaacccaggaggcagagguugcagugagccgagguugcaccauugcacucaagccugugugacauacugagacuccgucucaagaaaagaagugaucauacugaauaagcaauuuuauagauuacguuucccaguuaauauuuuagcuucagcguguccucauguuguuaggcacuuugcaaguguuuauuuuuuuacagguuaaaaucuuuuucuguuacaggcaagcaccacagugcguguaaccaacuccaaugccaaugcggccaguccccucauaguugcuggcuacaaugugucuggcucuguccgaagugauggggagcccaugaaaggggugaaguuucuucucuuuucuucuuuaguaacuaaagagguaagcaaagaaaagaacaaaagagauggugugaaggguaggagggugggggauuauagaccagaacauacuguuuuaaaaaaugcaggucugaguugauuuaucauuuuaacacuuaagaauaucgucugucucaggccgggugugguagcucaugccuguaaucccagcacuuugggaggccaagguggguggaucacuugaggucaggaguuuuagaccagccuggccaacauuaugaaaccccaucucuacuaaaaauacaaaaacauuagccgggcauguuggcacgugccuguagucccagcugcgugggaggcugaggcaguagaaucgcuugaacccaggagguggagguugcagugagccaagaucacgccacugcacuccagccugggugacagagugagacucucaaaaaaaaaaaaaaaaaaauucaagaauaucaugugucucuguugacucacaagacauugcacaucuacacugggaggcagugguaugugauggaaaguacacaggcuuugaaaucagaccuggguuuaaacaaaucucagguuuaaacaaauuccucuuccuagcuaugcgacccugggccggucacauuaccuuccugagcuuccguuuccuuauuuggagaauggugacccaugauaaggaaggacagucaugucaucuuucccgggaagacugugccaguuuuuaacuuugcaacuugaaugucaagauuuuuguuccuuuuaucuguauuaaugugucuuagauuucagaaauacauauauugacaugaaacuuaaaaaaauuuuccuauaauguggcuaauugaugguauucagaacauguaaauggaaaaggaagucuugucuuuuuuacccccuggcauaggauguccugggcugcaaugucucaccagugccuggguuccagccccaagacgagagucugguguauuugugcuacacggucuccagagaagauggcucguucucuuucuauuccuugccaagugggggcuacacuguggugagugaagcagauuuccguucuguuuaugucugggacucucaugacacaguaaaagccaaugcuguuuggguguuaaaggaaaagaugguuggccugcaguucucugaacacgcuguuaagcaguaacuuacuuaagaugagacacucaccccuucguaauagcuacaaaaagggcaaggcuuccucuuuucgaaucugcaacaguuaugaugaauguuucucuuggucugucugaaccccuugucauuugugggcugcuagaucgauuauuaauauugcugauugaucauguuagugguucuuagugauuaagagacucuuccuuccagauuccguucuaucgaggggagaggauuaccuuugauguggcgccuuccagacuugacuucacaguggagcaugacagcuugaaaaucgagguaaggcuuuucugucuucuggagggacagguguuugaguucccaucccuaggcacagguauugcaaacauguuuuaaaaaaaaaucaauuauuuuaucuggaagggcuguuggaaaaaaugccaucugguauuauauucuuacccaugauguccuuaucguagagagcuggauuccuaguuaaaucuacucauucaaugaaauauauuuauugauugccagugacaugcauuucaggcaccauuccaggacuggggauauagcagugaccaaaagaggcaaaaauucuugucccuguggaccucauuuuuuuuuuuuuuuuuuuuuuuuaagauagggucucacuguguggcucaagcuggagugcagugguacgaucucaucucacugcagccauugccuccagggcucaagugauccucccaccucagccuguugaguagcugggaccacaggcacgugccaccaugcccagcuaauuuuuguauuuuuguuagagaugggguuucaccauguugcccaggcuguucucuaacuccuggguucaagugaucugccugccucggcuucccaaaguguugggauuacaggugugagccaucgcaccuggcuagaccucauguucuaaugacaggaagggucaauacauguauagauguauaaguuagaaaguacaguagaaggugauaaguguucucuagaaaaauaaaggaagaaaggaggucguacaguaucaggguggagacagggguugcaguuguacauaggguguuuuugggaaguccucccugugaaggugacauuugaucaacaaccugaagggaaagaacaagagaaccauacuucacuccugcaggaagaguguguaagacugagggaacggcacgugcaaagguccugaggcaggagugugcugaaggguuuggggcaucccaaggaggccaggguggcuggaguggagggaaugagcaaggaaggaggaggcggaaagagggucagggaggugacagggcagauugugcagggcuuggugggccacuuugccuauaacucugggugagaauuggugccacuggaagguuccuagcagaggaguggcgugauccuucuggcagcugcauugaggagaguuugcagggugucaggguggaagugggagaccaguugggaugccauggccguaaaccaggugagaacuggcagagcuuggaccgugaugguaggaaugggcagugugauacauggcuugauaaacugccuagacccucacauaaaugguaaauguauuuuucaucucacuuacgucuccuuuaauuacagaaguagaaaaugguuacuguagaaaauuggcuagcuagaacaaaucccaaaagaaaauaacagccucuccuaaguggaccacccaauguuagaguuaucgaagcaauuauauuuuaaucauuuucuuuuaauaauuacauuugaaaguacuguguuaaaaucgcuuaaacuggcagaagcggacuuuuaggucauaugcacaguggggugcagacucugcauuuuaagauucaguggaguguuugacuguucugcuguacacuggaggggaaagagaaggguaagaagaugaagccuuuacuuugcuucucguagcuugcagagaaggaugggggcaggugagcagagacagcuauucccagauuacagccaaauacauauuuugaaaaugaugaauggaauuucagggaauggggcccuguaaguucccugaggucagguaccgugucuuauucuuuacuguuuuccuaacaugugauuuagugccuggcacauaguaggugcccagcaaaaauauuuguugaguacauaugugaauuaauaaguagguaaugcauggaaugaaacaugucuuuuuggaaagaucaggaaggacuaccugucaugugagaccaucacuaagaaaccauuugcugaaaaaaaaaauaaaaaaauaaaaaagaagggcucccugcauaaaaaggaagucauuuaauuauuuaaagcuucaucucaaaugcuguugcacacgugcgugcacacauucauucauucaggagucaguuauugagugccugcuguguaccaggugacuaagacagaaaaagucccugucuccaugagguaacaugcuagugggagggagacaacuaagaaaucgaacgaggacauuucagauacugguaaguuugaugaagauacuaaaauggguuagcaguggugaccuuggggauacacagaucagggcuggaacucaguaacugcagagaaagcacaggugugcugcucacaggcaaguggggcacagacacagacacagacacagacacauggagcaugggaccacgugugagccagugauggugguggaggaggguggucuagguggauuucuuuuuuuuucuuugagacagagucuugcugcgucacacaggcuggcacugucuuggcucacugcaaccuccgcaucccgaguugaagcgauucuccugccucagccucccgaguagcugggauuacaggcgccugccaccacaccuggcuaauuuuuguauuuuuaguggagacagggcuucaccauguuggucaggcuggucuuggacugcugaccucaagugaucugccugccucggccucccaaagugcugggauuacaggcgugaaccacugcgccuggccuagguggauuucauaaggaccuguguucaggucgugguggaaagacaggaggggacacgugagaccuugcagagguggaauccacaggacugaucgaugcuggaggagcggggcggggcauccaaagugaugccggggugugcaugggagacuggaggaagacgugguucaccaaaaugggggcaucuggaggggaggagauggcacagggguaaggguggggggcuucuagaagcuugagucagugaccuuuuaacgagggaaguaagucucuagacuuuucuuuucuguuguuugacacucagcaguguguugggaacacaacagagaagacagauguggguaaagugagagggagcccggcuggcacacaggaccggggcacugaguguugggaggugggcggcaggagcagacaugguaggugguggccggcgcagcagaaggaggcuuuguggcucuggcacaggagcaccuucgagcaccuucuucuuguucuuuguuuucuagcccguguuccacgucaugggauucuccgucaccgggagggucuugaacggacccgaaggagaugguguuccagaagcaguagucacccugaauaaccaaaucaaaggugggcugacacagcagccccaggcugauggccagcgcucuuuuuggaucacagagagaaauggagaggaacugaugacuauaugagaacauggcagcuuuugguccaaguauucugguguacauguaaggauacacuguuauuuuuggcuuaucuucuguuuguguguuuuuguuuuacaguuaaaacaaaagcugauggcucauuccgccuugagaacauaaccacagggacauacaccauccaugcucagaaagagcaccucuacuuugaaacggucaccaucaaaauugcaccgaacacaccucagcuggcugacauuguugcaacaggguaagcuuaucguguggauuuggaagcaccaguaaauaugcuggcagccaguguagaaccaaaugaccugugaucugugugucuuugccgagcuuaagaacuuaagaaagauuaguacuuuuuuuuuuuuuuuuuugagagacagagucuugcccuguugcccaggcuguagugcaguggugccaucucgacucacugcaaccucugccucccagguucaagugauucuccugccucagcuucccaaguagcugggacuauaggcgugccccaccacacccagcuaauuuuuguauuuuuuaguagagacaggguuucacuauauguuguccaggcuagucucaaaacuccuaaccucaggcugucugccugcuuuggccucccaaagugcugggauuauaggugugagacacugcacccggccaagaaagauuaguucuaaaucuuacaaacugaagguacugacaugucggaugcuuaaugaaaagucccuugcuucaaauuaaaaugggcuugugaaauuaaaaaaucuuucaugucugacuuucacgaucuuucacaggaccccucuuugcuuaaucuuugaggauuuuuggaagaugguauuguugguugagaaagcuuauuggaagaugcuucaggucauugguguaguucuuccugcuuguaguuacucauuauacuauaaguacaggcagggacaucuugugguugaauucaugugguuuuaccaucaucugaagcaagauuguguagugccaagaacuugggcuuuggagucagaucccagauccaccuguauguaaccugcagaacagcuuuagacauaacaggugcucacaaaacaguagcuuagaaggagacugcagggucugcuugggagaagcgcggcaugagcaaagucaggcagucucacagcagcaugagguggcugcggguguaaagcugggugcuacuggagcagaauauacuggcaggugaaggugaugaugaggccaaccccauagcaccuccucacaccccaccagggcguaggggcuuucucccacuggggccaacgggccaugagugguuuugagcauuaauauaacaagcuuugaucauuguuuucaauagggcauucugaaaacaguggcauggaguagaguggcuuugaaggggacaggacuugggcacaggaggucugaaagcagagacgacaagggcuugccuuguagggaagucagggacagacuggugagauauuuagggugcccagcuugagaggugugauggcuggggacagaaagagaagccaguuaggugaugaggguucagauuuggccacauuggucuguaggaccacuagguggagcucuucaauagguacuuggauggaugguaaauccugaagauuuggccgcagguggcagccaggaccucaaauauguaugugcaaguagaauuagaagaacaguaggccaaaaacagagugccagguggcccaggggggaccuagggagcgugaggucauaggagcuaagaaaguaaguuugggguaggagguagggcccaacagggaggugcagggagcugggcccuggugaacacaguccccuggcuugaucacugaggaggccacagugacucuucuguagacagauggaggucgaggucaaggaguccaguggugaauggaagacagggaagcaaauuacccucagaaaguaauucuuggauuuaagucuuucccaccuuccauaaacacuuugugcaauuacucuagaugaggcacugaaaaaugcuucguaccuaauaauuaaucaaacuaguguuccagagauggggcuuucacccuuccagggagacagacugaagacaaauacaucuguggccaggcuuaaugccucacaccuguaauccaucccagcacuuugggaggcagaggcggguggaucgcuugagcccaggaguuugagaccagccugggcaacuugggaaaacaacaucucuaccaaaaaugcaaaaauuagcuaguuucauaaccuggucuaaaaauaaauaaagagauaaaaauuaaaaaauaaaauaacaagauuuuaaaaaaagacaaaaaagacaaauacauuuaugcugcuaaauuauggcaaguguugugcagggaagagaucagggugcugcaagaagagcuaauuuagagugggagcucugcaaggcucucuggguugcagagaccuuaguaaagacuaaaaguuagcuaaagaaagaucuucccuaguagagaagcagcaugcucagaggccugcauaggauaggaaggaccugaaaggcagucugcgcagcuggaggaggugggugaggucagggagcucuggggccuuguagccuugcuuugggauugggcuuugcucccuaaugcaguggaaacccguuaggaguugucuguugguuggccgggcaugguggcucacgccuaugaucucagcacuuugggaggcugaggugggcggaucaugaggucaggaguucaagcgcagccuggccagcauggugaaacccggucuguacuaaagauacaaaagguuggcggggcauggugaugcguuccuguaaucccagcaacucaggaggcugaggcaggagaaucgcuugaauccgagaggcagggguugcagugagcugagauugcaccauugcacuccagccuggccgacagggugagauuccgucucagaaaaaaaaaagaguuaucaguuggcaagggagugauagggaucaugguacuuuaaaaaguuuguuuuucuuccuggcugcuguguggagaauggauuggaggaaagccauggugugaauggaggggccagauaugaggcaguggugguugucuggaggagauaugguaguggccgggcccaggcggcuggcaggcgagggagggaggaguagauggauuugguaggucacauggagaacacacccacaggccugugcuguugagguuacagguuucuuauuugagccacuggguagauggaggaggcgcuguucacagagauggaggaaauauauuuauuuucuccuuuaaaguagaguauuugggucaaagaaagaaaaauagcauuuguugaacauuuuuggaaaaucucuuuuuuuuauuggccgacguaguacauuugccuuuuuagcacacugauacuucuuacuauuucuuuuccuuuuuauuuuuuuuugagacagggucuuacuccguugcccaggcuggaguacaguggcgccaucucggcucacugcagccuccgccucucggguucaagugauucuccugccccagccuccugaguagcugggauuacaggcuaauuuuuauauuuuuuaguagagaugugguuuugccguguuggcuaggcuggucucgaacuccugaccucaagugacccacccgccucggcuucccaaagugcugggauuacaggcugagccauggugccuagucuuccuuuaaaguaaaauaaaaaaauuacucaauuuauuguaaaaacaaacucuuuggcuucuguccaaaugacugugaaaauagauuucucucaauauccaccaauauuaccuguuucuguccauauauguauuuaaacccuguugaaagaauuuauugauacaaaucaauuuuuaagggcuucaguauaacggaaccuuuuucuaccacccuuuugguuuauuuuuccaaacuaagccaguauagauuugagguuuagggaaaauaggcacuucuuuuuaauaagaaugugggcuaaaacagaucuuaugguucaaauauuuacaacuuaaggaggcaaagagauuugauaggaaauagacaaggugauguguccucugacagguacacaaaucaagagaauaugacagguccuugggaaugauugugucaguguucgcuucccauccuuuuauucugaaaguucacaguaggggaaugugagaaccaaaaugcauaugcuaggucagggacugggacacuuucucuguggagagccagagaauaacuauuuuaggcugcgugagccauacggucucuaggacaacagcugagauagacauuuguaaaugaaugggcagagcgcaacacaacuacauuuuuggacaccacaguuugcauuucauguaauuuuuacaugugaaauauuaucuuucuuuugauuuuuuuuuuuuaacuuuaaccacuuaagaguguaaaauucuuuuucucggcuugcaguucauacacaaaugggagggggguccuugggugguaguuugcugacccaugcuggagauagugagcucauauggcugggcagucccuucacucugaagaaauggcuguguuuuucaugauuccuagauuucacauacacaaucuuccaccauuuccuuguguuuuccacuguuuuuuuauuugaggcggaguggugguuccaacauuuaauguaccccuaauugucagaauccaacauucuugauuaucuuuaugucaaaaguaacuaauuuuuaucuaaaaugauucuugaagauucuuuaaaaugaacaguugaaaagacaacugugacccccagcuaggauguacuauuacacuuuaauacaccagcugcuucagaaaugaagaccagcacuccaaggaugauggucguuguaggggggccucucguguguuauucgagggaugccuugcaacaccuuacuccuuauuuagaaucucaaaucugaaucauuaccuuaauagggcuuuucaguuauaaguuacauuuguggcuccuaccucccaaggaguucaauuuuagcuuugcauuuuuuaacuuaauuaccuuuucuguuccaaucucccaguuugcuuucauccauguauuauauauaaucacaagcaaggaagacgucuuugauaauccugacuuauuugauggccugauaaugccacaguuucuuaggcagcuuagagcucuugcuuuuaagggcuagcccacauucucaguccaaggccgcuccgcugucaacgauccaauuaccugaaacguuuuuauuaucugcagauuuucuuaaaauugccucugcagugggggauugccacaugucacccggaacacacaaacagccccacuacgggccccuguucuguagaaagaugcccagucuugcuucugaagguugcuuuuuaaaaccagaaugaagguugcuuuuuaaaaccagaaucaucuggacugcauucugucucuucauuaagauuagacuauucucaggaacaagggcugggagagggcugcaucuuuuuuggucgauaagagccuuuccuguuauaauugaguccucgugcuggaaugaauggucuucucuuugcagguucagugucuguggucggauaucaaucauucgcuucccggacaccgucaagcagaugaauaaauacaaaguuguccugucaucucaagacaaggacaagucuuuggucaccguggagacagaugcucauggaucauuuuguuuuaaagcaaaaccagggacuuacaaagugcaggugcgaugcauuguuuuaaauuuaaaauguuuugagaaaaagcagugauuuuuagaaggguuauuaggucgaaugggguuagagaaggagcauuccaguuuccaacuucuuguuuuuaagucuuuacaauccugcaccaguagaggagagucagauaggcauccagcuaaaaaauaaugccaucugccucucuuuuuuccagucuugauguuuauuaguaucaggcugccagucacuccucuaccuucaggcuucuggcugcuguagaaugucgaugaguccaagaggacaccaaaaaugaacucuacuaauggccgcucaaaaauggccauagugcguggcuucugggaccccaggccaaaauggagcuucccauuuccugcuuugccuugacuucaagauggcuaggcagggaccacgcgacuuauccauucaagcaggccgagaacggggagacggucuggccuguggucuccucaccauggugaaggcccaagccacagcuggcccaagcaagcaagagacaggacagagcagaggucagcccaccaugccuuucagugcaguggcccugcccuuggggagagacuguuuccgugggcugucacccaucaaaucagcagcugcccuuccucccuguggaagagcaaauaacacaaagggagagggccgagaagguucccuguuagacucugcuguccucuagggcaaaguggggucccucccucugugggaaacaggguaggagauugcguucucccugcuuccacagaacagcgugguguguggguugacagcugccuuuauuagaugguagcuggcuucuugcgaagauguccacauugacaagucuuuggaagcccuuucggaagcaugauggacuucuccaaggaagggcagugucgucuuuacuagggaugaaagaguugaccgcugcuaccuucaccuguuccucuucuuagcccaugaaaggcacgcagaacaauaggaggaagaaaaugacuuaauuccaccaaagugucauccacauaguguuaacagguucagagcuuaugcuacaagugauccgaagccgggaaaagugacugggauguaguaugguuucuaguauguaagugaggcguguccgcguugcgggccuguggggaauuaggccagauagacuuuuguucauacacaucggucuguugaggcuaauuuuucaucuggguagaacugugcuuacuucacacaaguuauucguggauuuguugugauuguaaaauuggccuggaaacgaaccuuuggccuucaaaaucucuuuagccuuagucccagaugaauguucuagcgcccuguaggucagggggaagaucuccccgaaugcagccucuaacguuccauccacguuuccgcaggugaugguuccugaggcagaaaccagagcagggcugacguugaaaccccagacauuuccucuuacugugaccgacaggcccgugauggauguggccuuuguacaguucuuggcaucaguuucugggaaagucucuuguuuggguaagauaucacuggaaaguaagaacacauaguuucaaagaagucagccaguaggagugggauuugggaaacuuuuccuuuugccuuuguuguuugcuacugaucaccugcgugcgagggaggcuucuuggagucaagugggugcauguuagcuugaaagaagcacuccgucugccuccggccacugccucuuaggagcucagcaguagcaagaagcuauuacauaggguuaggauucgaaccugugcugaagccuuauaaggggucacauggagcccucccuucuuuucccugcagacaccuguggugacuugcuggugacucuacagucccugagccgccagggugagaagcggagccuccagcucuccggcaaggucaacgccaugacuuucaccuuugacaacgugcucccuggaaaauacaaaaguaagaauuggaaugcaacauccuguggcccucacacacuucuugucuuuguaaacuuucuaaaacucaggucucaaauuguaucacgaccauguaccuuuccuuguuuuaagucgucuuugccucgugaccuugacugcauuauuuagcguuggacaagcauggaggaguccaggcccugagcugaccgccaccuugucugcacagcccacuggcggcuucuguuaagggagggugccccgacguauggcauuuuauuucuaaagcccagagaaaggagugugaaauaguuccacugauguguucuacuaacuuagcaguacuggugcugaguacuggccauggcaagguacuugaccucccugaaacucaguuuucccaucuguaaaauagacguaauggaaccuuucugcagaauauaagacuaaaagaaguaaaguuuauaaagcccguugugcagagagccagcuaaguagcuggugcccacaaauguuacuucccuuuuccuugcccuucuuaagaagccacuucuugccuguauuucugcuuuuucagaaaucagcuuggggcugcuggcaguggauagcucauaaaacagacugcuuuuucuggaauuauauuaauauuuucuguuauggcagggcuuggcagacuacaaaaacugccuuuuauaagcguaguuuccuuagaauacagccuugcccauuuguuuauggauucucuauggcugcucguguguaacaguggccaagucgagugguugaggcugacaaagcauguggccugcaaaacugaaaagaguuacagaaaaaguuuguggaucccugaauaccuuacuugcagccugaucuuacaggccccauuagauuucuuucuugauguaauggaaauugguuccaguuuuucuuucuuuuuuuuugaaauuuagccucgcucugucacccaggccggagugugguggcgcgaccuuggcucacugcaaccucuccgccuucugggugcaggagauucucuugccucagcuucccgaguagcugggauuacaggcaugcaccaccaugccuggaucacuuuuguauuuuuaguagagaugggguuuugcuauguuggucagacuggucuugaacuccuggcuucaagccauccaacugccgucagccucccagagugcugggauuauaggcaugagccaccacgcucgacuccagguuuucuuuagcaguaauuuauuccaaauacugcuaguuauaaauauauguauguguauauuucuaucuuuaugucuacauacacaccugcuuuuuaaaauuaguuaauucaugaucauuguuucugguggcgugcagggagguggugugcuccacgcccauguauccguuuuugguguuugcuuuugcaguaagcaucaugcaugaggauuggugcuggaagaacaagagccuggagguggaagugcuggaggaugacgugucugcaguugaguucaggcagacgggcuacaugcugagauguucccugucucacgccaucacucugguauguacggcuuauggagucucuuauuuggaaaagcgcucgccuuguggaugucaagaaagacuaacaucccaggaauauuguaaacguaggcaagucagauuuccuuuucugccucuccacucgcccaccuguuacgcaacgcauaaucaggaagcauuuauacucucucaguggaaggaccccuguauuuaggagguuuccuuguccuggcccuacacuaaaucugacuggugauucggggugaccuuugguacagugcagagcacacuggcuuuauauuauuaguaauaauagcuucggguaaauucauuuacugcuucucagccucaguuuucaccgaaaauugagaucuuaauaccuacuucucaggguuauggcagggcuuaagugaacccucuuagguaucaaaguguccuugguguacaccgcucuguacugccaagugaguuucucugauauauauauauauauauauauauauauauauauauauauauauauauauguauuuuuuuuuuuuuuuuuuuuuugagauggagucuugcucuguugcccaggcuggagugcaguggcgcaaucucggcucacugaaaccuccgccucccgaguucaagcgauucuccugcuucagccccccgaguagcugggacuagaggugcgugccgccaugcucagcuuuuuuuuucuuuuuuuuuuguauuuuuguuagagacagaguuccaccauguuggccagacuggucuuaaaacuccugaccucaggggauccaccuguguuggccucgcagagugcuaggauuacaggcgugagccauugugccccaccuucucugguguauuuguuccagcgcaggggaagaagcuguaaacaggaucuuagcuucuuguugauuguggucucuguggccugaaaggcagugugaaauggguuucaggagcaccucuguagaucccuucgugaauuuucuauaauguuuugauguugaguggcggcagaugucaucgucaggucuuaguuucucuguagagaaacuagaagaauuggaacugguguuucaugugccaacuuacuccccuaacugcuuaauuacaaaaacuugacaggucgauuuguuauaggagaucgauuaauauccgguucauaauaagugauagauauuuaggaaaccuuucccuuccagcaguggaguggauuuccagcucucuuguaauaagauccuuuuuuuuuuuuuuuuugacacuuccuuaaccccuucuuuaucuccucccacuguccccucacucgccgggccccagccacagugguccucugcagucccacaccaagcucacucccuccucggggccuuugcacauacucuccccucugccuggagugcugugucuucuccagaaacacguguuguugguuuuuccuccucauucaggcgcagcccuauuguucaggagagaugugcccugggaccagcgagcuaaagaccccuagguggggauuguucuucucuugcuuuccuguuuauuuucacagcuucguuacugaccaguugagaucacuaauuuauuuguugaugcguugauuuugucuuccuguauuagaacauaagcccugugagagcaggagccauggucaugacucccaaggcccagccuugugucugucacauagcaggugcucaauaaauauuaguugauugaaugaaaaauagcacacuuuuguuggaaguuuugggagguuuuuaauuuuccuguggcacccaacugcuccaaugauuaaugggcaaaacagaugacugguuuggaaagagaaauauuauuaaucaucuuggugucuccaucucucuuaguaagucauuguauuggcuuugcucccuuaggaauuuuaucaggauggaaaugggcgugagaauguggggauuuauaaccucuccaaaggagucaaccgauucugccuguccaagccugguaaguuuggaaggauugaugugccaugaauuagaaaaauggaaaggcaccagaggaugguuuugaaggcauuuuuuucuaccuuaguucuguuugcaucaagcuuucaauuucuguguguucaaccugcucuuguuuuucugucugucuuggguuugaguuggguagacaccacugggcccuuucaccuccaaaaauauaccauuggccaauggccucucuuuauagagcuguuuuaaaauuggaaucauuucccacuuugcuuaaaaucuuucaguggcuucucgcucuuucucauuuuuuuuucucuuuuuuuuuuuugagauggagucuugcucugucacccaggcuggaguguaguggcuugaucuuggcucacugcagccuccgccuccuggguucaagcgauuccccugccucagccucucgagaagcugggauuacaggugcccaccaccacauccggcuaauuuuuguauuuuuaguagggauggguuucaccacauuguccaggcuggucucaaacuccugaccuaaagugauccgcccgccucagccucccaaagugcugggauuacaggugugagcugcugcacccaaccuucucucucuuuuauaauggauuuuuuuggaggcagaauuugcauaucguaaaacucaccuauuuaagauguacaauaaaaugauuuguaguaaauuuaucaaguugcacaaccacggccagaauccaguuuuagauuuguucaucacccacaauguaagauccucugugcccauugacaguuaaucccuguuucuagccauggccagccacugaucuauuuucuguccccauggauuggcuuuuuuuggacguuuaucauacgaugcugguauuuuguuuggcuucuuuuauuuaacauguuuuugaaguuuaucugugucauggcacauaucaguaguuuguucuguuacauugcuguguaguauucuggugugugguuauaucauauuuuguguauccauuuaucaguugguggauauuugagugguuuccaguuugacgcuguuaugacuaauguuacggacauucuuguacaagucuuuguguccguauguuuucauuuuucuuguuucgauaccuaggaauggaauugcugcauuguguaauaaauuuauguuuaaccuuuuaagaaacugucaaauuguuuuccacagaggcugugucauuugauauucccaccagcaaugcacgaggguuccgguuucuucaccuccuucgccaacauuuguuauugucuguuuuauuauagucaucuugguagaugugaaguugugucucauggugguuuuguuuugcauuuuccuaaugaauaauucaguggcuccucuguuugguucccaagauaaaauacaaacuccuuaaccugaucuuagcuccuguguaacccagcccugucugccacugucucuacuccagccacucuguccuucugggugucaguucagcugccuuuggcuacauguaacaaaauccauacagcagugccaucggcaagugguaguuuauuuggcucaauaaagaaguguggcagugcguggcugccagcauggguucagcagcugguagauguuagggguggugucuuugugauucuuuaggccuuucccuucuauuuuuugccuuguauuuucaagauggcuguuguuagaaaacuuauguuuaaaggagaaagucaaggagagggcaggcaaacauuuccuugcgcccccuccuccaguaagcuacuugucuguauuauuggccagaaccgugccacaugguuacuucuagcugcaagggaggcugggacaguuggaugugcuacccgaggcugagcacguugccacccucaacauaaccaggguuuguucucaaggcaggaaggaugccuguugaggaaacaaugagccagccugugaggcagaugcuguucucuguggacauguccuccugccccuccuagcuggggccuucuuacccaucaguucaguauugcuucccuggggaaggauggccuccagggccacuuaggccugccuccuacacucuugcucucagcacucacuucuauccccuucuugcaugugccacaauugauauguuuguggcugucaaaugcucccccucucuguggaugguaaacuccaugaagacagggaccacugcucugucauuccccacuguguaccaguaccuagcauaauaccuggccaggaagaggugcucugucgauauuuguugaaugaaagaccaaacaaaacaaacagagaaaccugauuuuuuuuuuuuuuugaugguaacuacucuggggcuuguugagugcaaugaaaacagcagggugguuuuagcuaauuucagguuuuuguaggaaguguggccaaaauauugguuaaugaugauuugggggaaauacauuguuauuccuuguaucuuccugaaauugacuguguuccucuggcaagugaugaaauguaccccuacucggaguguccucccacacagacucacacuuuucuggggcuucccuuacuccuuaccuccuuuuuaggaauauuuauaggaagaaauugaggcugugguuaucucuuggauccuuaauagaaucuuuuaaguaggaaauuauccucaguccaauuugcaguagaaacguacuuucuguuccuucucgugcauggguccguucaccuggucugugcagauuuaacuacugugaguuguuaccuuauggaaaaugaaaaucaugcgccugugaucgggccauugcauggaucgggucauugguaagacgccuucauaggcagugaaaacgaugccugcccaguauuucugaucccauuauugcagaucugcgauacguuugaguuuucacaugcaaagagcugccacucgauuucagaugucggaauugcucaguguaauagaugccauucucugaaaauuacuuuugauuuccugucuguagguguguacaaagugaccccucgcuccugccaccgguuugagcaagcguucuacaccuaugacacguaagccugggaauugaaugcuuugugguguuuguauacauuccguggaggauucuucauuuacuucagagaacaaaaggaguuuuucuguuuuuuuuucugaaagaggcaagguuaggccuucaacagcauuucuagauaaggauuuuaagacacuuggauuaguuacugaggaaccggagacaggaucccuuucccaagaauucuguaaccccaggauagagggcuguguuuuugaagugccuuaaauagaagcuuugucaaaucucccagcccucaccgaugggcaucugucaaguucaagucugccauuuuuguauuuuuacagacguguguggguuucacugggaauuggaagcauaaaguuguggaguggagaauuaguuuacucuuuaaaauacuucucuggaucuccagaguuauuuuaccccagacuaaaagcaauuuucuguaguauauuuagggugaagaaggaugcccaaaaaggguauugcugaugaucuucugagaaugaguagguucuagcguuuccucugcuuugauuuguaggucuucaccuaguaucuugacauugacagccauucgccaccauguccuuggaacuaucaccaccgacaaaaugauggaugucacugugacuaucaaguaagaugagcguucugcagugggccgagaguggcgggagaggguguggaugaggccuggggagucucuaauaggcucucuggaaauuaguuuugauuucuuaucucuagauguauauacaaauggccuucccucucuuauaggacauugccgucaauucccagcagccuugauccuuuccuuuucugauucagaaauuaccugugggugaggaagagcguugcgacagcuuguuucagugucuucaauuucuguuugaacucuuuguacuucucaucuuugcuaaggaaaaaaaaaaucucugggguuugugcauuguauuucaaguguuuuagcaaauucaaauugccuauuuuucuuuagacuuuugcuugaaggcuugggaaauagagauggcaccugguauaagagaagggucgugagagaggaaguauuugaaaggcaagucccucaccgaaggucacguucaugugaaugucaccuuucagggaauuuuugcaguguggugagguaccugugacgccccaauuuucuugagaaaugaaagaguuuuggcaacaugaccgucucugucaaguagaaugggcauugcagucccugucucccuccugccccugguugaagucaccuuuccagcuauguuuccaucuuucuguccaccaucuguuuauccauccgucaucccugcagaguacaugaugacugaaaaacugagagucuucaguguuuaggcacugggcuuaugaggccacagccccuacacuuaugggauugacagucucauggggggaacaguggucagauacucacaugcagaaccguaaaaugacaacuguucugagugcuuugagcuugaccuugggggcaugcaggacagguaggcugcggggggccaggccauguuaagguccauagucuuugucccaugaugcaauugacauguuuuacauagaggaaugacauuuuucuuccugaaggucccccuauuggccgaguggagaacagacagaagaggccugagagugggaggugguggaggcagggggaggcaaugggggccccagacuaguggcugcggagauggagagcgacggacuggucggagagucguugagggacugaguugaugagacauggcacuaaagugaccacuggguuagggcgggagaaaugucagggcuggcccugguuucuggugauggggagccagguuuuuagcuggggguggauuugcugaaggucuguugcugucuuuuacuaucauuuacugucucccugcuuggaaaguaugaauuacugauaggacuagcaaucuaccuucuuaccaguaguaacugcauguuaccuccuuucagcuugauuacauucauuuuuguaacuucacaaggguguuuguguugcuugcuugugccggagguuguauggaaugcaucuuccagcuagacagagccacucggauuccccugggaaucguguacucagcagacccaaaacccgacugcugacaguugcccuccaugagccccucuguggucuuuucugauucagauauggcagcucccgcuuucuccuuguuucuugauucuuauuucccuugaacccuaggcccagccaauuccccaacaaagccuuggcuuuacaaucaaaauacacccaucaucuagucccuuuuuaccacuuggcccucagccuuggucugaccccccucuggggucacuguagcagcuucccagcuggccuucccuucuuaccacguggcccucagcccuggucugacccccuccgggaucacugcagcagcuucccagcugggcuuugcuucuuaccacguggcccucagcccuagucugacccccucugggaucauugcagcagcuucccagcuggccuucccuucucaccacguggcccucagcccuggucugaccccccucugggaucacugcagcagcuucucagcuggccuuccuguuuccgccauugcuuuguguauuuuccaugaaggagcgaacgauuucuuuuaucauaccauuccucgacugaaaacuccaguggcuccaggucggcaccaagccugugaagccucagucugacaucugcugccccuuggaccucucuguuggauaugacucuuccgugggccccugugccccaggcuggacugguguugccauugcuugaacaucugagugagcuuucucuccaaggacuuugcacuuggcaucgcuuugcccaagcuacuguuuacccagagagcugcguggcgcauucucucccuuccuucagaccuuugcucaaugucaccuuaucagaaaggccuugacugucccuuuaauguaaaacagugcuccgggcucuccgucuucccacacugcuuuauuuuucuuuauugcacuuuuccucugguauuauuuuucucuuuauuuucagccccuucccacugaaacguggauuccacagggguaggaaguguggucuguuuuguugaugcuguauccuuggugccuaguucucuaucagagcaguucucagcgaagguagaauggagaacagaggauggugguguggagaaaacuccguguccuacauggaagcuacaagcuuauauccagucgccauaaaaucaaccguauuucauuccagcccagaucuaccagauacugccaccaucacugcgaagcucaguuguuauuuuuugugaaacuacuaguuuauuuaaaacagaagacuccgccacuguggugucaugauaagauguccaguuuguaacucgcaaguccauacucguagaaaggucaaauucccacugaccacaaggauacgcaaccacguccuaggggccgccauuucuuucuucuaggucuuccaucgacagugaacccgccuuggucuuaggcccucugaagucugugcaggagcugcggagggagcagcagcuggcugagaucgaggcccgcaggcaggagagggagaaaaacggcaaugaggaaggugaagaaagaaugaccaagccucccgugcaggagaugguagaugaguuacaaggccccuucucguaugauuucucuuacugggcgcgguaagcucucuugugcguuucccuacaguguccucuguuuuguggggacaggacccgccaaacugaaguauauuaauuauuuuaggucuggagagaaaaucacuguuacaccgucaucuaaagagcugcucuuuuaucccccuucaauggaagccguugucaguggagguaaaugucaacucagcgagcgaaugucacacacaccuuugcaguuguucccuugccugcauuuacaaguagauuugugauguuauagugaagccaucuuuguaagccaccuuacauccucucuggcacacagauguuacuguugguuggauggauggauggauggauggauggauggaugguuggguuggauggauggauggauggauggauggauggauggaugaaugaaugauuuagauaaauaaaaguaacuuuugcuguuagaauugaguugaucuuuuuggaaaaggacuugguuuucuuugacauuaucaggucgacaccagaagguagaugaagcacaaagcugccagugaugaucuuuaaugaucuuucuguuguuuggcagagcaugaugggagggucuuuuuuuggggaauggaugacugaagugaucacuuguggaguauuugucuuuugccacuuauuauuuuuuucccagcacucuggcuucguuaaguuguggguguuaugugguucgcguuuggaagcagaggguguugaagagcgugacuucuagcaggcaggcuguuuggggcggucuuucucaguggguccuccagaggcugagcagcacggccuccugucugcuguaaaguguucccuccugaucuguggccuccugagaaccuaggaagaguaguaguaaaaacccagccuucagcguuuuuugauucucuugcuaaaguccuucacacugagaaaggccuuucagggauggaaagaggcuugggcuguauccgauuauugagcuccccgggguguuaaauaaccgcauuuggaacuagcuucuaagaucuguuuuagccacuuuugucaugggaaacccccaaccaagaagcuccugucucugcuaccaagccccauccuuguguuuauuucuuccccucuuagaaagcugcccagggaagcugaucgagauccacgggaaggcaggccuguuuuuagaaggccagauccaccccgaguuggaaggagucgagauugucaucagugaaaagggggcaaguucaccgcugaucacagucuuuacugaugacaaaggugccuacaggugagcccgggauagagacacauuugccugggaucagcgugggaguccucugaagaaacuggggcccacauuuccuugggcuugguaaggcuuccugcagggugugaacaaagccguugcuagcauucugcucucuccucuucaguguuggcccccugcacagugaccuggaguacacggugaccucacagaaggagggcuauguucugacugcaguggaaggaaccaucggagacuucaaggccuaugcccuggcaggcguaagcuuugagguaacuaacacuguauuuucaaaaggcaguuauacugagguauaauuaacauauaauaaacugcacaaaaaggguacagugugguagucuugaccuaggaauacacccaugaaaacaccuccacaauuaaaauagcacaucuguggcccucaagguuuccuccugccccuugguaaucccucccugccacccuuccgcugagcugaugaucugcuuuucaucaccauugguuaguuugcauuuucgaguuuuuauagguuggugcaaaagugauugugguuuuugccauugagaauaauggcagaaaccgcaaucacuuuugcaccaaccuguauauaaauggaaucaaacaggauauacuguuguuuuuuuuuuuuuuuuggucugacuucuuucacguagcauaauuuggagagcuguugacuuuagcauguuuguguaccuucugggaaguaguuaaagcugucauccauaacuguuccauuuugaaggacacagaauguuuuuacugaggcguuugcugccuagcucccuuccaccgguccuuucugggaagaagcgugcugcgauuguacagagugggucuggagaucguugagaaugaauauuuauaaacuauaggccaaaggaaaagagugacagauuacaucgcauaaaaauuuaaaauucuauauugcugaauacauuuggaaccaaacugaaagauauucaaacucggaagaaauguuuguaucauaaauaauauccccauuuuacaaggagcuccuaaaauugguaagaaaaagacaacccacuagaaaaaaaaugaacaaagauuaugaaaaggaaauucauggaaguaacgcaggugacuaauaaacacagaaacacaaagccucuguaguuacugaggaaaugugcuaaggaaguuacagucgaaacacuguuuugcagggauuagauuugcuguaauuaagacaaucucuauuuuuugguaaguguggguuuucccaagcauaaauaauuuaugggacuguaagugguuacagccacuuuggaaugcaauuagauaguaucuuucugaauuuaaagugcauguauccaacaauucuacuucuaggaauggauuguucaggaaauaaaacuaagugccuagagauacauauuuggggauauuccaauugucucuuguguaccacaagaguaggugcugugguuugucaaacccugccuuagaaugcuaugcaguaguuaagaaacaggcagauuucuauuggcuggcagaagagaaccaggauaaauuguugaggaagagagcaaguugcagaacuguacauauaacaugccauuuuuauuucaccuccuccacccacucaaugaacuugccagucugugaacaauaauauguaauguuuauaaaauuugugugggcauagaaagaguucugggcggggcacgguggcucaugccucuaaucccagcacuuugggaggcccaggcauguggauugcuugagcccaguaguuugagaucagccugggcaacguggcaagacccgucucuauaaaaaauacagaaauguaguugggcaugguggugugcgccuauagucccaucuccucaggagguuaaagcugaaggauugcuugagcuugggaggcgaagguuguagugagcccagguugugccacugcacuccagccugggugacagagcaagacccugucucaaaaaaaaaaaaaaaaaaaguucuagaaggcuacacaccaaacuuacaaaacuuacaacaguaguuaccuguggggaggaagauuagguccccuguccuccuuugaguaacaauaaaagaaaaaaaccuugaaaaaaugaccucuugacuuguggaacuguuauuuucauaguuaguaggaguuuaaccuugcucuggucucaccuucucauccccagauaaaagcugaggaugaccagccccucccgggaguccucuuaucccugagugguggccuguuucguuccaaccucuugacccaggacaacggcauucugacauucucaaaccugguaacguguucugcaauuuaccaccugccugucuucccugagagagagccaggaugcagcaugcgagacuuauguguugcuugacaacgugagaagagaaggccaauguggagugguuucaguuucuugggggcccacggucauuagaguauugcucuuacucgaacuuaaugcugcugauucauguucccuuccacacgcgcuucuuguuuucugaucacccgcuugucacuaagacaguguaauuaauuucccuggccacaacggcugcucucuuaggcgucuucucguuuugccacagaaucauguuuaugaugcugagucuuguuuggugguuagcuugcguuucuucugaaaagacauuccacuuggugggaagagagcagcaguuuuucuuucaagaugcagucggaggcccugacugguggggauucaggaaguguguguuaguuggucaucuugucagucauggugacaaaguggcugugguggggcuacuggagaccgggcagugggggcaucugaagacaccacuuugcagugaugcagacugcuccuuacuugcuguguccuaucaggcaaguuacuuugccucucugagccucaguuucuuuauucauuaaauucaaauaugagccagguaugguggcccacgccuguaaucccaccgcuuugggagggugaggcaguaggaucgcuugagcuugggaguuugagaccagcaacauaggaagaccccaucucuacaaaaaauaaaaaaauuagcugggcaugguggugcaugccuguggucccagguacucaggaggccgaggugggagauuugcuugagcccagaagguugagacuacggugugcugugaucgugcacuccauccugggggacagagucaggcccugucucagaaaaaaaaaaaaaaaagaaaagaaaaauuaaauaugacuucuaccucucugagucauugcaggcaggugauaccaucagcugccguuguuagaguugugauugccacuaccugacugugaguggugauuauagagagaggguuacuauuuuuggcugccagggaagccauggcgcuccccugguguaauucugguccaucgugacauucgccccucacuuuuaagccaugccuagauguggcugcugaggcucagugugauuaucuuggcagagcccuggccaguauuacuucaaacccaugaugaaggaguuccgguuugagccauccucacagaugaucgaggugcaggaaggccagaaccugaagaucaccaucacgggguaccgaaccgcuuacagguaagugcccuggccaccccacucucuuccagggcugggcuggugaaucacauucaggccucuguugccuggaaacgcaucccaggcuucacacugauuuuacuugggagggaagggagaugagauaugagggcaaaggaguuuugacugcugcccuucucuccuaggagcucaaccuggugguucagucucaaauuuccuauuuuggaauuggcuugagagagccuauugaguugcuaaaagcuuuuauuuauuuuuuauuuuuugagacggaguuucauucuucuugcccaggcuggaguacaauggcgcagccuuggcucacugcaaccucugccucccggguuccagcaauucucuuguccuggccucccaaguagcugggacugccaccaugcauggcuaauuuuucuauuuuuaguagagacaagauuucacuuuguuggccagguuggucucggacuccugaucucagaugaucugccugccucggucucccaaaguguugggauuacaggcgugagccacugcgccuggccacuuuuauuuuuuaaaagaguuucaaaccugaauuacaucauuaaaaggagaaaaugugcucaguugaauaaaacuucaaaaugcugaaaagaguauaguguaaaauuuccccucugucucgucuccuagccacccaaguuccucuucugggagacaaccaguacuuccaguuuuucugaaugcucccagcuguagauagauagauacacaugagugucuggcaaggcacaguggcucacaccuauaaucccagcacuuuuggaggcugaagugggaaguucucuugagucuggaaguucaagaccagccuaggcaacauagcaagaccccgucucuacaaaaaaauaaaaauacaaaauaaaaaagauacacaucuauagauagagagaugcauacauauauacauguauacacacagauacacacauauguguauuuuuuguagacuuauacagaaucacuuuagaggaagaguaauuggaaagauuggguuuagaaaaauggaccauuuucuacugaauauauggaaugaaagaggaagugaguuauuuccauguuauugaaagcuccauuauuucaaauaaagccuagaaagaauaaaauaaagcuuuagccuucuuaaauuacaauuuuccagagcaucccucaaaauguaugagaaaagaaauugauggcagcuuaucccuccggcaggaaggugugguuugaaagugggccggccacaccgaguugccugggucauugaggcacaguucuccccugaacuauuuugccccauaauuguugguaaacgggaaacacuuggguccuucagauaaccaugagaauaucucauucgugccuguucuugccauacuaguugcuauggcacagugucuuccuuaaacggagagcccgaacaagggguugccauggaagcggugggccagaacgacugcagcauuuacggagaagacaccgugacagacgaagagggcaaguucagauuacguggauugcuggugagacuuggaauguguuuucuuuggggacuuuuuuuucauccuguguccagaaguaucuugugguggccccaagacugcuaggaguggguugggcgagagggcuggggguggggcucuggagcccucccaguucuuaccuuuaauugguagaguuugccuuuuuucuagccaacaggucagaucaaggaucuguggcacaauggaguuggaaaaccauggguuugguagggcuuuucccuagcaguauguggccauggcuuacgccagggcucaagccaaacgccuauggagccagaagagcaguaugaacgggggagaggaggcugugcgaaaugauagggaguggugagggcuguggagugggcacggccuguggaaagggacagccugucacuugguuccagcuuauuguagccaugggggaagacagagucaggguugccagauccuugaaauuuuaaaaagagaagucagaaauucccacuucccagaaauaauacccaacacaagcauuugggaaugcuuaugguggacauuccagauauccaucaauguguauauacggguagaggggagggguggauggagaggaaaaacaucuuagaagaguaagagcacauaguaugcuuggaauuuugaaauaagaaaccaaauuugauuuauuuugggguaggagaaaaugaaacugaguugggauggaaggagucgcaaaauuucagauguuucaacacuagggguguucuuaaaggaacucuggacucuuaagguuaacaggccacagauuaggaaaugaggggagagaaaugcuccugucuuaaugaucucgugcagccaaaccaggcuuggaccaggcacgauacgacaagcccccuuucuagagaacugacuccugaguuuuuuugcagccgggauguguguaccacguucagcucaaggcagaaggcaacgaccacauugagcgggcgcucccccaccauagggugauugagguaaggcauucagugcugccgcugcaccugggugugggugccucccuaaucagaaguccucccgucuccucuggcugucugccuuucaucuguggcggggggaacuuucauccuaauuaaggguccucuuagaauagugucaucuucacaagcagaaucuuauguggguuuuuagugaacagcguugcugucaugcauccagaaaggaaauuggaacuguuguauccuccccgcgacuugcccuguaagcucugaucauuauucugcaaguuaaggaacuuaaggccuaagcagcauuucaaaucaagggacaauaauagcacaugggcuuaauggguggcagggccacgcaguuaucuuagguucagaugaccuuuuuccugcucccauuuugugggcagagucuuuugauacucaagaucaugaccuagcuaaauuaaucccuaaagaggacauccuucgagucacagaauguggccugggaaucauuugaaguaaggcuuuucucuuacugaguaacucucauugggaagacuagagggcuuagguagggcaagaggggcugccucuuaguggcuuuauuuagguggcuucauuaugcaugaagauugugagggaggauagaacuuuugaccuaggaaguggauuuucuuuuuuuuuucuuuuuuuuuuuuuuugagauggagucucacccugucacgcaggauggagugcagugccgugaucucggcucacugcaaccuccuccuuguggguucaagugauuuucccaccucagccuguagcugggacuacaggcauacaccaucacacccgacuaauuuuuguauuuuuaguagagacgggguuucaccauguuggccagauuggucuugaacuccugaccucaggugaucugcucgcuucggccucccaaagugcugggauuacaggcaugagccaccgcaccgggccggaaguggauuuccuugacgucuuuacgguguuggcauuuuaaauggcugggaugacugcaucucacaccaaaaugcuuugcauguucucgguguaguaacuuaggccaggaucacuagcauaauguggacuguggccgggcagguaugaaagggaagggggccggcccucugggaucucgcaaacuccauguacagaccucacgcagagggggugcugugacucugccccugcucuaacaggcaagagcauccuucuccucuuuuuuuuuaagagaagcuggaaaaucuggcuucauauaugaaauuucuuaauuuuuaacauguuggcaaguaauucaaacguagaaaaaaaauacugugcuuucgaaaugaaaugugucuaugggccagggauaugccccugcucuaacaggcaagagcauccuucuccuuuuuuuuuaagagaagcuggaaaaucuggcuucauauaugaaauuuccuaauuuuuaacauguuggcaaguaauucaaacguagaaaaaaaauacugugcuuucgaaaugaaaugugucuaugggccagggauagccaucuucugucgguuugugaccuuggacguaggguacucaaugacaaacuuagcuuccuuaauguaagaagcaaaguuugccaugaagcagcucucaggccaucggacagcuggcauagaaguuccuccaccagcuuucucauuacuggcauucccucuuucucucucuagguugggaauaaugacaucgaugauguaaacaucauaguuuuccggcagauuaaucaauuugauuuaaguggaaaugugaucacuuccucugaauaccuuccuacguuauggguaaguccagacuuuuaagcuccaaguauuguguucccuuuggcuuugagacaaguacgaaugggauguuuuugguuuugugccugucucgugccuuaggugugacagguggaggugcuccagagugccgccugcugaggguugagguugagauuuaagaaccuuggaccacaacacguauuugggagagugauugccaguugugggagagaaugugguccaguuucagauaacugucugccaucaguuaaucuuccaaagaauuauaguagaagccugaucaaugaucaauacaauauggaaucuaacguggaaagccaauucuaaagaaagcgccuuguaacuuaaaauuuucucuggaguggaggucguauuaaacguucuugcauugguuuaaagaaaugccugaggcuagauaauuuauaacaaaagagguuucauuggcuccucguucuguagguuguacaggaagcauaguggcgucugcuucuggggaggccucaggaggcuuccaaucauggcagaaggugaagugggagcaggcaugucaugugggagaagcuggagcaaaagagagaguuggggcauggugccacacacuuuuaaaugaucagaucucacaagacucauaacgaagacagcaccaagccacgagggauccaccccaaagauccgaucaucucacagcaggcccuaccuccggcacgggggauuacaauucaacaugagauuugggcagggacaaauauccaaacaguaucagaggugguggacggugggcuggagagcagguggucugggcuuucucuugucuccaguagugacucaccuugcugccugggccagucacuucauuuccacaugccucgacuucguccucugcaaaaccuagauuuuggacucagagaccucuuauaaucuuguucagcucuaacaaaaucuccauguuaccauuaaugaagaaauguuuauaaaauacccugcagacccucugcggauguuagugauuugcucuggggguacauuguuaagaugcgcuuguaauuuuauaagcaguuaaguauuuggcaugggugagaaagugugugugcgcuuuaguccacucuguccagggcuugcaggcgugugcuuguagggaccaggcagguaaugucagagagugcagaggguuggguaggguggggggcaaacuggggaacuccugccccauccaugaggggcacaagggaggggaagaggcagagaggaggggagggcgccacucucuugcuccugaguguugcugugcuagaauugaggcucaggguuggugucacuucccaguuuuccggagaagcuggaaauuagaauuauuugaaaucaccugauuuuuaaauauagucggugaauucagauuuacuuaagauguuauagaagaaaaaagaacacauaagggaucuucaaugcgacccauaaccuucagucugugacuuucauuuuaggaaaauuccccugguguguuauguagaaaggugccagugugggcccagggaggugguccuggcauucucuugcggcaggugcacuguggcauccucacagccuuugccaucagccagggcugcaccuuaacccugcucaugccccaucccgugugggagugagaacaggcaacaaccccagaaauaaagccagaaacaaaguacuccagugccuccugaagcagcguggagagccacguacaugauggaaugcguuuugaguuuaacagauugguggaguuaaggugacaucauaugaugaggcagugcaaggcgggaaggacccucaggagucgucaggggguugagucccaggcucuaccauguguaaguugugugaccuuaggugacuuuggcucucugggucuccauagggauaauaacaauaccuguuuuguagucaggauuggcgauaauguagauaaaauaucuggcgccugccuggcauauuacagauguucaacacguguuagaagcuauuuuuaauauuacuauuauauuaacuuauauuacuauuuugagcaagaacauggguagucagaaucugauuugaaucuuaauuucugugcaugauacauaacuggauggagucucagaugacagagggaugugugaugucuauggagggagcuuucuuuuucaaauauccauguuuccaaagacaccuacccagagagcggcuguccugaggaugucugcuaugaaauauugauuguguuucaguuucaaagcaugucugacuuuguuucucccuccaggucaagcuuuacaaaagcgaaaaccucgacaauccaauccagacaguuucccuuggccagucccuguucuuccauuuccccccacugcucagagauggcgagguaaugccuguggccggauucuaccuucugccuuuguuuuaauaauucugcuguuuaguuuaaggaagcacaguucucuccuuuucucccuaaauaccacucugcagaaaugcgcucucugaaucaaaagagguuggguucuguagggauuauuuuuucuucauuguuuuucuguuuacaaaaagaauacauauucauggcaggagauuuugggaaaaagaagacauaagcccaucauccagaaauagccacugcuaacauggugauugguauccuuugggucuuuuuucaggcacgugugcgcaugcauguauaaauauaaauagacauuuauuuuaauaauucaaaacugacacuguuuuguacauuguuuuguaauccaugcuuuucaaugaagaauuuaucacaaaucuguuccucaucaucaaaucuuucuuuuuuuuuuuuuuuugagacggagucucgccuugucgcccaggcuggagugcaguggcgcaaucugggcucacugcaagcuccgccuccuggguucacaccauucuccugccucagccuccgaaguagcugggacuacaggcgugcgccaccacacccggcuaauuuuuuuuuuuguguauuuuuaguagagacgggguuucaccauguuagccaggauggucuugaucuccugaccucgugauccaccugccucggccucccaaagugcugagauuacaggcgugagcccccgugccuggccaaaucuuucauacuaugauuuuuauggacaguaguccauaaacuaggaaacgcgaugauuuauuuaaccaaggccuacuguugggcaugaucgacucuugcacuuugaacauaucaccccaugcuuuccugcuaagaaguccacuuuuaaaaaugccuuguaauuuuuaaaaauuccucuauuuuaacauucugcuauugaguuuagggaaauacaguuuccucaugaugggggaucccuugaaugagaugaguugcuuuucucuugcugcuuugaacguucucucugucuuugauaaucugauuauaacgugugucguguagaacacuugcagcuccaccuuuucaguguccuuuggguuccaugaaucuggaugucucccuccuuggaacugggaaguuuucagccauuauucuggccgucauuuacugauuauaaagugcuuauuaucaauucuauuuggacagagcuaacuuguaguugguguggggagugcaaacuuugcaaagaauuugguucuuuucugguggucuuagccugaggaugucaagugugagccuagagggugacguuuccucuccuggcuccuuaccaccugccgugaagaugaucuacucuggccuuucucuguggaaaauggcugcgaaauaaugaaacaggcugucacggaauuuucuccuccucuuucuccagggguguugaaauagucacuuccuacagcgaugcggaaacaucuugggcuuuggggucacacuuccccugaguucagagccuucauagauguguggcagccuucuuagcugagugaccuugggcaaguuacucuuagucucuucgugcuugacuuuccucgucuauaagacggggugaugaucccgaccuugccagugguagaaagcaaagcagccgcgggccucaugcaaugugcauggugccuggcagcuggucggugcucagcacacagagcugugacgggccucaugcaaugugcauggugccuggcagcuggucggugcucagcacacagagcuguggcugccccuggugccguuccagggaugcuguauuuuuaggauuugccagcuuacgagccucucaagcaucgucccuuagaagucagccccguuguggauccucaguuguaucacguaccucccucaucagaauuggcucauaauaauuuuuuguguuucauaaagucagauccucagaggaccguaauugucaagguuggguacucauaaaaaggcugcaggcucugacagccuuaucagaagccacagucucagagacacuggggacacaugcccgccacugauggaauagcccgcugagguugauacuuugaaggcagcaaccuugguuuggauguguagucuuggggauuucuuuaaaaacauaaaguucuuuacaucacagccauacguuagguuuuaguuuucauuugcuuugccagagcuguccuuauaaaaauaacuucuucccaugugugcacagaacuauguugugcuucuggacuccacacuccccagaucccaguaugacuacaucuugccucaaguuucuuucaccgcagugggcuaccauaaacacaucaccuugauuuuuaaucccacgguaaguaaaagagggaguuaaaaaaaaauccaugggcuggguuugguggcucacgccuguaaucccagcacuuugggaggccaaggcugguggaucucuugagcccgggaguuucagaccagccuaggcaauacgguaaaaccccaacucuacaaaaaauacaaaaauuaaccgggcgugguggaacgcaccuauagucccggcuacucaggaggcugaggugggaggaucacuugagccugggagguugaggccucgaugagccaugaucaugccccugcacuccagcuuggguaacagagugagacccuuucuccagaagaaacaaaacaaaacaaaacaaaacaaaacaaaacaauccaugggguggcgaaagaaggcauguccauacaaccugugcuccaggucgcagguugcagggcagauauuuaaagggcuccuggcauugggucacuuucucauucugccuucuggauucugggcuuccccagauuguuuuuagcuuuucugagcacugaugccugcgauucccuuugaggaggaaacugguaauaagagcaguguaauuguuuagaucgguggcucaggaaugauuuugggggaggagggacaccacuaucgcugguguggcgugugcuucuccaugagggagcacaugguacauggccacgcaaaccccuagaaccaacugcuacuuuacaggaaauagggaggacccaggagcacgcaaaugacuccacagggaugcaggacaaccaccuggagccugauuuguuugacaaauaaauugcaaggaaaaaaaaaccaacaacagauggacagaauaccuguggguuaaaagaaacuuaacuuaucgcuuaauucauugcaauauguggcccuuacuauuugcaauauguguaucuguugcauacggucuguccuguauccgauaggcuggaacaguggaacaaacaaaacauacacguaucuuuuaccuucuugauaaaauuguuuagugauuccuaaagcucagaugcaguauugucaccugaugauuaaacagacacaucagcaauagcaaaaacagaguccagggcucagccucaggacugcugauucugaacuugacggggugaaaguguagcacaggagucugcauuaaaaacaaaaaucuggccucauagcuacuguguugguuguugcuucuaggccuuuucagugggcagaauaagaacuuuauuguuuucaaaagauguaacuguaaguggaacaauauccuccgauccuccuuuuuccuuuuuugauaacgacacagcauuccucuguguggauauaccgugugucuuaggccauuugggcugcuauuuuguaucuuagacuggguaacuuauaaacaacaaacauuuauuucuuacaguacuagaggcugggaaguccaagaucaaggcauuggcagauuuggggucuggcgaggacuugcugucugcuucauagauggugccaccuagcuguguccccacaaggcggaaaggggcaaacaaguucccucaggccacucuuacggggcauuaaucccugacuuaaucaccuccuaaaaaggguguccucuugacacuaucacauuauggauuaggguucaaccuaugaauuacguaggcacagacacauucagauccuggcacuacauguaggauauucaguuagccccugguugaggggcguuuguguuguuacugguuuucugcuauuacacauaacccuuuaaugaauugccuuacgcaugcauguuuuugaguguucgucagucucucuuuggaauagacucccagaaguggaauugcugagucaaaggguaaaugcauacggaauuuugauugauacggccacuucccauccauggggguuuuacuguuuuauauucccgccagcagugaaugaguacccuuuuuuccccaacagaguauuuugucaaauuuuucaauuuuugcaggcuuauagaugagaagugauauuaucucacuguacuucuaauugcauuucucucuuuucaugugguuaagagccauuuguauuuucugugaacuauuuaaccuauuuuucuauagaauuuuuggucuuuuucaaccauuuucagcucuuuguauacuaggaauauuaacccuuuguaauguuuguuguacauauuuuucccaauuugucauuuaucuuuucacuugguuucugcaaagauuuacuuuauuucuguguuaaauguguugauuuuuucuuauugcuucuggauuuuagagucauaggaagguuuucuucauucccagcuuuuacaggaauuuaucguguuuuuuucaggcagacuuuuauaguuucuguuuuuacauuuaaaucucucuauccauuuggaguuuuuccugguauagaugugaaguauggcuccagauugucuuuuuccacaugcuauccaguuaccauuucaugcuuuucaaacgccauccugcauggaagguggacaggaauuaccuuucauuuagagaugagaagaugggaaccuagaaggagaugugagcagcccaaggucaccagcucacguggagcagugcuagggcuugagcagagcucugcugcugauucugggcuucugugaagagugauucaugcucagugagccuguaaauaugaucuuaccugaacaagagaguuuuucucaugacccacgaggaaacacuuccuuguuacucacaguagagaccugguuagaaagugcuggagagggcuaggugugguggcucacgccuguaaucccagcauuuuaggaggcugaggugggcagaucauuugaggucaggaguucgagaccagccugggcaauguggugaaagugaaaccccaucucugcuaacaauacaaacauuagccaggcgugguagcacgcaccuguaaucccagcuacucgagaggcuguggcaggagaauugugaaccugggaugcagaguuuguagugagcuaagauagccccagugcacuccagccugggcgacagagcaagacugucucaaaaaaaaaaaaaaaaaagaaagugccagaaagauaagcauauacaagaaccacuuaccuuugcuuggggcugcauuguggcccaguugcugggagaggcuucugugaaggccguugauagcugcaggcagugacauucucaggggccccuagcagacaacucauccgggcucagggacacaccugggagccaguggcaggaauguggagacacugcuuggugguggccgagcagcccagccucguagcugcugccugucacuucugagaauguaagaaacugugcccuggugugugauguuccccuuccuguauaccuauguaacuaaccugcacauugugcacauauauccuaaaacuuaaaguauaauuaaaaaaaaaaaaaaaagcugugccugcuggggcuuggauucccgagcagggccaaguguugaaugaagagagcgcccacucugugccaccccguacagggcccucacagguugauccucacaacaagccuucaagcaggugugccauuccucccauuuucacagaagcccagaaagauugagucacuuacugaguguuagcagaaccaggacucaagugaggcaguuugucucaagccacaugguuuccaccucguucugcccuccgcgugaugaguggcucagcauugcauguucacgggggcuuuguaagcacauugguuuccuucuuuguugaugugacugcccacagccucgcgacuggauuuuacucaguauuccaugcccugcugagcauuucacauacuccuuucaucaaguuucacagcauccacccccaguggguguuguucauaugaucuccaugucauaguugaguaaacugagucucaacgugguugccugaguuuacccagugaggccugggaccugagccuagacugaaucacucuuaauuccugcugaauuaaacuuuuauuuauuuauucauuauuauuuuuuucugagacagagucuugcuuuguugccccugcuggagugcaguggcacgaucuuggcccacugcaaccucugccucccggguucaagugauucucaccuccugaguagcuggaauuacaggcaugcaccaccacuucuggcuaauuuuguauuuuuauagagacgggguuucaccaugcuggccaggcuguucucaaacuccugaccucaggugaucugcccaccucagccucccaaagugcugggauuacaggcgugagccacugcaccuggccugaauuaaacuuuuaaguaaguguuuacuucaguggaaaaauggguuggguucuaagagauguccagagauacaggaguaggcaguuguugauggaaaucuguuccugcccuuauucuuucauuuaugaaagggcaucccagguacagcggcccccacagucacucucuagcccagcaguucucggauggguugguugcaggaccccuuuauacuguuaaaaauuauugaggauuuuaaagaguuugaguuugcauggauuaucucuguguauauuuaucauauuaguaauuaaaaccgagauguugaaaacgcaagaacucacaagcuacacauuccguuagcugugggcgugaugacaucagggugcguagucucuggaaaaguccacugugugcuugcgaaugaaagagggcggaaaaggcacaucacaucuuacuauuggcugaaaauagcuguggccucgggaaccucugcgagaggagucccgguauccuacacugagaacacugcucuggcucauuaacuuguuuuuaucauuauugggaaguucuccuuccauuuauuugcuuccuuuaugagaguagagugggccaaugggauauagguucacuugaugcuuuagaacccagcauuucaggggcuuuagcaagauggaaaugucugucucaugucaaguguccaggagugaccagugcagagauagucugguagcuccaaggcgucaggggacccaggccccuucugucucauugugcuguuccagugcauugcuuuucuccaaaauggggcaauuggccaaaugcugucuacccagcaaaagggagggcacaccacuucccuaggguccagccaggguguggcacuuaccgcuucuguuccuguaccauuggccaaaauuuaguuccagggcugcgccugcugcagggaaggcuggaaaaggugaucuauauugucgguggcccagauaaaaguuggggguucuauugggagaaagggagaauggccacagggaugcuaguagcagugccugcuuugcuuccucacuagaccguacuggcugggaauagcugcccaucacugugugcccugggucuagaacuguagguucuugauacauccuuguaggacuaagucccugcauguugcugggacucaacaaacugagacccaguugcuuuucaaccaccaagacucucugauagcugcaucucuucauuuccucaguugggaggaggguccagaggcugaggaaugccuugucauuggaaucucuuugucccugaguuucagaagcaaauagugaagcuuugggcagaagaggauucaugggaaaauacauccaaaucacuuugguuccuuccuuuggauagaaggaauuuggaucaugagggccccuggguguccucaaguggccacuuuggaaggcugggugggugguggcuguggcauuguggaugauggacaagcuuguggccuuggugaggagugauggggcucucgguguuugcagaggaagcugccugaacaggacaucgcacaaggauccuacauugcccugccauugacgcugcugguucugcuggccgguuacaaccaugacaagguaggaaauccagaggccucaggagauggcgggcaugucagggagagcgaguccucacagcugcaggagugauagcagagggauguccagggucacagaaaucacauuuccgggucgggagggcccgugaaggccucaaguccagacuuaggucuccuuucaaggcuguaaacuucuguaacaucuccuaauccuuaaaccuggaacaccucuagggacauauuaggcccggagagaggccagcccaucccuggggacucauuaguaagaggccugccucguuugaacugaaacccacccauuagcacguggcagcugcugaucaugucugaagaagguguguugagaagugaggcuccgcuguucaucuggcaaaagccuccucuuuguaccccucucucucacacuuucucucuuuucuagcucauuccuuugcugcugcaguugacaagccggcuacagggagucggcgcgcucggccaggcagccucugacaauagcggcccagaagaugcaaagagacaagccaagaaacagaagacaaggcggacgugaggaggaaggggacaguugcagucucacuugggacaggccacagccagggguccggccacuacccgcccgugggauaaaagccaaaagcaugcgucagcuaacuucagccugugcugcugggcccgcaccccaugucccuugucacuguggcauccugcacccauccucaccccuccguagagccccucgugcaaugcaaugaauggacccuccugucacucugcugaacagaauuuauuuucugagucaaauauaauuuauuauuauuuuugucaaagaaguauuuaagcugugcuguggugugagaaugucauucuugaucuucagccuucguuugcaagaagaguuccaguugaugugguguuugguuccauggcgggguacccuagggauucaucuguuuucuucacuucccuuugcaucugagauccugcuggaaaccacggcaaccuguauccacuauuaggagguaaaaaucaauaaaauggcccauucauuuguguuguagcuca

SEQ ID NO: 191775 - RNA, 13830 nt, Homo sapiens
cccugccuuaagauuguuuuuaauuguuaccagcuuccagaggacaagaucucaaaaaucuguguucccuauagugacacacuaucauugccuauauucaguuggcaaauaaauuuuacauuuacauauagaauguuacuuuccaauuaugauuagcauuauuaucaaauauauaauacuuugggacuuacaauggaagugguaccaauacaacucaguugacuauuacauccucugcuauuagucaauaauaucccuguuagaaaaaaucguugcaggguugcccaagaauagccuaauauuuccaaauuaauauaauaacuagcagcuuuaugacuuuauaucuuaauauaaugaauuaaccaaaguagucacuguucaagguuuauuggggguuuuaguugguauaacacuuggauaguugguugcauuguuuguauguagaucuuuuuacauuauaugguaauguacacuacugauauaguucacaaaauaagauccuuuggaagaauuaugcacaagacaugauauuggauuuauacacuggaucccaggaugugacucacugggaaaaaauguuggacuaggcauguucagugaaggagccaggaaguuauauaacacacgguaaacauccaccuggcucaaggggcaaaugcaguacguacagcauuggcaguggugcgucagagguggcagaacuauuucacacuaaccaguugaagacuacacaagauuaauaccauccagcaucaggauauagcuguggauuuuacaaaccauucuuauuucuaacuucaggaguugauguuuuucccaguccaucuuaaaauauuacugcuuuaaucacagaucagauaaaaaggacaacaugcacaaccuccaccuagaauccuguuguagccuagacagugaaaugauaugacaucagaagacuuuaaaauugcagcuccuuuuggaucccccaaaguguaucugcacucuucuucaaacgggccucuuccucagaagucagagucaccuucacaaggucugagauuccauucugucccaaaaugcaaggaacacuaaggaagacaucauccuuuauuccguaaagacccugaagaugaaaugaaaaaaaaaaaaucucacauuuugucuaugcauucccagguuucccaagacuuacagucucuauaauuauaaagcuuuuuuuuuuuaauuuuuuuuugaggcagagucucgcucugucgcccaggcuggagugcaguggcacgaucucagcucaccgcaaccuccaccuccaggguucaaguaauucuccugcuucagccuucugggacuacaggcgugcgccaccacacuuggcuaauuuuuguauguuuaguacagaugggguuucaccauguuggccagguuggucucaaauucuugaccucaggugauccaccucuuggccucccaaagugcugggguuacaagcaugagccacagagcccagccgcuuuuuuuuuucuuuugagauggaguuucacucuuguugcccaggcuggagugcaauggugcgaucucagcucacugcaaccuccaccuccuggguucaagugauucuucugccucagucucccaaguagcugggauuacaggcgccugccaccacaccuggcuaauucuguauuuuuaguagagacaggguuucaccauguuggucaggcuggucuugaacuacugaccucaggugauccaccccuuggccucccaaagugcugggauuacaggcaucagcugcccgcacauggccuuuuuuuuuuuuuuuuuuuuuaacagaggcaagaucucacuauacugccuaggguggucucaaacaccugggcucaagcaauucuccugcccuuggccuuccaaagugcuggcauuacagcugucagucacuguguguggccuaauuaugaagauuuuaaaauacaacuugaggccaggugcgguggcucacaccugcaaucccagcauucggggaggccgaggcggguggaucacaaggucaggaguucgagaccagccuagccaauauggugaaacuccaucucuacuaaaaauacaaaaaguagccgggcgugguggcacgcaccuguagucccagcuacuuaggaggcugaggcagaagaaucgcuuaaaccugggaggcagagguugcggugagccgagaucggccacugcacugcagccugggugacagagggagacugucucaaaaaaauaaaaaacuuugauaaguagaaauuccuuuccagguguucaguuaugauuuaauuaauaguauaaaagaaagucauuaaaaauaguaacauaaugcuaacuugaauauaauuucuauuuuccccaauggagaaauaguuuauuucuuuuauagucuuccaccuaccucagcauaauugaacaagacuuuuuuguagucaaauuaucaaguaucuauguguugaacaggccuaauggacauuaauccuaaagcucaaccauuucuuucaaaaaagguaagcuguggguacauuaauuuauuucacuuaagucaguaauggaagacuuguauuaaucuuucucagaagaaucuuuuuuaaaaagccagcaaaaagcauucaaaugcagcguaucacuacauagaccuaccuuaaucaugguggaaacugggugcacccgccuaagauucuucauuauacucucugccaaaucugcuacagagaguccaauagcccaggauguguagccuuugaguuugaucaccucauaagcacuguaugauaggaaaccauagguaaaggcagaaaaagcagggugggagaaagaaagaaaaacaaaguuuucauuaauacacauuuuacaguaaauaaugccacaauguugcauuauaccaagaauaacccuugcacacauguaugcuaggauauuauguacagggauauucauuaacaguacuguuaguaacagcaaaaacaugacaaucuuuccaauguccuccaacagaagaauggauaaaucaugguauacugauacaauggaauauuacacagcuaucaaaaaauaaacuauagcuacuuguaaaaaaaauuggauaauucuuaaaaauauaauauugaauuuuaaaaagaaauccaagauaacauagcauccuuaacucaggauuaucucaagugggagcgugagggggacagagggauagcugggggaaagagcacagaauccacuuauuuccaaacaccagcagaauacuaaauucugauucaacaauguuauuugacagauauuguguuucuuucuugagcugggugguggguucacagguuuuauuuaauuaaacaaauacaaacaagagggccuugcuugaccaaucacaagaauauguuaugaacuaaagauuaugauucuuuuuuuuuugagacggagucucgcucugucgcccaggcuggagugcaguggcgcgaucucggcucacugcaagcuccaacuaccggguucaugccauucuccugccucagccucccgaguagcugggacuacaggcgccugccaccacgcccggcuaauuuuuuguauuuuuaguagagacgggguuucaccguguuagccaggauggucuccaucuccugaccucgugaucugccugccucggccucccaaagugcugggauuacaggcaugagccaccaugcccggcuaugauucauuuuuuaauucuauagaccugagguccacacaggaccacaaagguaaauaaugccaccaaguugaaagcuucccuauuucaauaauuuuuuuuuuccuuugagacaggcucuuacucugucacccaggcuagcaggcucuggagugcaguggcaggaucucgcuucacugcagccuugaccucccaggcucaugcgauccuccugccucagccucucaaguagcuaggaccacaggugcucaccaccaugccuggcuaauuuguguauuuauuguagagacaggguuuugcccuguugcccaggcuggccuugaacuccugagcucaagugauccuagggccugggccuugcaaggugaggcacauucuuuuuuuuuuggcuaacauggugaaaccccaucucuacuaaaaauacaaaaaauuagccgggcgucauggcauaugccuguagucccagguacccaggaggcugaggcaggagaaucgccugaacccgggaggcagagguugcagugagccaagauugcgccacugcacugcagccugugcgaaagggcaagauucugucucaaacaaaacaaaacaaaaaaaccacacaaguuuucuaacaaaaaguucucaaaugcaaauacuauuacaauuuuaaccuuuuaaauaaaaauaguaaauguuaauauucuguguugccaaauugaaagauuuauuaccucucaaccaccugcuugugaaccucuuuccacuguuccuuaucuuuaucagucccuaaaucugggugcagagucuucagagagacaccagcaacauucauuccacuccauacaggcacuaaaagaaauaguacagacuacauuuauuuucauguaccaacagauuaguaauugugauucauuuuccuaauucucuuaucuucggaggaagaauacucaauuuugguagauggucaagacuacuaauguagucauuacucacuuuuagauuagauuuucauuuacuuacauuauguaaaacuaagaauuuuaacuguauucuaaccuguuucucuagccaauugaaauguuuaacccauguauauuugaaauauaaagauaguaugagaacauaagggggguuuucuuagcauacagaaccuaaucauaacauuuuucaacugugauaauauaacuuuugugcauuuggauuugcucaucuuuucagggccaggcaguacaagucagguauaaacagcugugauauuaaaugacugaagacauccuaagaacuacagucuuaagauauccaugguaagaagagaaauuucauuucccgucccccucgccauaaaaugccauauaaaauggcaacaaucuuaacaauucuuaacauauaauuauacaaaaugcuagauuucgggaaaccauuccauccuacugaauggauauuugauuaggcucuaauugaauaauauaaugcccaucgacuuuuuauauaaucuuuucaaaaacaaaaagaaaauaacuuaugcuuaccacuggaaucuccauguuccccaaggacccacccaugacagcuuaaugggugaacucccagccuuucccccauuagguaacggaaucgggcugaauccagauugcaaccgcuuccaauaacacgguuuuugggaaaaccacuuaucuuccaagccacguaggucaagauauccacuaugaaaaaggagaaaauaaaaaucacccauuauccucucccuacacacaaaaaagauauaccuacuaugaagaaaacacuuaaccagauacuaggugaucauuagauaauaauaggcuacuccagauauauggcuuuucaggaucuugauauugaucauggcuaaccaauaauuuuguuaauauuuuuaagccucuacacuauguauaucaaguccauuaauuauucaaaaaguaguuuuggcugggcaugacaacucacaccuguuaucccaacacuuugggaggcugaggugggaggacugccugaggccagcaguucaagaccagccugggcaacauagcaaaaccccaucucuacaaaaaaacuuuuaacaaacuagccaggcauauuggugcacgccuguaguccuagcuacuuaagaggcugaggaagaaggaucaccugagccuaguaggucaaagcugccaugaucaucccauugcccuccagcuugggcgacagagugagacaugcucucaaaaaaaaaguauaguaacaguuuuaugaaaauaaacuguuuaucaacuaagagacaauuaugggcccgggcacgguggcucacgccuguaauccuaauacuuugggaggcugaggcagauggaucaccugagcucaggaauuugagaccagccugggcaacauggugaaaccccuuucuacuaaaacuucaaaaauuagccgagcaugguggcacgugccuguaaucccagcucuugggaggcugaggcaggagaauugcuugaacccaggaggcagagguugcagugagccaagaucgaaccacugcacuccagccugagcuacaaagugagacugucucaaaaaaaaaaaaaaaaaaaaagagaauaacaauuauucacaaacuuaucccuuauccaagaucuugggcagguaauuuuaagcuccaacuacauuuaaaggcauuguauucccuuuaauguuuuaaaauuauuaaaaaacaaaaaacacacacacacaaaucuccuuagaagggaaaugaaacaugaaaaauaaaugaaucaccaggcacgguggcucacgccuguaaucccagcacuuugggaggccaaggcgggcagaucacgaggucaggagaucgagaccauccuggcuaaccugaugaaaccccgucucuacuaaaaauacaaaaaauuagccaggcgucguggugggcaccuguagucccagcuacucgggaggcugaggcaggagaauggcaugaacccgggaggcggagcuugcagugagccaagaucaagccacuguacuccagccagggugacagagcaagacuccgucucaaaaaaaaaaaaaaaaaaaaaagaaaaauaaaugaaucaauaaauaugcguggcugggcacgguggcucacgccuguaauccuagcacuuugggaggcagauggacugcuugaggccaggaguucaaaaccagccuggccaacauggugaaacccugucucuacuaaaaauauaaaaaauuagccaugugugguggcaggcgcuuauaaucccagcuacuugagaggcugaggcaaaagaaucgcuugaacccaugaggcagagguugcagugagcccagauugcgccacugcacuccaaccugggcgacaagagcaaaacuccgccucaaaauauauauauauauuuuaaaauaauauucgaaaauauuuuuaaaaauguauuuuuuaaaauauuucaaaauauuuaaaauauauauaauauauauaucauauacuaucaguuuuacuauagcuugucaauuuuuaugcagucaaaagccucaccuggauuugaaacaauaagcaacuugcaguucgggcuguauuuuacaacauuaggaaugaugaauuuaaagauguucacguuacgcuggaccaaauuaagacggcuuucucccucuugcugacgugccccagccgugauaaugaccagcuuggaguuugcaguuacauuauagucuagagaaaaggggaauaaugaccagauuaaggccuuuagaauaaauuuuaccuaggcagcaaaaauuuguuccauaaaugcuccacaaaccuuucuuguucuuagaguuuuaucauuauggcuucuuaaauggaggaagagcaugucaacaucuuccuuguaguuuuagucaaguuguaacuuuauguaacuacaauuagggagagcuggaggaaaucaaguuuauuauuugauucuccuauuaauuucuuacauauccucaaauuuuugauccccaagcucaacguucacacucuuccauacuccuguuucuacuuaacugguguccuaucagcccaggaacaggcaauuucguguguguguguguguguguguguguguguguguguguguguguguguguguggugguggugguagggggacuuguuuuuaagcagagacagcuuuacacuuaacaaacauauuuugcuucuagauacccuauggcacaagagaguuaaaccagugaugaagggaguugcccaucagcaagguggccagugauuuucagguaucaaaauagacacuauuugggcucacauucagguuucuuggcuggugcuguuaagugugaaagggucaagccaagaguauuagcugaacaggcucauuuauuuacccuauucucaacuucgugugugaaaggaugugggggcaaguaaguaacacaaugugguuaaauacagaccuaagguuuaagcuuuacucauuacauucuaauucagaugguuugcauagcauggacaaauuggauuucuauuuuaaaccauuugccagaaauugaaacuuugauauucacaggcaccuaagugaaauuguucccaggcucuugcacccggcauuuaaaacaaaaucuuuaaagagcuaggauuucaagccugauaaaacauuuaagucuaaagccgggcacagugguucacaccugcaaucccaguacuucggaaggcuaaggagggaggaucacuugagcccagugguucaagacaggccugggcaacacaguggguccccaucucuacaaaaaguaaaaaaauuagccgggcaugguagcauacccuauagucccaguuucuuugugagggggaggggguaaugaaguggaaggaggauugcuugagcccaggguucgaggcuguggugagccauaauugugcaacugcacucuacccuaagcaacaaauggagaccaucuggaaaaagaauuuaagucaagcauggauuauaauauaaacuuguugaaaucaaccuuugccagagacaaucuuugguguucuaaggaaaaggcugccauguuggagauccaucaucucucccuucaauuugucuucgaugacaucaacaagagcaaguucaucugccaaguccuaaaagacaucaaaucuuuaguuaaauggaaaauugccacuucuagauuuuuagaagagcaugaaaaauuucuauauuucuggcauaggagaguucuguuacuuuauuaguacaguaucgagauauucaaaguagagggcaccccauuucaaaagcugacuuacagauuacacccuacauagauagcacugacccucucuccagcccugucuccccacugaagcgagcucuauaggaguuccaccacugcagauguggaagcagaacacuggacuggcaguugcuagaauaacuuccaauuauauaaaacugcucugucuacucucucaaauuccauccuacacaccaauuuuagguuguuauucauuuaacuaggugauauugaccagcaucaagacuugaaauuaguaagaaauguucuggccgggcauagugacucacaucuguaaucccaacacuuugggaggccgaggcgggcacaucacuugaggucaggaguucaagacagccuggccaggccaggcacgguggcucacgcuuguaaucccagcacuuugggaggccaagguaggcggaucacgaggucaggagaucgagaccauccuggcuaacauggugaaaccccgucucuacuaaaaaauacaaacauuuagccaggcgugguggugggugccuguagucccagcuacuugggaggcugagacaggagaaugguaugaacccgggaggcagagcuagcagugagcggaguucacgccacugcacucuagccugggcgacacggcgagacuccuucucagaaaaaaaaaaaaaaaaaaaaaaaaaagaccagccuggccaauauggugaaggccugucucuacuaaaaauacaaaaaucagccaggcguggcggugggugccuguagucccagcuacucgggaggcugaggcaggagaaucacuugaacccaggaggucaagugagccaagaucgugccacugcacuccagccagggcaacaaagcgagauuccgucucaaaaaaaaaaaacuuaaaaaguuaaaaagucugauuuccgcccaucuuucagagauggaaucugaacuauucccugguugauuccauauaugaaccaauacuaacaguuauggauaaauagguuugugcaguguauaauacuggcaaaaaauauccuuauaguugcaacucaaaguucauagguccauuucaggccaggagcaccaauaacagcuuuaauacaacuggauguggucuaucguuaccaaaaguuauucaagcugcagaucuaucccuaaaucauccacaauauaaugagugucaguuacucuucuuacccacaccugagccagaggccaucacagagaaaaaacauaggcgguuuguagguguggggaaaacagcaucaauuucucaucuaguggguaaggaauaaaaguugguguauuauguggccuuuccuaagaacauauguagagucaccuguguuguuacgaggccuuuucauagcucauuucugucuuuagucccuucucacuugaauccauuucuauuuagaacccagaauucaucauuuuacuuuuauuagacacuccacaucuuaacuucagauuuuuuuuuuugagauggagucucacugucgcccaggcuggaguggaguggugcuaucucgggucacugccaccuccaccuccuggguucaagcaauucuccugccucagccucccaaguagcugggacuauaggcguaugccaccacgcccggcuaauuuuuuguauuucuaguaaagaugggguuucaucguguuagccaggauggucuccaucuccugaccucgugauccacccaccucagccuccuaaagugcuggcauuacaagcaugagccacugugccccgccucagacauuuuaauguuguaagcugccucaauuucuuuuaaauauaaaucagcuuucaauaguguaauaaggagugcuuuacucacaauuucuuuuuucuaauuaaauuuuagcuccauaauugauaacaaaauugcuauccaaggcacaggggcaaugagauuugagugggagaacuuaugauuucccauauaauuuuaccaauaaaugacaauuuuugaauugucauuuucaauucaaaaaucacuuuaaaagaauuuuggcucauuuaaaaucauggacccuuccuuuucauugguagucaauccaugcauguuaauacagaauaaugaauuuuaggaacugggucuccagccugacaaccuuugauucuuuuuaauuucagauacacuuuugguguauuaucauauuucaaaaguuuguuucacagaaaguuauccgaaugagugcauaaaucuaaauacuguuacaugaaauguaauaauacaguucuagggguaggaguggggguagaggauggggucaagguaugggcuuccagugugguagacucucacuuaccuucauuaagauacugauggcacaggccaugccaacagcaccaaccccaacaacuguaaucuuauucuggggggucuguucuuccuuuagaagauuauaaaucagcugauccuuuagaguugccauauuggacuuggaaccaaaaggaaucuauaggaggaaaaacauuuagugucacuacagcuucuuuaauguuuauuaaccaagagauuuuuuuaagcuauuuuacuuccuuuggggguauuugccacuauaaaucacuagagaugacuaaaaagggaggggaaaaaaccuaaugguugccaaaagagaguugaaaggccuaaugacagggucugugaagagugaaggcccauaccuuagcguggaaaaggaauaucgacguuuggguguaaguauagccuccugaggguucacccaucgcgguuuauuaaccccaaguggggcuggccuuuccucagacaagaucacucugagcuacuccggcuccuacagcaaggacacagccaggcuucucaaguaaacaccagagauacgugcagaaaagccauuaacugccacaaagcucaagcccaaggcacaggagccugcggugauccgcgcgcaugcgcgcuuuguggcucuccuucccgcucggaaaggugggcggaaaucagacuaauugcuggguccuccgaacgcccggcuuuuacgccccgcccaaguccggaagaugggcgggcccaggaacuugugcgcgugcgcaugcgcauuacagcgcgcagggcgaagccgauuagucuagcggccuccggccguugggaagcgggcaucgggccagaaggcagaaggcugagaagccccgcccguaagcagaggcaaucuggagcuaugcagcucagugggugagagggagggagcugggauucagacuucagaccuaaugaaugccccgaagcagacgccagcaacgugaagccuagcuggcagccucccaggucuggcgcgcagccagcgccagacuuuaaaucgcaauacuagaaaccagggccuguuaaccaaccgggagggaggcgcacgguguggcuucggccgugauccuuguugcaaaggccugucaggcccaguaugaagaaauaguuucaguacagggaguguagaaauagcugcagaaggccugaggccugcagcccuagaguuaauagcuacuugguggaacccucgaauucuuuccaccuuguuaauccaacccugcacugcauucgcuggaggaaauaucacaggcugcauccccaaaguaucacgucuaguuuugacaccacuccaaagggcaaaaauccgagaggaccucuaggcaggcagucagcccagagucaccaagcuggagccgggucucuccuuacaaaucacugcuauuucuagacagccuuguaagguuucuagccuggcagggggaagggaguuccugcggacaccugcuagcuucacugaacggccccgggauccaaugcuaccuuuaauguaggggcggaggugggagggcaugggaugagggaagggugcgucuagaggcgagagacaugcaaaaacgaguucuacaccucaccucugccuccuacucacugggaacuuagagaucccugacugucuccuagcuuucggucucccuauuuguuaaaaggaggaguugguaccggcggauccuacucaacugaccgucugaggugcggaagggcugggaugcugccugcuucaucuuugcaugcgccgugccuagcgcagcccgagauacaccaguagcuucuuaauaaaugcgcaaagggcucccuauaaucugcaggcagcagcugcccucacggagcccaccucucgagcgucccaagagaaaaaugcaagccgcgugguacucagccgcuuuccgucuuucaagaacccgccccggacaagcugaggcuuuuuuggcucuaugggcuccgagaacuggaccucgaguuuugcaccgcccgccgauuucgagcccagagguaucccccacccuuaaggccuaucauauccuuguuccgcauccacccgggcuuucgaccccugcuugggugcggccaccuccucgguuccccagcguggccagaagccaugguucccgcuuagagcaaaagcagagcgcggcgagcuccgaacacaugcguugugugggccgccgcccagacgucucugggcugugcuucuggaaagcggcuccuacaccucccgggagcaggaaucccuucgcgagcagcggaggccagcagaaccagaggcaguuggcucuacccgcccaucccucuggcgccgugcgcgcagggcccuaccguaccgggaaugcacgucgggcggucgucgggggcgcguggcaaugagauccggaaucggcggcagcggcugcagcacucugagcugggcgcgggaggggccuuaaguggaacagcuaugcugacgucagcggggggggccggcggacgugcgggaacccacgugugagucgggcuggggguggaugccgagccaggcggggcacuggagaggcccggguggcgcgcgcagccagacaaccgaccggcagac

SEQ ID NO: 191776 - RNA, 46646 nt, Homo sapiens
gaagcggaagugguguaguggugccgacuuccuguuguuugaggccggguugggggugugcgauugugugggacggucuggggcagcccagcagcggcugacccucugccugcggggaagggagucgccaggcggccgucauggcggugucggagagccagcucaagaaaaugguguccaaggugaggcugcgacgcgcucgccucccagggcgcgcccaccgcucccuuccgcgcccugucgaguccgucccggcccagccaagcaagcuucccagacgggccggaagccccggugcaguccuuagcgaccuccucagaaccccgccccgaggcgccugucgccuggugcgggaauccccguacgggagcugggagggugggggacggcgacagucaacaaaggcguggagcggaggcuaccugacaccugccgcccacccgcccuccucucuuccacugaguuuggagcugucuguggggcaguguaguuuuucguuuguuuuuauaaacacaaacaagggaucauacuuaguuguagaucugaggcaauccucuacuccugucccaaucuagggauccuccagucuuagccuuucuuuugccgacccgcagagaguguggccuuuucaguuuuguauucuccagaaaagaagcgaaaauaccagucccuuacugccccaggugaaauacauaccauuaccauuucagggauuuucuaagaguaacuacuuuuaaguguaugcuucuuauaacgcguauuuauuugcuuugagcuuaauuuaugaucuucacggcucaagacuaguguuuuuuuuuucaauuuuuaaaaaagcaguuaagcauuuuguauuuuaaagccaugauuuauuuauauaauuacuucaaacguggcaccucacaccagaguggaauggcuuuuguuauguuuuguuguaauuuuccaaaacuauguaaaaugauugagaguugagucuugaccaguucaacguguuagcuugggauaguuuugucaaagcaagaaugguagcaaucagcgguuuaagcgguuucaauuuuuaauaaaacacacuauuauguguaaaacuuuuuuaaaaacagacuuuuuccaguuaaaucgcccccauaguucuugauugaagaccaaauaaucucuaaggagaaaaugacagcuuucaaaauaaagcauauauugguuguguaaucguauauuuuaggcuucuugguuuuguuuugauaaacuuguuauccuuaguuauagaagacauaugggaagccauagaagauugugacccagguaaagauccauguuguaacuuuuauauaucacuuuuugaaaaaaacgguauauuguuuuacauaguauguaacugaagaguaucuguuccaugacucuuuuuuuuuuuuuuuuuuuuuuagagucuugcucugucacccaggcuggagugcaguggcacgaucuuggcucacugcaaucuccgccucccagguucaagcgauucuccugccuuagccucccaaguagcuggggauuacaggugcccaccacuucacacagcugauuguuguauuuuuaguagagacgggauuucaccauguuggccaggcuggucuuaaacuccagaccucagugauccaccgcuuuggcuucccaaaaugaugggaauacaggcgugagccaccacaccuggccuccaugacauuuuugaucuuuaaauugauagcauagucauuaagauuuaguccuugggcugggcgcaguggcuuacgccuguaauccuagcacuuugggaggccaaggcggguggaucaccugaggucacgaguucaagaccagccugaucaacauggugaaaccccgucuccuaaaauacaaaaauuagccgggcaugauggcgggugccuguaaucccagccuacucgggaggcugagaugggagaaucgcuugaaccugggagacggugguugcagugagucgagaucaggccacugcacuccagccuggguggcugagcaagacuccaucucaaaaaaaaaaaaaaaaagauuuauuccuuaauguauguauauucauauaaagagcaagaauauucaaauauuagcuuauuuuuuauacccuaauuaaguuuccuaagcuucccuagagaaaccugccaucaaagacaaaggcaaggcauguucagaagauauuuuauaccucuaccugccuuccccuccacccaaccugugauuacuuuagaaacaaaaacagagguagggaagaggugggagagggcauccuaccugccuuuugguccuugacucaauaucuggaaaauugagacuccuguaugugauuaugacgauucugagcaucagcauuaguacuguccaaccuaugaauuuuagacagguaagaauaggaaguaaaguaauagaagcaguuguggggcuccuuccuccuaaagaagggcuucaaauguuuuccuuucagcugguguggucugauguaagaauuguuagccaggacccugaacacauagcuagggugaaggucauuauuguuuucucuuuaucugauuguaggcucuccacacacaucaugguacucuggccaccugccuuauguuuuauguguuuauuauaaaaggucuuuuuuucccuugagcauuaucuuagcucccaacuucaacauaacuuucaacaccuuucucuguuauuuuugcaauuaacagauauauuuauaccagauuaguccuucuucuuuuacagaaacaacuucccacuuuagauguuucauacauacagccacuuauauuuuuacauaguuuaucuacagcauuucuagaggcacagucacugcuaaaugaguagaagaaaacugugggccuggugugguggcucaugccuguaaucccaauacuuugggagguagagaugggagaauccacuugaggccaggaguucaggaucagccugggcaacauagcuagacucugucucuacagaaaauuuaaaaaucagccagacuucguggcuugcaccuguaguccuagcuacuugagaagcagaagcaggaggaucacuuaagcccaggaguucaagguuacagugagcuaugacagagaaccugucucaaaaaguaaaaaauaaacauuuuaaacuauaacaaaauuggccaggugcaauggcucaugccuguaaucucagcacuuugggaggcugaggugggcggaucacuugaggucaggaguuuuggaccagacuggccaagauggugaaaccccaucucuacuaaaaauacaaaauuagccagacaugguggcgcacgccuguaaucccagcuacucgggaagcugagaaaggagaauugccugaaccugggaggcagagguugcagugagcugagaucacgccacugcacuccagccugggugacaaagcgagaauccaucucaaaaacaaauaaauaaauaaaaauaauaaaauaaagauugauaugucccucacuguuuuagguucuagggaugcaacagugaacaaucagacaaagaaacugugcuucuggaauuuaaauucuuauagaaggcaauaaacaacucaauaaauacaucaagaaguacguuggaaagugauaagugcuuuagagaaaauaaagcagggaagaaauggggaaugcuaggguguggaaaugggaugagucaccguuuuauaucugauaguaaagagaggucuuucugaaaaaaucuacuugagcucaccugagagagguaaagaaacugugugcuugacauggggcuuacaccugaaauccaaacauuuugggaggcggaagcuagaggaucacauugaggccaggaguuccagaccagccugggcaacauagcaugaccuugucucuucucuacuaaaaauauaaaaaaauuagccaggcguggugcauaccucuaaucccagcugguugggaggcugagaugggaggaucacuugagcccaggaguuugagguugcagugagcugugaucacaccacuguacuccagcuugggugacagagcaagauccugucaagaaaaaaacaaaccuggaacaaucugggguaagaacauuucagaaggaaggaaaaacaaaugcaaagacucauagacagaaguuugucaugcaugauagaggaacaacaaaggaggguaugguggcuagacuggagugagcaagggaggaaaguggugguaugggucuagacagcaucaaugguaugggagguuuggagggccuugcaggccauuguaaggaccuuggcauuuacuuggaguaugaugaaaagccguugcuguguuucagcuguuagcaauauuacucuagaugcuaugcugagacuagacuguaggggguuaacgauggaggcagagacacguaaggaggcuguugcaguaaucuaggugagaggugcugguggcuuagaccaggacuguagcuguggagauuccggauguauuuugaaggcaaagcuaacaggauauuuugacagauuugcuguggaugugaagaaaagagagggcaucaaggauaaugucaugguuuuuggccugagcaccuggaaggauauguauguauacacauauggaagacacuggagaaguaaauuuggggagaagaugaggaguucaguuuuggucauguucaauuugacauuuauuagauauccaagggaaaugucaaauugguaauuguauauauguuuucuggaguucagagaagagguuaagauuggaaaauuuuaauuuaaggguuucaacauauaaauuaauuuucaaccaugagggagaucaaaggaaugaguuuagauagagaagaagaccaaggacuuagccugugcucaauaauaauugguuaggauaagagaacgaaccagcaaagagacugagaaggcacaggcacagagugcaggagaacaguugauguccuggaaaucaaaugaagaacauguuuuaagagaaagggagcugggcaugauggcucaugccuguaaucccaacacugugggaggcugagguggacagauugcuugagucuagaaauucaagacuagccugggcaacaugcuaaaauccagcucuaucaaaaauauacaaaaauuagccaaacacuguggcgcauaccuguagucccagcuacuuggaaggcugagaugggaggauugcuugagccugggagguggagguugcagugaacugagaucacaccaccgcacuccagccugggugacagccacaugcugucucaaaaaaaaaaaaaaaaaaaaaaaaaaggaaggggccaggugcagugguucauaccuguaauaccaacacuuuggaaggcugaguugagaggaucacuuccaggaguuugagaacagcuugggcaacauagugagauccugucuuuaugaaaaauuuaaaaauuauccaggugugauggugcaugccuguagucccagcuacuugggaggcgguggugggaguaucacuugaguccaggagguugaggcugaagugagccaugaucauaccacugcacuguagccugagcgacagagugagacccuaucucaaaaaaaaaaaaaaaaaaaaaaaaaaaggaaucaguuuggucaaauauugcugaaucagcuuggucaaauacugcugacaggugaaguaagacaaagguagaauuggucauuacauaucauguggcaguuauuggugaccuuaaugaacaauuucagugaaaugcugaguguagaagccuaauuggaguggauuugaagagaccaggucucuagacguugagcaucagugguugcugauaucacagagauacucagauauauugugcuccaugaugaaaaaacguuauccucuaugaagugaucuuaccagagaagaggagaaaaauauaaaagcaaauuuuuuuuuuuuuuuuccaagacggagucuagcucugucacccaggcuggagugcaagggcacgaucucggcucacugcaaccucugccuccuggguucaagcgauucuccugccucagccuccugaguagcugggauuauaggugcggaccaccacgcccagauaauuuuuguauuuuuaguagagaugggguuucacuguguuggccaggcuggucucgaacuccugaccucgugauccgccugccucggccucccaaaaugcuaggauuacaaguguaagccaccacgccuggccggaaauuuuguaaucaugaaaauaaccucuagauccaacuaacucacagaaacauauaucuaugaaacuauacuaaagggauacaauuaacacauuccaaacugugagagccucuguaggacaaaugaacaaauuucuuuaagaaauaaauucuaaggagcaaaaaagagaugugcccaucaguuaaguauuuuucagcugaacaguaggugaauaaaauguucaguaagaagugggccauacgugccuguaaaucccaacacuuugggagccugaggcaggaggauugcuugaggucaggaguuggagaccagccugggcaacauagcaagacccugucuuuacaaaaauaaaaauaaauuagcugggcaugauggcacaugccuguaguucuguauacuugggaggcugaggcaggagaaucacuugagcccaggaguucgagguuacagugagcugugauugugccacucuacuucauccugggcgacagagcgagacccugucuccaaaauaaauaaaaggagugaaauacagauaaaugcuacaacguggauaaucucaaaaacaugcuaagugaaauaauuuagucaugaaagaucacauuguaugaauaagcaaaucuguagagacaaaguaaauucgugguugucuaggaugaaggcuggggacaaguagaauggggggugauugcuaaaggguauggauuucuuuuuagggauggugaaaauguucugaaguugauuaugguggugguuacacaacuccaaauguacuaaaaaccauugaacuauacucuuuaaaugugugaauuauaugguaugugaauuauaucuuuaaaaagcuauuaauggugaguuaaauaauauaaauuauugagacguuuuaaccaaugcaauguguggacuuuauuuggauccugauucaaacugagaacauaaaaaacaugacuugagacuauagauauuuacugauguuaagaaaauagugauuauuuuagugugauaauaguauuauggguuuuuuagguucuuucaggcuuucauuaauguuaacaauuaguggaagagauuuuaagaaaauucauccagcuguaaaauauaugcauugguuuuaaacuaaauucuuaugcgauuuugcuuuucaguacaaauacagagaccuaacuguacgugaaacugucaauguuauuacucuauacaaagaucucaaaccuguuuuggauucauauggugaguuuaugcaguaaaaauagcaauuucuauacuuugaguuuacucucuuuguuaaugauuguaauuuuuuccauuugagguuuguggauuuuucaauugugggauugcaccaccgccuaauaaaacuguuggaggguagcaaauuagaagaucuaauaaaaacauuucauauuucuuuaguuuuaguuuuuuauguuaaaaaaaaauacuguaccuggaugugguggcucauuucuguaaucccagcacuuugggaggcugagguggguggaccacugagcccaggagguugagaccagccugggcaauauggugaaaccucgucucaacaaaaaaauacuuaaaguuggccuggugcuccuguagucccagcuacccaggaggcugagguggaaggauugcuugaguccaggaggcaguccaggaggcagagguugcagugagccgagaucgggccacugcacuccagccugggcaacagagcaagaaccugucucaaaaaaauaaaaaacaaaaccucuaacauagaacuaugcaaauuuaaaccuaggaggggauguuaaagauaauuuaguccauuucccaaaguguugucuguagacccuuaguuaugcugggaacagggguagaggcagaauucuauaguuaagcuugagcaacuuauggauuaaacaaaauugaguuucauugcaugaagauuuaucagagccuuuaguaugcuaauguguuguguaucaccgagacgagcaagaauauauuguauaauacauccuaaaguuauuuaacugcugaaccucccugcccccauagugucucuuuauauuuucaggaacacauuuugcgaaacuauacucuggacugucccuuucauuuuauagaugaggaaaauguuauuuaauguggucuuuaauucuguagaguagguaagcauaacaguuugucucuacuuucuauugagacaaaguuguaaggcaagacaacgcuuggaguuuuccuuauuuuaaaauagucuuuucugucccuaccaaauccuaacauaauuucuucaacccugucuccuugaaaauaauaugccagggccgagggaaaacccaugcugcugcuuguccauugugagucccuuagcucugaaagcaaggaacugaauuuuguagcugagacuuucuaaauuucauuugcuuccaaggcuuugaaaacauuaggaaacuggugaagagaggugggaagcaacagaggggcaaucaguucugcauuuccugaacaauaaagacaugaacccaaaguccucuuccaaaccuaggacacgauuccuucucaucucagccuaccuuauuucugucugcauacuauauguacaaugguauuuugaacuacaaaggccucacauuaccaaaauuaaaguuaguuuuuaaauggcuucaguggggagaaaaaugguuggagcuagaauuuuauaguuuuuacugcauauaaaagaauaaauacauuuaucaaaacugacaaagacuccauuauaaagucuuguauaguuucauguggcuggacuaaguguaaaucauuguuaacaaauacuuuuagaguaaacaaagccccaaauuuauauaaggugguuuucuuuuuuaaaaugcacaaaaucagaauacauugcgguauagcuuacauucgucaacaguaaguaaaauaacaaaggucaagaauguacagucgugcauuuuguagugauagagauauggucugagaaaugcauuauuuggcaauuucaucauugaguguacuuagacaaaccuagaugguauauccuacuacacaccuagguuauauggcauagccuguugcuccuaggcuacaaccuauaccagauguuacuguacugcauaccauaggcaguuguaacacaaugguauuuauguaucuaaccguagaaaaguuacaguaaaaauacaguauuauaaucuuaugggaccaguguucuuaugugcaguccauuguagacccaaacauuacacaguagauggcuauaguucuauguuuuuguacugcacauuacaaccuuuccucuauggguauaguguuaauuccaaauuauuguuagaaauaauagcuguccaauacaaacuaugugccauauuaauuauagacauaaauuauagauagaaaaaugugugugguaugagaaauacagauugaaagaaauuguuuauauuuggcuaugaacuuuucuuuuuuucauuuuaauacuggcuaaggaggcugaggccaggagaccauuugaguccaggaguucaaguccagcccggacaacuuagaccccauuucuaaaaaaaaaaaaagcugggcaugguagugcacgccuguagucccagcuacacggaaggcugaggugggaggauugcuugagccuagaguuugaggauagccugcacaacauagcaagacccugucuccaaaaaacaauaauaaauaaauaacugugagcgacuagggauaaaugucugcacaucucuaaaauagaaagacaguagguuaacauuuaguaugguauuguuugauaguguuuuuuuguuuguuuguuugcaguggaguuuugcucuuguugcccagacuaaagugcaaugggcacagucucggcucacugcaaccucugccuccuggguucaagcaauucuccugccucagccuuccgaguagcugggauuacaggcaugugccaccacgcccagcuaauuuuguauuuuuaguagagaugggguuucuccauguuggucaggcuagucucaaacuccugaccucaggugauccaccugccucggccucucaaagugcugggauuacaggcgcgaaccaccgcgccuggccgauggugauuuuuaaauaguuuuaaaagugacucacaccuguaaucccagcacuuugggaggccaaggcagguggauaacgagguuaggaguucgagaccagccuagccaacauggugaagccccaucucuacuaaagauacaaaaaauuagucaggugugguggcacgugccuguaaucccaacuacucgggaugcugaggcaggagaaucgcuugaacccaggagguggagguugcagcgagccaaaaucgcgccauugcacuccauccugggcaacaggaugagacucugaaaaaaaaaacaaaaaagagcugaucaaugacauugagugaaucaacaaagaauuguuaguuauuggacaggauggaugauacauugacaggucagccccuuucaaggauaaugaugaauuuuaaccagucuuucugaaagaauaacuuaugggaguaucuuaaaaaaugcucaugauuaaaucauuguucuuuccuuucaguuuuuaacgauggcaguuccagggaacuaaugaaccucacuggaacaaucccugugccuuauagagguaaaugucuuauuagguuuccagcauagaugcauuuugaauacauaauaaauauguugccaaagaguuauaaccaaauuaaaccuacuuucucagggcuuugaugcugauauagauuuuaacuucuauucaaauugaaguucauuuggcaguaacaccuaacauuuucagcuuucuuaaaacuuccuuaccaagauauaugaacaaauaagugccuaaguucaccagaggaguuuaauguuucacugaaucaaauaauuguagaacuagaaauggaucuuacuugccuccuaguucagccucccacaccauucaaacuuuccugacaaugggaagcuaagauauaggcuucaaagucaggacagaguuauguuugaguucuugcucuauaaucuuagcaguuuuguuacauguuauauauggauaucuuugacauuuggauaauaguaccuaacuugggggaagugagcauuuauuagauaaugaauguaaaggacguggcacagagccuggaauauaauaagcagacaguuaaaaguagcuguuauuuaugguugugauguuggugauaaugcuaaugauagauaauugaucucuguuagccugucuuucacccucugcugaaauauuuaguggugaggaagcauuuagcuuaaugagagaccauuuuguuuuuggacagcucuguuuguuaauuauuccuuguaauuagcuaagaccuauguccuuuacccauugauuucacauaguaccugcuauucauaaggcaauaaggauaggagcuguggcuacaaagaugaauaaaggauguaccucuucuggaagaacuccacuaauaggggaaacaaagggaacagauagauauuuacacuauucuguaacugcuauagaauuauaaaaugaaaaagugcuaugagauuacagaggagaacaaggccacaugggaagaucacagaggaagugacauuugagccacuauuaauaagucaaccauucauaauaaacagagggaaaaaacaguuaauugaguaucagcauuguauaaagcaaguauaaguuuagggaagacugaguaaaauuuaagauuacugacuuugcuauugcccucaggaaauaaauucugcugggggaaauaggaaugggggggaugcggauauauguauaaauuguaucuagacuaaaccucuguuccuuuaaccauucuucaauuuaaaaauaauaaaaauagaguaacugaaguuucuauuucuuuuucagguaauacauacaauauuccaauaugccuauggcuacuggacacauacccauauaaucccccuaucuguuuuguuaagccuacuaguucaaugacuauuaaaacaggaaagcauguugaugcaaaugggaagauauaucuuccuuaucuacaugaauggaaacacguaaguauucauaguguucugugaauuaguuauguuuuauauauuuugcucacuagcaucugcuuucuuuuagcacucaaggaggauucgagguaggauagauaaguucagauaauggacuaaucacugaguugaggguaaauuagaaaaggcugacuaaaagaaauggguuucuguagagcuuuguaauuuucagaauacuuauauucaauauuuuguuggcuuuaguugaaccuuuuuaaaauaggcaggauucacauagugggaagugcauuuuaaaaaauaguauccuggugagguaguuauggaauucaaaucugauuacucaaagcauuucugucaagaauaauaguagggaacuucuguuuaugugucugauaguguaacugugacagauuaauguuccuaugaaaaauaacuagaaaagcaagagaaaauacaaacaacaccuguuggaaggcuuuggaaagcuguuuaggcaaucaagacauguauggccaagauucuguagagaagaaaacagcaaagagaugagguaguucugccaauaacuuuucccccaggguacuuacugauuccuuuuuuuuuuuuuggagacagaguuuuacucuguugcccaggcuggagggcaguggcacaaucucagcucacuuacaaccuccaccucccagguccaagcaauucagcuugguagacucaaccuacugaguagaugggauuacaggcgcccaccaccaaauacaaaaguuuuguauuuuaguauuuaguagaggugggguuucaccauguuggugaggcuguucucgaacuccugaccucaagugauccacccaucucggccuucuaaagugcugggauuacaggcauaagccaccaugcccagccuacuuacuuauucuugaugaaggaugaagggcugagaaucugggcaaagggccuuagcuaagaggcagagaaaccugcagagucucuagcagucucagagggcugaaaagacaaaaguugcuguucugucuaccaaaguaacuaggacuuuuagauccaagauuugggagaaaagccauaaagaagugaguagcucuggggaugguggcucauggcugugaucccaggacuuuggaaagcugaggcaggaggauugcuugagcucaggaguuugagaccagccugggcaacauagugagaaccccaucucuauaaaaaaauauuuuaaaaaaaccuuggcaugguggugugugccugugaccccagcuacucaggaggcuaaggugaaaggaucacuugagccugggaauucgaggcugcagugagccaugauugcaucacuguccuccagccuggacaacagagcaagaucugucuccaaaaaagaaaagaaaagaugagauacucugaauuuucccaccuuaagagauauguugaauuccugagcuucaaagauaagaugcuaaaaaaaaaacuaagcagaacgccucugaaaaucagccaaguuuucagcagucuuagguugaggaggcaauuggaguucaguaccuuaucaagaaggggaacaaguaaacauccuaggcuguuaguuggcaccacuggaagaacacaucuuaggagggagaacuuagagguagaaugagccuuauaaaaaucuguccuugaggcugggugggguggcucacaccuguagucucagcacuuugggaggcugaggcgggaggaucacuugaggccagaaguuugagacgagccuggccaacauggugaaaucccauuucuacuaaaaauauaaaaauuagccaggcaugauggcacaugucuauaaucccagcuacuccggaggcugaggcaggagaaucgcuugaaccugggaggcggagguugcagugagccgagaucgcaccacugcacuccagccuggguggcagagugagagagacugucucaaaaaaaaaaaaaaaaaaaaucugucuguccuucaaucagcucagucccugauccugacugucugccugccacaggauagggugaacccuugcuggaagaagauaauauauagacucucuauaauuuuucacaaugucuagcauacaauuuauauuuaucaaguacaccaagaaagagaaccaagaggaaaaaaagacaauagaaacgggacaucccuccacuccacccccacaaacacacagguaacuugguuaucagacacagacuuaaaaaugguugugaucagugcauucaagaaaauagaggacaagaugguaaauuuuauuaaaaagaaacuaaguggaaaucuuagaacugaaaaauagaauaauagagauuaagaacucaguagauggguuuaguagcagacuggacucaguagaauagagacugccucaaccuccugaguagcugggauuacaggcgcccaccaccacaccuggcuaauuuuuguauuuuuuaguagagaugggguuuugcuacauuggccagucuggucucgaacucuugacuucaggugauccguccgccucagccucccaaagugcugggauuacaggugugagccauugugccucgccucaguuugaauucuuaaccuguugcuuuauauuaggccuggaaguagauauuaacauagauauuaauuuuuuucuucaaagaauuuaguguaaaaggaaugguaugauaauuaaaacuuaccuugacaaaacuguaagaauguaugaaugaagaauugauucauacuaccacauuaaugaauucugaaaacauuaugccaagugaaagaagccaagcacaaaaggccauauauuguaugauuucauuuauaugaaacauuuaggaaagcaaaucuauagagauggaaaguagauuagugguugcuaaagggcuguggggaaagggaaacgggaagugacuacuaaugaguacaggguuucuuuuucggaugaugaaaauauuauggaauuagauggugguaaugguugcauagcuucgugaaauaauaaaagccacugaaauguauacuuuaaaaggagaaaguuuaugggaugugaauuauauuucaccuacaugcaugaggcuuacaugaggcuaugauuuaguuaaggaauuuuguugggccgaaaaauugagaaagcauguggucucaguggccauccccacacacaccagccacaguaucugugaguguugcacagauacugugcuuauaacaccccgagucucaguauauaaauuuacaggcaaacacaagaaaaauauuggaaaaguagauaucagcaaguuuucacagaaagcuuugagaaauguuauuaauugucaucuuccaugaguuaggucaaaauugaacaaaugaggugaguuugguucuuuggaaaaggugaaaacugccacugaacucuucugucaggaguauuaaaagaagugccaauccuaauccuguaauccugacuacuugggagacugaagcaggaagauuguugaguucaagucugagcugggcaacauggcaagaccuugucuggggggaggagggguguaaaaaguaguuucuaugaagaugguuagccuaucaaggugauugaguaauucuucagaacucagugaacuuaugaaugaaguacgugagaugagauauacacaaaauagauuaaggaguaaaagaagaauaaucaaauaagccauuuugaacaacuuugucuagcacagcuuaauuagugguugguagauauuucuuuuguuguuuuuuguugucguuguuguuggguuuuguuuuuguuuuuuugaaacagggucucacucuaacccaggcuggagugcaguggcgcagucauacugcagccucaaccuuccuggcucaggugauccucccgcugcagccuccugaguaguugugaccacaggcgcaugccaccauguacaguuaauuuuuuuguagagaccaggcuggucucaaacuccugagcucaagcuggauuacaaaauggaggggaaaguacuggaauagaccuagaauuuuuaaaauuaugcaugcugcaaaauagccuuauuugauccuccugccuuggccucccaaagugcugggauuacagguguaagccaccaccccuggccagugcucaauagguauuugagagaaaaucuuaguaacuuaugaaaaaauaggaaucucuuugucauuguuggaaggaaagauccuuuaacaauucaccccuuuguacuacaaucuagcaauuucuaagcuagaaucuacguauaauuuuuuuguuuguuuguuuugagacagagucuugcucugucgccuaggauggagugcaguggugugaucucagcucacugcaaccucugccucugggguuuaagcaauucucuugccucagccuccugaguaacugggaccauagacgcacaucaccacacccggcuaauuuuuguguuuuuaguagagaugggauuuugccauguuggcccagcuggucucaaacuccuggcuucaagcaguccacccaccuuggccucccaaagugcugggauuacaggugugaaccaccucacuuggcuagaaucuaccuguaauuucagaguucauaauaucuuuaauaaaaauuaauuuuaagaacacguauuuccaagauaucauugaugucuuuuaauggccuuuaauaauauugugacuguugcucauauucaucccuaaauuuguaccaguauacuuauaauacauuguacaguggcaauaaaauaaauuuuuguuaguucuguggagucaaaugaagaacaaaacucuaugaauuuugcaauaugcugcuuuaacuagugcuauuuuuauauacuugaagcaagaaccuugcugcacaucauguuuaaaaccacuuaacucuauuaaaauaaauuaauuaaaugaaauuuucaugauugggguccuacaaagaaaauuaucaagcugaguugaaaaccgaugagaaauggcuaaccuuuuucuuuuuacugaaaagcaacucuguagcugacuugaauuuuuuuucauuuuguagccacagucagacuuguuggggcuuauucaggucaugauugugguauuuggagaugaaccuccagucuucucucguccuauuucggcauccuauccgccauaccaggcaacggggccaccaaauaguaaguagaauugagauuuuacuuuaaaacucauauaaacaaaagagaacagaaaccuuuguaaaaaaauaaagaaaaauaaugacuucuuugcuuuuuaguuuaucaagcuaguggauuuuuuggaaguauucugaggccccacaucugcauguacagauucccaccaaagacuggcauuugggcuuccauuuguagguagaaaucuaagaaugguugugcuggauuccaaaauggaggagaaaguguagaauagagcuagaauuuuuaaaauuaugcaugcugcagaauagccuuauuugaucagcuuggaagcacauauaacuugaaagguagucugaccucuccuuucucuuugcaacuacaaaaucaguguuguagauaaggauuaaggucaacugaagcguucacauucagcuauucuggguauacacaauuggacaucuagcucuuagcuuucuucucuuucguacagccaauucaugauuuuaccuuguguggaguggugggagcauggagagaguguugcuucuccccuaauuggaauauauuaucucuguuaucucuauuuucuugaauaauucuuacugauacuuaaaaaucacucugaauaauugugaguugguuguacuuauuuugaauuuacuaaaucugcauugauuucacuguguuuugagcugugacuuuuuuuuuuuugguaaauuuucuuuaagauuauaauuaaccaaacuuguuuaucuuacaagacaaauuauaugugcuuucauuuuucuucugcugaaaauuauacuuuuuccuuuuuaauccauucuuuccugaggaacaucuugguuuauaagcugaaugggaauuuaacagaaagaauuuuugaacccauuucucuuuccuucccuaccuucccagaauaagcuugauuuuaggauuacuauuucuuuuaguaaagguacugguaauuccuuuggauuagaaauuuguuuuuaucuuauuaaauucuguugacucuagugcccaagaguagaguaucuugcuuaaguuugaaauacgaaauauuuggccgggugugguagcuguaaccccagcacuuugggaggccgagguggggguggaucaccugaugucagaaguucaagaccagcuuggccaacaugaugaaaccccaucucuacuaaaaauacaaaauuagccaggugugguggugcaugccuguagucccagcuacucgggaggcugaggcagauguugcagugagcugagaucgcauuacugcacuccagccugggugacagagcaagacucuguaucaaaaaaaaaaaaaaaaaagauaucaaauauuuccuagucucauuaccuuuguuuauuugcucagauaauauagcgagugaccgcuaugacaaagguaaccuuuucagaaauucagguagucuccuaagcaacuuuuuuuuuuuuuugagacagagucucgcucuguugcccaggccggagugcagugguaugaucugggcugacugcaaccucugccucccagguucaagugauucucgagccucagccucccaagucgcugggauuacaggcccccaccaccaugcccagcuaauuuuuguauuuuuaguagagucgggguuucaccauguuggccaggcuggucucgaacuccugaccucaagugaucugccucggccucccaaagugcugggauuacaggcgugagccaccgcggccggccugcaacauuuuuuuuuuccuaaauuucuuugaguuuuaaauugacauuggaagugcaguauucaagaaagagaccauacuauuguuacuguugcaauucaauuuuguacucagucacuguaagucauguuaaacacucuagagcagauucuuuacuauuuuuuuuugucaguuaagcucaagauuaacuucucuuuuucuuccucuauguugauuagccucuuggcaccacugaucuuaguucuuuggcauucacguucucuuuaaagaauguauaaaguauucuuuaagcuugcuggguuuuaaccuuuuaucccuaguauuucuaagcuuuuguuuuguuuguuucuuuguuuugagauagggucucacucugucaccuagacuaguuuuuaacagucuggauaauguaaguuuuguauaggacuucucauaguaguuugaagucucuugaagucuuuaaaccaacaaaaucagcugugcuaauuggccaacauaguuauaaaagaaauaucaaaagauuuauuagauauaauaaagaaguuacuuucuaagaaguuaaccuuggaccgaagaaggccagaauuaccuuccucuaaauuugaaauugaacuugcucuuagguaauagacuucuugagaacuuuaaaagcugaccagguugaccuguuugccaguucuuuugguagggauugucauaaguauuguaauucauguuuaaugauuucaggauuaugaaagggagagguauuuguuuuguuuuggugcugagauuuggauuuuuuaacugugaaauuuugcuguguauugacagugugauguauaucuuauucaguagccuacauauucaggccuuguauauuauuuuuacaaugugaaaaaaauuguuuuuagcuuccuacaugccaggcaugccagguggaaucucuccauacccauccggauacccucccaaucccagguaaugaaaaacguucuuuugaauaauuguauuacaaauucuucuauuagaucuagaaucaaaauaauuugcuaauuagggcauuaaaauaaauuuaauugcaauuuaguggaagauaaaacuugguuuauuccuggaauuuauuuauuuauuuauuuauuuuuuuugagauggagucuugcucugucacccaggcuggaguacaguggcgcaaucucggcucacugcaaccucuacuuccccaguucaagugauucuccugccucagccucccuagcaguugggacuacaggcugugccaccauucccggcuaauuuuuguauuuuuaguagagacaggauuucaccauguuggccaggcuggucucaaacuccugaccuugugaucugccugccucagacucccaaagcgcugggauuacaggugugagccaccaugcccagccuauguauuuuuuuuuuuuuaaaagaagagaguauuauaaaauauuuuuccccuuggcugaauucauuauaacuagcauuccauuuaauauuucagcuaucuauacuagauauacaaauuucuuaaaaggacuucaagaucaaaaaccaauugagaucacugucauuacucaacccauuucuuuccucuuuaaaauaaaaaugcagcccaggagcugcuuuucuguagauugaaagaaacuccuuucaaauuauacacacacaccuuaaaauucuagcaauaaggccgggugugguagcucacaccuguaaucuuacccagcacuuucggaggccgaugcaggcggaucaccugagguccugaggucaggaguucgagaccagccuggccaacagagugaaaccccaucucuacuaaaaauacaaaauuagccaggcaugguggcacaugccuguaaucccagcucuuugggaggcugagguaggagaauugcuugaacccaggaggcagagguugcagugagccgagaucgcgccauuacacuccacccugggcgacagagcaaaacucucucucaaacaaacaaaaccccacaaccuaucuuuucuauacauugcaggaaucaauuaaugguucagauaauggggucaaacuugucgcaugauauuuacuuauucaguucauagacuaccuguacuaucaaccuuuauuauccauuuaguaauaacauagguaacuaaauuaaauuaacaaugaaaucagucuguuaacacacgcuagaaagucaaugauaaauaauuacuaacccauguuuuaaauguguacuuguuucagugguaaucuaggaguacucuccaaagguggucuaugggcuaacuuaaaaucccacccagcacuuugggaggccgagguagggauugcuugagcccagaaguuggagaccagccugggcaacauaguagaccucauuucuacaaaaaaaauuaaaauuagccaggcaugguggugugaaccuguagucccagcuacuugggagggugagguggaaggaucacuugagccuacagaucgaggaugcaaugagccguaauugcaccacuguacuccagucuggccaacagagugagaaccugucucaaaaaaaaaaaaaagauuggcauauacugaugccaagaugagacuuccagcugcucuaacaauuagcaaggaaaauuuaacucuacuaagucuucuuaguuucauauaacccagucauaauccucauggauaaaugcagccagauuucugaacacaugucauagguaaauauauauauguacauauauaauaucuaggaucuugaaaguuaauuuagcaaacacuucauuucuggguugucuuaauuucacaacuuuuuagaagguaauaagcauucugucacuuuggauagguaagcagagauuagaagaacauuugucagggacaauagagaaagauuccuuugguaguaauauauaagcagguuauucauuuuagauuucuugaggcccuaaauuuucugauuaaguucuagaaauggaauccuaccugaagccuugaaauuacaaggcuacugaacaauugcuaguaaaaagcagcuuuggacauagagggaauaauuguugaagguacacuauggaaauggacuucugaacaauaaagcuacagauggagauuucucugaaguuaauaucuguaggcuuagaagaguuuuauaccaaguuacaaaaaaauucagcaaugugaucacauuaucuuugcaaagguaugcaaaaugggagaaacuccagaaaaaaagagcaguuuaucccaguuuucagaaagguggauuuagaaauuucaguaggauugacauuucuuuacagcauuauagcauggauuacugaagagacuagaaacaaaaguacuguguucaguagccuccagcauguguccacuaggaacaaaaaugcuuucuuuuuuuuuugucugauuuugcuuuuauacugauauauaagagaaguaccaugauuacauugaaucuucagcaagucauauauaaaacuuaguugaggacaaguuauaaaguggaagcugauaauacaaauaggagaaucuuugaaccacugcauugaaaaaggauuauugacgauaaacucagaaggagcucuugcuccaguguccuaggcuagcuuuuuuuuuuuuuuuuuuuuugagaugggggcuucacucuguugcccaggcuggagugcaguggcauaaucucagcuacuguagccuugaccuccugggcucaggugaucuuucaacuucagccucccaaguagcugggacuacaggugugugccccuacaccuagcuaauuuuucuauuuuuguagaaaugguuucgccauguugucuaggcuugccuugaacuccuggacucaagugaucuaccugccucagccucccaaagugcuaggauuacaggugugauccacugcacccagccugggcuagcucuuuuuaaucaguaauuuuaaugcgcuuguaaaaggcaaaugucauagaauugauaauuauagcuaaaauaggauuaauugagauuuauugucuaacuaaccagguggccaguaaucauccuauucuaauuuucuucuucguuguaagggaaacacugacuaguaagcauucagaggaaagcaauuagaucugaaaaucauguccugagacaaaugguuaaaggaauuaagaauaguuagggcugggugcgguggcucacagcuguaaucccagcaguuugggaggcugaggcgggugaaucacgaggucaggagauugagaccauccuggcuaacauggugaaaccccgucucuacuaaaaauacaaaaaauuagccgggugugguggcgggcaccuauagucccagcuacucaggaggcuguggcaggagaauggcgugaacccaggaaguggagcuugcagugagcugagaucacaccacugcacuccagccugagcaacagggcgagacuccgucucaaaaaaaaaaaaaaaaaaaauuuaaccugaagaagagaagcuugagggaaaaauguuagaaguucucaaauauucgaguuuuaggagucuccaaauaguugagugucuuccaaaaugcaaauuuaggacuccuauuuauaaauuauauugaaaugauguuuaauguuaaauagagaaagaugaccauuugucagggauguuauaaaugauguguguagauaagagauuguuggaaaggugauuggaguagaauaccucuaaggaaaguuccucugacuuugauacgaauacaugaaugacagaaacuguccagaaagugagaaaaaagguuuuuuuuuaaacuaaagaugaguuugguacgaauguuaucaaaagaggaaaaaaacuauuuaaagacaaguguuuucggguuaaauauccccaaagguuaccaauaagccacagguacaaauuaaauaguaucauuuucccacagacugagaaaucggaaaaguucucucacaaauuacuuguugcuucugaugcuguuggauuguccuuagaaauacucuaguuacauuuccgcugcuaugagggugacucucauauaacugggaccaagcaagagcauuuagccauuuaagaguaaaugcagugucauuaauacaauuuccauagagcuuuacuugaauaaacacuugcagcuccaagacuauaaauucaucaacugguaaaacaaccauaugucaagcuuaacuuccugaaugggguucuucaaaauacuauaagguugggucaucuuaaauguuaaauguuuuuuguucuugucuuuagugguuacccaggcuguccuuacccaccuggugguccauauccugccacaacaaguucucaguacccuucucagccuccugugaccacuguugguaaguacccuugaaaacuuguguuucaccauauaagcaaagucuaacucccuguugugaaaagcacauuucacuugugaauuuuggacuacucuuucuucuuagaggaaaaccuauaauaauguacuauaaucuuaaacuugaaguaaaugacuuaacauauaaaugaaccuucuaccagggcaugaaaauaaaucugauuaacucaucaaucuuucuuuugaucacauaguuuuauuugugagccaaacauguguugaacuauuagcagauacauagauuuuccuagcuugguuauaugugaaaacagaucaccaucauuaagagaagaaaguaaaauggguuaauaugagcaggucaaaucagacaaaugauugaagaccaguaguuuuugcuuuuuguguuugcuuauuagcguuaccugaaauauaauuuucuucaacuaaaaaaacuaaggcagugagagaauuucuuuagacuccagccuucaccuaugccuaucucccacuaccugcaccaccauaucugccuucucccuguuaccauaaguugguuaucuuugcuucuaucuaaagcugauuucuccacuagaccuuauccccucuaauguacucaggggcaucacuucagcaguuccuuccucucaaguuuuguucucuacuggaugacucaucagcacagagaaccaugcccuaaaaaagccuuaaagaguccaauugagacaaacaaauggaaagacauuucaugcccaugaagaauuaauauuguaaaaaugacuauauuacccaaagcagucuguagauucagugcagucugugucgaaauaccaaugucaguuuccauagaaauagaaaaagcuaucauaaaauguauauggaaccaaaaaagaagccaaauagccaaagugaucuugaacuaaaagaacaaagcuggaagcaucauacuaccugacuucaaaauauauuacaagguuauaguaaccgaaacagcaugguauugguauaaaaacagaaacagaccaauggaacagaauaaagaaccuagaaauaaaucuacauauuuacagccaacugauuuucagcaaaggugccaagaacauauauugggaaaaagacauuguucauaaaugguggugggaaaacuggguauccauaugcagaagaaugaaaacuggaccccuaucuuguaccacauacaaaaaucaacuugagauggauuaaagacuuaauguaagacccaaagcuauaaaacuacuagaagaauacauaggggaaacccuucgggacauuggccuaggcaaccauuuuauaguuaauaucucaaaagcauagucaacaaaaauagacuacugcgaugauacuaaauuaaaaagcuugugagccagaugcaguggcucacgucuguaaucccagcacuuugggaagccaaggcgggcgaaucauuugaggugaggaguucaagaccagccuggccaacaugguaaaaccccgucucuccuaaaaacuaaaaaugcaaaaaucugggcguggugguacaccccuguaaucccagcuacuugggaggcugaggcaagagaauugcuugaaccugggagguggagguugcagugagcugagaucgcaccacugcacuccacccugggcaacagagcgagaccuugucucaaaaaaaaaaagcuucugcacaacaaaggagauagucaacaaaguaaagagacgaccuguugagugggagaaaauauuugcaaaguacccaucugacaaggaacuaauaaauauacaagguauugaaaccacucaacaguaaaacaaaccauuaaaaagugggcaaagaacaugaauagacauuucuuaaaggaagacauacaaauggccaacagguauaugaaaaaaugcucaauaucacucaucaucaggaaaaugcagauaaaaaccacaaagaaauauaaucuuaucccaguuugaauggccauuauuaaaaagacaaaaaauaaaaaaauaacaaauguuauugaggaugaggagaaaagggaacuuauacaauguuggugggaauguaaauuaaagccacuauggaaaacaguauggcaauuucuaaaaaaacuaaaauuagaacuaccagacaguucagcaaucccacugcuggguauuuauccaagggaaaggaaaucaguauauuaaaggaauaccuguacucccauauuuauagcaacaguauucauacuagcuaagauauggagugaaccuaaauauuuaucagcagaugaauggauaaagacaaugagguauguguacacaguggaauacuguucagccauaaaaagaaugaaaacgucauuguagcaacauggauggaauuggaaauaaacuaggcgcagaaagacaaauaucaaauguucucaugugggagccaaaaaacuugaucucuuggagguagacaguagaaugauagacaccagagacuuaagaacggugugugggugggauagggcuuaugaagaaagguugguuaaugaguacaaacauacaguuagauagaaggaauaaguucuaauguuugauagcagaguagggugacuauaguuaacaauguauugucuauuucagaauagcuagaagacuuaaaauguuccuaccacauagaaaugauaaauacucaaggugauggauacccuaaauacccucacuugaacauuacauuccgugcagguaacaaaauaucacaugguacccacguaaauauguacaaauauuauguaucuaaaaaaauuuuuuaggccaggcacaguggcucacaccuguaaucccagcacuuugggaggccaaggcgggcagauugcgaggucaggaguuggagaccagccuggccaacauggugaaacccugucucuacuaaaaauacaaaaaaauuagccgggcgugguggcgcacgccuguaauccuagcuacucaagaagcugaggcaggagaauugcuugaacccuggaggcagagguugcagugagcugagaucagacaacuauacuccagccugggcaauagagugggacuccaucucaggaaaaaaaaaaaaaaaaaaaaaaauauauauauauauauauauauuuaaauauaaacauauuuauauauaaacauauauaaauauacauaaauauaaauauauaaauauauauaaauaaauauauaaauauaaauauauaugauauauauaaauauauauaaaauauauauaauauauaaauauauaauuauauaucauauauaaauauauauauuuuauauauauauauuuaaaaaagaauccucuucucuauuccacuuuuccugccaccacuauuggaugucuucauucuucucugaauaacuccuugaaguaacucucuuuguuaucuucaguaccucuucuccguuuuucucuuaaaccuccuuuuggacuuuuucucauaccauuuugcuaaaacuggucaugauuaccaauaacuuuuugagguuacauccaauggauaguuacuauucucaucuuacuuguccuaucagcagcauuugacacaguugguuacuuccuccuugauacacuuuccucuuguuuuccaaaacaccaugcucauuuuauuuucuuccugucucauggguauucauacuuagucuccucugcaaguucuuccauuuuucuuaacauuggugugacccuggcuuagucuccuuggcacucucuauccucacucuccugauaauuuccaccaguucaauagcuuuaaauaccaucucugugcccccaguucucaaauuuaugucucugaccuauaccucucuccugaacucgagauuguuauauccagcugccuuuucaguaucucuacuuggauguuuaauaggcaucucaaacucaaccaaaaccgaauucucaaucuuccuaacaccugccccaucuccauuguuaccuacucuauacucuuuggagucauccuugacuccucaucaggaaauccucuugucuucaaaauauaucuagaaucugaucauauccagugcugauccaagucaccauuauggcucaucuaauuuacuucaaaagccuuccacaagauuucucugcuucuuuccuugucccccuacaucucucuuuuuugacacagcagcuagagugauccuaauaaaauauaaauaaauuguaucacuccucugcucaaaaccuucaagugauuuccuguuucacucagaguucaguccaaaguucuugggcccagaaggcccuacaugauccugcccucuuccccauuacuuuucugaccucaucuccuacuggucuccugucuuaggauuuguccacggccuauuucugugcauggaucagccaggccuauccuuaccaauuugcugccaccaccaccaauccccccuccaaccccccacccacacacucaacauccagaagagugcuugguauauagaaguuugcuguugaagagauuugcugaguuccugaaugaacauagaaucuugugaaguuuauuuuucuguuauguuuucugauaacuuguaaccauccugaggucugauguaaaugucauccccccaccccauaaaggguuauuuccaccguuuuucucauugauacacacuauucagguuccaguggugugguuuugauuuauuaaaauguauuugucauuaauguaacuacaauauaaugaaaugauuggaguuagaaaccuaaaugauaaaaggucuuuaauccauaagcaaagcacacuaaaucuggugaagcucucuuauuuugguucagcauuaucaauaaaauaggaauagugcuguuugucacccuguuucucauugaaauaauaguauaauccuuuugauuuguagagaaccuuaguuuacaaagaucuuuuuuauauuaacuuguuucauuacauuagguacgaagcauuuuuuuauagcuuagaugauuuccauauauccaaagaauagaaauguguggaaaaugguauauguggaaucagaucucauguuuaugauuuuugaacggguaaucaaaucaacuaauauuuuacucuacauuuucaagaguacugucuuaggcauauaggcuagaggcaaauuauuuuaugauaauuuaggauauccuuuaauauauauuguuuuucuacccuuugaucuuuaccuacuugauuugauuuuuuucaucauauuucauuaguugaacauuuaguagucuguugaacuuuagacuuaaaggaaagcagaaacauaaaaguaucauuuagauauuagaguccacagucacauuuucucaguauaucaauggucacgauuugggcuguuauucuguuacugaggccaugagaaagaaugaauuugguuauuuauccuuguuuuuuuuguuguuguuguuuuugagacagacucgcucugucgccaaggcuggagugcaguggcgcgaucuuggcucacugcaaccuccaccucucagguucaagcaguucuacugccucagccucccaaguagcugggauuagaggagcguaccaccacacccggcuaauuuuuauauuuuuaguagagacaggguuuuaccauguuggccaggcugaucuccaacugcaacuccugaccucaccaccugccucaacccaccaaagugcugguauuacaggccugagccaccacaccuggcgcuauccuuguuuuuugauacaggaucuugcucucuugcucaggcuggagugcagcagugcugucugcccacugcaaccuccaucuccugggcucaggugauccucccaccucagccuccugaguagcuaggacuguagacacauaccaccaugcccggcuaauuuuuguauugcccaggcuggccuugaacuccuagauucaagugauccacccgugcuggccucccggauuacagaugugagucacugcacuaggcucccuuguucuuuuugaaacuuagcaguuucacucuguagauuuauuuuauuuuauuuuauuuuauuuuauuuuauuuuauuuuauuuuauuuuauuuuauuuuauuuuugagacagaguuucgcucugccacccaggcuggagugcaguggcaugaucucggcucacuguaaucucugccuccuggguucaagugauucuccugccucagcauccugaguagcugagacuauaggcaugugccaccacacccacuaauuuuuguauuuuguauguuagccaggcuggucaaucuccuaaccucaggugauccaccugccucggccucccaaagugcugggauuacaggcauaagccaccucacccagccuggauuuuaauuuuaugguguaaucugaauuaagaaagauuuaaaauuuaccagauguucaaaaauauuaguauauaguaugguacccagaagagaaugguguuccacucagugacacuuccauauguugugaauuuaugugugaggaaugucaguggacuaauuggccccucccuuuggaggauguacugucagcugugcuugugccagaaucuccagguuuauuugaucucuguagaguacuuuuuuuuuuuuuuugagacggagucucacucuguugcccaggcuggagugcagugaugcaaucucagcucacugcaagcuccgcccuccagguucacgccauucuccugccucagccuugaucuauguagaguccuuuuaucagagugcuauagacaucuucaaccucaguuuacauaguguuuugaaaacuaacuaggggaaugaggaggugguagucggugaauaaugaaggaacaaaccaauucauguagcaaaaaaaaaaaaaaaaaccuaacugguaguaugcauugaaacuuaacacaaagauucuuuuuccuguuacuguaggagcaaaacauaaacugacuauaccuaucuuaaucaguuucacauacaagaucccugaaaaauaguggguauggaugggcaccaggugagccaccaugaaguuucucuaccacaaccaccaccccugccccugguaaaaaaagaggaaguuaaaaggcuuuggugauuccuuacuccagucucagcaguggugaaaguucucuuuugaagguugacuuauuuuaaaaagcuauauagaugauuguaguugauuuauagcucugaauccuaggcuuuaggccuuuaacauauacacaguuugaccuuucaguaguugcaguuuaauaauaguaaaauugaagaguagguguuuauucccgguuaaagccaauaccuaccacagaauuuuucuugguaaaacuucauaaauacuguauauuucaaccucugaguuuuaaaaaugucauuuuaagauuuuguuccuaaaaaucaaauaaacaaggaucagaaacaguaaguuuggaagggugcuauuaacagagauucagggaccaguuuuaccuuuguuaaaguguuguuuaaaaaugugggaguggaaaacccugaaaaugcugcagcugaaugauguguuucuguaguuuccacucuuuaguccauacugaauauuuagauaaagaaaggaaaaggugaagaaaaauaagagagcuuaccuguuaauauuucuuugaggacagaagcuaguaaacaugacaaguuuuucuugacugucuuauccaaugcuguucuucccucuggccauccuagauuaaguguuuggccuacagaaacuguacuuucaggauauggcacccaaggcacccagcccauguggguuuacuagugcacgcuugcuugugugcagguuugggugccucuuccccacaccuuucacagacuuccuuugggaauaacugccucaucuucaggauaaguagcguuuucuuccaauccuggacagucagugagucaugagugaaauuuaaaugcugagaguuuagucugcuaaauguuaaauccuuuucugccaaagcaauaaugauaacagaaauaaugauaacagaaauucaaagcaauaaugauagauuugaaagcuuuuaaaaaagcuauuguguaaguuaacaaaugauuuuuauuuuguuaguaaaggaaagguaggagaagcugauucauuuggcuuccugucguuauuccuauagaauaccucuaacauaauagauucuuaaauuagucuuuucacaaaacguuaauuuuaauggaauuacuuugauucugauucauuuuuuuaagaauagaauuuuaacucuccuucagauuuauuggcuuuugugcuuaugccuaccagguagcaucuuucaucuuuuaugacuuacuaugauagcugaaugauuuugucacacuguuucuuuuuuggaguaguuauuauuuugcugucucauuuuagcaagacuuauaccuacuuaccuucacuuuugaaaacuuuaauuuuuauguaaaugaauuuaaacuuuuuuugugguguguguuuauuuucaagaaguguaaaccugcugauagcuuucuuuaaauuuuuucuuauugauuguguugauagaaacuuucuagagcucaaguaaagcgcauuuuucugaguguuuaaaagauaaauugaggcccccuaauuucuuuggaagaaaagcuccauagccugcacaaagccuguaaguaguauuagaagcuuacauauucauacacuauaaauaaaaaggacuuuuguaagccauguaauggauuugcaguguuugcacuuaauagcacagaucagaacuccuuugcucauacaguugucugaaauguucuuccuucuucagagauagaccuguuuuuuguuuuuuauuaugaaagaaaaauaauccucauauguucucggucuaguuucuaaauagauggucaguaagcuacugugugggauuacuugggcuccauaguuugcuguguagcacagaugccagaccuaggaccauuaugugggccugagcaaguaacauccaggaguaaaaaugcugggcagguaguuuacuuuugcugauuaagggugaggucagaaaaauuaucguugaguuauaguuuacuuugggcuuauggauucuuucucuaauauaaaauagcuucauuugaguuccaggaaguagugaucguuuguaaauacucuuaggagauaaaugaaaccgggugucuuaaguguuuaaauaguggcuuuaaaucagguaguguauacuagugcacugugaauauacuugcauaaauuauucaaugaauuuuuggguccauugaguguagaguguugguuuccuaauacuagaaaaauuauaucuuauuuccuaaggauuaaguuuggagaucagauccuaccugacauuuaaaggaaguuuugcuuaagauuguuacucaaagucuguuagcucuucaacugcuaaucuggaauuguagaagggcacuuuugaaaucugacucugcuugaguaaaaaggucaguguguuggggacuugggguauggcaguuugccaaaaacucuucuuauucuuguuauagcagguauagagaauauucaaauuucuucuaagauguuugagaagaaaguuugguuugguaaguguucacaaaguagaugagaaucuuccaccaaaucuuuuuucuuauuuguuugcauaaacauuaucuuaaaguggcaugguucaucgaauuuugaacuuugaugaguuuuucuuuuacuucuuugaaaaacucuggguuuuucuuuuuuuacuuucuuauuucagaucuuaguuauaauuccuuuuuuuuuuuuuacaaaguaguucgauuuuuuaaaguuuagauauacuucacagugaagucuaugugugauagagauaagacuaggucuaaucuugguguuuguaacuuccucaggugaacugugaccuuuauaggccaagcgacugcugccucggcuugguucuuauuuugaggguuaaugacuuuggcuggaaagucuuggcaaggacuuauuuggugguauuaugguagcauuugccugaacauauucuauaaagagaaacagaauguaaauuccaggauuuaaauguguguuuuuaaaaauaaggauuuaaaaauuuagcaucaguauaauuugacccauuagaccagauauaauagcuuuaacaaaguauguugauguguuuaugugugaaaaauucacuaacuauaaaaagacucuuaaguuuucauuaguucugauaacuucugugccaaugaauggaauaccaccacuguugcaugugauugaaugcuuaauuauagacauaucauuuagguacguaaucuaugggagaaggauuuuccuuccugucucacaagaaccaucauaauauuucauauagauuauaagacagguucuucuagaaagguuuuaaaauuccuuuugcuaaugcagccuuacuauaaacuggggacuuaaugaaaucuucaauagucaucauaucaugaaucauccuuuggauaugaaauucuaaaccaaacucuuguagaaauuggcucuuuuucacuuucuuuaaaggacuuuuuaaguacaguauaagaaauuagagauuuuuauucggucuaaauucuguccagaugacugaacagcuaagacuuuaauucauauuaagucugugaaagagagcucacucucugacguauuuuaaucuguauguucagugaguguggaaagauguguugccuuuuuauauggccucauuugaaguagaccgacuuauucuacaaauugccaugaagagcaaguucuugauuagguaagaaaauacucuuuaguuaaggaccuguaaaguuuggaaguucacaaaaccaccugcacuucugacacucauugcaaguucaugguuucccaaggccacccuaaaguucuauaauuaucuagaaggacuuuaaaagcucacugaaagcuauuauacucacaguuaugacuuauggcaaaagauacagauuaaaauaggcugaggaaagacacgugggcaacccagaaaguuucaagugcaaagcuucuaguugucuucucccaguggagucauaggcagugcugacuuuucccaguaacaguauguaucauuaugcauggaguauuacccaccaagguagcucaccugagccuugggucuagaguuuuuaucaggacuuggucauauagacaccauugacugccugugaggcugaccuuuagucuccagcuccuccagagguugagcuguuaccuaucacugcauggcccagacccccccauaaaucacacuguuagacugucugguguagauaaagaacacucuaauuagucaggaaguucugagggcuuagacaucaccuccaggagccaagggcaaaggcguggccucucuggguaaaguuaauucuuuacuacacagaaccaagcuguaaggcauuuugccuuauuuugcuugaacuuuaaaaauauccgaauacaggagcugcugcuaccgucgcugcagccacggcaggcaccgccaccgcugccagaggagugggcuugggaaagaaguggucaccucacuuggagcuuugcucagaagcauccucguccccugcagcccucccacgggaacgacuggauaaaagugagcugguacagaaagccaacucacugagcaggcugagcgcuaugaugauauggcuguagucacgaaggcagucacagaacgaggcaugaauacuccaacgaagagagaaaucugcucucuguugccuacaagaacaugguuggugcccgcugcuuuccuggcaugucuucuccagcauugagcagaaaacagaggaaugagaaacagcagcagauggggagagaguagcaugagaagauagaggcagaacugcaggacaucugcaaugacguucuggagcuguuggacaaauaucuuguucucaauucuauacaaccauuuucuauuugaaaaugaaaggagauuauuuuagguauuuuucugaaguggcaucuggagacaacaaacaaaccacuguguggaauucccagcaggcuuaccaggaagcauuugaaauuaguaagaaagaagaaaugcagccuacacauccaguuugacuuggucuggcacuuaauuucucagucuuuuacuaugagauucuaaacucuacugaaaaggccugcagccuggcaaaaacaguauuugaugaagcaauuacugaauuggauacacugaaugaagagucuuauaaagacagcacucugaucaugcaauuacuugggacaguguuacucuguggacaucggaaaaccaggaagaugaaggagaugcuggggagggagagaaguaauguuucuugugcuuuguaaucuguucaaugucacucuguacccuccacguauaucccuugugugguaaaaaauaauuguauguugacuuuggauuuuucacagccucagccuagcaaaaaugguucaugggauaaacagcugguguuuguauucuaaaacucagauuggucacauaaaugccacggcauucugaaguuuugauuuugauuaacauugacaggauuacuguguguuuaauuuuuuuuaauucaacacugugauuaugggguuuuguaauuuagcaaaacucuuacuuguagaaaaaauagaccugaauuauguguaacuuuuuggaaaguuuaaucugauaccagaaucauugaaauacaauuccauuguaaaguuguacagaagguuauagagauuauauuaugaugcuagaaccuggagugagacacacaucauuuggcauuugaguuuaaugguaauucauaguaaugcugccuguuguuuggcacuuaaagacacuugaccuguuugggcuguugccacucaaaaguucaugaccacagauguccacagugucuuccucugaagaaacucgaauccugaaauuuaaauucuuuguggcagauaacuggcuuaugacaccuugaaaaguccaagugcucauauaacacaccugacuaaauccccuuuucuacugcaguguguucacuuuguuaccaauuugcaacuugugcuucaauaauggaaucuauuuucauuguuaacacugagcuaaagaaaagccauguguuuuaugaaugaccuuaucuguuuccuggauaauaccuuuaagaauaaucuucugagucaggcauggugguguaggcauauagucccaacuacuugggaggccgaggcaggaggaucgccugagcguaggaguuuaaggcugcagugcccugugguugcaccugugaaauaaccgcacuccagccuggacaacguagggagaccucaucuccaaaaaaaaaaaaaaauagaaugauguucuguagagauugccuuucacuugaggaguacugaauuuccuggcuuggggcuuuuaaauuuugaaaucaaaacauucuuucccaccauccuuuuuuuuuuuugagauggagucuugcuguguugucaggcuggagugcaguggcaugaucucggcucacugcaaccuccgccucccggguuccagcgauucuccugucucagccucccaaguagcugggacuacaggcacgcaccaccacgcccagcuaauuuuuguauuuuuaguagagauggguuuucaccauguugaucucgaucucuggaccucaugauccacccgccuuggccucccaaagugcuggaauugcaggugugagccacugcgcccggccccccaucauccuuuuugacuguugacuuugguuuucccuucccuccucucuaaauuucuguccuucugcuuccuuccuuuuuuugcuuuuugaauucuaucuuuaccugucuuuuguucacuuuuuaaugcuguauaugggcaggggugagagacauuagugagcaacuuggugagcaagccuggcuuuaaagacuugagaagaacuucuagcaccagagcucugucuuccuccaguucucaacacgguguugcucuuuagucauaccaggaucugaaucaaaaaaguauuuuuaaauaucccugacuucucccuguauugaggcuggcccugaucaugcuuuuuagugccccucaccaggucucccaagugcacuuauccagcucaacucucagauguguuuuaacgagacccuauauucagggaaguuguguggacacugcaguggagagaauugauaauaggccuaucagucucacaauaucaccccucuaccuuuaacauuccaucuagcuguagaguccaucuguuuguccaucugcugaaaugagaaaagaaaaccucaugcacugauuuaaaacaaaccaaaaaaagaaaaaaaacaaaaaucccuccuuucuaacugaacaaaaaugugcaguuaauaguuggcccuugaaaaugcaguagugaauguggagcuaagccuguuuguauaucugguagcucuuuucuugcuuuguuuuuccuuaaccaguauucugccuaauguuuucuucugugaugguuauauugucuagcaagcacaccugugguugugaaaauaguauagcaaaaaagaaaaauccuguuacugauguacuagguuuguguaugucuuuuaaacaguuccaguuucaccuuacacagaauaaucaggaaaaguguaaaacuucaaaagugaaauaaaaauuuuaucaguuaaaaacaaaaaauacccaaauacaaaaaaaaaagaucuaccaaaagcuuccugccuaauacuguaauuugaagaugagaugggcaacauggagcaauggaaaaggaggauguaugcucacugaagcaugagcugggccaccacuccuguuacaaaccaggaauuauagcagauuccuauacuuugagguuuuuuuguuucuuuuguuuuuguuuuuugcaauagcaaauaggugggaugccaggcacaguggcucaugccuguaaucccagcacuccaggaggcugaggaaggaggauagcuugagccuggaauuugagaccagccugagcaacauagugagacuaccucucuacuagaaaaaaaauuuuaaugguuacagaaacgaucuaauguuuuuucuuccuuguguuaagguguuuuaguaaaguuuucucaaauuauauugcauuuuacauuuuuucuaauccuuugaauuuguugugagagaccaaaauuauaaaucaguuuuccccucccugccaaaaauggaaaccaaagcaaguccaggagauugaauuaugguaauuaugguaguauucuuuguuaaagaauuuggauguucccuugggaacagaaauuuuuuuuucuuuuuuuuuuuuauuauacuuuaaguuuuaggguacaugugcauaacaugcagguuaguuacauauguauacaugugccauguuguugugcugcaccuacuaacucgucauuuaacauuagguauaucuccuaaugcuaucccuccccccaccccacaacaggucccgaugugugauguuccccuuccuguguccauguguucucauuguucaguucccaccuaugagugagaacaugcaguguuugguuuuuuuguccuugugauaguuugcugagaaugaugguuuccagcuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaacagugcugcaauaaacauaugugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugaucaccauucuaacuggugugagaugguaucucauugugguuuugauuugcauuucucugauggccagugaugaugagcauuuuuucaugugucuuuuggcugcauaagaaauuuuuaaagaauuuaacugccgaaggggcuuagcccugaauuaugguggcugguugggcagaauuguuugaaugaagugaagcagugauaguguugaugaugcaggauuuucuucucagucacucugcaagccagggaccucugacgagcgacacccugccugggccucccucagccaugcuaccugcugccagagacagcccucccauucggcccacuugggccgagucuggcuuacccgcugguucccgaguucuuguccugugcccacaaagaauggggaugcacugacaaucaagagugagcaagacagggaguuuuauugacugaugaaagagcuuucacuggagaggggaugcaggggugguuccccuacccaaaggugggaaaguccccucuaaguggcugaguccugcggcuucuuacaggcucagaauaggggaagggcaggccauagguaguauuggaaaaggcaacauuugauugguuaaaaggcauuauugaggaagaaucaaugggaaagggugggcaaacaggaauagaaguucucacucuaggucagggguuucauccgggaccagcaguccaaucuuucagccuucaggcuguuuuuggcuugaagguggcguuucaccggggacccaccccaucugccucagcauuuggcugccuccuguugcuguuaaugaaauccauaauuuuaaauauuuuacucuauuaaugacuuuucagcacuguuuccaaccacaugccuucaaagcaguagagcuucagcaguucauuuuucugauuuucagguagagauauugaugaguucuuucauuugguuuaauaccaccauaccauuuauuuuggagagcgcucauauauuuauaaacaauuuuaauaauuaccuucuucuacauugcagcagaagacaagagaagggaaguuuccaaaaaagcacauucuaaggacuucuaaccaucugaggccuuuucucuaggacuccuagaagauaaccaauucuguugauuucaggagaucauucagcaacaguuugccacccuuaacauuuaguauuuaggcugcauaauaaggauuauagagaccuuuccuucagaaaauagguuauuaaacuaauaaauauagugauaacuguuaagagagagcagauucuaguuguugugcugacguuuugggaauuaugguuaauggaggaaagaucauuggcaaagauuagguuucaccauaauuuaaugguagagagaagaugggaucugauguucgagagcauuaaacuuuuuuguuaguuuagaauggcuuagaguuuguugacagaguuuguugaugguuuugguaaaaagcaggaucaucuaacagguaauuagaagacccagguaauucacaaggcccuucaggaaguuugcuucccagcuacucgggaggcugaggcaggagaaucgcuugaacucaggaggcagagguugcagugagccgagaucaugcgacugcacuccagccugggugacagagugagacuccaucucaaaaaaaaaaaaaaaaaaaaaggcggcaauuaagguuaaauauacuuaacguccucacguaguauuuuauaaucaaacauaauuaaaagucaaaaugccauuuacacauuugcugauuugggacaauaacugaagaacacugauagucauaaagaauacccaaacuuauauuagaaaggggaccuuuuugaagaaaauauccagaggauguuuauuugaucugaaauaugcauggaaaugauauaauauacugauuaggaagggacauuuggaagagaauaguaaagaaucugggaauaaacaguuuaucagcuguugaauuuuuuggaugucauucuuuuuuguucaucuguucuguccuguugguaaagggugaaguaguaaaagucuuacagagggaagccuuauuaaccuguacauucguuuagggaaacugcccauucucaguccucucacuggccucuacagugggcacuugucuccuucagcuuagcagcgaagccugauguuggacuuggccugcaccaaauguuuuuccuuaguggaaauuauugugccauuuguugguuauuuaggaauaauuguaauugguagggacauagccucugucucauugagaaaauaacuaauuguagcuaauuguuugggcuaugaauagggaaacuggguuuaacauggauuaauaguaaucucuuguagggcaaguauuucugaaucaacucagauuuuuacauuauuucucaugaaacugguaacauaauuuuuuucuuuccucacauuuugaaagugucgguucauauugcccccuuuucugaagguuccugugagacaaauagaaggaacuugggaaguaagcaaguguuuuuugccucuguuuccugcaggucccaguagggauggcacaaucagcgaggacaccauccgagccucucucaucucugcggucagugacaaacugagauggcggaugaaggaggaaauggaucgugcccaggcagagcucaaugccuugaaacgaacagaagaagaccugaaaaagggucaccagaaacuggaagagaugguuacccguuuagaucaagaaguaguaagugacucauuaaagacuuaaaauuuuuggauugaauuguagccauggcagaguguucuauauguucccuggauguugugggcauaguaggaguucagaaaauuauaggcaucuuuaaacauuugaauguaauuuuuuauaccuuuguuuacaguggagccuauguuuggcauuuggucuuagauugggagggguauaauauuuagaccauuuuguuugcaccuuguauuaguucguuuucacacugcugauaaagacauauccgagacuugagagaaaaagagguuuaauuggacuuacaguuccacauggcuggggagaccucagaaucauggugggaggcaaaaggcacuccuuuuuuuuuuuuuuuuuuuugagaguuucacucuugcgcucaggcuggagugaaguggugcaaucuuggcucacugcaaccuccacccuccagguucaagcgauucuccugacucagccuccugaguagcugggauuacaggugccugccaccaugcuuggcuaauuuuuguauuuuuuaguagagacgggguaucaccauguuggccaggcucgucccgaacuccugaucucaggugauccacccaccuuggccucccaaaguguugggauuacaggagugagccacugugcccagccaaaaggcacuucuuacauggugguggcaagaggaaaugaggaggaagcaaaagcuggaaccccugauaaacccaucagaucuugugagacuuacuaucacgagaauagaaagaccggcucccaugauucaauuaccaccccugcgugccaucccuccccacccccugcuacacacacacacacacgcacacaggucccuuucugugagauacaauucaaguugagauuuggguggggacacagccaaaccuuaucacaccuuugcccuaggaaauguuuuaggcaaaggauguuuuaacccaaaggaggacuguuugagugcuugauguugccaguuacuaggaaauaaguuuagagaguucuaagccaugauaaagaucugcacaucuuaggagcagacuuaaaaggacaguacuauuuuauuguuuccaaagguugugugagccauuuuuuaaaaguauguucagggaacuuucucaauaauccagagauacuugguuggcuaaagagcuacauauaaacauagcauaugcaaccuucagcucuuuaagcuuucucauaacagacagcuaugccuuggacaguccguguguaagucagcccuauggcuuugcuuaaugaugauaaaguggaagcaucagcauaauugaagugccaauuucacgcuccauuuucauccccaugagggagaauuuauuccaguaaauguguguuuuugauggaauaguaaagaauucuuagaagguugagggcuuuguggaaagugauuuguauguacccauuagccuuacaaagugguucuagauuguaaaaugagccucgaaguagccaauuuuuagaauucaggaaagugacaccaauacaacucagagccuacaaccagcaccugcgugugauacuuugugauuagaaugcagacauuugggccucuaugcauugaauccucuucauagacugaggaaaguuacucuccuauggcaggugcccauuuguugggaagaaaaaccucuuaugauuuucuauguaaaggaaccuucugcuggaaaguaucuugucugauggcuuaguuugcaguaucauuugucgcugacaggugacaagcuuguuacugucacugaaagugcugucaccucaggauaucuccaucauuacucuauuucacucagcauaguagaucacaucuuuuccucuaccuuugaccaggguguuauuugaaacauuauucucauccaugaguuguuuaaacaugguuguuagccugucuuuuccugugaaguguuguaggugucugacaaguggauaauuauguacaguuauuaaugcuuggacuguucuguuuucaggccgagguugauaaaaacauagaacuuuugaaaaagaaggaugaagaacucaguucugcucuggaaaaaauggaaaaucagucugaaaacaaugauaucgaugaaguuaucauucccacagcucccuuauacaaacagauccugaaucuguaugcagaagaaaacgcuauugaagacacuaucuuuuacuugggagaagccuugagaaggggcgugauagaccuggaugucuuccugaagguauuucuucauuuuacguuccaagauuuuuuaacuuggguuguagaggcacugaccuugcaaaccacaaaccaagagaguuucuuuguaguauggauuaagauucuuuaucuucccaaaaaacacuaaaugagauguaggguuuugcaccaucuuuuuaccuacagaguacugaggauuggucugagcaggggaagagaagugggcugguggcugcaguucucugcccacaggcagcauuaagaugaguguaacucuucugugccuggguggaucaggagguacgaucagauuuccauugguucuuugaggucauaccaccuaaauugagaucacugauugugccaccuccauuuuuuaucuguuaauuuucuuagaguuauauaacuuuagaccaguuuucccacaucaaaguaucaggcugcccuuucaagcccucuuguaugaaaguugucucaagcuuaaugcuguuguacagaggaaaaucuaguaagcgaaguuuggcuacugcugucucuugggucauggagaacaugguuuuagggauaauagcagccacccuugggauaucugauccagcuguagcuggagccuggucaggucaugugcugaucuugccuaucuccucucacugugggggaauggccaaaccaugugccucagaagugguacaaccacaugaauggcuggauauaaaccagagacccaagagaggacucuuuuucuguacaaucucuugcuugaguggcauggcuuaggaaaagaaaguguaggucaaacuccugagccagauccugcaauguaaugcuuucccuguugaguaagccuuuauaauaugcagcuuaaaagccacauauaaugagguauucauuccaaagguuggcaggucaugaguuaggguucuuagaucccaucuagguuacaaauugucuauuuuaugccugggccuaaaucaaagccauucuaaacuauucaaacuuuucuccccucccagcauguacgucuucugucccguaaacaguuccagcugagggcacuaaugcaaaaagcaagaaagacugccggucucagugaccucuacugacuucucugauaccagcuggagguugagcucuucuuaaaguauucuucucuuccuuuuaucaguaggugcccagaauaaguuauugcaguuuaucauucaaguguaaaauauuuugaaucaauaauauauuuucuguuuucuuuugguaaagacuggcuuuuauuaaugcacuuucuauccucuguaaacuuuuugugcugaauguugggacugcuaaauaaaauuuguugcauaa

SEQ ID NO: 191777 - RNA, 57038 nt, Homo sapiens
agcggcuuccguccugcagcaaguccggaagaagguccgggggcuggaguccugggaccuagcucgggaccggccuggagauggaguucgacugcgagggccugagacggcugcuuggcaaggugcgggcaguccgcugggccaguuuggguccucagggucuugcggggggugccucugccuuuggccagguugccuccguuuugcguuucccggcuuguaguggggcuuggagccggggcggcuggucugaaaccggcuauggggcgcggccccagggaggcugaggggaccuggauucugauuucucccgcaacucugagguuucccaaccuccaccuggugcgagcccuccucauacccccagcuucacugaccucaaacagcucccagcacacgccuaaccacgccuuucucucuuucucucugcugaaauggucugccuuuuuuuucuuuuuucuugaauugcaaagcucauccuuuguaagacccaacucagucacucccuguaagauugaaucaacccuucuguuuugaaagauaucgauuaucacauuguggaguaauuauguauuuacaaaccguaaucuugcugugagccccuuugacugcagacauugugcuuuuguauucccuuccucuagccacuauguuugacaacaccauagguacuaaguaacugugcagugaaugaaagaccugaguagauuuagagaugaagacagagcuugaaggcccuggagagaucuuaauguuggaaggcuggggaguaggcgggccgaccuagaaaucugaccuauauuucugagaccugacuagccugaguuuccgguguacaaucugagggaauccccgccaauuuucuaguuaagaagacuaguuuucaccaguuuccuaguuaaggugguuuuuuguuuuuuguguuuuuuuuuuugacagagucuugcucugucccccaggcuggagugcaguggugcgaucuaggcucacugcaaccuccaccucccggguucaagccgauucucgugccucagccucccaaguagcugggacuacaggcgcgugccaccaugccuggcuaauuuuuguauuuuaguagagauggguuuucaccauguuggccagucuggucucgaacucuugaccucaagugauccacucgccugagccucccaaagugguggaauuacagguaugaaccaccgcacccggccuuaaauaauucuuaaugcuucuuaagacuuccuaaugcagaaaccauaguuuaugccauuuuuguuauacuugccucuuucuuuguuggggcaguuuacauacccgugggagguuuugaaguccuaagauugaaauuguuuauguaagugacuugaaugaauuuaucuacugcgacaggugcagaucuuguaggaagagaaguaucauaaugcuacccuuucugucuccucuucagagcaugugaaauuaaaagaaccauucaaguuuuaaugugcagaggaugauggauuguccgaugggaagaauuguucaaguuaagauucaaacauagagcauauuuuugguggcacuggaaugaaggaaaagaagagagacaaugguuuuuucaagggugagaguagaauaguagaggauuuuuuuuuccccaucagugcauagcauagagucuggcacauagguagcuuauuauuauuauuacuguuuguuuugagacggagucucgcucugucacccagguugaagugcaguggcgcgaucucugcucacugccaucuccgccuccuggguucaagcgauucuccugccuuagcauccugaguagcugggacuacaggcgcccaccaccaagcccggcuaauuuuuuuuguauuuuuaguagcgacgagguuucgucauauuggccaggcugggguagcuuauuauuaauaaguauuuguuggcuguauaaauuaaggaaaccaaucagaaacaagucagugcagcaaauauaugaaguuuccugaccauucacugcagucugcaaauaauauuguuuaauaucuagaaauaauuuuagucuaggcacaguuacucaugccuguaguccccgcuacuugagaggcugaggcaggagaauagcuugagcccugguguuugaguaugcagagagcuaugauugugccacugcuugccagccugggagacagaacgagaccgugucucuaaaaaguagaaauaaauguaaggccaggcacgguagcucacgucuguaauuccagcacuuugggagaccgaggcggguagaucaccugcggccaggaguucgagaucggccuguccaacauggugaaaccccaucucuacuaaaaauacaaaaaaauaagccaggcgugguggcccgcuccuguaaucccaucuacucgggaggcugaagcaggagaaucacuugaaccugggagguggagguuacaguggcccaagaucgugccacugcacuccagccugggcaacagagggagaccccaucucaaaaaaauaaaaaaaaaugaauuuaaaauuuuuuaaaacuuagaaauaauuuuguugcagaaaaaaucgauggagaagugaucaguacauuaaaaaauuaagcaacuauggagaaaguaaaaaaucuaauuaaauagauaucccaguuucauagaugugaagauugucaguucucuccaaauuuaucuauagggucaaugcauuucuuggaaacuucaaacugauucuaaaauucauucagaagagcagaaggccaaggauaaccuugacauuauuauggaaaaaaaauagauaugagggcugggugugguggcuuacgccucuaaucccagcacuucgggaggccgaggugggcggaucacuugaggucaggaguucaagagcagccuggccaacauggugaaaccucgucucuccuaaaaaauguaaaaacugggcaugguggugggcaccuguaaccccagcuacuugggaggcugaggcaggagaaucgcuugaacccaggagacagagguugcagugagcugagaaugcgccacugcaccccagccugagccacagagcaauacucugucucaaaaaaaaaaaaauaauaauaauaaagaaggaaagaauagaugauagauuugaggaccugcucuaccaaauaucaguacuacggcaaguaaaauuuaguguggcauugguguggaauagacuaaccagugaaacagacuaaagggcuuagaaucguagucacacauguuuggaaaugcaauauaaaacagaagacauugcagauaaauggcgaaaggagaauggagagacaagugaauauccacaugagaaaaaugaaauuguaccuuguaucccugccuuacgccaaacauaaaaauuuccaguggauuaaagaccuaaauguaaaagacaacuuuaaaaccuaaaaagauaaauguuauaggcucagaauaugcaaaccguuuuaaaauaauacacaaauaagagacaaauucaacuguauuaaaauuaagaacagaagacaccaugaagaaagugaagaggcagccaggugugguggcucacaccuguaaucucagcacuuugggaggccaagacaggcagaucuguugaguccaggaguuugagacaagccugaacaauauggcaagacccuaucucaauuuuuuuaaaaagaaaauuaaagaaagugaagaggcaagauacaaacuuagagaagcuaucuguagcacacauaacugacaaaguauugguaucuaaaauauauaaagcaugccuacaaaucaauauuagaaccaauaaauaggccaggcaugguggcacacaccuguaaucccagcacauuaggaggcugaggcaugcagaucacgaggucaggaauucaagaccagccuggccaacauagugaaacccugucucuacuaaaaauacaaaaauuagccgggcauccugcaaugggccuguagucccagcuacucaggaggcugagacaggagaaucgcuugaacccgggagguggagguuguggugagcugagaucacgccacugcacuccagccugggcaacagagcaagacuccgucucaaaaaaacaaagcaaacaaaaaaguaaauagauaauugggcaaaagauauaaauaagcauuuuuuaaaaacaggaauaaaaucacuaaucacauuucaauuguuaguagccacaugugguuuguggcuaucauauuggacaauguauguguagauuauuuccauuauggcagaaagcuuugucagacaguucuguaucauaagugggugggucaauucaccaguacuuauuauucugcaaaaagcgugugcuuuuucuuuuuuuuaaagagacagagccuugcuccgucucccaggcuggagugcagugguaccaucauagcuuacugcagccucaaacucuugggcucaagugauccuccugccucagccucuggagguagcuaggaccacaggcaacaucaccacaucuggccaauuuuuguuuuuauuuuuguagagacagugucuuguuguguugcccaggcuggucucaaaacuacuggccucaagugauccuuuguccuugacuguccaaaagucugggauuacagaugugagccaccaugcccagccaauaaguauauuccuucguuuauauuaaguguuacauuuagagaaauuaccuaguucccuaauuccuauuuucugcuccuccagcugaguuaccucggagaggcaacuuaaccuagauuugcucacucauaaaaugguaauacugcgguggcucacaccuguaaucucaacacuuugggaggcugagguggguggaucaccugaggucaggaguucaagaccagccugaccaacauggagaaaccucgucucuaccaaaaauacaaaauuacccgggugugguggugcaugccuguaaucccagcuacucgagaggcugaggcaggacaaucgcuugaaccugggcagugcagguugcggugagccgggauugcgccauugcauuccauccugugcaacaagagugaaacucugucucaaaaaaaaaaaaaaaaaaaaaguaauacuggacuuaauaaagauuccuuccugcuaaaaacuucuuuuaauaaaugauacuacaaaguauuauuauuccucaguguguccuacauuugagcaaagucauguaagaauacucuugaaauaucagucuucuaggccgagcgugguagcucacgccuguaaucccagcauuuugggaggccaaagcagguggaucaucugaggucaagaguucgagaccagccuggccaacacgaugaaaccccaucuccacuaaaaacacaaaaaagccagacaugguggcgggugccuguaaucccagcuauuugggaggcucaggcaggagaauugcuugaacccgggaggcggagguugcagugagccaagauagcgccacugcacuccagccugggcaacaagagugaaacucugucaaaaaaaaaaaaaaaaagcugggcacaauggcucacgccuguaauccaaguacuuugggaggcugaggcagguggaucacuuaagcucaggaguucgagaccagccuggccaacuuggugaaacccuguuucuacuaaagauacaaaaaauuagccagguguggugaugcgcaucuguaaucccagcuacucgggaggcugaggcaggagaauugcuugaacccgggaaauggagguuacagugagcugagaucacgccauugcacuccagccugggcgacaaggugagacugccucucaaaagaaaaaagaaauaucagucuucugaauaaauacacuguagugcagcaggcaaauuuaaaauuuuauuaaacucaauuuuucagucuuacuaauuuuuauaaccauguaauuguauuacuuuuagaaugucuuggaccacuuucuucuuuagugaaguaccuguacccuuuaagcacauggcacugcuugagacacauuucuuuagagaauguuaugcagaauuuuuaguggugaggaccaguauggaaucugucuuaauauuacacuaagaagauacacuguuuaauauguagugaaaauaaggcugggugugguggcucacaccuguaaucccagcccuuugggagggugaaacagguggaucccuugagcccaggaguucaaggccagccucggcaacauggugaaacccaucucuacgaaaaauaccaaagaauuauccaggcaugguggcacgcaccugauugugccacugcacuccagccugggugacauagugagacccugucuccaaaaaaaaaaaaaaaaaaagcuaauauuuuccuugggacagauaaaacagguacuuuuuggcucgggccgggaguggggguggguggugggugucaaaacaaaacagcaaaugaaauauuuaacuaauaguaacauuuggguuuuuaagucccgagaagagugcuuuugcugccuuugagaaacuuguguagcaguuuugcaauuaaaucaauucuaguguagccuuauauagcuauuaauaaucauguucuccaaugauuuuacggauguaaaaaauaguggaaaaugaaacaaauuauauuuguugauaauauguauauuccaggugacaacaaugcagccuuuuguacauuuguguaguguuuggaguugaggugacuucauucaguuuuguuuacacugaaucaugggcacugaaucuaggacucauuuugcccaacagacuaaacaagucuguuauaguuaauacugaucauuucuuaguuuugaugcucagugcuguggaucauaauuacuuucuaugucuacucuacucauauaaaucugccuauuugcuaacuccuauccaaaaaacauaauucuaucaaaggcauacccuguacuaaguacugugaagagcuagaacaaugagggaaagacgauuccugcucucaaguuguuuauaaucaggcuucucuucuagcaaauucuuccccaucuuagaaugaccuucccuuuucccccuaauuuucuuuuuuuuuuuuuuugagacagugucucgcucugucacuagagugcagugaggugaucccagcucguugcaaccucugccucccggguucaagugauucuccugccucagccuccugaguagcugggauuacaggugcaugccagcaugccuggcuaauuuuuguauuuuuaguugagacgggauuucaccauguuggccugucuguucucgaacuccugaccucaagugauuugccugccuuggccucccaaugugcugggauuacaggcgugagccaccaugccuggcuuaacuacuaauuuucuauacuguucuagacucuaggcugaaauguagauucagcuucuccagaggccuuucucuaacuuagauguucuuugugucaauuuguaguuuccugccuguacuuacuauuguauacauauuuuguuuauuaucucacuuuuacauauguuaauuguaagaccuucauacacaccuguugaaguuuguaggcaguagagcuauaucuuuuuuuuuuuuuuuuuugagacugagucuagcucuuguugcccaggcuggagugcaauggcaccaucucggcccacugcaaccuccgccuccuggguuuaagcgauucuccugccucagccucgcaaguagcugggauuauagucgccugccaccaugcccggcuaauuuuguauuuuuauuagagaugggguuucaccauguuggucaggcuagucuugaacuccugaccucaggugauccacccaccuuagccucccaaagugcugggauuacaggcgugagccaccgcgccuggcgagcuguaucuuuuuugcaggugaacaacuuaaggcucugagagaggaaacaggauccacuagcaauccucuuccauuuucucccaaacucccacaauccuagguuuccacuagucuacuuuguguuucuauguauuugccaguuggagauauugcauauacauggaaucauaaaauauauagccuuugugucucauuucuuuuauuuuuaauuuuucuuuuuuuuuuuuuucugggaagcacagucuuuguccaagaccagaggcaggcacuuccugugucuaguuucuuucacuuagcauaguguuuuuaagguucauccauguuguagcauauauuagcauuuuauuccuuuuugugguugaauauuucauuuuauggauaugccacauuuuauucauucauuaguuaauggacauuugaauuguuuucacuuuuuggcuauuaugaauaaugcugcuaugaacaauugcauacaaguuuuuguguagguacccguuuucauuuuucuuggguguauaccuagaaguggaauuaauugcucagucauguaguaacccugacucuguauuuagucuuuugaagaacuaccaggcuguuucccaaagcagcugcaucauuuugccacuggcagugguguaugugugagaguucugauuucuuuacauccucuccaacacuuguuauuuucuccuuuugaugauaaccugucuuuugauuauaguaugaauccaccagcuguuuuguucuuuuuccugaucguuuuggcuauucuaggucccucgaauuuccaaaugaauuuuagagacuguaaaucuuugccaaaaaaaaaaaaaaaaaaaaaaagccagcugggauuuugauagggauuauguugaaucuguugaggaaaauugccaucuuaacaauacagucuucaaguccgugaacaagggaugcuuuccauuuacuuuggucuauuuuauuuuuuucaacaauguucuguaguuuucagagucuaaguauuguaccuuguuaaauuuauuccuaaauauuuuauucuuuuugauaccauuguaaaaggaauuguugucucaaauccauuuucagaaugguaaacucuuaauauacuuauuuucuuucauuuaaaccuaaccacuaguguaagagguaaguauuauuuauuuuugcagaugagaaaauaagcuuaaagaauuuaaaugauuuugcccacaagacaaccaagucaguaucucugagaagacaucuggauaaaugaagaggcaguucacacaccugacuacaaaacuugcaugcuuuuguuuuccauuugaaacccaggaugcagugccaggaaggugggaggggaaagucgagguaucucaagugaaugagccgugccaaaaagacgguuggauccugcauaguggugagaggggugauccauucugccucaucauuuaagcugucuggagguauuuggaggcaguuugauuuagagauuaaagacucugguccuggauuugagcucgggcuucacuauuuaacuugcuauaugacucagcaaguuacuuugauucucuagcuuucauuuucuucuccugcuccuauagagcaguuguaaagcccuaccuaccugguaggguuguuguuaaaaagauuaaaucaaauaccauucuuguuugcagagcucagggccuaccacaccguaaauugucaguuaaauauuaacugcaggccgggcgugguggcucacgccuguaaccacagcacuuugggaggccgaggcaggcagaucacgaggucaggaguucgagaccagccugaccaacauggcaaaacccugccucuacuaaaaauacaaaaaauuagccaggcgugguggcgugcgccuguaaucccagcaacucaggaggcugaggcaagagaaucacuuaaacccaggagacggagguugcagugagcugagaucccgccacugcauuccagccugggcaacagagugagacuccgucucaaaaaaaaaaaguuaacugcaauuguucuuuugcuuacagcuuuauucuuacuccaugcuuauuuuucucuuuucaguacaaguucagggaccuaacuguggaagaacuaaggaauguaaauguauuuuucccacauuucaaauauuccauggacaccuaugguaagaaucauauccucuaguuuaaaugcugcauuauuugaacuacuaauuuuugguccuaaagagcugcaaaauuguaauuucucuuuuucucuuuuauccucugauuuucagcuauacuuuaugaccugcaauuucugagaaagcuuaaauuaauacaauguaucuuguauuaguuuucuauugcugcuguaacaaacuaccacaaacuuaguggcuuuaaaaaacacacguuuacuguguuauaauucuguaggcaagaaguccaccacaaauuucuauagcuuagaaaguaaacuagagguuugacuuggcuaaaauccaggugucaacugccuuuguuucuggaggcucugggagauaauguuuccuugccuuuuucaguuucuagaggucacccacauuccugggcucuuggucuccuuucuccaucuucagagccagcaguguugcaugucucuaaccauucuucuauagucaaaucgcccucugaccacagcugggaaagauucucugcuuuuaaggaccaaugugauuagauuagacccaccccaguaauacaggauaauuucuucaucucagacuccuuaauuuuuuuaaggcuagccaagugaucagagucacuaaucacaucuaaaaaaucccuuugccaaguaaggugacauauucacagguuccaaggguuagauauggacaucuuuaaaggaccuuuauucggccuaucauauguauaugguugauucuaaaucauuaacaguuuuaguuauucuguucaccuaauaguaagaauuugguuuucuaagaaauauuuuacuuuauuaucuuaaucuuucuuuuuuuuuuuuuuuuuuugagauggagucuugcucugucgcccaggcuggagugcaguggcaccaucucagcucacugcaaccucugccuccuagguucaagcgauucuccugccucagccuuccgaguagcugggauuacaggcacccaccaccaugcccggcuaauuuucuuguauuuuuaguagagaugggguuucaccauguuggccagucuggucucgaacuccugaccucaauugauacauccaccucggccucccaaagugcugggauuacaggcguaagccacugugcccgaccaugggcucuuuuaugaagacacuagucucauucaugagggcccaaaggccccccuccaagguaguuugauuguuugaaaccagagauaguguuuccuguacucaauccugagauuagggcguugauucucuaucagugugucccaguuacugaugggaaaguugaacuuucagagauaugaauguugaaaagagguugagaauaaugaaauuagagaaaccaaagaagguaauuauugaucuaacaguuugcuuuagaaagcaaugcuggcaguuuuucuucugguucuaaaagugacuauaacugauuuuguuacaugcgauaauguuuuuuuguuuguuuguuuuuuguuuuuugguuuguuuuugcgggagacuggagguugguugguugguugguuuguugagacguagucacugucuguuugcccaggcugcagugcaguggcacgaucucagcucacugcaaccucccccuuccagguucaagcaauucucaugcaucagucucucuaguagcuggaacuacaggcgcaugccaccacgcccugcuaauuuuuguauuuuuaguagagaugagguuucaccauguuggccaggcuggucuugaacuccugaccucaagugauccacccaccuuggccucccaaagugcugggauuacaggcaugagccacugugccagaccuggaauuuuacuguuacucaaaucagucgccccgagcauugugagaacaguuuuuaaugacagcuugguggguggggggaagccagugagccaggagugcugauugguuagguagaagaugaaaucaugggaaguugaaguuguccucuugcucuaggucacuucccggguuggggccacaagaucagaugagccaguuuaucaaucuggguggugccagcugauccaucaaguguagggccugcaaaauaucucaagcacugaucuuaggagcaguuuagggaggaccagaaucuuguaagcuuccaggugcaugauuacuaaaccauaauuuuuauuuuauuuuacuuuauuuauuuauuuauuuauuuuucugagauggagucucgcucuguugcccaggcuggaguacaguggugugaucuuggcucacugcaaccucugccuccuggcuucaaguuauucuccugccucagccucccgagcagcugggaaccaccacacccggcugauagagaugggguuucaucauguugcccaagcuggucuugaacuucugaccucaaguaauccaccugccucagccucccaaggugcugggauuacaggugugagccaccgugcccggccauaaaccauaauuuuuaauuuuguggcuaauuuguuagucuuacaaaggcagucuaguccccaggcaagaaggaaguuuguuuugggaaagggcuguuauugucuuuguuuuaaacuauaaauuauaaauuaaguucuucccaaagugaguucagccuaugcccaggaaggaacaaggacagcuuaaagguuagaaggaagacggaguugguuagguuagaucuuguuugcugucucagucauaauuuugcaaaggcaauuucaaccccucccuuuggauuuuuaaaacaccuuaaucuuaagguguuggcuaaugaaaaugggaaaaggccgucgaucacucuggcuucuuccugcugagggggcguaguggagguagguguugacaccgaggugagaggaguggaacugcuuugcaacugacauugacaauuauuuaauaauggccccacauauuauaguacuucuuaaguuuucaaauuuucucauuugauccuuaugacaacuuuguaaggcagucuuauuaucuuuauuuuauagaugauaaaacugaagaucaaagaugauuaaagucaccaaaagucacauuccucuaaguggggaagguggcccuagaacuugggguuucaguaucaaaguccuguauucuuucagcuacccuuacugcuuucuaaguaaacaacaucuagucauuuccucuuguugacagauuuaccgauuccuagauuauguuuagagauuguguguguauuuguguguguauauucaugagcacacacaugugcacacuuacauacuuuacuacaguucuuucuguuucugauugcacauuuuggggcuuuuuuuuuuuucuucuaguuuuuaaagauaguucucagaaagaccugcugaauuuuacuggcacaauuccugugauguaucaggguaaguguggaaguugaaaaaaugugugaguuuucuaaaagagcaguucauuuaauaacuuaaauuuguuuaugccauaacauucuuaaaguauuauugcagauauaugaccuauacagaaccuuacuggaucuguuccagucaaggaaggccuguauuaaugucaacaaguucaguucaauucaacaaauacuuacuaucaacuagauaaaucaaauagaacagcguaacuucgaucucuuaaaaagaguucagcauuguacaaugagaauacauugcccaaaagacacuaggaagcuguauuuuggggggacuucuuucaaaguaggugcuucuuugugguagcuccuggauuaucacaaacccccuacuaccacuacucugaaaggcuccaggguacaaaggaaagcaagacagacauaggccugcccuuggggagaguuacuuuuuucuucauuacaccuauauuuuguuccccuccuuuccucucuaugugauauagcauuaucuccauuccauaggugaaacugaaucuuagccuggucugauuuaccuaagaucacauagcuaguguuagccugaaacucagacuccaauaggaaaauuuuacaacacagaagccauuaaagcucaaagaaaggaacacauuuuagagugaccuagcaguuuagaauagcuaaguguuugcccaaaaauaaaagaaaacaaaucacugacuuuucuuacacuuaacucuucccauuuuuccagaccuacuucuccuguguucaucaaggacuaaccuuucagauaagaaucacaagagguugcuuauauauaguaugauuuuaagaacaccagugaaucuuuguuuccaaauauuuaucugaaguggugccugaaauuucaccauuagaaauucacuguucuugccgggugugguggcucaugccuguaaucccagcacuuugggaggccuaggugggcagaucacuugaggucaggaguucaagaccagcccggccaacauggugaaaucucaucucuacuaaaaauacaaaaauuaggccugauggcacgugccuguaaucccagcuacucagaaggcugaggcaggggaaucucuugaacucaggagacagagguugcagugagccgagauugugccacugcacuccagccugagugacagagugagacucagucucaauaaaaguucacuguucuuuugaaaugcaaauaaucccaggacaaauaacauccauaaucacuaauauacaguuaugugcuuaaaggacauuuuugguauuuguugaacaguggaguuaguuugauuauugacugaagggcuuaggaauaaguggcuuacuggggcauuugaaacagaagauacacugaaaggggggcugagaaagaucuggaaaccaaauagggagagaacagcguaacuuugaucucuuaaaaagaguucagcauuguacaaugagaauacauugcccaaaagacacuaggaagcugcauuugcggggacuucuuuuaaaguaggugcuucuuugugguagcuccuggauuaucacaaacccccuuaauuccccacuccccacccccagucaugacuuguugcuagagaugcacucauguuuuguucugcuucuguguaugucccaccaugauaccuccuuuugcaauaguaggcacucaggaaauguguaggaauucauuuuguuuuuaugcauaggagaauggauggagaugaaugcagcuagccaugggauccaugcagagauugcagagugaaguaggcagaacaggcauagaguugauuuuucuuuucuuuccuuggucuucccugccaagcuuuuagacuguuuccuggcuguguagagaauuuuacucagaccuguuccccuuaaguuguauucugaauuuaucuugguuagacguugaaaagaaagggaagggaaggguauuagggaaaggaggaagggagaggaagagggaaggaaacugauuaaggugauucauucugagagauaaaggcuaauucuuaacccaccccaguguuuucaaggguaguugcauauuaacagaggagcuugugaauuuaaaugaauuacugcuuaguagcauuucgguuucuaauacagaguagggcgguaacaugagggcagaaagguuaucuuaauaccauugguaaaaucccgcugauuggcacuaugccuguccugcagucauugaguuaugucauugauucuuaugcuggggucuuccucaggugcuccccccaccuuuuuuuccugcauuacacuuuuccuuugcuuuggaauuauaucaacucagugugaaugcacacuaauuauuuccugcugaucagaaggucagaauguauauuaucuuucucaucuguaaaaugggccaauaguagagcccaccucagaguuguaaggcuuaaaugaauuacaguaaguaaagcucugggcauagugccuggcauauagugugugccaguguaugcucaguaaauguggccauuauuauuugucugccuuuuuuuuuuuuuuuugagauggaguuuugcucuuguugcccaggcuggagugcaaugguaugaucucagcucacugcaaccuccaccucccagguucaagcaauucuccugccucagucuccugaguagcugggauuacuggugugcaccaccaugcccagcuaauuuuguauuuuuaauagagaugagguuucuccauguuggucaggcuggucuugaacuccugcccucuggugauccgcccgccucugccucccgaagugcugggauuacaggcgugagccaccgcgcccagccuugucugccuuuauuacucucuuuuaguuaacuaguuuuauuaguguaaugauuauacaugcuuaugcuaaaaaaaauuuaaacauuugggaagggaugaagugaagccuauaucuauccucccaucugcauggaacuucuguuaauauuaccuuauguuuaccucuagaaauuuuugguauuauuucuuauacagccaacauuguguuaaguuauaaugauacuuuuucuucaaacacucauuuuuuagagauguauguaaucuuuuuuucuuuuacuuuuuuuuugagacggagucucgcacugucgcccaggcuggagugcaguggcgcgaucucggcucacugcaaacgccgccucccaguuucaugccauucuccugccucagccuccugaggagcugggacuacaggugcccgccaccacaccuggcuaauuuuuuguauuuuuaguagagaugggguuucaccguguuagccaggauggucuugaucuccugaucucgugaucuguccgccuuggccucccaaagugcugggauuacagacgugagccaucacuccugggcuguucuuuuucuuuuaagagagaggguguugcucuguugccuaggcuagaguacaguggugugaucauagcuaacuguaaccucaaauuucugggcucaagcauucuuccugccucagccuccugaguggcuaggacuacagauaugugcuaccacaccagggucuugcauuguugcccaggcuggucuugaaguccuggacucaagcuguccucccauuuuggccuaccaauguaucaucuuaagaucacaccuaucuaaacuuuguuuacauccaacuuaaguuauguucuuaugauauaauuccuuuaaaucugaggacuuugugccaggaguucggacucuucagugcugaauuacuaaaagcuagaugugcaggguaggagucaagguauuugcugauaggaaagagggaaggaagaagagacuagugaacuaguggugaaaucuuaacguuuagacacaggaaucugagucaccaggugcuuugccagucaugggcuguuaaaaugcaagaauacugcuggggaggggcauugguggaggcagauccuugaucaaccaggggaauaccuucaauagacauuuuuuguuuuguuuuguuuuuuugagacagagucuugcgcugucaccuggcuggagugcaguggcgcaaucucggcucacugcaaccuaugccuccugaguucaagccauucuugugccucagccccccaaguaucugggauuacaggugcuugccaccaugcccgguuaacuuuuugaauuuuuaguggagaugggguuucaucauguuggucaggcuggucucaaacuccugaccucaaguggucaacccaccuugaaagugcugggauuacaggugugagccaccacgcccggccuucaauagacauuucuuuccuuuucuuuaauguguagugauuaauguaggaagugacuccaucaggauuugggcugccacucuggcuauauuaguaaacauuuuugaaaauuugauuuuuuuuuuuuuuuugagaggcaggguggaugauuuggccauuguuuuaauuaaacuuacucaaauguuauaccagugaucuaauaggaacauauuuccaaugugaauguggaugaaaugggggggaauaggccuugauuaacauuaauccuuuauauguaaaccugacuagacugcucauuucuuuucuuuuuuuuuuuuuuuuuuuugaaacagugucuuacuccguaacccaggcuggagugcagugacacaaucauggcuuacugcaaacuucaccugccaggcucaagucaucugcccaucucagccuccccaguaacugggacuauaggugugugccaccacacccagcuaauuuuaaaauuuuuuguagagaugggguuccuccauguugccuaggcuggucugaaacuccugggcucaugcaaucugcucaccucagcaucccaaagugcugggauuacaggcuucagccaccaccccagccuacucauuucuuaaaaugccgccuagcuauaucauaaugugugugcuuuauuauuguuugaagauauguuucuuuugucucaaauagguaauacauauaacauaccaauucguuucuggauuuuggauucucacccuuucgcucccccuauuugcuucuugaagccaacugcaaauaugggaaucuuagucggaaaacauguggaugcucaaggcagaauauauuugcccuaucuccaaaacuggagccauguaagaucaauuuggauuuucuacagaaagcuuuuuuuuuuuuuuaaauaccuaucauugauucugcugguacaaauaaguaugauacugcauuuucuuucaaugauauucuucauguagucuuuggaaguaauuugaaauugagcucucuaggguuacccaagucccagaacccugaugacaacugccuguacaaagcugcucccuccagguuuuggagccaacuguuugcucccugucuuuuuauagucguuucccacuugagaaaguacaggaggagcuacuagcaagugauuggggcauuauuuccaagucccuuccuauuacagauuuuuauguuauauuuauuuguaguuuugccuguuuuugacuuucauauaaguugaaucauacuguauguaaucuuuugugacaugcuuuguuuuaaccaauauuaaguuuuaaaaagucauccacauugaucuauauaacuguaguauuuguuuuauguccucauguuauguaauuuuguauucugcauuuuucauugaccauuauauugagcauuucuccauguuaaaccauuuucaaaauacaugguuuuuaaugguuaccugaugacagcauaaggauauugcguauuguauuuacaaauugcccuaacguaagacauuuaaugaugaacaucuuuaaauguaaauguuuguauauaucuaauauaucuuugauacuuccguaaugauaaaucucuuggaguagaauuauugguccaaagguuuucaauauuuucaagauuuucuuauauauuacuaaauuggccuccaaaaggguacacaaaaugauacauuucuauaaucaguagaaaucaguguaggaggguaccuauuuuacaguaccuuuucucuaauagaagguauuauccuuaaaacaaaccuuugcuuaucuucuauacauugguuuagacagauguauaguauucucucauuuuuguaaauaauuaaaaaucuguauaaaaggauaauuuauaauauguuuauaugaggccaggugcaguggcucacagcuguaaucccagcacuuugguaggccgaggcggguggaucacgaggucaggagaucgagaccaucuuggcuaacgcagugaaacccugucucuacuaaaaauacaaaaaauaagccaggcgugguggugggcgccuguagucccggcuacuugggaggcugaggcaguagaauggugugaacucagaagguggagcuugcagugagccaagauugcaccacugcacuccagccugggcgacagagcgagacuccgccucaaaaaaaaaaauauguuuauauguaccagaaagcuaguagggcuggaggacagggguauauuggaguccagugagguuggaguaaagaaugccuuaggauuaucacuuuuuauuuuauagacagcuuauaaaaagguguauaauuguagaugcauuuuacuuuguuuuaugguuuucuauauuuuuauauagaaaacauuuaaaaagaagaaaaaagaaauagaaaaaacaaaggacauacuucggauuaucaguaguaggaguugacauuuuacuuugugaacauuuauguuauuugcauuaccugaugauuuaaauaagauugccaguuaaaugugaugaauggggcauaauaaaaauuugucaguuggaaggacaaaaauggaucuuacucuuaauuuucaguuguuugguuauuugagaaauugaaaucauuuucauuuacuuaucaaucguacguuucuuccuuuuugaauugucuguuucucuccuccauccauuguuacacccuucuuuaaacaaaacaaaacaaaacuauccucgaguaguauuuugacaucuguaccauguugcaggaauucauguauccuguuucuucucucugguuuucauuggcaucucuuuucauaauuuuguuuguuuaauaaauccucggggauagucuuauaaucuagugaaaguuguguuuaauuuuaguuuagacaguucugauuuuauuuuacuguucugagccucuuuauuauaagcuaaaacuagucucuuuuuuugagacaggguaaugcugucuucacccgugcuggagugcaguagcacaaucauagcucacuguacccucaaauuccugggcucaagugaguuucccaccucagccuucugaguagcugggacuacaagcauggucuaccauccacuacuaauuuuaaaauuuuuuguacagacaggaucucccuauguuguccaggcugguauugaacuccugggaucaaggcauccucccaccucagccucccaaagugaugggauuacaagugugagccacagugcccccacuuaaaacuagucuuaaaaagacauuacauuauuuaaauugcccuauuuaaaaguacugcagcaccuuuaaguuccacaugcaguuggaauuauaauuauguagcauaauuuuauagaacuuuggagcuagaaggaaucuagaggucaucuaggccaggguuugcaauuucucugagagauucagagggccgcguuaggccuauggaauuuguuugaacagcacaguucguuuuguuuuaccuuguuuuguuuuguucuuaauguaaauuugaaugccuauuggcaugcuguuuccaauuugccacaauaaccgucucuccagauuuucuuguacuugccagcuucacacauuuaacguuaccugcuugguccccaaagguauuugaauucuuggcccuaauagccucuucuuacuuuauaaauagugaaacucagacucugagaaauuaagcacuuuuuaaaugagcauacuacuaaauauucccaggaauaauaauaaacaucuguuuuacacucacggcguauaguuugcauucauugacucauuuauugcucauaacaaccauuugggauuuauuauucacuuuguauuacugaugacacugaagcucagaaagguuagugaauuucaucaagguugcuuaaccaauuacauuaaaagaauacaguaccagauuagauacuauuaguguuaauuuucugauuugauaacgguuaaaaggagaaugucuuuuucuuuuaggaaauauacauuaaaguacuuagggguaaaaggacaucauguuugcaguuuacuuguucaguuuguucagaaaaacuagagagagaaagacuaaacaagcaaaugugaucaaauguuaacauuugaguaaucuaggugaagaguauauguacuauuuuugcaacuuuucuguaagucugaaauuauuucaaaaugaaaaguuaaaaaaaggagaguuccuaaaccuagguauucggcuauuaagcauauucaugcuauuuuucuacuuuugggaaauguugaauuagcauuucuucuuccuuuauuuuucaguuaaaaguauucaguaauuuuucaugaaaagcauuacaacaguuaaaaguaucauauaauguguaugaugauuuuugaaaaaugagaacaugauugaaugcuucuuuuugacuaacucuaaaagaauguauagguuaaaaaagauuuuuuguuuguuuuguuuggagaugaagucucauucuguugcccaagcuggaguauaguggugcaaccauaacucacugcaucugaaacuccugggcucaaguaauacuccugccucaacaaagguaguauucuucagcaaaauuuuuguguaacuuuucuguuuuuuguguauucuacagccuaaaucugucauuguuggauuaauuaaagaaaugauugccaaguuucaagaggaacuucccauguauucucuaucaucaucugaugaggcacggcagguagacuugcuagccuauauugcaaaaaucacugaagguuuguauauuugucaggcagauuaucuugagaguuaugaguuaccaguuucucacuaaacuccuuuacuuucugccacuugauuuuuauaaauaaauuugugugcguauguacaucuguuuuugaaauaagaaauuccugugccucaggccaggcgcaguggcucacuccuguaaucccaggacuuugggaggcugaggcaggcagaucaccugaggucaggaguuggagaccagcuuggccaacauggugaaacccuaucucuacuaaaaauaaaaaaaguagcugggcgugguggcaggugccuguaaucccagcuacuuggguggcugaggugggaaaauugcuugaauccgggaggcagagguugcagugagcugagauugaacaacugcacuccagccugggcaacagagcaagacuccaucucaaaaaaaaaaaaaaaagaaaaaaaaaguaauuccuuugccuuuaucacaggguauuaccauguaauuccaauaaauauuauuuauuuuuuuauuuuuuugagauggagucucgcugugucacccaggcuggagugcagugguaccauaugggcucaugcaaccucugccuccuggguucaagcgauuccccugcuucauccucccauguugcugggacuacaggcaugcccagccaauuuuuguauuuuugauaagaaugagguuuugccauguuggccaggcugguuuugaacuccugaccucaggugauccucccgccuuggcuucccaaaguucagggauuacaggcaugagccaccgggccuggccagguuucuuaaaguguaaagaauuggucuuaaacagauaaaacaauucuuguucaaaaccacuugcuguauauuaaugaucccaaacuuuuuuucaugauauguauauguggcuuguuggcuuauucaauauauuggaucagaauaucuaugauucucaucaagaauaaaggcaaauaccuauguuugaaacauuugguaagguguuagacauauuuuuuuauuguagaccagagcaaugaguuggaauauuuuucagaauuauggaaauccuacuuuuuuagagucuuauacaauauuuuaaaaauguuuagaaagauacauucucuuuagaaggauaauuucuauuuagucgacuauuuaauaggaaacgucugccuuccuugcauucauuuguucaguaguauuuuuugcccauuauggacuagcaccauauuuucucucuaagcuaugaagccugcuauauauuuuuuuuaaagauccuaaaaaaauucuugauauuuuugaauucucaggauaauucaccuuucuuucuagguguuucagauacaaauucaaagagcugggcaaaucaugagaauaaaacagucaauaaaauuacugugguuggagguggagaacucgguauugccugcacauuagcaauuucagcaaagguauguaaacauagugguuauaaauacaucuaucauagugccacacuucuaggcagguuguguuuuacacaccaaaaaaugccuucauuuugucgugggaaaaccuuauuuuggcuuaaaauauauuuaguaaguugacaaaaaaguugaaagcuuucaucagugauguugccuuuuaauuaguagguuuaaaaaagugauuugaacaaugggcuuauccucauccaagggaaagcucaauuugacauucauaugacuuaaucacaaauucuuuuguauuuucugaaucaugccacuuuaauuaaacucauuuaauguaguaauuuuagcucuuucuaaaauuggcuuuuuuuuuuuuaaagauggccuuuucuuacauaauuacuuucuuuuaggaucacaguuucugaguugauauuuaauacuaguuuaggguuuguuuuuuucaucaguccuuuuuacuagugucugcauaaauuguuugcaggaaagcuuaaaugcccuuccagagagguucaaaagaccugccugccucccuccagagccuaguaucaugauaacagcaugucuuuugucauuugagagauguagcccugaauagaauagcuguaccucuauauauuuauuugguggcuggcauuaguuuuucuuuucuauauauauuugauuguuuugccaucuaaauucuucccuuuccauuuaagacucacauaugucuuggagguggguucuacugcagcaaauaauuaaauuauauccauggagcuagaauaucuuaaaagcuggcugcucagaguuaaauaugccaacuuuuggcaugcuguaguuuuauuucuuucacccuccauuugaauacacuaucaccucuuuuuuuuuuuuuuuuuuuuuagguggagucucgcucuguuacccaggcuggaguguagugguacaaucuuggcucacuacagccuccgccuccuggguucaagcgauucuccugccucagccuccagaguagcugggacuacaggcaugcgccacgacgcccagcuaauuuuuguauuuuuagcagagacaggguuuugccauguuggccaggcuggucucgaacuucugaccucaagugauccaccugcccuggccucccaaagugcugggauuacaagugugagccaccguaccuggccugcuauuaccucuuaauuagaauuugaguuguauucagucuuuugucacuaaauaaaugcuucuauaaacauuucaaguugcuuguuuucucaucugaauuuuuauuuggucauacauuauuuuauuuuauuuagacagggucauguucuguugcacaggcuggaaugcaguggugcaaucucagcuuacugcacccuccaccuccccagcucaagccauccucccaccuuagccucccaaguagcugggcuuacaggcgccagcaaccauccccacuaauucuuguauuuuuuuguagagacagaguuucaccauguugcccaggcuggucuugaauuccugggcucaagcaaucuuccugccucagccucccaaagugcugggaguacaagcaugccccacugcacccggccugguuguacauaauuuuaaaaaauaguacuagugagucagagggcaugaaugguuuuuauagcacuuaugacauagugccagauugcucuuuggaaaggcagaacuaauuuaugcugcuaauaacaugcacaucaaccugauuuuugacaucccuaacaguacuaaguuuuauuuauuuguaauuauuugucuuuuuuuuuuuuugguaagcacaagaaggcaucugaaagucugaaagucaugguuuuucauuuuuguuuuugagaccagguuucucucuguagcccaaguuggcaugcacugguaugaucauggcuuacugcggucucuaucuccugggcuuaagagaucuucccaccucagccuccugaguagcugggaccacaggggugugccacuacaccuagguaauuuuuaguuuuuuuguagagauaggucucccuguguugccuagauuggucuugaacuccugguucagacuaucuuccugccuuggccucccaaagugcugggauuacaggcaugagucacugcuccuggccauguuuuuaaacuguuagaagaaucucacugucauuauuugucugugaauugucuggguggaaaauuugccguuuuucagcugggcccgguggcuuacaccuguacucccagcacuuugggaggccaaggcaggagaaucaguugagcccaggaguuugagaccagccugggcgacacagcgagauccccauuucuacaaaaaaaauuuuuuuuuuuuucuuuggagauggagucucgcugugucucccaggcuggagugcaguagcaugaucucagcucacugcaaccuccaucucccggguucaagugauucuccuaccucagccucccgaguagcugggauuacaggcgugugccacuacacccagcuaauuuuuguauuuuuaguagagaggggguuucgcuauguuggccaggcuggucucgagcucuugacaucaggugaucugccugccucagccucccaaagugcugggauuacaggugucagccacugccuccacccuacaaaaauuaaaaauuagcuaggugugguggugcacacugguagucccagcaacuuggguggcugaggauugcuugagccugggagguugaggcugcagugagcugcgauugugcaguugcacucuagccugggcgacacagugagacccugucucaaaaaaaaauucuguuuuucuuuuuagacguuaauauuuugauacaaaguacaauauucauaggccacuauuaugacugcaacagugauaguacucauaauaguggcaacaaaaguaguggugguagcagcagcaacuaaccuuuacacaaugcuuauuagguaccaggcacuugucuaaacacuugacucuuuuuuuuuucuugagauggagucucgcucagucacccaggcuggagugcaguggcgcaaacuuuuuuuuuuuuuuuuuugagacgaagucucgcccuguuccccaggcuggauugcaguggcgugaucucagcucacugcaaccuccugccuccuggguucaagugauucuccuuccuuagccuaagauuacaggcacccgucaccacaccuggguaauuuuuguauuuuuaguagagacgggguuucaccauguuggccaggcuggucuugagcuccugaccucaggcaaucugcccgccucggccucccaaaguguugggauuacaggcgugagccaccgugccuggccaguagugugaccuugacucaccacaaccucugccucccggguucaagcgauucucccaccucagccucccaaguagcugggauuacagguacgugccaccaugccugguuaauuuuuguacuuucaguugacaugggauuucacuguguugguaggcuggucuggaacucacuccugaccucaggugaugcaccagccucagccucccaaagugcugggauuacaggcaugagccaccgugccuggcccacuugacucauuuuuacaacaacccuuuguuuagguacuguuauuacugacauuuuacaaaugaagaaacaaaggcauagggcgguuacccaaguugccccaaauuacacuguuaauaaaugaugaagcgagaauuuaaagaccagguaaucuguuuaucagagccuguauucuagauccuuacuaaacaaaguguggcuuucaaacuagcagcauugguaccaccugaguucuugcuagcaaugcauaauccaggacccuucccagaccuacugaaacaaaaucagcauuuuuuuuuuuuugagauggagucccgcucugucccaggcuggagugcaauggcgcaaucuccacucacugcaaccuccaccucccggcuucaagagauucuccugccucagccucccgaguagcugggacuacaagcaugcgccaccaggcccggcuaauuuuuguauuuuugggagagacaggguuucaccauguuggcuacggggcucucaaacuccugaacucaggcaaccaaccugccuugguuucccaaagugcucagauuacagggcugagccaccaugcccggccaaaaucugcauuuuaauaaaaucccuggugauaauauaugcuucacggauugauuacauggugacauuuuaaaacuuuuucaaucucugcuauaaaccacuauauugucucguuguuacugaugaacguuuuguuguuccuagucuuaugaauauccuuaauauuguacucuuuuacacauguacugauaaauuuguaggaugauuucuauaaaugaauugauggauucaagaaguuaauguuuuaaauuuuugauagaaaauugucaaauuaucuuuuauuaauuauaccaguuuauucccauacccauaauauguaagaauacuuauuuuccuacaacuacugcuaaacuuuuggauuuuuuugugccuuauaaaugaaaaugguaacucauaguuuucuuugcauuuuccuuauggguaugguuagcaauaaaauuaauaacuauguuuuagaggggauuacuauaugcaagcccugugucacauaauuaauccuuacaaccucauaaaguaaggccgaauucagugacuguccugguguuacauagcuaauacauaguguagcaggguuauuuucuuucucucucuguguguguguguguguguguguguguguguguguguguguguguguguagagacgggguuuugccauguugcccaggcuggucugaaacuccuggacuccagccuaugcccauccuguccuuccaaacugcugggauuacaggugugaaccaccgugcccagccaggguuguuuucuuuaccaucacacuuucugucugauagucugguagaucuuuggguacuuuugcccgugaauccuaaaauaggagauaucuucaagucuccuacuacuuugaagaaagaccuuccauaaagguaaacugauuuuuaggaguuuccaugcuguuauuuacagucagcccacugugccgcccuauuuacaggcauguggaguauuuuccaugagaucucuggggagaguacugcaugauaauaggauuugauuuuagauuuuauagcuauuauacuuuuuuuaagaaaaagcuggcauuauuuuuuuaacuuuucuacuagaaauaagacacacaaauagacccaaaagcacuuucagaaugaaaaugauaacaucaaaaugaaaacauaaaucaagagcaauagcagaaguauugagugcaccaagucaucuuuauuaacucaucccauuaaaagaaaccugcaggggccaggcauaguggcucaugccuguaaucccagcacuuugagaggacgaggcaggcagaucacuugaggucaggaguucgagaccagccuagccaacauggugaaaccccaucucuaccaaaaauauaaaaaauagccaggugagguggugcacgccuguaaucccagccacuuggcaggcugagacaggagaaucgcuugaaccugggagguggagguugcagugagcugagcucgugcuaaugcaccccagccugggcgacagagcaagacuccuucucagaaaaaaaaagaaaagaaaagaaaagaaaaagaaaccugcagaccugggcacgguggcucacaccuguaauuccagcacuuugggagaccaaggugagcacaucaccugaggucaggaguuugugaugagccuggccaacauggugauaccccgucucuacuaaaaauacaaaauuaggugggcaugguggugcaugccuguaaucccagcuauuugggaggcugaggcaggaaaaucacuugaacccaggaggcagagguugcagugagccgagauuguaccauugcacuccagccugggcgacaagagugaaaugcuguucucaaaagaaaccugcaaucugugacuugugaguuaagcccuguuaaagcuuuuaguagucaagccuaaaggauuacuuauugaaguucauaauuucuuuuuuuuuuuuuugagauagagucucgcucuaucgcccaggcuggagugcagugacacaaucuuggcucacugcaacucugccuccuggguucaagcgauucuccugccucagccuccugaauagcuaggauuauaagcaugugccaccaugccuggcugguuuuuguauuuuuaguagaggugggguuucgccauguuggccaggcuggucuugaacuccugaccucaggugauccgccugccuuggccucccaaagugcugggauuacaggccaccaagcccagccaaaguuaauaauuucuugcuugcaugucacuuuuauugcuauuguguuacuuacucuucuuaacacuaaaagacaguguaugaggccuguuuauuguccuuuaguccucauuguugaaugaauuuaaauugagucacuggccauguucaguguaauguucuuucucuuacuguacaggguauugcagacaggcuuguccucuuagaccucucagaagggacuaaaggagccacgauggaccuugaaaucuucaaccuuccuaauguggagaucagcaaaggucuguuuauucugcuuaaagauguaugccuuauuagaucuucauuuuugacuccuagaauguuaaugcugaaaagcaccuuaaagaucaccuuguccaagucucucauuuuacauauugggaaacuaagauugaaauaaguuaaaugacuuacccaaagagucauucagggauuuuaacugauuauauuaauaggaaucaaaugagcaaauaauucagauuuauucagauuggucagaaggaguuauucuuuguuuuugacuuauaccucaaaauaaauuuaucucugauugccucuuuucuuagaauauauugguuaagagcauuggcuuuagaguucuacagauagaaguuuccaucccugcucugccauaauagugcugacauuugucagauuauauaaucucucaaacuucaguuuuuucaucuauaaaguagaaauaauaccuaccuuuugguauauagcaaagugcuaaaccaagaauaagaaaaaaaauuuagcugggugugguggcucaugacuguagucccagcuacgugggaggcugaggcagaaggauuacuugagcccagguguucaaggcugcaaugcacuaggauugugacugugaauagccaccacacuccagccugagcaacauaucgagacccugucucugaaaaaaaaaaaaagaaaaaaagaaaaaaaauucaguuuacauucauugcacuaaaaauauauuguuaaaauaaauuuuaauaauaaaaagauuuucugugucaauaacauuugagugggccaggcgcgguggcucacgccuguaaucccagcacuuugggaagccgacgcaggcagaucacgaggucgggaaaucgagaccauccuggcaaacauggugaaaccccaucucuacuaaaaauacaaaaaaauuagccgggcaugguggcgggcaccuguagucccagcuacucgggaggcugaggcaggagaguggugugaacccgggaugcggaguuugcagugagccgagaugcgccacugcacuccagccugggcgacagagugagacucugucucaaaaaaacaaaaacaaaaacaaaaacaaaacguuugaaauguuaaauuuucuaucucucucucuuuuuuuuuuuuuuuuugagucgggguuucacucugucacccaggcgugagugcaguggcaugauucagcucacuggaaccuccacuuccccagcucaagcuauccuuucaccucugccucccaaguagcuggggcuauaggcaugcaccaccacaccuggcuaauuuuuguauuuuuaguagagacaggauuugccuuauugcccaggcuggucuugaacuccuggacucaagugaucugcccgccucagccucccaaaguacuaggauuacagucaugagccaccgcacccugcccuaucucauuuuuuaauuaaaaaauuugcauguauuuuauaauguacguaacauauuaguauagacauauuuauguagguaaauaccguauuuggggauguggaguugaaaguauuuuaccaaggaugcaugauccaaaaaaaagaaaaaaggccacugaacuagaauaaacauuuccuaaagccuuucuaccaaguuauggguaaggucggauuauaacaugcuauaguuguuuggcuuuccuuugccuuuccuuagguccccuuuauuccuugacaauauuuuccaaauaauauauaaagacauacaguauuacaagccucaauaaacuaaggaaugguagucagaaaaguugaaauuauaccuaucaguuguaaaaguuagguguaaaaguuuuaguaagccuucggcugccuguaggauacaaugaguucauuuuccuucucuggaaagaguaccauaguugcuuuaaggaucuuuuuuguaggucucauguagaaguucuuuggggaacuggauauucucuugugccugugauuuucagguacugaaguucuuaaaggaccucuuaacucuucaaaaucacuuuaggagacucuucaguauauggacucuagagguugugaggccacguaggacugaagaaauuguuucuuccugugugucucaucaaccaucaauagguauugcuucagauaauugaaagacuagaauccuuggaauagauguguagugcauggugcuugccaccaaguagggagucaguaauuaucuguugaauguugaaugaguguauaucaucuugggguaacuuucauucauguuccccuuauuaauugugguuguacauuuuuuuuuucuagagacaaggucuugcucugugguccaagcuggagugcagcggugccaucauagcuuauuguaaccucaaacuccuggguucaagcgauccucccaccucagccuccuaaguagcuuggacuacaggcaugugccaccauuccuggcuaauuuauuuucauuuuugcagagacagggucuugcuauguugcccuggguggucuuaaacuccuagccucaagcaguccuccugccucagccucauaaguaucugggacuacaggugcacgucaccauacccagcuugguuguauauuucugauagcauuuauuuaauuacuauuagaugaaguaauuuuauuuauucauuuguuuauuuuuuuuagacagugucucacucuguugcccaggauggagggcaguggcagaaucauggcucaccgaagccuggaucuaccaggcucaagugauucuccuaucucagccucccaaguagcugggaccacaggcaugcgucaccacaucugacuaauuuuuuuuuuuuuuuaagacagucucgcacuuucacccaggcuggaaugcaguggcacgaucucggcucacugcaagcuccaccucccggguucacaccauucucccgccucagccucccgaguagcugggacuacaggugcccaccaccaugcccagcuaauuuuuuguauuuuuaguagagaugggguuucaccauguuagcuaggauggucuugaucuccugaccucgugauccacccuccucagccucccaaagugcugggauuacaggcgugagccaccgcaccuggcccuaauuuuuucauuuuuuguagagacagggucccacuauguugccaagguuggucuugaacuccuggauucaagccguucucucuccuuggccucccaaaaugcugggauuacaggcaugagccacugcaaccauccuuagaugaaguaauuuuaaauguaauguuaacugacuucucaugaauauauucugagauauggcgaaguacaucaauaauucggggaauuaaagcucauuuggaaauuuuaguaaugccccauuguaacacacauagaugacugcagcugacugaucauuugaugucuuuuuuaauagcuacuauaacauuuuggggagggauauacauauauacauaugagcaugaaaauuuacauacagauacauacauacacacuuaugcuuguguauauaccgacaaucuggagaaauacuaagaaacuguuaagauguugggcacggugucccaugccuguaaucccagcacugugagaggccgaggcggguggaucaccugaggucagggguugaggaccagccuggucaacaugguggaaacccaucucuacuaaaacuacaaaaaauuagccaggcaugcuggcggguucuuguaaucccagcuacucaggagacugaggcaggaagaucgcuugaaccugguaggcggagguugcagugagcugagauugugccauuguacuccagccugggcaacaagaguaaaaacucugucucaaaaaaaaaaaaaaaaaaaauggccaggcacaguggcucacgccuguaaucccagcacuuugggaggccgaggcgggaggaucaccugaggucgggaguuugagaccagccugaccaacauggagaaaccccaucuguacuaaaaauacaaaaauuagccagaugugguggugcaugccuauaaucccagcuacucaggaggcugaggcaggagaauugcuugaaccuuggaggaagagguugcauugagccgagaucgugccauugcacuccauccugggggcaacaagagcgaaacuccgucucaaaaaaaaagaaacuauuaagaguaguugcuuuaggagucagaccgagggaauugauuuugcacuuguuuuuugcauauaauaguauauauauuuaaauccuuuuaucuuuuuauugugcccaaauacacauaacauaaaauuuaccauuggugacuuuagguacucauucacaauguugugcaacuaucaccacuaauuuccagcauuuucaccaccccaaaaggaagcucuguacacauugagcaguuacuccccauuuucccuucucccagguucuggcaacuacuaaucugucuguucuguggauuuuccucuacuagcuaauuuauauaaauggaaucauauaguaugugacuuuugugucacuucgcauaauguuuucaagguacauccauguuguggcacgugucagugcaucauucauuuuuguggcuaauguuucuugguauggauauagcacauuuuauuuauccauuuaucaguuaauggacaucggguugcacuuuuucacuauuguaacuagugcuacuaugaacauucauguaccaguuuuuuuaauaccucuuuuugguucuuuuggauguauauccaaaagugaaauugcuggauuauaugguaauuugaucuuuaacuuauuaaggaauuaauucuacacuuuugaagauguuuauuaacaguacauauagcucuaaguaacucuauuucuuugaaaacguucuacauaauauuccaucauaugagugacuguauuuucuuuuuucuuuucuuuuuuuuuuuuugagacagagucuugcucugaugcacaggcuggagugcaguggcacaaucguggcccacugcaaccuccgcuuccuggguucaggcuauucuccugccucagcuucccaaguaacugggauuacgggagcacgccaccaugcccggcuaauuuuuuuuuuuuuuuuuuuuuugagacggaaccucacucugucacccaggcuggagugcaauggcgcuaucucgacucacugcaaccucugucuccuggguucaagugauucuucugccucagccucccaaguagcugggacuauaggcgcaugccaccaugccuggcuaacuuuuuguauuuuuaguagagacgggguuucaccauguuagccaggauggucucgaucugcugaccucgugauccacccgccuuggccucccaaagugcugggauuacaggggugagccaccacgcccagccuaauuuuuuuucuuuuugagaccaagucucacucauucaggcuggagugcgguggugcaaucuuggcucucugcaaacuucaccuccuggguucaagcgauucucuugccccagccucccgaauagcugggauuacaauugugugccaccacaccuggcuaauuuuguauuuuuaguagagacaggguuucaccauguuggucaggcuggucuugaacucccaaccucaggugauccgcccaccucagccucccaaagugcugugauuacaugcgugagccaccgugaccagccuaauuuuuuaauuuuaauuuuuauuuucauuuuuugagacagucucgcucgguugcucaggcuagagugcaguggugccaucucggcucacugccaccuccgccuccuggguucaagugauucuccugccucggccuccugaguagcugggauuacaggugcacaccaucacaccuggcuaauuuuuguauuuuuaguagagacgggguuucaccauguugucucaggcuggucucaaaacucguggccucaagugauccaccugccuuggccucccaaaaugcugggauuauaggcgugagccacugcaccuagccuucaggaagauuuuuaauagcuauaauuuuagcacaguuuucuagauuaagggucauuaucauuaguaugagagaacacacauuucuaaaauuuugggucauauuaaauaauuugaaaagaguauauucaauaauuuuuaguaccguaagaauggcuuaaugauauaccagauaaaugaaaauauguguagugucuucaguauauucagacugauagaguagcuagaauauuucaguaggucugcacgguauuuacccaucauuauuugauacagaguuaccuggucuuucaguauuuuaaauaaucagcaguguuuuaaaaugaguucauauuucauucaucauaacauuggccucauaauccgagaacaguaguauauuaaagcaugaaauauuauuuacugggucuuuugacauacuugauuugaucaucccuuaguauaacugugaccagccuuugguuuagguuguagaccuuggcuuagcaggaaggauauaguuuuuucugggcuaccuauagaaaugggaaagaggugagaggcuuguguccugguaacacagaugcugacugaguucuuggcaugggaggaaacuuagcauuaugcuaaugucuaagugggacaacucauauuugaaccaggcggucucauucugaagcccuccuuacuaacccuuguacuacauugugugauauauagaguagggacaauaucauguucacuuuuguguucuuagggccuaacacauuaccugugacaugacaggaccuuaguagggguuuguugaauucauuauugucgaaugaacuuuuauccugauccucuuuuuuuuuuuuuuuuugugauggagucuuacucgguugcccagguuggggugcaguggcgcgaucucagcucacuacaaccuccuccucccagguucaagcgauucucuugcuucagcuuccugaguagcugggauuacaggcacgugucaccacgcccggcuaauuucuuuuuaguagagacaggguuucaccaucuuagccaggcuggucuugaacuccugaccucgugauccgcccaccucagccucccaaagugcugggauuacgugugugagccacugcacccggccuauccugauccuuaaccuuguaauuuauagcuuuaauaaucaugcuuaaaguucuuucuaauucucuuuauaacuguauaaucuucuucccuuguuaaaucaucaacuuguaagggaagacuugaaaagucaaagauuuugagugccagguacaaggaacuuaguugccuguggagcaaugcuaaccaaaccuggcugugcaucagaaucaucuggggguuugcauucuggaagcuauuuccccuuauauauuuaaguaaaaucuucagaacaugggcuaaucugcauuuuuauuaagcuucccagguuaggcuuaggcaccuagccuagcauuuaagaacugcugcaagagauugauagaaauggaagacucuauuuggucagaagcagcuuaaaguuuagauaaaaagacacaugcaauauauaaacaguuauucaugacaagagagugaggaggcacuaugugauuaaugccaagagagugguccagacagugaggacucgaaguuggguggagacagagauugcuuucaacugauuaggauugagauaguugcugguucuucugggauuggagagauuuggacuggcagaaagcugggggaaauguuccaguugcuaugcgacuagaucuuggagguggaaagaugaguaagaaacaaauaaucccuguucccccagagcuuguaauauguuugauguagacaguuaagcagauguuugucaaacauguggugagugcagugagaauuugagcaaaagccaguaucaggaaaauuagguagauauucuagggaaugaguauagaccaauucagccugcaucacaaguuuauguaggagaauuuaaagaaauacugagcugggugcuguggcauacaccuauaguaccuccuacuuggcaggcugaggcuggaggauuguuugagcccagggauuugaauccagccucggcaacauagcaagaccccaugucuaaaagaaaacuuuaaaauauaagaaauacuggcuuuuaaacucaaaggaggccgggcacaguggcucacaccuguaaucccagcacuuugggaggccgaggcagguggaucaccugaggucaggaguucaagaccagccuggccaacauugugaaaccccaucucuacuaaaaauccaaaaauuagcugggaaugguggugggcaccuguaaucccagcuacuugggaggcagacgcaggagaaucacuugaacccaggaggcagagguugcagugagccaagauggcaccauugcacuacagccugggcgacaagagcaaaacuccaucucaaaaaaaaaauuaaauaaauaaaaaauaaacucagaggaauugauuaaaaggcccgagagcuugaugggaaaaucuuugggaguaggaaggcuuucuuguacuuuugaaaucauauuaggggcugggcacaguggcuuacgccuguaauuccagcacuuugggaggccaaggcaggcagaucaucugaggucaggaguucgagaccagccuggccaacauggugaaacucugucuuuacuaaaaauacaaaaauuagccgggcucaguggcgggcaccuguaaucccagcuacuagggaagcugaggcaggagaaucacuugaaaccgggaggcagagguugcagugagcugagauugcauaccacugcacuccagccugggcaacagagugagacccugucucaaaacaaaaaagaaaagaaaucauauuagguagccacuacuauguuuacuccuaagucaaccuugaagaugaggaagcuaaaggagcaaagaaaagaaauaaucacaauagccuggggccagauuguagaguuauaaauugaacuguccacuaauauuucauaauauggacagaccaccuaaccucuccacauaacaguuuccucauccuuaugaggguguaggacuaaguuucuaaauguagcauaguguuuaauagcacuuugaagucagacugcaugggcuuaaccucuggcucuacacuucagcucuaugacuuugagcaguuuauuuaacuucucugugccucagauuucucaucuguaaaauacuccauuguguauuguugauuagauuaaacaaauaaauuuauggagaacuguuagaacaguguuugacacauauggaauuguuaaguauaucccuuccaguucuaaugucuucuaauucuugagguuuugacucaucaccagguaucuacugugaauccuacaacauaggaauuacuuaagaggacucaugaagaaccauaauuaaaaucuaggacuuaguguuuagaucuaccaucacuagaacuguaucagaauaggaaguaaaauuagauaaugcaucucccaguggacacauugcacaaguguuuccuucugaaacuuguuuagaaagauggccuagccaggugcgguggcucacgccuguaaucccagcacuuugggaggccgagguggguggaucaccugagguugggaguucgagaccaaccucaccaacauguagaaaccccgucucuacuaaaaauacaaaauuagcugggugugguggcauaugccuguaaucccagcuacuugggaggcugaggcaggagaaucacuugaacccaggaggcagagguuguggugagccgagauugcaccauuggacaucagccuggggcaacaagagcgaaacuccauuucaaaaaacaaaaaagaaagauggccuuagaggcuuaauuaggaauauaaaccauggagucuacugucucccugggaggcuaauauucauuuguaaauguugacuggacugaugccauucuaauuacuuuauuaugguucucuuauuucugauguugguaacaucuggccacgguuugggcauguacuuacuguaaaacacacugugcaauggagaguaauauaguuguaacagcauaacgugugcuggagggucaaaggugcucuggagucagagugaacuccauagacuagcuuuuccuaagucauaacaguugauuaccuguaguucccaugggaagaaguaguuauccaaggacagcugggcuucuguauaagaaaagucaguuuaaaaugauccaagaggcaggugugguaaagucucagcuucucaggaggcagaagcaggaggaguacuugagcccaggaguuugaguccagccugggcaauauagugagaccuugucucuuuauuaaaaaaaagccaagauauuuaauuuagagauuuuugaacuacucuuuagaguagaauccuuaauaaguaaaacagauuuuuaaaaagcaccacuauucugcuuggauaggccaaaguaaguggccuggagcuauacuuaccagccuucuuccuacuuauuuccacuccucccugauggccucugaguuucuuucaaggaacuuuagggcaccuaagcucacaguuuaggaaccaaugguguaauugaugguagguucauuuugccuauagcauaauauuuauuuuccuuuaaaaauuguaauuuauauaaaaaacucaguucuuguuuguagguuuuagaucccauaauuuauuuugauuauuacuauugcuaucuuccccccuggggauacacucuuccuuuuuuauugagacagagucucacucugucacgagacucuggagugcaauggcgagaucucagcucacugaaccuccaccuccuggguucaacugaaucucugccucagccuccugaguagcugagacuacagucacacaccaccaugccuggcuaauuuuuauauuuuaguagagacaggguuucaccauguugggcaggcuggucuugaacuccuggccucaagugauccaccagccucagccucccaaagugcugggauuacaggcaugagccaccacacccagucaacacuuacucuuaauccucuuuuuggaggcaaaccuccgcauuuuauaugcuuuuguggaucugggguugauuuauggggaggcgugccuaaaagcucucuuauuuguugaaaagaacaaccuuuuaaucgugaacuagaacuugauuaaagccuguaucuucagcucagacuguuucuuuucauucacuagauuugucugccucugcucauuccaagguggugaucuucacagucaacucuuuggguaguucucagucguaccuugaugugguacagagcaauguggauauguucagagcccuugucccagcucugggacauuauagucaacacaguguccugcucguugcaucucaaccagguaaaaugcuuuauuuuaaauuaaguugaugguccaguacaucaguagaauugccauuacugauaaaaaccauaaaacuuuagggccuggcacaguggcucacaccaguaaucccaacacugggagucugaggcgggcggaucaccugaggucaggaguuccagaccauccugaccaacauggugaaaccccgucucuaccaaaaauacaaaaguuagccaggcaugguggcgggugccuguaaucccggcuacuuggaaggcugaggugggagaauugcuugaaccccggagauggugguugcagugaggccaagauggugucacugaaccccagucuggccgacagagugagacucucucaaaaaaaaaaaacaaaaacaaaauaaaaaacaaaacaaaaaaagccuuuaaauuauaaagagauggcuagaauauucagcaaaauugccuauauaauaaacaguguaauauucuggcaaccaguuacuuguuaugacuaacauuaucuagaagguuccagcauacaauuuuuuaaugaaauaugauauuauguucuagguucuaagccauaccuuccucagugagaagauguuuaaacucccaagagaaaaaugcaaugacuuauaugcaugauauuuuguuaauucugaaguaucaaaaauguuagcaugccagagugcauuuuuaacauuuuguauuuugcagguuguuuuggaacugucguacucaaaaauagaaauauuuucaaagaguuaguuuguacugggcucaaauuggugaacagauuuuuuuuaaauguucccaauguagagguauuguaugcauuucaguuguuuuuuuguaguaauuuguugagggacauugaucucuuuaauucucgacaugcuuuuggaauguaagaaaaaaguaguuguguuuucauucauaaugcgacacugaaucaugguggcauaugaaucaguauuuuaauuuaaagauagaaauucaguuuaagauagauagauguaaaagaaaacucgaucaauaagaagaaauuauuuuuuaguuuuuuguaccaguuuuuauccucacuuaacuguucuaggaauuaucuauuuucuaccccugacaauuuauauuuaacaauaaaauuugaccaggcacgguggcucacgccuguaaucacagcacuuugggaggccgaggcagguggaucaccugaggucaggaguuugagaccagccuggccaacauggugaaacccugccucuauuaaaaauacaaaaaauagccaagugugguggugcacaccuguaaucccagcuacuagggagacuaagguaggagaaucccuugaaccugggaggcagagguugcagugagcccaggucaugccacugcacuccagccugggggacagagcaagacuccaucucaaaaaacaaacaaacaaacaaacaaaacacaguaaaauguaucuuguugaaaccuuguuaguguuucuaauguacauuaaaaauauguuaugggcugggcgcgguggcucacaccuguaaucccagcacuuugggaggccgaggcaaguggaucaugaggucaagagaucgagaccauccuggccaacauggugaaaccccgucucuaccaaaaauacaaaaauuaacugggcaugguggcaggugccuauagucccagcuacucgggaggcugaggcaggagaauugcuggaacccgggaggcagagguugcagugagccgagaucgugccacugcacuccagccugggcgauagagcgacacuccaucucaaaaaaaaaaaaaaaauauagauauagauauagauauagauauagauagauauacacacacauauauacacguauauauacauacguguauauauauguguguauguauguguguauuauauguguauauauauaguauauauauguauauauguguguguguauauauauacauauaaugccucagugcauugaggaccuaauauacuuauuaaaauaauaaauauuugugagcuaggcuagaaguauauauuuuuuaaccuuuacauuuuuuaccuuguaugcaauauuuaguggaaaucaugaccuauguaacauggaaacugaguacauuuccugcaaaucgagugaucggaauuggauguaaucuggauucacagagauuacaguauauuauuacaaauguuuugaaggcacagacuucaggcaaagaaguauggguuauuggcgagcaaggagaagacaaagguaagaaguacguuuuuaggcugggugugguggcucaugccuguaauuccaacacuuugggaggccaaggcaggauugcuugaagccaggacuucaagaccagccugggcaacauagcaagaccccaucucuacaaaaagauaaaaaauuagccaggcacgguagugcaugccuguagucccaguuacucaggagacugagugggaggaucacuugagcccgggaggucaaggcugcagugagccaugaucgcagcacugcauucaagccugggugacagggugaaaccccaucgcuaaaaaaagaaguacauuauuauuaguuacaaccaaaauugccaguggucauggcauucacauauaucugaggacuccagaauugugggcuuaauuggcuuuguuccacauuugagugugccuucuguauaacaggcccuauauugugaauaaauuccucauaugugucauucucguuguaauuacuuuucuguaaguuuaagguuagacaagaccgcuuaguaggauuuuauauuuuuaaauugaauuucagaguucaggaucaauuuaaaaauuuaauuuuccagaaagaaacauuuaaauaaaccuuaaagcauauauagaacucuuuccuuuacucuucccacccuucaaccuugcuuaccuuucccaaguucagaccuucucccuagauacaugccuucugucugcuucuuuuuaaacagaguuuucacucauuguuuaucccuauggccuuuuucuccagccacuugcucuuucccacagaaggcauucaguuuccuguauuggaaagcuccuuuuccuauuucaaaagaaugcuuucccuauuuaacuugagaaucucuucccuuacucuuuuauuguuucucucuugcuauaaagccagguuggucagugauuuaagugcuguucacccugauuuuguucauuuaaguauaugaguaaaauaaagauaauaguauacuauuagaguaagugccaaagugaguacuauacacuuacagugcuuagauacuuaugagugagcauuuaacaugggcugaaaugacuagagaaaauucuauaaaggccaucuggaguuugaacuggaguuuggacgaaugaauaggauuuuaauagauagugaacaauaggaaaaacacuccaggaaugggaaaucagaauuaggcaaaagcacgaaguuaaguauggcauguucaugggauaaaaaauguggacuaguuguugcagaagguuucaaugagauaaaucuaauugaaauuacauuuugaagaucugugaauacccgaucgaagagcuggaaagugaucuggggaaaauuagucauuacuucaucauuugaaguacuuacuguuaacuucacucagcauguaagugcugcaagguagagcaugauauagaaaauaaccucucugggcugggugugguggcucacgccuguagucccagcacuuugggaggccaagguggauggaucacaagcucaggagaucgagaccauccuggccaacauggugaaaccccgucucuacuaaaaauacaaaaauuagcuaggcauggcagcacgugccuguagucccagcuacucaggaggcugaggcaggagaacugcuugaacccaggaggcggaggcugcagugagccgagaucacaccacugcacuccagucugggcgacagagugagacuuagucucaaagaaaaaaaaaaaaaaaagaaaagaaaagaaaauaacuccucugccggugaggagguaauaauuuaauugaagaguuagagaaagaccaugcacauuaaaaaguuaaauagaugucaaaccauauuuccacaaagcaaaucacccucucaaaacuauuuccuuggaauuuaaagugucaucuauacuuugaugccauuaaaauaaaauauuaacauugaugauaucuagguuagagguaacuuuuaaaaauuuauaguuuucuguguaguaaaaauauguaguauuuauauaauuuuuaagaaaagcauuuuaauaaaauauaacaguauuuuaaaucuguaaaaaucugcacuggcuacuagaaggcucagugcuagaaugagucaggcuauacaauaaacccuuaaaaaacccgacagcaugacugagcaaaaauacuuuugaggcuccaaaugcucccugacacuacacacuaaucaacaggacccuggaaaaggguagcaaacaagaacuuggagcaaauguauucaaguaaugaaugucuccauucauucauuacuugaauacauuugaaauucauggcucauucaaacucaaaacccaacauagaccaaacccucugguccauguugaucucuugcuugccugguuauugcacaucucaugguuaguuugccucuuccccucuagucuacccgguaaaugaugugaaaauaauaauaauauuacucaaaacuuauagaauguuuauugugugcucucacauauuaauucaaucuuccuaaaacauguuauuauuuucaaaaacuuucagaggcuuccucugaccaaaccauuaaauugcauugcuuggcacucagggacccccaaaauauaacccuaaucuuucuucccaauuauaguuagggagauagccacguuauuagagagcuggaagggaccaucuauuacauuuuguuuuagggagccagugaaugcaggcauuguaaaagugaccugcguggaagccuacagcuuuuagggucaaaggacuagcacccaggucuugugucucccaggcccaccccacagcuuugccacagggacauuuacucacuuuguuuaccucccuuguaaucccuuugccuucucggccaucuuauugacaucuuucaaggucuaagucaagcaucccuuauaugauaaagguuuuuuccugaucacaucacuucacagugauuucuucacuccuuugagcuaaagcuauuucaaucuauaagguaauaaacuacaucuugucucaucauguuacuuuuguuguccugcugcuuguucuuaucugauuuuugugugugaccuucuccuuauuuaaagugcaaauuauuaaguuauuuuaguugaaaauguaguacauucacacuggaaaaauaaguacaaaaagauaugcagugaaaagucucccuuagaugccagacacucaauccuucuuccuagggacaaucacaguuaucagucucuuuuauaaucuuccagaaauauucuguguauagacaagcacacaugugaaauagacaucauacaucauucuccaccucgcccuuuuacuuaccaaugauuauggaaugauugcacaguaacauagagcucauucauucuuuuuaacuacuggauauaccauaauuuacuuaaccagccucucuaauuuacaaguuuugaggaauaguugauauacaauaaauauugaaugaguaagaauguuugaaauaugguuguauuaauuucuuaagucucauaaagagaaaauacaggcugaugugaugugauaaauauaccacuuacccuaaccuaguauaucugggugaaggaaaaaaacaaucuaauagaaguuaauugugagcucuucagaggaacaauuuaaaaccuaccaaaaagcaguuuguauuugauuaaaugaccuuuuaucccaaauguaggaauuuauuuucagaaacauuuauuggccaccugcuuugcucaauaaacacuguguugauugcuguuagaacuauauagauguguaagaaccugacccugucuuuaggaaacuuugagucuaauacuggaaaugacuggaaggcuguacucugagagagguccaagggaaguaggauaaaaccacagggaagagaugugguaauucugucuugaggucucaaauuggaacuagaaauagagagauguaggugcaugcaaauugagaucacauaaauguaguauuauguaauauuugacacacauaaugccaguguuaaaacauaacugagcacguaugaauccauacucaaucaagaacauuacugauacugaaguuaacuauguaguucuccccagucuaucucccugucugccuucuagaaguaccaucugaucacuuuuuauucugucuucuacucuucuugaagagcuaguuauauccauggauagguauauuuaccuugguccugguaucagaaauggauuagaagcucccucugcugguuucauguauagauaccaacuguuuagacuuuugcauaagugauaccaucacaguaacugcaauuauaauuauuuuuuauuguaccuacuauguguauuaaauauuuugcauaucucauuuaaauuuuauaaacacucugugaaggagguagugguuuuccagauuuauguaugaggaaacuuaaggcucaaugagauaaguaauuugcccaagguuacauaucugugaagggcagaacugagauuugaacccugaucugacucugaagcugugcucuuccuugcugucacuuaagauaauguaucuagagcauuuaguacaguaucuggcacacagcaaacgcucagcaaaugguagcuauuauuacagugauuggcaagauggugaugaauagaaaauuggcaaaaaacauguaaaauaacucuuugaaguaaagcaacauuaggauuuggaaacagauauaagaguaacaauuguguaaauaaaauauccucuucaaguauuucagagacaagugacagcuacagccuagggaggaaucacaugacauacaagaccuuuaggucuauuuccugcuucaucgucucccauucucccaggcauucuaugcuagucaggugguugacuugcaguuuacugaaugguuuaugcacucucaugccuccuuaacuuagcaacugcugcuuccuuucccugaacucguucacuuggcuaacuccugcuuacccuuuaggauugggcuugagugccaccucucccaggaagccuuccuuaauuugccaaguuaaguaaguucauacaaauaauguaacaaauuuuuaaagaaaguaauccaccuauuacccuuuuaucuaaguaaaacauucaugccaaaacacaauuuucaaaacaucccgcccaauguaacaaauuuuuaaaguaauccaccuaucacccuucuaucuaaguaaaacauuuuaaaaaucccuuaaguuguccauauguauuuauauuuuucauauaacaguucaugguuuuguguuuuuuucuuauacaaaaacuuuuggcugggugcaguggcucaugccuauaauccuagcacuuugggagaccgaggcggguggaucacaaggucaggagaucgagaccagccuggccaacguggugaagcccugucucuacuaaaaauacaaauuagccgggcggguggcuggcgucuguagucccagcuacucgggaggcugaggcaggagaauuguuugaaccugggagguggugcagugagccgagauugcaccacugcacuccagccugggcaacagagcgagacugucucaaaaaaaaaaaaaaaaaaaaacuuauaaaacuuuuucuguuuuucuuuuucuuuuuuggggggguuggggacagagucucgcucuguugccaggcuggagcacaguggcacggucucggcucacugcaaccuccgccuccuggguucaagcgauuuuccugccucagccuccaaguagcugggauuaccggcaugcgccaccacgccuggcuaauuuuuguauuuuuaguagagauggggguuucaccaugguggccaggcuggucucgaacuccugaccuuaugauccacccgccucggccucccaaagugcugggauuacuggcgugagccaccacgcccggcccuuuuucuguuuuucaacuuaacuauggcaaguauguuuuccccuuuguuaccaaauauaauuaugaaucaugcgagagguuuuguauuuuccucgauuguguacccaacaccaugguaaagaauacgugcaagaggugccagccauggugguucacagcuguaaucccagcacuuugggaggccaaggcggguggaucacuugaggucaggaguuugagaccagccugcccaacauggugaaaacccgucucuacuaaaaauacaaaauuacccgggcgugggggugcacaccugugaucccagcuacuugggagucugaggcgcacaccuguaaucccagcuacuugggaggcugaggcaauagaaucgcuugaaccugggagacggagguugcagugagccgagauggugccacugcaauccauccugggucacagugagacuccgucuccaaaaaaaaaaaaaaagaauaugugcaagagaacacaaaagaauaauacauggucccugcacucugggagcuuauaaucaguuugaggaagggaggcaucuggauacauaugggguccuuuguugcugacacaugacuaaguggucuaauuuugaauguaguuuagaauucuuguaucuuaaacauauuauucuauagccacaaguauuuuuguuuugccuacucaaauauguacagauuuguaccaaacaaucucuucacacagaugagaaacaggugaacauuggaaagguuucaaaauguuacuggcaacuucaauuuaauauuaaagugcaguucggcucaguggcuuacgccuguaaucccagcacuuugggaggccaaggcaggcagaucaccugagguaaggaguucaagaccagccuggccaacauggugaaauccugucucuacuaaaaauacaaaaauuagccuggugugguggcaggcaccuguaaucccagcuaguugggaggcugagguagaauaauugcuugaacccaggaggcagagguuguagugagcugagagugugccacugcacuccacccuaggugacaaaguaagacuguguaucaaauaauaauaauaauaauaauauuaaagugugauauaaauuucuagucuggccaggcgcaguggcucacaccuguaauccuagcacuuugggaggccaaggugggugaaucaccugaggucaggaguucgagaccugccuggcuaacauggcaaaaucccaucucuacuaaaaauacaaaaauuagccaggugugguggcgggugccuguagucccagcuacucaggaggcugaggcaggagaauuguuugaaccgggaggcggagguugcagugagccaagaucacaccauugcacaccaggcuagguaacagcgagaguccgucucaaaaagaaaaagaaaaaaaaaaaaaaauauauauauauauaaagaaauuuccagucuguguaugcagcuuugaaguuuugaauuguuuuuguaaaugauguaguaaaaggaaauggguaacccagaagauucuuuuagaaaacaggacccuggugcugggugugguggcucaagccuguaauccuagcacuuugggaggccgaagcagguggauuacgaggucaggaguucaagaccagccuggccaacauggugaacccugucucuacuaaacacacacacacaaaaauuagcagggcaugguggcaugugccuguaguaccagcuacucgggaggcugaggcgugagaauugcgugaacccgggaggcagagguugcagugagccaagaucaugccacugcacuacagccugggcgacagagcaagacuccaucugaaaaaaaaaaaaaaaaaaggaacaggauucucugccucuguaacagcuguggaaauucuagcccaaaauaggugaccagauuauucccuaccuggugaaauuagucucagugcauuucucagcagaacaaaugucaagugcuuauagguuucuacuuagauaguaaaauggcccuugcagaacuguuacugaugagagaaaacagguaaggagacugcaagcagacuuuggggaucauguuuuuuguaguucagaguuuuccucaccucgggcuagugguacagcacauucauuguuauccaguggaaaaaucuaacuugcuagaaaugagaaaacuucuauauaaauauuagcacagguacccuugacuccaaaagaucuguuaucacaucuuaauccaaagagucacuggcaaaacauaauuaauucuucaucuaauuuuagugcucacauggaguggccaagaagaaguagugagucauaccucucaagugcagcuguccaacagguaacacugacuggaaauuugcauuuauccaacgaaaaaucauuuacuucauagcuaacagcuauuuauacaguauguacuuaaccaggcuucuggaaacaaaacuaauauggacaaacccaaaaguauaaaggagcaguguuuuauauucuuugauuucuuaucugaagguagaucuaagagugcuuugcaagcuuuuucagauaacacaguugacauuuaaaugguaaaacauguuauuuguagacagugauuuacugcuucucuaccuaaacaucugagccccacucugucaccaggcuggagugcaguggcgcgaucucggcucacugcagccuccgccucccggguucaagcgauuccccugccucagugucccaaguagcuggaauuacaggcaugcgccaccaugcccaguaauuuuuuguauuuuaguagagacgggguuucaccauguuggucaggauggucuugaucuccugaccacaugauccacccgccuuggccucccaaagugccgggauuacaggugugagccaccgugccaggccaacaauuuucuuaauguagaagauaauuuguccacaccacuuaaaaaugaauaucuauuaaucacacacaaauagaacuggaaaucagucuaauaugaauggauaagccauauuauauguucaggcaaaaaaaaaaguguaacacacagauccuuguaucuuuugcuuuuauccagaggccuuccaggggucuguaccgcauaggcaggacucuacacagaauuuauacucauggcauuuguuguuucaccgucauauaacauuuuccugaagucugagagguggugaucuuuagcuuucaaagccaucagcuuaugacuuuuagaauauaacaacuggaaaaaguguucucuuucuugagaagauuaguguaugguauaauucauucuaaucugauuauacaauccugcauuuauacuuuuuaaaaggaagaaauuuaaguguuuauguauuuuuaucauuuauaaaagaauguaugcuuauuauaaaacuucagauacugcagauaucuauaaaauauuaaaagaaaaagcuaagguaauuccauuuuucagagacaaccauuuuuaacaauuuaguguccacauguccaaaaaauuuuuuuucuacucaggaggcugaaaugggaggaucaguugagcccaggaguuugagaccagcuuggacaacacagagacccugucucuaaaaagaaaaaauuguuuuucaaugcuucuacaaauguauaauaauauagauuuaugcuauccauacuaucuugcaacuucauuucuuuccuuaaugaugaaaucucagacauuuuugcacauuguacauguaaaucuaccuuauucuucucaaaagcuacaugguacuacgcuugguagugauuuaaccaguccucuuuugaugaguuguuuccaaauauugcagacaugcuuauuauguacaucuuugcacacuugagcauacugcuguaagauaaaugccuagaagaggaauuucuagaucagacguuaccaaaucuucuucuuaaaagguuagaucacuuuacauucucaauagcaguuaugagaaugccuguuuacaguuucuccaaauuaguuaucagucuuuuuaauuuuugccaauuaucgauaggcaaauugguauuuauuguuuuaauucauauugguuaaauaucaauggcagugaacauuuuuuauguuauuaggccauuuguauuuucuuugaacugccuaucugacaucuuaggaaaaguuuaaauaaacauuagauuagauuaucuauaggcuucccuaacaauugcugcauaacucuuguuucugucauagaaacaucuaauuaauaccuuagccagaauguaaaacuaaaugugcauauuuuaugcauuuucugagaucacguauuuuuguaaccuagagccauggaacugcuaagaguaaaaggucaaagauccuggucuguuggacuaucaguagcugacaugguugacaguauuguaaacaauaagaagaaagugcauucuguaucagcuuuagcaaagguaauugcuauucuuauucucuuauuauauuuuaaacuuagauauuauuaauacaaaacuaacaaaaucauuauucauacucuaaccccaggugucuucaguaucaccagcuuuuagaguaacagguaggagaaggcaguuuaguuuaagcccuauccugcuuagcuaugagaagucugccagcuugggcaacauagugagaccccaacuuuacaaaaacaaaaacaaaacuuugccaggcaugugacaaccacucaguaggcugaggugggaaaaucucuugagccugggagguugaggcugcagugagccaugaucaugucacuggacuccagcauggacaacacagcgaaucccugucuccaaagauaacauuuugacugggggcaguggcucacgccuguaaucccagcacucggaggccgaggcagguggaucacuugagguuaggaguuugagaccagccuggcuaacauggugaaaccccucucuacuaaaaauacaaaaauuagccagacauaguggcguaugucuguaaucccagcuacucgggaggcggagguugcagugagcaccucugcaacuccagccugggugacacagcgagacucagucucgaaaacaaacaaacaaaaaaaguguggacuucuaucagguugccuucucacccucaugugauuuuugguaacccccaaauaguguuuauauauccauaaauuucuucuuacugucauuuaucaucucagccagccaagucaccccagauuuaugugccagaaagacaaauaucacauauucuuacucauguaacccccaaauaguguuuauauauccauaaauuucuucugacugucauuuaucaucucagccagccaagucaccccagauuuaugugccagaaagacaaauaucacauauucucacucacgugggagcuuuuuuuuuuuuuuuuaaaguugaucucauggagguagagaguagaguguugguuaccacaggcugcgguugggggauagaaugaaaagcaguugguuaauggguacaaaaauagauaggaauaaauucuaguguucaacagcacaguagggugagugugauuauuaauaauuuauuguacauuucaaaacagcuagaagaagcugggugugguggcccaugccuguaaucccagcacuuugggaggccaaggugggaggaucacuugagcuuaggaguucaagaucagcuugggcaauauagagagaccucaucucaaaaaaaaaaaaaagaaaagaaaagaaaagaaaaaauagccagaagagaccauuuggaauguuuucaacacaaauaaaugauaaauguuugaggugauggauagccccauuacccugauuugaucauuacauguuauaugcauauauugaaauaucacauguaccccacaaauacacacucuuaugguaccaguuguuuuauuuuuuaaagaagcuauugucaugacugugcccagagaccaucccaugccccuccccaggaaauacauucuuaacuaucuuuuuucuuagcccccaaccuccuacccauauugcagggggggcuagcuugcuucucuacaaagugggugucugaccaaguugcuuccaucucucaaaaauuuucugaaaugauaacaaguuuauagaaucaaugaaugauugugaggucuggacuucuaaaaauaaaauaaguaaaugaacaaaaaaauuuuuuuaaguccaacuuguaucacuuuguccuaguuaagaaagcaagaaaguaugcauuuuuguauuaacuucuuugcaaugauuuaguucuauuaaaucccuauuuuucucauuucagggauauuaugauauaaauagugaaguguuuuuaaguuugccuugcauccuuggaaccaauggaguaucugaaguuaucaaaaccacacugaaagaagauacaguuacugagaaacuccaaagcagugcauccucaauccacagucuccaacaacaguuaaaacuuugauucucaaaugcaauuugagaggcuggacuucuaccuaaagggaaaagucauuuaauuuuaccuauauauagguuugaggauuucuguauccugcuacuuacuuuuacaaacugcuugguuaaaguagaggguuucuugauuagcuuugugauguaaauccuuaaggaguuauacaaggaggggaaaaauuaauuuuauuugggguucuugagauaucuaugcuguucuuuaaaucuacagcagggguaaacauucaucugcagugugcaucaauuuaaaucauauauccuaaacuaaaagcacaauucauacuucgggaauauuuuauaaguaauauaucuuuaaaagaaaauuacccuuugacuuuuauaaucaacauaaguuccaggcccaguauggauuuacaaaaucugugucaguuguacauucacaggauccacagcuuaaguuacuaauguuucuuguguaaaauccuguugguaguaauaguaaagcauuguauuucccuucuucaaauuaauuaccuaccaaaaaauggaaaagaauuuuacaugcacuuuaaaauaguaaaauggaaagugaauuuuuaaaauauaugcauuaaaaguuuacuuuaauuucca

SEQ ID NO: 191778 - RNA, 39389 nt, Homo sapiens
gaagucgcccggcgcgggagcgcgaacucucgcgagaaugccgccagcuccggaggcgacugcggcaggagcccgagcucucgcgcgacaggcaccaauucguuagacgcgcgcugcaggagcgcggaacauggcgcggcacgggccaccguggagucgguuggacgcgcagcaggagcgcgacgugcgggagcucguccggggugucgccggccuccaggacgaggcagaccccaacuuccagcucgcccuaaacuucgccugguccaacuucagguguggggcacggcgcgcgggcggguucccggccacagcccggagcccgcgcgugggucccgcacagcccggggucggggcgcgcuggggcagggcauggggcggaggcgggcgcggccucagggagccuucgcaggcccugccaccgccugcuccccgccggccagcgcucucggcgcggugcccugcgcaccacagggcguguuacccgggacgcguccugaucgucacggggaaagcgugaacuggguuucuugccggccggcgcgcgcgccugcaaccccagcgcucugggaggcccaggcgggacuccaggccagcuugggcaacguagcaacuccauguuuauaauuuuuuuuuuuuuuaaauuaaagagauuguauucucacugacuccugcucccuggucagcccaguguaagaucucucacccugcucuccuuuuuccaaaacgcgugucaugacacugauuuaaccugucauuacugucuccuccacuuccacuccagcuagaaugcugcaucucugcacagcuccuggcacguagcacgcugagucaccuaauacaauuucuaaugcaguuucucuuguaacuaauuuuuaaagacuuacagaauuuagauauuuacguaaagugagaucuccuauuuuucuuuaugggagauguaaauuaauacuuuuagagucauuacccauaaugaaauuauuacuaaaaaaauguuaauguuaauauucuaccuguuuaauuucaguaaaaaucuucuugaauaaugaacaguuuuucaaaauccguaaucuuaguuaccuuaaugaucauagccauaaagugucuaguuggcuuauaauaggaauacggggcuuucagauucuuuuaaaccaugccaaguuucugaaguaauaaacugaauucuuaaguguaacuuauaaaaauaaacaaugugugaaauagguuauacaauacagaaacuuaaaugcugaaauccaaguuauuuuucuacuaauauuucuaaaugacaguaggcagauugucaucauuuuagagcugggagagacguuggagguuacuauuuucauucacagauuucaggaacuaaauuauaauagguaaagugguguuccauucacccauuuacuggccuagaaucauguguuuuucaguaguguaauuuuauuuaaguacagauugcucgcuuugauacuaaaaaauggaaaacauuuuuugcauaggcuaugcuauguacauauacauuaguugcauaggcugugcuguaauuuuaugaugcuuuaaaccaucagaaaaaugaauaguucauguuuacauucuugaaaauuguggacugggcgcgguggcucacgccuguaaucccagcacuuuaggaggccgagguggguggaucacgaggucaggagaucgagacuauccuggcuaacacggugaaacccggucucuacuaaaaguacaaaaaauuagccgggcgugguggcaggcgccuguagucccagcuacuugggaggcugaggcaggagaauggcgcgaacccaggaggcggagcuugcacugagcaagcucacuuuucucuaacugaaaaguagcaucuccuucuauuaugaaugaaggcagcaaaccauagcaguauuagccuaccuaugacuuuaucaccaguagaaaucgcauacuguuuucacaucagaguuguagauauuuguaaauguuguuuacuguuacuuuaaugguaguuaauuggaccuacugcuaaaucuuguuauuuaauacuuucauaaauaacauuucuugccauaucuuaaacuucuuuaaauauuugacaacuguaucucaguauaaugggauuccuuuguauuuauuuuuuggcuuuaaaaauguuauucagagaagggguccuuaggcuucaccgggccucacuauggcauaaaaagguugggaccaccugauguagaauguguucagcuggacuuagguacaggggcuuaugggaagacagaggagccagaggacaagguugggagggucaggaagaaccugugugcuggagaaaggaugcuugcacagucucggacacggugauuauuugccugccugaugguggagguaacggaggacaagguacacuccauucuggaaauguguagcugaguacagagcauaugggggauauggagggccaugagaugaguucacuuaccugugugacagaguuggcauaagaauugcauuuugucuuuaauagauuucaucguuucuuggaugucaacagccacaaaauagaaaaaacaaucgaaggguaagucaguguguauauauacgcauccagaaauauauguauuuucuuauagaucuuuuuaagauagcuuuauaaucuuuucuuauauuuuagaauuuaugaaaaauuugucauucauucugaucuaagcaaagcugcuaguuggaagagauuaacggaggaauuucuaaaugcaccacuucccaguauaaaggaaauaaagguaugccuucaauuaugagaucuccacuguguauuuuacuguuuccuaucugauuaucgucaauuuguuucaguuacuguuuaaacauucuauuuuaguauuaucuacuggcuaacgggaucucuuggaaauuuacuuaaauauugccaucaaaccagauaugccucaguuugugaugaaagaaagagcuuguuuuuaaucauuuuuucaccucaguccuacuaaggaaagagagaucagagauugauacaaauaguagcauuguuuggguaucucaaaacuuucaaaugguuucucagcacuuggcagugacugucuguagaugcuuacuagaugccugguauacuuucauauuguuugggggauuccccaagaccaccuuuuggcauaaugauuugcucaaaggauucacagaacuuaaaaaaaaaaagcuguuauccucacuguuaauaguuuauuacagugaaaggauacagauuaaaaucaccaaagggaaaaggugcuuagagcaaagucuaggagaagcuaggcacgcauguccaaauguuccuuccuaguggagucaccuggggaugcaguuaauucucucaguaacaguauaugacaacaugugcaaaguauuacccuccacuccccccagggccacucggcugagccuuggugaccagcauuuuuauugggggugggucacauaagcaagcagagcccacauggcugaccuuagcugcugagucuguagcccccuagaggucaaaccaaggauggcaagcguauggaaacagcuguggguucccugaacacggugggaccacauucccuagcucugcugugacacaucuugugccuacauaguucuuucccuuucuccugccugaggaagcucacguuuuaauauuaaacucaggcacugucuccacacaugcuauguauuucaauucuuuauaguuccuuucuugucucccccuuuaaaaggcacauuuuacaggcauagggcucugugucugauuuguucccggacaccuagagcacaguggacagugcauguuuguugagggaaucaguaaggcugugcagucuugucugcuucacuauccccucuguguccacagcccccacccacuuacacaaggugggauugguuauccuuuucucuugcuguguggcaucuuggauguguuuguuauggcagagguccccaacccccacaugguggacgaguaccaauaugugccugcuaggaacagggcuccauggcaggaggugcaguggggugagugaggaugacugccugagcuccaccuccugucagaucagcgguggcauuagauucucauaggagagcaaaccccauugugaacugcacauuugagggaucuagguugcaugcuccuuaugacaaucuaaugccuaaugaucugagguggaacaguuucauccuugaaaccaacccccacccaacaguccauggaaaaauugucuuccacaaaaccagucccuggugccaaaacgguuggggauugcugugugguguagcaauaacuucacacuuuuuuucuuuuuuuuuuuuaagacugagugucacuuugucacccaggcuuggagugcaguggugcagucucgacucauugcaacccccacuucccagauucaagugauucuccugccucagccucccgaguagcugggauuacaggugcccaccaccaugcccagcuaauuuuuuguauuuuuaguagagacaggguuucaccauguuggccaggcuggucccgaacucuugaccucaagcaauccaccugccuuggccucccaaagugcugggauuacaggcaugagccaccaugccgagcuucuuuauuauccuuuuaaugucugugggaucaguagugaugaccccucuuuauuuucugauuuuaguaauguauguauacucucuuuuuuuuugugguuaguaugucuagagauuuauuaauguuauuaaucucuucagcgaaucaguuuuugguuuugccauuuuuauuauuguuccuguuuucaaugucuuuuuguuuguuuguuuuuuuguuuuuugagacggaaucuugcucuguugcccaggcuggaaugcaauggugcaaucucagcucacugcagccucagccucccaaguaacugggauuacaagcguacaccaccccgcccggcuaauuuuuguauuuuuaguagagaugagguuucgccauguuggccaggguagugucgaacuccugaccucaagugaucugcccaccuugguuccaaaagugcugggauuacaggcgugagccaccccggccugcucuguugauauauuuucaagcucaugccagucuacugggugagcccaucaaaagcauucuucauuucugacacuuuauuuuucauuggaacacuucgauucuuugaguuuccaucucaccacuuauauuucugaucuguucuuccuuguuauccacauuuuucauuagcacucuuagcauauuaaucauaguuguuuucaauucccgggcugauaauuccaacaucccugccauauuugagucugguuuggaugcuugcucugucucuucugacauacugucagguggccaguguugucuaccuggacaccugagcccaggacucuggggcuuuuauugggggcuuaucucuuaggcauaggaccugugugacugaccacaauuacugaaguuccagagccuucaaaggaaagcagguguucaccuucagucacacuguuugcgcaaacuaucuaaacagacuaguacaacaugguucaagaucugagcauacagaacacauuugccaguucagauauuucaagagcucaguuaccacaagcuggccaaggcuuauucaugaaaauaagcccuuuugggggaugcugaaggcuuuggcaauucaggcuugcugaguuaaugcauucccacacagcuaauaucccaauuuaaaaaucaaucauauaaauaagaaaagacuggcaaucaaauagaaacuugaacagaggagaguaauacccaauaaaggaaaaucaguaauuuuaagcuuauggaaaagugccuaccauuucauaagauaagauaaaugcaaauuaaagcaacacugagagaauguuuuucaccgaucugauuaauaaaaggugugggaaacagguaauucuaugcguauguauauuuguauuaccuguauggaauauauuuuggcauuauuucucaaaauuccaaaugcaaacacucuuugacuuaguguuucacuuuuuaggaauuuauuauacagauaaacucuuauaauuaugaaacaacagccaagugugguggcccaugccuguaaucccaguacuuugggaggccaaggugggcggaucaugaggucaggaguuggagaccauccuggccaacauggugaaaccccaucucuacuaaaaauacaaaaguuacccgggcgugguggugcguaccuguaaucccagcuacucgggaggcugagacaggagaaucacuugaaccaggggaggcugagguugcggugagcugagauugcacuauugcacuccagccugggcgacagagcgaaaauccaucucggggggaaaaaaaauaugaaacaacauaaguuugugauagcaaaagauugggaaaaaaucuaaauuucauuaauaggggacugguuaaauaaaauaugauacaucuuaguuaaacuaucaggcauguuuaaccuucaugauacauauugccacaggagaauaauuuuuaaccauaauguuauacucuaaagacauuuccgucguuuuagaaauaaaaagcugucauccacucagaucuuauacuuguuagaaauauagaacucagauuucagauggcuuugagguuccuuauguguaugcauuugagcuaugaagaaguuugaagguuaaggauuauuuagguauaacucauguuuucucaaaccaggaaaaaaauuggggacauaacugucauggaguuaucuuuacucaaucugguguagaaagcauuucccaaccucagagauuuauguucuuuuuuuuguuuuaaagacagaugcacauuauuccauacugucacuucuucugugucugucagacucuccuucaaacagcaguuauguggagacaccaagaaauaaagaaguggguauguuacuagauuccuuaacauaugagaaguaaaagagaaauuguuugauuacuuaguugcuaaacacugaguuuuauugaaacuucuaaaaaucugugaaacuaaaguauuucuauugcuuuagaugcuaucacaauuguaaaauuuuauuuaaaaugcugucagcccucuauauucucagguuccagacccacagauucaaucaacuacagaucaaaaauauucaaaauaaauaaauaauaauacaacagucuaaaauaauacaaucuuuuaaaaaacuauuuacauagcauuuacaugauauuagguauuauaaguaaucuagagauuauuuaaaguauacagcaggauguauuuagguuaugugcacauacuacaccauuuucugucagccuugagcauugcggagggugguguaccuccuggaaccaauuccccucagauauugagggaugacuguauucguucuaacuuuacaaacuaccuucagcuguagaaagagaacacucaccuuugagaaugaguuaauuaaaauguaaaauguuuuaggauaucaauuuauuaaauguuucaauauuuuuaaauuuuuauuuccugaguauuuugagucuuguuagucuuuuuuccuuaguuuugagguuuuuuuucaaagauagauauaauaaagccaaugaaguucuucuguuacauuuuagaaaagaaagaugauuucgacuggggaaaauacuugauggaagaugaagaaauggacauugguccguacauggacacaccaguaagugguaguaguuuugcuauugaaaauugaaauacacgccaggugauauagaugauuuucaugggucuuuccacccuaggucaacuuagcuaaaacaggaacacucuucacuaagcuagagucauuuauuauggaagacugauuaggauuucgcaccaaaucauuagugguaagaaguuaaaaggggccgggcaugguggcucacaucuguaaucuccugcucacuuucgagaggcaggaggauugcuugagccuaggaauuugagaccagccugggcaacauagcgagauccugugucuauuuuuaaaaaauaaauucuaaaaaaguugucugggcuugguggcucacaacuguaaucccagcauugugggaggcugagguaggcggaucacuugaggccagaggaguucgagagcagccugggcaacauagugaaaccccgucaacuaagaauacaaaaaauuagcuggguguggugguacacgccuguaaucccagcuacucaggaggcucaggcacgagaaucucuugaacacaggagguggagguugcaaugagcugagaucgugcuauugcacuccaaccuggaugacaaagcgagagacucugucucaaaaaaaaaaaaagaaguuaaaaggggugaguacaaguaucccuuaaggaccugugaucuugggacuuuuugccacaaaaaauaauuccauuccuuauuauuucaacauuauagaaaaaaagaaaaaguaguaaucauauuuccauuccuauaauaggcacuuccaagagauuuaggaaaaaaaaauuuguuuuucuguuccauguugcuucaaaguuuuugcuuuucuucaaaguuuucuuagucuuuuaauguaaauagcuuuaaguguuauacucuguaaagcuaaaguguaucucuuuuuuaaaucagaauuggucugaagaaagugaagaggaaaaugaucaacagcccuuaagcagagaggacucuggaauucagguagacaggacaccguuagaagaacaagaucaaaacagaaaacuggauccuuguaucaguuggaaagguauuauguguuaugaggugcucgcauuuucuaauagacaaauucccuagaaggaaaggcaaacuuugagaucaguuccauguaaucaagguauuggcuaagcucuaccauccuuauaaaaccaauuuuuaaaaccauuaguaauguuuucuaugaugcuuaaguaguaguacuauagaauuaauguugaauucauacauguagaguguaauuuuguaauuuuuuuccuauacuucugagaacuuucucagcuguaaauguuuccuuuuuuuuuuuuuuuuuuaauuggagaaggacugauuuugcuaagauugugccacugcacuccagcucuggcaacagagcgagacccugucucaaaaaaaaauuaaaauaaaaaaguauaagggaggauaugcauagguuauaugcaaauacuaugccauuuuauaucagggacuugagcaccugcagauuuuggcgucugcagcauuccugcaaccaguccccauuggauacugagggacagcugcauuuauuccggacuuucuaaucugugcacuuggugucagugugacccagaaacagacagacuuuuuuauuuguguggcuuuguaguauuaugucuuaauacauagauggcaaguuuccuuucagcuacuugggaggcugaggcaggaaaaucacuuggcuccuuuucuuuuuuuuuggagacaagggucucacucuguuucccaggcuagagugcaguggcacaaucuuagcucacugcaaccucugccuccuggccucaagcgauccucccaccucagccuccugaguagcuggaacuacaggugagugccaccauacccaguuaauuuuuguauuuuuuguagacacaggguuucaccauguugcccaggcuagucucaaacuccuagacucaagcaauuacuccgccucugcgucccaaagugcugggauuacagaugugagccaccaugcccagcccacuuugcucuucccccccacccccuuuuuuugagacggagucucacucugucgcccaggcuaugguacaguagcaugaucucaccucacugcaaacuccaucucccagguucaaacaauucuccugccucaguuucccgaguagcugggguuacaggcguguaccacacucagcuaauuuuuguauuuuuaguagagacaggguuucaccauguuggccaggcuggucucaaauuccugaccucaacucguccaccugccucugccucccaacgugcggggauuacagaugugaaucacugcucuuuuucaaaauuggcuuagcuauuugugaacuuuuauucuucuauagacauuuuggaagcagggugguaaacuuuaaagaaaaaaaaggccaggugcaguggcuuacgccuguaaucgcagcacuuugggaggccgagcuggguggaucacuugaggucaggaguucaagaccagccugaccaacauggugaaaccccacgucuacuaaaaauacaaaauuagcugggcauaguggcgcaugccuguaaucccagcuaccugggaggcugaagcagaagaaucgcuugaacccagcagguagagguugcagagagccaagaucacaccauugcacuccagccugggcaacaagagcaaaacuuuaucucaaaaaaaauaaauaaauaaaaaauaauccagcuggaguuuuuauugggauugcagagaauuuauagaucuaauuuggggaggcuugauugccuuaacauaauaauagcuacauuuaucguaauuuuuuaucuuuuacuagaguuuggaaauuuuuuuuaaacaucuugaguguucauuuguuaauuucuacauauguuauaguuuuuauuuuugugaauguugccucuuuuguuuauuccugauguagaagaaauaauauugcuuucuguaaguuguccguauaugcagcauuuuuacugaauucucauaauaguuuguugauucauuugguuucuuauauagaugauuaguaucaucugcgaauauugaugguuuuauucuuccugcuaguucuuaugccuguaucuucucugugacaugaucaaaucucuuuucuggcccagcagcccaacccucuaguccguagcagaagcaacagcucaugggagugggcuuccuggaugacuaggucucauccuaagggggguuauaccugaaacuccuccguuaagugugaugguuguuugguaucaguucaggguauguggccuuuaucaaauuaagacaauuuccuucuauuacuuuuuuuuucuagaagucuuuaauuaugaauaaauguugaauuuuuauuaaaugcuacuauuuauccgugagauaaucucauaacuuuucucuuuuauccuaauaaugcaucgauagauuuucugauguugaauuauccuugaauucuucaccuaaacuugcuugaucauguuauuuuuuaguacauuuuuagaucggauucaauuuuggauuugcuuuuuuuuuuuuuuuuuuuuuaagaccgggcccugcucugucacccaggcuggagugcaguagcgugaucacagcucacuccagccucaaccuccugggcucaaaguauccucccaccucagccuccuaagaagcuggggcuuccagugcaugccaccacacccagcuaaguuuguuacuuuuuuguagagaugaggucucacuauguuugagaccagcccaggcugggauugcaggugugagccaccgagcccaacagguuagcucuuuuuuaauguaggauuuuucaucuuuauucuuugaugaauuacauguauccugucuuugucuaguuuaaagcaucacuguuacauuagccucauaaaauguuagguggcuuucucuuuuucugcuuuuucaaacaacuuguauaagauagagguuaucuaauccuucaaaauuuagcaccaguccugagacuuccguagugguugggaaggucuucaguuaccauuucaguuuccuuaaugguuacuggacaauuaacauauaccauuuauaucuuuuuauguauguggcaauuuuuuuuuuuuuuacuuucuagucaguuacauuuaauuaaauuuaguaugcguuucuauaugugugguuuuauuuuauuuuacuuuguuuuuugagauagggucuuacugugucacccaggcuggagcguaguggcaugaucucagaucacugcagccucaaccucuuggcucaaccaguccccucucgugucagccucccgagaacaagcacaugccaccaucccuggcuaauuuuuuuguauuuuuuguggagauggggggucauacuuuguugcccaggcuggucuugaacuccuggauucaaguggucaucccacccuggcuucccaaagggcugggauuauaugugugagccauagaacccagcagauauaugugguuuaaaauaaucauauauacauaaauguuagguagcuguuauuuuuaaaaagccauuuucaacuauacguuugaauggagcuguaaguccagguauugugacccaguauuuuguuguuguuaacucaaacugauuacauuucuuucaagcagaugagccagaugaccgaagcuggcuggaacaucaugugguccaucaguacuggacagccaggcccucccaguuuccucauaguuuacauuugcacucuaauuuagcugcugucugguaagaagcuaaaguuuucauuuaaugugaugauagaagaaacuuugauguuuaaacguuuggcuuugauuugugacuuaaguucuucccugaaauuuaaacuuguuuuuguuuugacaauucuuuuuuuuuuggagacagauucucacucuucguugcccagacugcagugcaguggucagaucucagcucacugcagucuagaccucacucaacuaauuuuuuauuuuuuauuuuauuuuacuuuuuuuugcagggggagacaaagucucgcucugucacccuggcuggagugcaguggcguaaucauggcucacuguaacaucugccucccggguuccagcaauugucguccuucagccucccaaguagcugagauuauaggugcaugccaccaugcccagcuaauuuuuauauuuuuagcggagaugggguuuuaccauguuggccaggcuggucuugaacuccuguccucaagugauccaccugccucggccucccaaagugcuggaauuacaggcgugagccagcacaccuggcugguguugaaaauuuuaguugaauaguuuuuaauuauuuguuauugaaaaucauuaaauuauaguauuauuuaauuauagucucuguuuccauuuuuuguuguuaauuucaguguaaauggauugguauauauuagggcauuauuugauuucuguuuugguauacuuacugcaaaaauacacaucuuguuuuccagaaaacaacauuacauaguuguaaacauuugccuaaaucagcaauaaacguaacaauuguaauuguucugaaaguguuucucagaguauucugauugacaugaaaauauagggggcauuuaagccauuuauuauguauacuuguuaguugauugcuacuuaaguuagcacuaaauugcagauauucuuugagauaaguuauuuacuuacuuagaaaccuuucuauugacauuuauguuugcugucucauagggaccaacacuuguacagcagugauccauuguauguuccagaugacaggguuuugguuacugagacucagguuauucgggaaacccuaugguaagaaauguucauuuaauuaauagucuuuaugagacuugauuacugagaagcaaaaacuuuuauuaaaggaaacuuuucaagcauuuucacaugcaaacuagaaaagguccauuaggugugaaguucggaccagauuugacuguggagauugagagaguuugauauaauuacuucauuuucauuuuaaauaauuuagcauaugauuuacuuagguuagcccaucucuucuuuaacaccugaguucaaagcaagauuugcuacugauuuuuuuuuuuuuuuuuugagacggagucucacucuguugcucaggcuggagugcaguagcucuaucucagcucacugcaagcuucaccuccuggguucacgccauucuccugccucagccucccgaguagcugggacuacaggaacccaccaccaagcccggcuaauuuuuacuuuuuuaguagagacgggguuucaccauguuagccaggauggucuagaucuccugaccucaugauccacccaccuuggccucccaaagugcugggauuacaggcgugagccaccgcgccgguagcuacugacuauucuuaauagguggaguauaucaaugagggccugugcccguaccuggaagccaggaaucuaaugcggcacauggugcuguuacuacugaaauuccaaguccuggugcucucaccauaaaguaugauauugacaugcucgcauucuuagaaauaggaagaucucuuugggucgucaaguauauaggggagaugcuuugacaacauguuuuagacuucucuaagaugauguugaaauaucuugagucuuaggguaaucagaugaaaagauugaugucuuccauuuucuuauuaucugaccuuuuugccccuaauucugaauauuuaauaaaaauuuccugagguggggcauggugguucacaccuguaaucccagugcugugggaggccaaggcagguggaucacuugagcucaggaguucgagaccagccugggcaacauggugaaaccccguaucuacaaaaaaugcaaaaauuagccaggcauggugacaugcaccuguagucccaacugcuggagaggcugaggcugcagaaucacuugaacccaggagguuguggcuccagugagcugugaucaugcugcugcacuccagccugggugggugacaaagugagucccugucaaaaaaaaaaaaaaauguccugggcauacugucaugaauauuuuucuagacuuaaaguacacucgucuuuuuuuaaucucauuucagguuacuuucaggagugaaaaagcucuuuauauuucaguugauagaugggaagguaacugugagaaacaauauuauaguaacucauuuaacacauguaaguuauuuguauuuaugguaauuuaagaaauaggauuuauguaaacuaguaauauaauuuuagaacauuuuacaauauuaaaauugcuauugaacucguucuugcuuccucacaugcaaaaaaaagcuaacuuaaaaauauuuaauauccaaaaagaaaaauugaguugugcaucuuuauaguacguagaggauuccuuaauauuguuuggaacauauuuaauuucaauuugcauuuucugcuuuuuauuugucauucuguauugugaaaguuauauacuguaauuuuguuuugcuuuaaguacauuuacuuauguauguuuuuaaaaauauaagccauaauucucuagucuguugaaauuauuguucacuuuuuccuuuguguauaaaauuauaaauauuaaucauauuauuacuuugucuucuacuaaacauacuguuuaaaacaauugcaaaagaaguauuuuacagcgagagggaaaugaauuugaauguuuacagaagaccaccuuugaauaauugcaguuugcuuguguuguagagcuguuuacgaucugugcuggaacaaauagcagcauauggccagguuguguuucgacuccaggaguucauugaugaagucaugggacacaguucugagagcaugcugccuggaagugggucuguuccuaagaagucaacugaagcucccuuuagaaccuaccaggcuuucaugugggcccuguacaaauauuucauuaguuucaaagaggaacuugcagaaauugagaagugcaucaucaauaaugguauuaaauguucuucaucuuuacucauacuacacguaacucauaauuugaaugccacuuagaguuuuuauuauauaagauuugaaaguugccuagcagauaaguaguucucgugaaugcuucuuuuaaaauuauuuuaaauuuauauuuuuaagccauucauaucucuaaaaaucaaaaaacuacagaagauuuagaaugaaaaaucuaaauuauucuuccugcaccaguaccccagccagucaguucuccucuccagagacagccagguccuuggcuucuuacgcauccuuccagaaagaguuucaacauacaugagcagugcauauacauauacgcauaccuagcagucauuacacugcucucuucaaauuuuuccaguuuaaauuuugaggauaauaccauacauauaugaagagcuucuguuuuccuuuuuacaaauugaguguuucaucauauggucgugucauagcccaguccccuuaauggauuuagguuguucccaggcuuuugcuauugccaguagugcugcagugauaaucacuucuacauauccguuaucguacacaggcagugaguuaucuguaggguagguucuuuuuuuuuuuuuuucauuugagacggagucucgcucuguuaccuaggcuggagugcaguggcucaaucucugcuuacugcaagcuccgccucccggguucacgccauccuccugccucagccucccgaguaacugauuacaggcaccugccaccauccccagcuaauuuuuguauuuucaauagagacaggcuuucaccauguugaccaccuuggccucccaaaaugcugggauuacgggcauaagcugggauuauacugcaucugaccaugugggguagguucuuauaaauggaauugcugggucaugugugauuuuccuaaguuuugccacuuuauggggagguauagguaaauacauuuuuacuguugugaaccaaguagaugaauaccuguuuccucacacuucuugccaucuguguguuaccagacguuuuggucuucaccaguaugacagcuguaaaaugguaacccauguagcuuuuuuccccuuaaauuucauuuugaacuaccacaaaaaauaguacagagaggcccuguguucccaugaccuugcuucccccagugguaaaaccuuacauagugacaguacauggucaaaacugggaaacugacauugacacagcacauuagccaaacugcagaccugacaugguuucaccagugucgcaggaacuugcuuugaacaggggugggugugguauauucauguauaguuuaucacaugucuagcuccacauagccacuuccauguucagaucacagcugugccaucgccucccaggagcuugcuugugcagcccuuuguaggcacagccucccucaccccucucuguaacauuagcccauugggagguguuuuguuuuaccuaguguaauuuuaauuugcguucuuuuauuauaaguaaggucaagugacuuucuguauguuuuagaaucacucaucauuccuuuuuuaugaacugucaguuccuuuauacauuauuuuucugcugaguugucuuuuucucugugacuugcaggaguucuuccuuagggaaauuagguccuugugguaugagauuaaaauccaccguccuccauuuugcccugccuguccauaagccugaugauuugccagcauuuaugucacauuuuagaugcauguauuuuuccuugcuguugaguuugauuuauugauauuugcagauacuacaauaacucuugcaauagugguggacaaguuggcaccucgauugucucagcucaagguucugcacaaaguguuuaguacuggaguagcagaaguuccaccugauacucgaaaugucguccgggccucucaccugcuuaacacccuguacaaggccauucuugaauaugacaauguuggagaagccucugagcaaaccguaagugagacuucugccuaaagugugugacuccaugcugcacagcagaggagugauagacagcugaugguaguucuuuguugauacuugaaugaugacucgucagacaguucagaguuuuuaaauuaacuuccaaauuuaaggcuguaggaaacuggcuuuucagcucuaauugccaagauccucagaaggaugaggcaaggacaaggcaagcugugagaaguaccuaccugauguguauagauauuuacaauaacgcuuucuuacauaaacacuaacauguaacuaacaugacaugagauagcugaaguagacacauccacagaaacaaaguggaaugcugguuaccaagggcuggggaauggggagcuguuguuuaauggguacagaguuucaguuuuauaacaugaaaaaguucuggagauuugucacaacgauaugaauguacuuaaaaccucugaacuuaaaaaugcugagggucaggcacaguggcucgugccuguaaucccaacacuuugggaggccgaggcaggaggauugauugagcccaggaguuugagacuugccugggcaacauaguaagacucugucuuuaaaaaauuaguuaaauuaaaauuuuuuaaaauauacaguuaagauaaauuuuauguuauauauuuuauauuguauuuuaaaaaauacaaaucuaggccaugcauaguggcucacgccuguagucccagcuacauaugagucugaggugagaggaucacuugagcccaggaauuugagaccagcccgggcaacauacugagacccugucucuacaaaaaauuuuuaaaguagccaggugugcugacaccaggaauucgagaccagccuggccaacauggugaaaccccgucucuacuaaaaauacaaacauuagccuagugugguggcgaacaccugucaucccagcuacucaggaggcugaggcaggagaauugcuugaacccgggaggaugcagugagccgagaucgcaccacuacacuccagccugggcaacagagcaagacucugucucaaaaaagguagccagcucuggaggcacaugccuauggucccagguacucgagaggcuaaggcaggaagauggcuugaguguggaaggucaaggcugcagugagccauguuugugccacugcacuccagcuuggguaacagagcaagacccugucucaaacaauauauagauuuaaaaauaaaaaucuaacuagaggcuguaauuuagaaugcuacagucuuaguuggguauguacauuagguguauuuucuaguuuguugguauaacuuuuuuucacaccaauuuaauaccauauuucuuuuuuucuuuuuuuuuuuuuuuuuuuuuugagacguagucuugcucuguugccaggcuggagugcagucgcacgaucuuggcucacugcaaccuccaccucccagguucaagugauucuucugccucagcccccugaguagcugggacuacaggcgcacaucaccaugcccggcuaauuuuuugggguuuuuuuuuguuuuuuguuugagauggagucucgcccugucgcccaggcuggagugcagugucaugaucuuggcucacugcaaccucugccuccuggguucaaacuauucuccugccuuagccuccugaguaccugggauuacaggcgcccaccaccaugcccaucuaauuuuuguauuuuuaauagagaugggguuucaccauguuggccaggcuggucucgagcuccugaccuccugauccgccuaccucggccuuccaaagugcugggauuacaggcaugagccaccacacccagcuguauuuuuuuuuaauagagaugggguuucaccauauuggccaggcuggucucaaacuccugcccuugugaucugcccaccucagccucccaaagugcugggguuacaggcgugagccaccaugcccagccaauuuccucauccuuaauggaugcuuugcuaguaauaggauuuagauagggaaaccuuguucgcuugccugggcuaucucaggauacaccugcugccucugugucacuuucacucucaaguuucccagucuggacuacaaacaauaugaucaucccauauuuaggugaguuuuucuuuuuucuuuuuuuuuucuuuuuguuuugagacagugucacucuguugccaggcuggaguguaguggcacgaucuuggcucauugcagccuccaccugccagauucaagcaauucuccucccucagccucccaaguagccaggacuacaggcgcgugucaccaugcccagcuaauuuuuguauuuuuaguagagaggggguuucaccauguuggccaggauggucucgauuucuuaccucaggugauccgcccaccucggucucccaaagugcugggaucacaggcgugagccaccacgcccggcauuuaggugaguuuuucauaaggauuuuauaguguauguuuuuggauuuuuaauuucuuugugccccaaaaaacauagaaauccgaucacuuuuuuaaaggcauuucagaaauguuuaaaccuccuuuuauccuagugaccagggaacccugagagcugaccgugcacacucucugccucaggucucccuccuuuucucucucuggguggaaacggugcggccuuaccugcagacgguggacgaguggaucgugcacgggcaccugugggauggcgccagggaguucaucauccagaggugagcugcagcagagcacaaggucacugggggcuggcaucaccaguuuccuccccaugaaaaucaaaugcuuucguuaguuucagacaguacugagaaagcacaguucacaucacagaacuugucgucaucauaggcaaguucuaucucauuuuuacggaaggcaucaguaauaccagcugauuagaaauaucuuuguccaaguuuugucaguccgcaacuuuucuuaagcaaauuauauuuuuggaugguaguauauuuauggcuagcuaguacacacugcuucccauaaaaugaguuuagaugauaucauaugguuucagcuauuuccauuguaaauuaucaguaaagagauacagaaauauuacagaguaugccucuaauauauuuauuucucugaauuaucuacugauuucuuuuaccuuaguauauuuuacaaaacaaggaaaaucuuaauccauuuaugacaauuucccuucaguuaauugauuuuucugaauagaaucauauaaacaauguagagcuauuuguacucuuuuagcccaauuuuaaauuaugcgguauauuuagauauaugguuucuauugauagcuauccauugagcucaucaggaaggauaacuuuaagucuuuaguguucuggaaggguagcaauauguaugcaaugcucacauaagugaacugacccuuccuucaacucaaucucauaucugucacuguguucugauucaucaaucucacaugagaauuuuugugaaaaauaggacucugacuguucuucuagggugaugauugaccaucauuuuauuguuaaaaguaguccaguuaagaaucuuuguagggaaaaugauagagaagucugcaaauuaguuucacagcagaugguaaauggauaaacuuuuauucuucuucuaaagaggaccaaauuagucauauuuuaaauaauuccaauucaggaaacuauuucuacuuaaauuuuacuuacacuauucaaaguauuuauucacuuuucucuuuaaacugagaugagauuaaaacugucccauuuugccuaaaguuugcuucaguuuacuaauaauuaauacuauguuuuauaaugucuggacaacaaacuagaacaaguaugcuguuuuuaagaaagagaaauaagaguuuaaaauucuuuugaaucucuuuagaaacaaaaauguuccaguuaaucacagagacuucugguaugcaacuuacacguuauauagcguaucagaaaagacagaaaaugaagaaaaaaugagugauaacgcuagugcgaguuccggcagugaccaggggcccuccagcaggcagcacaccaugguguccuuccucaaaccuguccugaagcagaucauaauggcuggcaagucgaugcagcugcugaagaaccugcagugugcggagagcaccaccugccaggcaggagccagagguacuuguuccgucuuccugugucucucuugguguugggacaccugacccuacucgcucuugucauccugauaccuaauuauuuuguaguuugcaagucaucaaacccucuuauuucgguggcaauuaucgucaugguugaauuaguaaccaugcugcucuugauuuuuuaaaagauugucuucauugaaaacuuuuagugcuguguuugaaaaggcagugacgauaaguuccacaugcauuuuccucacucuggauuccuuaggacuggaacuuuaaaaaguaauccccugccauuucuuuucuuuuauuauuuuuauaaauugacauaauaauuguacauauucaugggguacauagugauguuuugauacauauauagugaucagaucaggauaauuagcacuuccaucaucucaaacauuuacuacuucuuuauguuggggacauucaguauccucuucuuugcuaugugcaacucuauaauacauuauuaacuauagucaucccauagugauacagagcacuagaacuuauuccuuccagcuagcuauuuguauccuuuaacaaauaucuuccucuuucucccuucccccuacaaaauccagcaucugguauccuguucuacuuuuuacuaauacgagaucaacauuuuuuagcuaccagaugagugagaacaugcaguguuuaacuuucuguuccuggcuuauuucacuuaauguccaccauuuccaucaguguugcugcaaacaacaggauucacucuuuuaucuucaagauauauacauauauauauauauauaucucacaauuuuuuuacccauucaucuguuguugggcaccuagguugauuccaugucuuggcugugugaauagugcugcaguaaacaugggggugcggaugucucuuugauauccugauuuccuuuccuuuggauaaaugcccaccagugggauugcuauaucauauaguaguucuauuuguaguuuuuugaggaaccgccaaacuguucuccauggugucuguacuaguuuauguucccaccaacauuguguaagaguuuccuuuucuccacauccucaccagcauuuauuuuuugucuucgugauaaauaaccauccugacuggggugaaaugauaccucauugugguuuugauuugcauuuucccuaauaauuagugaugcugagcauuuuuucaucuauuucuuggccauuuguauuacuucuuuggagaaaugucuguucagaucauuugccuuuuuuuuuuuuuuuuccugagacagaguuuuacucccaucacccaggcuggagugcaguggugcaaucugggcucacugcaagcucugccucccuggcucaagugauucuccugcuucagccuccugagcagcugggauuauaggcacccgccaccacacccggcugauuuuuuguguuuuuaguagagacgagguuucaccauguuggccaggcugaucucgaacuccugaccucaagugaucugcccgccuuggccucccagagugcugggauuacaggcgugagccaccgugccuggccucauucauugaauucuuucacuguaaaauuuguuuguuaaacaucuguuucuguugaauuucucauucaaaucauucuuuuccugauuuuguugaguguuuauuuguacugucuuguaucucaccgaguucucuuguaucucaccgaguuuccuuaagauuuuaauucugaauuauuuuuccggcauuuccuauaucauuguagucucuugcuagagaauuauugguuuucuugggaggugucauguuucuuugcuuuuucauguuugauguauuucuacauugauuucuacacaucuggugggaaagucaccuuuuccaauuuuauggaguacguuuuguaaagaguuauucauaugaaugggucuuggaguguggguucagugggaugcauucaccuugguucuggacaaaugcaguaguauagucuccauguacuuucuucaguuguaauccacuuuagugauguuugcaagugccucaguggccuacagugaggggguuuguggcaacaguggcacaguuggcugggcgugguggcucacgccuauaaucccagcacuuucuuuuuugagacagucuugcucuauuaccuaggcuggagugcaguggcaugaucucggcucacugcaaacucugccuccuggguucaagucauucucuugccucagucucucaaguagaugggauuacaggcaugugccaccacgccuggcuaauuuuuguauuuuuaguagcgaucggguuuuaccauguuggugaggcugaucucaaacuccuagccucaagcaauccacccgccucggccucccaaaguauugggauugcaggcgugagccaucacgcccagccaaucccagcacuuucggaggccaaggcagguggauuacuugaggccaggaguuugagaccagccuggccaacauggugaaacccugucucuacccaaaauauaaaaauuagcuagaugugguggcgcaugccuauaaucccagcugcuugggaggcugaggcacaagaaucacuggaacccggaaggcggagguuugcagugagccaagauuauaccacuguacuccaaccugggcaacaaagcaagacucugucccaaaacaaaaaacaaacaguagcacagcuuugcugggaugggcuugcuggacuguuucucagauuagggguacaugcauguacacagugguuuggccaagguggggucuggcucaggguuugggaccacaggcuguuacucuggccaggaacaugagcaugugguugcuuggccagccuauagguuuauuugccugccagcaauggcccaaggggcuguuucucaggccuaggauguaggcacaaaacugguuuucuggccaggggcuccaugagaacagcccucagggucauuucucaagccuuggacaugagcacaggcuucuuugcucgccugggaguauguuugcuggggguaaccuauaaggcuguuucuuaggcccaggauguggguacaaggcugcuuugcuagccugggugcaugucugccugcacaguucaaggggcucuuucucaguccugggacauggucacauggcuuguuggccguccuagguauguaucugccaguggcagcccaugaggcugcuucugaggcccagcauguggguggaaggcugcuuggcuggcaugagggugugauuacuggggguggucuucaaggcucuuucucagguuugggauaugggugccagcuggcucagaacaugcccaccaagggcagaccacagggcuguuuggcaggcccaguaugcaggccuguggccgcucuguuggccugugacucccaggcgcugccuauggggcuucuucuccaaccaaagaugccgugcaaggccgcucaagaagccuagguacaugccugccagggcagccucugaaacuguuucucagacccugaaugcugacccagggccacuggguaggccacgggccugucugcaagggguugaugcuguggggcuguuucucaguuccugggcaaaggucuguaacugcuucaccagccuggaggcaugucagcugguaggaagcucaggggucuguucccacccucuagagauggcacagcaauuuggccagcucaaagauggguuuggucuguuggggcugccagacuguuccucugucugaaagugcaguggcaggggcugguuuuucugcugugcaggaccagaaucaccagucgauccugggcccaggcuccacauagcugggguugugguguucagccaucccuguggccuugguggaaugaggauggagccccaguggcuggggugcaggagaggugcagcagcuacuggcccagaggagggcgugcuccagagguggcucuggucugaagauggugccaugcugcaacagcuuggcucaaagggguggguggggaaggcacaccuugugccccuaacccggggcaaggcagcugcgugaauucccagcagcucuccaaacugggcucagagcucgugggaacuguggaauccuccuguaguaaugacuguagguguuugugggggcugguggguuucuucugcuuacccuuacccuacaaugggaaguccuucuugacuccagaccagccuguucugcgaagcugcagaggcuggaagccuccacacugcccuccugggccuccagucaccaacacugugucacauucccccucugcacuccagcacucgcccuucaacuccagucggaucuuuuuuuuuugagacggagucuuucccugucgcccaggcuggagugcagcggcgcgaucucggcucacugcgaacuucgccuccuggguucucuccugccucagccuccccagcagcugggacuacaggcgcacaccaccgugcccggcuaauuuuuuuguauuuuuaguagagacgggguuuuaccauacuagccaguauggucucgauccccugaccucaugauccgcccgccucggccuccugaaguguugggauuacaggugugagucaccacccccagccuccagucggaucuuaacuguugauucguugcuuugguccucucuugcuguugggagaggaacaccagacgucuccaggcagccaccuugcuggcgacuggagugcaguggcaugaucucggcucacugcaacuucugccucacagguucaagugauuucucaugccucagcuucccaaguagcugggacuauagaugugagccacuacgcccggcuaauuuuuuguguuuuuaguagagaugggguuucaccauguuggccaagcuggucuugaacuccugaccucagcugauccacccgccucuuaaagugcugggauuacaagcgugagccaccacaaccagcccuucuggcauuucuuaaugcaaugcagcguuuagcccuugagggccgugaaccauggcugauaagaauuucuuaugagcaguucagacucgaucauaaauuucaagaaaaugaugcaauuuaauauauucaaaguuuuaugcuguaaucccagcacuuugggaggcugaggcaggcagaucacgaggucaggagaucgauaccauccuggucaacgugguaaaaccccaucucuacuaaaaauacaaaaauuagcugggcaugauggcaugggccuguaauuccccacuacucaggaggcugaggcaagauaaucgcuucaaccagggagucagagauugcagugagccgagaucaugccacugcacuccagccuggugacagagugagacuccaugucaaaaaaaaaaguuuuaucaacugacuaaaaaggcuuggaagauaaagaugugaccuuauuuauacaucucaaucaucucaauguuauguuaauuauauuauuguaucuacuugaaauaaguagaugcaauacuuauuuucacuuuguggaauauuuccuucuuauguagugagcuucccagggccacugucagaaguguuuuuuccaaugagacugcgacuccuaucaggguuaccauaguguuaugcaguauuguaauaaauuucaagugugcugauuaggaucuuacucuuuuuuuuuuuuuuuuuuugagucagguuucacuccuauugcccaaacuggacuggagugcaguggcgugaucucagcgcauugcaaccuucaccugccagugcucacgcaguucucgugccucagccucccaaguagcuugggaccacaggcacauuccacugcacucagcuaauuuuuuuguagagcugagguuucaccauguugcccaggcuggucucaaacuccugagcuuaagugauccacccgccucagccucccaaagugcugggauuacaggcaugagccacugcacccggacaugauauuauuuaauauuucuugggccaggcacaguggcucacgccuguaaucccagcacuuugggaggcugaggcggguggaucacuuaagcucaggaguuugagaccagccugaccaacauggugaaaccccgucuguacuaaaaaacaaauauauaaaauuagccgggcgugguggcacaugccuguaaucccagcuacuugggaggcugaggcaggagaauuguuugaacccgggaggcggagguugcagugagccaagauggcgccauugcgcuccagccugggcaacaagagcaaaacuccaucucaaaaaauauauauuauuuuguuacuauauauaaauauauauauuuaauauuuacauauauuuaauauuuauauauaaauauauagauuuuguuacuuaauauauuguuaauguuaauaugauuaaacagaauguuacuuaauaugauuaaacagaacuuaguucaccuuacauauuucuuuauguuucagaugcagaaagaaaaaguuuauacacucucuuucuggaaucuguacagucccgucuucgacauggagaagauuccacuccacagguucuuacugagcaacaggcaaccaaggagaaccugaugaagaugcaguccauugcugaaagccaucuugaacuggaugauguucaugauccacugcuugccauuaacuuugcaaggugagacacaccugcaagguuaucaguaauugaaauggcaucauuugugcaauguuugcuaacuguuuauuucuggcagguagggcuaaaaacaaaaacucuuguaggcuauccuuucuuuuuucuuuuuccuuuuuuuuuuuuguuuguuugagauggagccucagucugucacccaggcuggaguguaguggugugaucuuggcugacugcugcaaccucugccucccagguuaagcaauuuuccuaccucagccucccagcuaccugggacuagaggcaugugccaccaugccccgcuaauuuuuguauuuuuuguagagacgggguuuccuccuguuggccaggcuugccucgaacuccugaccucaggugaucugcccaccucggccucccaaagugcugggauuacaggugugagccaccaugccaugccuauccuuuauaacaagcagaauacaagauguugugcucaccuacuucagguguauaguuuggauuccaugucguuuguggaagucugcagacuuggcccugccaccaugugguacaacuuuugucugugcccucgggccccuggaaaugucaucauuuacccagaagaugcugaaacucugggccaugagugggcccuggacacccauugagucaggguccccacuggcauauaauauguccugggcuuaagcugcuuuuaggcacuuaguccauuagaguaagucauuaauacccacacaguucccgguugucuaauggccagcauuugcuguguccagcccuaaucacuagaaagaccagcucuaguaccugacccuaagucaguggcaacuucaagagacugguucacucaaaggauauuuuugggagaaagauuuuucucuuucuguaauaguugguaacuucaagacuaaagguaaaaauggaacuucaggguuuugauuuaagagaguucuguugacagcagcucauaaaaagaagacucacauuuuuaucuugaaggauguauuuggagcagagugacuuucacgagaaguuugcugguggugauguauguguggauagaucaucggaaucugugacaugccagacuuuugaauuaacgcugagauccugccucuauccucauauugacaagcaguaucuagauugcuguggaaaucucaugcaaacucuaaaaaaagauuacagguaaaagaguaauuuaauuuuggaaguaguaaauaguugauuguacuugaagaacaguugagauuauuuuaaaaccuauuucaauuuuuauuagaguaggaaauggauauacaguaaacaauuuucuaagagaaaucaauugaccaucaauauuuucuuaacuauguuuugaaacuuaauucuuuauuucugagaaucuuucccaaaagaaauacagaaaaagcuuguagaaaaauuacaaaguuuguuaucagaaugaaaaacacuaaauuacuuagugauagaugacuaguuuuuuaaacuaugcauauccauaaauauggcauauacauacccacauaugaacuuuguaaaguucauaaaaauuauggcaauuaggccgagcacgguggcucacaccuguaaucccagcacuuugggaggcugaggugggaggaucacgagaucaggagaucgagagcauccuggcuaacacggugaaaccccgucucuacuaaaaauacaaaaaauucgccgggcguggugccgggcgccuguagucccaguuacucuggaggcuggggcaggagaauggcgugaacccaggaggcagagcuugcagugagcugagaucgggccacugcacuccagccugggcgacagagcaagacuccaucucaaaaaaaaaaaaauuauggcaauuaaaaagcaggagauauaauacgguaggaacuagguuuucuuaacacauagaagagaagacaggaaagaaacauuccagauauuaaauauuaaugauggaaauccaccauaaaugaugggauuuggauuuuuuuuuguuacauuuuugugacugcccaauuuucuauaauguuauagaagauaaccuuucugaugaugaaaggaaaaccuaugcuguuuuuauuauuggaacaaguuuaagagguguuaauauuucuaauuuuaguaaauguagaauguaaacuuguuccacuaaaaacagguuacaaaaccuguuguugauccagaauccugccuuacgaaugccagagaucuuagugucacucauuuucucuccauucagguugguagaauacuugcaagcuaugaggaauuuuuucuuaauggaaggaggagauaccauguaugacuucuacacgucaauuuuugauaaaauaagagaaaaggaaacauggcagaaugugucuuuucuuaauguccaacuccaagaagcaguaggacagcguuauccugaagauaguucacgguaaaauauggacgccaccuuuauuuaaauuaguguaacaugaacuaugugccaguaagucuucuaugaauuacacauauuauuuuauccucacuauuccuaugaguuuuacuaauauuauuuuacuuauuagaaaauggaggccaggcacgguggcucacaccuguaaugccagcacuuugggaggcagaggcgguggaucaccugaggucaggaguucgagaccagccuggccaacauggugaaacucugucucuacuaaaaauacaaaaagcaugguggcaggcgccuguaauccuggcuauuugggaggcugaagcaggagaaucgcuugaaccugggaggcagagguugcagugagccaagaucaugccacugcacuccagccugggcgacaagaacgagacuccauuuaaaaaaaaagaaaaaauugaggcagaggcuagcuaugugacucuccugcuaaacaacaaaagacguugagaugccaccauauggccagaugcaguggcucaugccaguaauccuagcacuuugggaggccaaggugggaggauugcuugagcuuaggaguuugcaaccagccugggcaacauagugggaccucgucccuauaaaaaaagaaaaaaguugccaccauacgaccugucagggucugauggccuccuucacauggcuggagucagugcuuccucucccugagcucccacacaugagguuuuucaguccugccuccuagagaaugccccugaccucucagaacuggcucagaacuccccaaugaccucugugucucucagccucacucccuuccaccaaaacggacuugacccucaccagggugaccucagaccaccagcagugacuuccaccacucaucccuaugcuccccgugggugccuccuaaacagauggacuaagcuuugucuuagaagggagaaagcuauuuacugucuggcuccauuuucccagccucaugucuugcacacauacacaccauguucucuuuccugucuuccuucgcguuucagggauuucagaauauuucuggugucugcuagugcuguccucccgccccccugugacauagucuccaguucaugggcccggcagaggucugcucauuccuacaucccccuugucuucgugugcugcacugggcugggagucccuggagggaagagagauuggcuuucuauugccugcucagugcagcaccuaacuuaguauuaguauuugguagaugccuacuaagcacugagugaaugcauacauaucaggccauuaagagcuaaaaauucuuuuuuuugagacagagucuugcucugucacccaggcuggagugcaguggcacaaucucgacucacugcaagcuccgccucccggguucaugccauuuuccugccucagccucccgaguugcugggacuacaggcgcccagcuaauuuuuuguauuuuuauagagacgggguuucacuggguuagccaggauggucucgaucuccugaccucgugauccucgaggaugccaaagugcugggauuacaggugugagccaccgcacccggcaaagagcuaaaaauucugacuagugccugugucauggaucagccaguucauaaucacacacugcccugugacaucucugauuuggaaguuaacuccccacuuuaaaccuucuucauaugcauccaggcauccccucuuagugccucugugacuguggaagaggacaucauuucucaggaaccacugaugggaguauuuugaggauuaaaugagcuaaggacacauaauagugccuggcacuuggacauuuucauguccauguuagaugcuugcuuuccucugugagucacauucaaaccugucucaggaacuuguggaugaagcacugcacagugccucugguguagaagcagaccccaucccaucucgauggggcucucgaagcaguacucucaccacaugcucggcuccgucgagcugcucugcucguccucuccugcccacccccaaccucagcagaggcuucaucuucccagccauugccugaaguuuacugucuuccucagcuucauccuuuuucuaauuacuaccauuguuaagugucucuuuaacuaaacucauuguuuaaaaguuuucucccucucuguuucuaaauccaaauuucugcucuggaauauauguuagaagagauacauuuguuggaauguuugcauuucuuuuaugaaaugcaguaucuuuuggggaauauuauguaaaugaaauaccaauuauuuuaaaagagcauuuuugugugacauagugcuuucacaaacuaaaacuggaauuucuuucuuuagucuaucuauaucuuuugaaaauguugacacagcuaagaagaagcugccuguucauaucuuagauggucugacccucagcuacaagguauaugcugauauuccuuguaugaaccguguuuucugcuaacauuaaaacaugcaaguaauugguuacuuucuaauuuuguuuuuguuucauaggucccauggcccguggacauuguuauaaguuuggaaugucaaaaaauuuauaaucaaguguuucuucucuuauugcaaauaaagugggcaaaauauagucuggauguuuuacuuuuuggugguaagauuuguuuucagcagauaaauuguaauuuuauuuaauuuuagcccuuaauaaaagagguuaaugggaaagggaagcauacggggaucuggaaaaaaaaaaaaaguuggugguuguugaucauuuuuuauguguacacaaaugccaaaauggugcguauucuagcaguaguuuuauggacaucaaaugccugaaagaaagaucaggaaguuguauguacaguugaucugaaaugcaacaacuugauuaggaaaagugauacaggaaacuuuucccacugcaccuuccagaggcacugagguucgguuccugccaccccugccagugcuuucuguggugccaggaccacauccgucaguguuucugccaggcgucauggugcagugggguuugaguugaugcucuuucuguccacuuugcucuuccaauguuuuauagaacugguuaguacugcagaaaaaccacgacuuaaagaaggccuuauacaugaacaagacacaguugcucaguucggaccacaaaaagaaccaguaagacagcagauucaucgcauguuccucuuaagagugaagcucaugcauuucgugaacagcuugcacaacuacaucaugaccaggguuugugccucucccaucugcuucaguucuaucgucguaucuauacaguuguucguagagaauuacucauacuauguuuauaaguaaaaaauaccuacagacugugaaaacgggacauguagcaaauuugaucauaaaauaacauggcagugggaggaauguuuuuguaaauauaccggaauauguguauccagaggcuguugucccuccaguccagcagccccuggggacaggcacagccacagcucgucuucuggaauugccuucagaaugugccgcauaguccuuuagguuucaauaguggugacagcugucccuaaaaaauggcuccaauguuuaauaacagccaaaauccacuacggugugugggaggaagaugcagccagguuauagacuuuuuucuuaaaaacaagaacucacuacaaaguaaaugaaauuauuuuucugauacaucuaaaagccaguucuaggggaaguucuaaaagaagcguucagaaauuggaacaagagcaguauuauuagaggacaguaugcauuugggguuugaauuguuguuuagaccuguuuauaccuggucugugaguucugaaacccaacuugcuugggugaagugagccacugaagccuguguuuuggaugggaaggcuauggcagaggggcuccacguuuccccugacugcauuacugccuucacaagguuggccuucauuaagccccuaauuguuaagaguaaaugauaagaguuuaaguuuuuucuuaguuuguuuuuuauuugagguauacuuauacucauuuuagagaaagaucaauguaugagaaaaggaacuuaagaaacauaaauucacuguaauuauuuguauaaaaguaacacauuuacuugauuuuuuuuuuaucgaugugucuuauauacagcuuaaugugcuugccccuuccugccaggaagucuguuaguccagaguuuggcguucauucauucacugugcaagugggcguccuacaggauugcccccgccguccucuuaggaucagaacgccagaguauccagccagccuuugaagaaugguacuuuaugaaacugucuagaugugcuuauugaaggaagaauuugagaggaguagaagagcuuaguaaaaaagauuugugugcagcacacaaguccucaaagaaggcugcugaugaagcuuuuuaucuuucucuuccaagauucuacacaguacagggcuggaguuucaacaucaagucgaggaagccaaggauuuagaucaauugauuaaaauucacuauagguaucugucaaccauccaugaccggugucugcugagagaaaagguacaugagaugucuccugcagauguggccacugcugggcgaguggcgcugucugcgugcuuuggaauuuuaugaugauuaagcuucuguccuguagaauauucuuuaaggaagaaccagaugaaaugagguuacaaacaaaugccccaggccggccacaauggcucaugccuguaaucccagcacauugggaaacugaggcaggcagaucuuaugaggccaagaguucaagaccacccugggcaacauagcaagacucugucuuuacaaaaaguuaaaaagauuagcagacaugguggugcauaccuggaggcccagcuacuugggaggcugaggugggagcauuguuugaggccaggaguuugaggcugcagugaacuaugaucugacaccacugcacuccacuccagcuuggguaacagagcaagaccuugucucuuaaaaaaaaaaaaaaaaaaaaaaaaaaaaacagaaggaggagugcccuauucguagaaauuguaucuaagagcaacaugagaacuaugugugauagucaacacucacucugcguuacucuuggauucauuuggaaaauugugucugcaguugcggagcaauagcauguccacuucaugugaauagauagaauucaguaauguuaaaaccauugcaauuauuuguccuaguuucauuggugaauuuaaauggccaucccaggaaaaggucuuaauaguuuguuuuguugguuugacuguacugcuaauaucacuuguaucuuacauucagugaaugcaugugccuggucccaaaugggcaugguucagagccuaguacccuuccauauacacagaaggcagucacuguggugaugaacuuuuucugugauucauuuaaaauagguaaaaguguugguaucaguguccaaaccuaguuacacaguuuguguucugugacuuuggucugcaggucagcuuugugaaagaagcuaucaugaagguguugaacuuggcucucauguuugcagacgguuggcaggcaggccugggcacuuggcgguaaguaugugauuucugcagcaucugcacugugaccauuucagcuucagcuucccuuuuuuuuagagacagggucuucccagccauucaggaggcugagaggagaggauugcuugaccccaggaguucaagacuagccugggcaacauagcaaaacccagucuuuaaaaaaaaaaaaaagugcaaguauuuuuugagaaguaaaacauuuuuaaaaaucugaggucuucugauuuaaacaagcaaacauuuuuagauuauacucauguuauauuguguacguuuuguuaaauuuuuaucauggacaccuucaaacugaaguggcaaagacaguguugugaacaccgugauggcaccugcuucagcugugccagugaggacagcucugucaugucugugcccaccuccccagucacacuugcugaauuauuuuaaaucaaauucuggacaucaugcuagacuauucuccaaaguuguauuuuggaugagcucuaaaagaugcuguguuuugagaguguuuguuauucacacacaucacauaggcaagugcacugaaucaggggaaguggcccgggagcagcucccucuagcacugccauccucuacuguuaacuccaguguacagcucaauauuuuguuaccuguccuguuuauaaagucagugcaacaguaauucugcuguuacuuccaugaaauaaaagugcauguuugguugacuguacuuacuccaugucaguaaggaaguaagaauucauuugagugcuaguauaauucgaaaucucccauuggcuguacucggaaucaagaaacuaagguaguagaugaagccauagcugcagggauggaaauagaagucuuccucgcuuuauauugcuggcucaaagugugcaaaauauauuuugcuuuuuuuuuuucuuuuuuuuuugucucacuuugggguggaggagaaauaacacugcugcauaugcuuugcugaaauucaacucuuucagguuuuuuuuacaaauaaaugugagaaaaauacagggggugaggaacuuaagaagucuaucaaccaucgcaguuuauggauaaguuaauuguuccugauugagacuuaaagccgaaaagugaaaaauuguagaagcaaugugaaauuugcuugaaugcuauuagaugauauuuuugagcaaaugguguuguggcuguguuuugaaaggagucuuuaucuuuaaaguauacauuuauacuuaugaaauauucaugacuguggugcucugaugucuccuguuugcuucugaauauugugguggggcuguggagguguaagcuuggcauguggcaccugccauggcugggcagugggccauggaaaccccuucugaaguucucucuuacaaaguguuugauauuucuuuaaaaaaaaaaaaaagaaagaaagaaagccgagcacaguggcuuacgccuguaaucccagugcuuugagaggcugaggugggcggaucuccugaggucaggaguucgagaccagccugaccaacauggagaaacuccaucucuacuaaaaauacaaaauuagccaggcgugguggugcaugccuguaaucccagcuacuugggaggcugaggcaggagaauugcugaacccaggaggcagagguugugguguggugagccgagaucgcuacauugcacuccagccugggcaacaagagcgaaacucugucuaaaaaaaaaaaaggcagccaggcuccauggcucacaacugcaaucccagcacuuugggaggccagugggggcagaucagcugaggucaggaguucgagaccagccugaccaacauggcgaaaccccaucucuacaaaaaauacaaaaauuagccagacaugguggugggcaucuguaaucccagcuacucaggaggcugaggcaggagaaucacuugaacccaggaggcggagguuacagugagccgagaucgugccacugcucuccagcaugggcgacagagcaagacuccaucucaaaaagaaaaaaaaccuuuuuaaaaauaauuucagauuuuaaguuuuauauccuuaauguguucuuuauuucaaagagaauguaugcuuguaaacaauaaaaacaagacuguauaaaggaaaagggaguaucuuugguccuccuaguuccagaacuagauacuaucuggaaacagcacaguuuuauauccuaaugaaacuuccuuugaaacacuuugacauuuuuuauuuuaaaguaggguaggacguuauguguuuuauuuuauaaucuuuagauuuaggauuuuaaauaauuaaaccaaaauacauuugaaauuacuccacagauaucuugaagccuaccuauauacccgcaaugcacuuacuuaauugaaauuuacuuuuauuccuagaauggaaucuauagagaaaauggaaucugauuuuaaaaacugccauauguuucuuguaaccauuuuaaacaaagccgucuguagaggauccuuuccccauugugaguauaucauguuaaaauauuucuaccucuguauuuccuuguaacuaaguguaugugucauuguuuuguuacugaucccaugaagaauuagaaauucucaccauuuucaaaacugaaaagucccuuagcaguugucccaugcuuugaauugcuuuuuaagcauuacggugaggugaguguaagccugaggaucuuacuuucugguauaccauuuauuacaacagauuucuaaaacuccuauuaaauaaaguugauggcagaauagauuucugucacacuuc

SEQ ID NO: 191779 - RNA, 47849 nt, Homo sapiens
ccgguuuaauccacaccgcugcgucuguccuccguccuggggcuggucuucucccucaucucugccggaggcuuuuaaucucuucugccacucuucuggaaagucaccagcaaugcacgcugcuggcucugcaggagggucagggggacggcccucggccugugcguggugccagccacccucccugccucccucugcgugcgucccgugucccugccuggggugugugugucgagugacuaacgucucucuccugccucucccuccugucuguccgugucuagcucuaccuggugcgcaccauggccgaguccuugggcucugccgagcugcucaggcagcucaagucucugggcauggagaggcucuugcaugcgguuaacacguuucugaggcagucgugcaccuaccuaccccuuuuaaccuuuggugguaagacaucauuuguuucucuugacguuuauggcacggaggcgaacugcuccgcuacaaguuguucuuuccccaaagcagcagcaacguggccgcguagacaggcacccggaccccucggggagcuggugcggggcccucccgaccagggcguagcggagcaguccuucucucaugggcuuuuugaguuuggcauaacuaauguaccauguauauuuucucccccacaaauguuuccuuggauaauccagcuuuacauggugagaaccaugcuagagucccucauugcagacaaaagugguuccaagaaaaccuugagaaguagccuugaggggcccaccauauuggacauagaaaaauuucaucgagagucauucuucuacacucacuugauaaauuucagugguaagagauacugcugagcagcauccggccuggcauguccuaacaccacuaacaccgucuagaaugcuuccgcccgccugaccacccccuaccccgucccuuggugcacccagacggugacucguccugcccucuguggcgguggcuguacgucccuggccugagcucgcuccacagggcguggucccuacaaggguauaaacugaggagcccgggcuggcccugagacaugaacagaaaaucuuuucaacccaugcgggguuggaaacaggcgaauguaaucuggugccugaguugagacacaggcauugauaaauacuagaaauggcccuugcagaccaugacguggggggaagguggcgggugcccugugccaggcaagcccauccugggugacacccggccaccuugaccggccaccggugggugcgcucucugcccuccgugugucugucccguguucucaucaaguccuccguuguccaccucuugcucagaacaggaucccugcugucuuggcuggggugcugcgagguauuggaggaaauaguaccacuuuugcuguuaacuccaugaaaggauggaguucgagugugggcucuuuuaaucugucucauuuuugcguuagacagaccucccugagugugccucuaaugcugcagccuggacauugguuuuuauccuaagugaaagugaagaaguccuguuuuuuuguuuuguuuuuuguugagacgaagucuugcucugucacccaggcuagaguacaguggggcgaucucagcucacugcaagcuccgccucccagguucaagagauucuccucccucagccucccaaguagcugggauuauaggugcucaccacugcgccuggcuaauuuuuguauuuuuaguagagaugggguuuuaccauguuggccaggcuggucucaaacuccugaccuugugauccacccgccucggccucccaaagugcuaggauuacaggcgugagccacugugcccagccagaaguccuguuuuuaugucuccuuuugagaagaacauuuuuagguaagacacaguggcucauaccuguuaauccuaacacuuugggaagccaaggcaggagaaucacuugaauucgggaguuugagaccagccugggcaacauggcgagacccccaucucuauaaaaaauacaaaaucaguugguggcacgugccuguguucucagcuacuugggaggcugaggcaggaggaucgcuugagcccaggaguugaaggcugcaguaagcuaugaucgcgccacucaccuccagccugggugacagagugagauagacucugucucaaaaaaaaaaaaaagacacuuucccccuggaucccacugaagggcucacaggguugaugagguggcuuuaccugcagcuaugcccagcugguccugucccuagugcaaggccccggugaccccuccccacucauguccaugcugcauggcuuggggcugagcgaggaggagcaggcacccagcacacagcccuugugucaucucugcuaaagguuuuuuuuugcuugcgggagauaacauggaguuguuugaacccucccagaaacgcugcagcagugcugugaccuuucgcagcugugguuccgagaguucuuccuggagcugaccaugggcaggaggauccaguuccccauugagaugucgaugcccuggauccugacggaccacauccuggagaccaaggaggcaucgaugauggagugcguguccugcgggccugucuccagccuuuguguguggugaccggggguccucagaggagguggcggagaggccgggacuguuuuuaguauuguauuugaaaucaaguuucugggccugggcaaaauagcaagaccccagucucuacaaaaaugagaaaacuuagccuggugugguggcugaugcgggaggauugcuuuaccacagaaauuuguggcugcauugagcuauggauugcaccacugcauuccagccuggccacguagcaagacccugucuccaaauaaaaaaaaaaaaaagagaaaucauguuuccugggguaaagcuuuagagauuaauacaaguaacuaaccaguuucuuggugucagacuggaauugagagcucaggcacuagaaccagucacguuccuacuuugcaugggugcuggcugggacccggggacucagccuggaccagggagauggaugaaccuggaccuuccccaggccuucguagugcaggcccugugagguggccaugcccgugagcugccuugcgggagcccuguggccuggccuuuugugugacacagccucugacccagaugaaguggggaaaggaaguauugauugaacagcuuuguucuggggaucaggacuguggaccuagauggaagggcagucuuucaaaauauaaaguucauggaagggaaaguguuuggaaaagggugugucucauggugagcgacuggggagccgcccagccggucugucuucugagcaccgugagugggaagccccugaguuccuugugcgucaguccucacacaucccuuguggugcccaggagaugguaagggcagucaccuuccacucucuguggcuguggcauggccaugccauuugugugggcagagccucugauggcucguugcacagcauugggguggcgugaggagcuggaaccagcuuggaggccuccuucaggcaugggccuccuugccccuggccauggccuuuguccagauaugagguagugggagacgggccuucaaccaugggccaugcuggacaugcuccuggugagcugugggauccaggaccuucaccuuuguucuuuuuuuuuuuuuuuuuuuuuuaaugcugucuauguacuuccguugguguaauuuuuucuuuuuuuucuuucuuucuuuuuuuuuuuuuuuuuuuuuuuugagacagagccuugcucuguuacccaggcuggagugcaguggcacaaucucagcucauugcaaccuaugccucccggguucaagcaauucuccggccucagcaucccaaguagcugggacuacaggcacccaccaccacgcccggcuaauuuuuguauuuuuaguagagaugaguuucaucauguuagccaggcuggucucgaacuccugaccucaagugauccgcccaccucggccucccaaagugcugggauuacaggcaugagucaccgcgcccaguccaccuuuguucuuuuccagucaguucauucuuuuuuuuuuuccccccaacagagacaaggucuugcucuauugcccaggcuggagugcaguggugcaaagacagcucacugcagcuucaaccucccaggcucaggugauccuccugccucagccuccugaguagcugggacuacaggcaugcgccaccacaccuggcuaauuguuuuguguuucauggagacggggucuugcuauguuguccaaccuggucucaaacuccuggccucauguuaucuuccugccucauccaccuaaagugcuggaguucauucucuaucauuuuuuuuggacagggucucacucugucacacaggcuagaguguaguggcacgaucucagcucacugcagccucaaccucucaggcucaagugauccuucuaccucagccucccaaguagcugggacucaggcgugcgccaccacgcccagauaguuuuuuguaguuuuguuagagacaguauugccguauugcccaggcuggucuugaacuccucaccucaaucaagugaucugcccaccucagccccacaaagugcugggauuacaggcaugaaccaccaagccugguccuuggaguucauucuggaaauaagaaaauaauuuucuuuuguuaaaaauccuauguacuuguagugaaauauuuuaaagucugcuaagugagaagaugcaggcagguggaggcccuuguccguguguggccuucagugagcgucugcuguccccaagcauccucgcagccugguggguguggcggccgccucaggcgcagccaccacgugcuuucacaggaggacugguguuugaagugaaaguuguuuuuccuuacgugagagguggaaaauggaguugaguuucugagguggggcgaggcugucggagcugcgagugaguggcagaggcugcuggucacacugcugcuguccucugcagguacgugcucuacucccuggaccuguacaaugacagcgcccacuacgcgcucaccagguucaacaagcaguuccuguacgacgaaauugaggccgaggugaggccccugcagcuccauuucuguucauuuccuucaauuaaaucuccuuucucuuuuuguuuucucccaaguauucaacuuucuuuaaaauauaagacaguauaaaccacgaagcaagcaugugggagcaagcccuuccucuguggauaugcuuccacgaugagugcaggaugcgcuuuuucacuugaccgugugucacugcggugucuguguccucaucuauuuuugguuaugagcaugaucuuugauguucaacugaagcaacuccuguuuuauuucucuauuuuuuugguuuuggauuuuauaaauagcacucugcugcacucccuggcauguuuuuuauuugcaucgcaugacuucuauaggacaaauucccacagguggaauucucagguuaguguaugcacauuuaaggagaugaaccuuauucuacacaucaucuccucugccuucucacaaagaccaccugaaaauggugcuucagggagaugucacagguccccggcccugcaggaugggaggagggcagagacgcccuucuuggcccugucugcugggcagauggguccugggucccacuugccacgaagcacagguauucuccucacaguuccaggagauagugcgaaucccaucugcaaguaagggucuuuugaggguaccuccugaccaaucucacacccagaacagccgcuuugcuccagggaaggcccucgguggugccuccuggagugcacaguaggcggagcugccccagggcaggaacccaccugcaaugcacaguagcuccucguggucacugcacacagugaagagagccuuguugauucucucuugcauuucagagaauaggaauauuuuucucccucaguaagauugguucuagccuaguuuucuguggcagugugguagucacuccuggccacacugcaguuuauuuagugugcuguuguuggacaguaagauuauugcuaguuucuuuaguuuauuuuucuuuuuugagguggagucuugcucugucgccgaggcuggagugcaguggugugaguucaagcgauucuugugcuuagccucccgaguagccaggaccacgggcacgugccaccacaccaggcuaaugguggugggcaccuauaaucccagcuacucaggaggcugaggcaggagaaucacuugaggcagagauugcagugagccaagaucgcacuacugcgcuccagccugggcaacagagcaagacuccgucucaaaaaaauaaaagagccucaguuaguugccuuaacgaaacauuuuguuuuucaccuuguuauuugaucuugcuuuagggaaucaaacuguaacgugugcuuucuuuuucuucaggugaaucuauguuuugaccaauuuguuuacaagcuagcagaccagauauuugccuauuauaagguuauggcaggaaggugaguaucuggugugugauuuugauacaaaacguuucauaauuugaucugacauucccauuacaauuuauggcguaugaaaaacuuucugucuuccuucuacacuaguuugcuucuugauaaacgguuacgaucagaaugcaagaaucagggagccacgauccaccucccgccgucuaaccgcuacgagacgcugcugaagcagaggcaugugcaggugagcuggggccgggcugugguggggacguagagugugcauugaaaagacuggguuuucggcugggugcgguggcucacgccuguaaucccaacacugggaggccaaggugggcggaucaccugagguuaggaguucaagaccagccuggccaacauagcaaaaccccaucucuacuaaaaauacaaaaauuagcugggcgugcugguggguuccuguagucccagccgcucugggaugcugaggcaagagaaucgccugaaccugggaaguggagcuugcagugagcugagauugcaccacugcacuccagccugggugacagagugagcaagacuccgucucaaaaaaaagaaaaaaaaaaugauugagauuucuuauagcuagcuagguuuagauaucagcaugccuugugacugugaacguccuuauaaauuguuaggcauugaaagacacaccguuucuauugggucaccucacacacagggaacaccugcagcauucuguaucugcccugcggcuccugggggcaggcauagcccggaggggucagcccuucuccaggagcccaaaagccagagcuuaaaaagaaugaaggugagaagcacucaucagcucagaguaucagagaaaacuuucuccuggccagcaggaagaauuuaaagauauacagugcuuauuuuuuacagcuuuuaaaaaaagauucacauugcaugccuguauuaaaacaucucauguaccccauaaauauguacacuuacugcguacccacaaacauuaaaaaaagaaaaaaaauuaaaaauuaaaagugauguuacauuacacacacaaaacuaguuaguaaaauauggaaaacuaaaaaaaauugcauuuaauucuacucucuauacacgaauaaucaucaugcacauuuuuggacauuuucaccagggcuuugucauauuuuuauguaguuagaacaacacugaaguauggauauguuccuaguaggccaaaauagagauggaguaauuuuauuuaucgucauaacaccuguaaaaagacacacacaggcugccauguauguggggagaugggucuugaacgugguuguaaagggugucguuauugacagaccagcuucuccagggucucuggugaggcguuuguuguuuucgagcugcucauguccacucuuuaccugccauccuucccuguguacgccagcuccucggcagaucaauagaccucaaucgucugaucacccagcgcgucucagcagccauguauaagucccuagaacuggcgauuggacgauuugaaagugaagauuugaccuccauaguuguaaguaauuucacuuugcccuauugauaaauuggacuaaggguagguccaguucuuguauagaugauaaaagagaugcacucaucgggcguggccuauaccaagccucuuguauagauaauaaaagagaugcacucacugggcguggccuauaccaagccucuuguauagauaauaaaagagaugcacucaucgggcguggccuauaccaagccuacacucaguguucacaaugcuaaauugacuuaacaaacacauaaccccaaucuugaaaaaaucgccaacuauggcaaaagguagcacaccacuuaauaacguguuuacauuuuaguaugaacgagcuaggagauaaaaauguuuaacuuuggcuggcacgguggcucaugccuguaaucccagcacuuugggaggccugcggggguggaucauuugaggucaggaguuugagaccagccuggccaacauagugaaaccccaucuccacuaaaacuacaaaaauuaggcgggcgugguggcaggcaccuguaguccgagcuacuccggaagcugaggcaggagaaucgcuugaauccaggaggcaggguugcagugagcccagaucgcgccacugcacuccagccugggcgacagagcaagacucugucucaaaaaaaaaaaaaaaaaaaaaaaaaaaaagaaauaucuucuuuagggaccaagagagcccacaagggucuuccugcuaauucuucuaccccuacauuucgcuuggcugucugaauucaucucaucuccagguaaggucuaauccuucuccuguuaucuggaccuucagguuucccagugaggauguguguucggggccaacguuccccgcucacccucuuugggcgcucacccauuuuucggcugucucacggagccuacagaggcaagccgcuuccuucagagggucuuuggauucucugcuuuccugguauguuccugugguauuucuugaagcaaaaauuugcagugugagucuucacacacugcuguguucgucugaaugggagcugccaguuaguccuaccuucugucugccauuuuucccugugucucuaucacaauuugaacacaggaagaggcaagacuaaggaacaggaaaacagagguuaaaaacaucugaacuggggaacagagaaaaauaaaaaugaaugagacagaaaagagcauaagaaauguagaaaacaguggaaagaccuaacguguaacuggaguguuagaggagaugagagagagaguggugucacggaagacuugucugaagagaagauggcagaaagaccuuaacguggacagaagacaccggccugccacucaggugugccacccaacuacacaugcuggagccagggccggagccacagggggaccucagugagcgggcccccgaaccacagcucuguggaucaccugaccaccccccaacucugacccucggccuguggugccuuugaaucuuuaggauuuaaucagagcuaguaggcaguaagccugaaugggcugguugucuucccuucuccagugcguggucauuggugcauggccacacguccguuuccacugugggagcagggggaggguuuacagugugcauuuucuaacaaaaugcacaagguccuuucuccccuucacccaaggagcucugggucugagaacugguugaggagccaugaauuucuuuuaugaugauucaaguuaggcugguauuggucggccuagggcuuuucccuuuauccagaucaaugagacuuccgaaggccgaucguuugugccagcccuggggauaccacaguccuuuagucaacacuggcaccccugugccaacgcuggcaccccugugagucaggcaauuugaguacacaugaguugugcugcccgccaccuggcaccauuggagucaaggagcccaggcugguggccuacagagaauaauuuagacagagcucuucaaagaugccugagaugagaacagguuucagggagcuaaaacaguaggcccugcugacucuggaauugaauaaaucaaaauucccuccuaagacaaagcugcccaugggagaagcugcugggaauagcauguaagcugguaaggguuaggaucauggcggaggggagcaugagaggcaggucucagaaggcuugagccagugcuguuacucuuggcccugaccaaccccucuuccucuucagaagcaugagagagcuuauuucacuuccagucgagccacagguaaagaucaugguccaauccccuuuagacguauuacacuaaaaaagaaaauguaagugcacagcagugucccuacagacaguggaggcacgucagacagacacccacggaccauggaaacuguaacuucaucuuucacagugagcuaaaagaaaugaagaaaguaguaguugcuggccgggcgcuguggcucacggcuguaaucccagcacuuugggaggacgaggcgggcggaucacgaggucaggagaucgagaccauccuggcuaacauggugaaaccccgucucuacuaaaaauacaaaaaauuagccaggcuugauggcggacgccuguagucccagcuacucaggaggcugaggcaggagaauggcgugaacccgggaggcggagguugcagugagccgagauugugccacugcacuccagccugggcaacagagcgagacuccgucucaaaaaaaaaaaaaaaaaaaaauaguaguugcugugaaagaauaauauaaaugagaauuuuuagaaauccagaaauaggcugggcacgguggcucacaccuguaaucccagcacuuuuggaggcugagguggguggauugccugaggucaggaguucaagaccaggcuggccaacguggugaaaccccaucucuacuaaaaauacaaaaaauuagccgggcgugguggcacaugccuguaaucucagcuacuugggaggcuggggcaggagaauugcuugaacccaggaggcagagguugcagugagccaagauuguaccauugcacuccagccuaggcaacagagcaagacucugucucaaagaaaaaaaaaaauaaaucgagaaauaagguuauuggaaaaaagaaaguuuugaaaagagaaaaggccgggcacaguggcucaugccuguaaucccagcacuuugggagacugaggcaggcagaucacgaggucaggagaucaagaccauccuggcuaacauggugaaaccccgucucuacuaaaaauaaaaaaauuagccgggugugguggcgggcaccuguagucccagcuuacucgggaggcugaggcaggagaauggcaggaacccgggagacagagguugcagugagccgagaucguuccacuguacuacagccugggugacagagcgagacuccgucucaaaacaaaaacaaaaaaaaaaacagaaauaagaaugaaggcugggcacucgguggcucgcuccuauaauuccagcacuuugggaggccaagguggauggaucacgaggucaggagaucgagaccauccuggccaccaugguaaaccccgucucuacuaaaaaauacaauaaauuaaccaggcaugguggcacacgcuuguagucccagcuacucgggaugcugaggcaggggaaucgcuugaacccaggaguuuuugaggcucugucucaaaaaaaaaaaaaaggaaugaaaagagggaacauuuuuaaaaucaaaaagaaauuaaagcagaaaaaggauuugagaggaaaugauguucucagaugaucaucaucauggaugaugaagauucaguguaccugucauacagcuuccucaagaagaaaaccaaagcaacggaacagggccgacuggcaucuauuucaagaaaauauugauaaaauagaagacaccuugaaagugucuauuaaaagcauacaucauguauuugguaaaaccgacccaagcuugucaacacuuagaaauacugcaucuuaggcugguugaagauuagaaaaaauaauaauaauacauuuaaaaacgguauugcagugaaaguuuuggacuuuccaggugaggaagaaguccuugggcugucugagcagggcaggcagggaaggaaaauccgauuguccucagaccuucaccagagccaaggaaaggaacugugaaucgaggguuuggucgccagccaaauugaucuucugagaauaaaggcugcagacagaugguaaugaacgugccagggcuccagaggauuguucauuccuggagaacagaccuuggcuggcagacacugggcgcuggcgggcacagugcgugucccugugagcaucucugcacuucagagcagggcccugcguauucauccuuagagucaaacaggcugggacucagagacagaccuguggcggccuuuuucuacgagcguaauuugguacaggccaugguguuucuguuggcauuggccaaauaugauuuugaguaaaaucauuggucgaggcuuugaucgaggccauuacuguccaauagaaauagaacacaagucagauccguaauuugaaauuuucccauagucucauuagaaaaggaaauaggugaaguuauuuuuaauaacauacuuaauccacuguauccccauauuaauucaccacgucauuccuauggcaguauaguugagguggguauuugcuagucuguuuuguccuacucagucuuugaaaucuggugucucauguagugcgccucaggugggagcagcugugcuccggccccggcugccacaucggacagugcagccugggcgagcuccagagcagcgcacgugagggcuugcaaggccugugggaacaagugcaccugcccugccacccacacgugccuuucagugacuucaggcaccucagagaaagcuggcucagcuccaacgcccagggagaugcagccgccggcuggguuauacugcagggcagggccggggcucagcgggcacauggggggaaggguggcaguagcaggccacacgugcacgcugccccacagggugcuggacagcagggguagguggcguggaggugacugcaguggagaaaggcaugacccagugggggugacugaaaagguggggugccaagaagcaagcucaugucaccugucagagccuacgcucacugggggcugccuccgugcagcccugccagggacugugaggccugggugggaucagaggccacucggcgccuccuuccugccuggaccagcucugucacccaccccugucuuuggugccacaggagcuggauggccuguuggaaaucaaccgcaugacccacaagcugcugagccgguaccugacgcuggacggcuucgacgccauguuccgggaggccaaccacaacgugucagcgcccuacgggaggaucacccugcacgucuucugggagcucaacuaugacuuccugcccaacuacugcuacaacggcucuaccaaccggugagcgugcccgccacacaggcgcccacaggcgaggcgcucagggacccauguccccgcaggcuuccuccaugucaccaggucccugucucccugcucuugcugcuccccaucacuucucacaugaagagcacgcaggcccuccagugucuucugugugcacaggcagccucgggucuacccucggguggauggucauggcuuugcacguggggcuugcguggggcugcaucuccuggcuuucuguuugccugaugguggaaguggggugagucugcuucuuaugcuuccgugcuggcauguuggaguguggggaagccacccucccacccaccgcccauggacagcaugaagugaugugauugguggugaaacgguggaugcuggcaguauccugagguucagccucauaguagggccugaguccugggacagcccugcccugggcuccgcacaccggguggcggucauucuggcugagguuccuucucugcucacugagcucagcaucuauacagugucagcgcgugccagggacaugucugugucacccaccaugccuucccauagacaccaacagccuggggggaugaccagggcaccaagcaaggugccuggccacugagcuccauccagacguagaggagugcaggugugugcacaugcgaguguuaggagcacuuuuacaaauaagugcuugugcuugccucugaucuccgcgucccacccacauguggcugaauucuuacugacuuguaggcccagaguuuugugucucaggagacaggaugccgagcucugaugagagcucugaugagagagaggagaggcgcagcugccccacggcccaguccugccugcuguggcugucgucuguucaggaccccugggugcaggaccgcguuuccuguggggccgugggucaggcccagguguguugcaucacugaggccauucuccagggucauggccacgcgcucugggcugcagguggcagcaccuggcuuggcuuuucagcucagggggccuccaggccgggcugggagugguccauggaaaccaaaccgugaagaccaccgucucuguuuaacucaccuuuaugguguccauuuuccucaacauuuuuaaaagauguuuaugcuuggaauuaauugcaaaaauauucuuacacaaguaauauaucaaaauuauagaaaaaugggaaaucauggauacauaggagagaaaaaugagugaacuccccagagguuuccuugguaaaaauguauuuguccucuaaagugaggcaugggcggcccucggccucuccaucccgagucugcaccccugcaguaccacauacaucacagcagcagggaggggauggccaggcgccuccuuccccacaccccgggaggugacgugaacacuucugugugcagaucagcacggugcacccagugccaugcgugcagcugcucagagccaucugcuggggccuuacacccagguagcugcacucguccccacugugggcggcaggaggccccuggacccaugggggacccuggacacaggcaggcugguuccaucuuaucuggaaaccaauuucaugugugucaccuguuuccccaagagacccagagcugcugccucgggccauaccuguugggcagaggucagcaugcagugaccucagccuccuggugccuggggacacuugaggugugauucacagggaacccuagcuugucacaggggcauuuucugcagaagagcuccgguuuacucagcaaccuccaccuuccgugaguguugguagaagccauugugucugcauuucccacaagucuuugguggaaucaggagagcuguguuaucugggaaaggcauuuuaaaacaggauuuugcguauccaaguucugugucgaauccugagaagacacauaaaccaugcuacccggaauuuuagucccaugccugaggguuuucugagagcuacauggcacaagccaggacuuugcucguugccuggccuaacuuccgguuagugagcuacgugugguggcucuaggaggugaccuagguggucugcgacuggaauuuaaccuguacaguggguaaaugugugacagugcugcagcucuggaaagaagcuggcagaaggguauuuccucaguccagaguuaggccucuuuuccagaagaccauagauggagggcguguccucagcggggcgcaccuggagcccaaggcggcaacuguccccucacugcucauggugacuucugucccuggggugaggugguggcugccagguguucccacugucauguuaccauuuuucuguuuaaaaguuauaauuuguagggagauaauuugagaugauguaaacaaacucccucauuaaaauuugucccggucguuuuaacaucugucgacgauuccuguccgaaucaguuaucuucacacuggugguugaacagcagugaguuguuuuuuugguuuuuuuuuuuguuuuuuugugacagagucuuacucuguugcccaggcuggagugcaguggugugaucuuggcucauugcagccucugccuuccgaguucaagcgauucuccugccucagccuccggaguagcugggauuacagaugcaugccaccaugccuggcuaauuuuuauaauuuuaauagagacaggguuucacuauguuggccaggcugaucucaaacuccugaccugagaugaucugcccgccucggcuacccaaagugcugggauuacagguaugagccaccgugcccagcugaguuuuaacuccuucauucccucugcagguacuagcuggaauucugcuguacgugguagcauuuguuuauuauuugcuuauuuguacuaaggauuauccauuacuguggaguuuugaggcuggggugggugcgguuugggcagugggagcugccugcuugguuucagucuccuggggccgucuccaccauucuuucugcaccacaagauguuccaggcucggccaggcacgguggcucaugccuguaaucccagcacuuugggaggccgaggcgggcagauccugagguaggagaccaagaccauucuggcuaacacggugaaacccugucucuacuaaaacaauacaaaaaaauuagcugggugugguggcgggcgccugcagucccagcuacuugggaggcugaggcaggagaauggcgugaacccgggcagcggagguugcagugagccgagauugcaccacugcacuccacccugggcgacagagugagacuccgucucaaaaaaaaaaaaaaaaagaacagaaauuuauucucuuacgguucuggaguccagaagucuggaaucaaggugucagcaggaccacgcccccucugagacacuggguagagcuguuacuucuggcggugaccucaguucuggguguucuuggcuugcaguggcaucacuccagucuccucucugucuucacuugccacugucccugugugucucugucucuucucuucucgcaaggacuucagucauauugggucaaggaccuacccugcuacuccaguaugaccuugucuuagccagacacauauguggugacccucuuuccagcagacuucacauucugagguacuaggagugaggauugaacauaucuuuuucgacggagucucguucugccacccaggcuggagugcaguuguacagucucggcucacugcaaccuccaguagguucaagcgauucuccugccacagccuccugagcagcugggauuacaggugccugccaccaugcccggcuaauuuuuguauuuuuaguagaaaugggguuucaccauguuagccaggcuggucuugaauucccaaccucaggugauccaccugccucagccuuccaaagugcugggauuacacgcaugagccacugcaccuggacgaacauacuguuuucagagacaguacaacccauagcccacaugugcauguguauuaguccauuuucacacugccgauaaagacauaccugaggcugggcgauuuacaaaagaaagagguuuaauggacuuaugguucuacauagcuggcgaggccucacaaucauggcggaaggugagagggaugucucacauggcagcagacgagagagagcuugugcagggaaacucaccuuuuaaaaccaugagaugucaugagacucacucacaaucaugaaaaaagcaugggaaagaccugcccccauuauucaguuaccuccuaacgagucccacucaugagacgugggaauuaugggaguuauaauucaagaugagauuuggguggggacacagccaaaccauaucaaugugcauguuuauuucuauauaguuaccuacguauuaaaacuauaaguuuauacugauauuuccaauuccauuucagcacugcagaguucauucuagucuucucucuuucccuuuuucugacuucauuaaacacugaggauccuugcuucauuauucuuaguauauuacucauuugcucauuuccaaaaaaacacagaaaguaguuucagaauugcuaauccuggcugggugcaguggcucacaccuguaauccuagcacuuugagaggccaaggcaggaagaucucuugaguccaggaguucaagaccagccuaggcaacauaaggagaccucgucucuacaaauuuuuuuuuuuuuuuagacagagucucaugcugucacccaggcuggagugcaguggcacagucucggcucacugcaaccucugccucccggauucaagcaauuccccugccuuagccucccgauuagcuggacuauagucgcccgccaccacgcccggcuaauuuuuuguauuuuuaguagagacgggguuucaccauuuuagccaggauggucuugaucuccugaccucauaauccgcccaccucagccucccaaagugcugggauuacaggcaugagccaccgugccuggucuacaaaaagguuuuuaaaauuagcuggguaugguagcacaccccuguagucucagcuacuuggaaggcugacaugggaggaucacuugagccuggggaggucuaggcuguagugagcugugaucaugccgcugcacgcccgccugagugacaaagcaagaccuugucucaaaauaagaaagaauugcucauuuuuaccaccguaaaacacaaaccugccaacucuaguucaauauuuguuaucaaauuuuuaucuuuagauugagaauauauaguaaaauauuauguuuaaaauucauuagccgagcaugguggcacacaucuguagucccagcuacucaggaggcccaggcaggagaauugcuugaacccaggacauggagguugcagugagcugagauugugccacugcacuccccugggugacagagugagacucugucucaaaauaaauaaauaaauaaaauuaaauuaaauuauuuggaaugauagaguaacaggguuuagauuuauucuuacuccuuaagugaaaaacuggacaggacguauggaucagcuguuuucagacucggaccuuuugcugaggggacggaagcaagugaggugagcccugugaucucccugacuuccaucugaaagcacuuucuggaccaaguucagagaggaacaguccaaguacagcuuggaaguuccugauugguagaggggacaaacuggaacuuggggaagcugaggcagcuggaauuugcaggguggcauaugagagagcagggaccuuaacagaaacagcuccugaaaccacaugggcaucccauagccuuugcuugaauacuaaacugugcgugugccagggagcugcuagcugaaugauucucagcguucacacaaggccaggaggcuucugaguuccuacuagcaagaagaauggaacucuguugaggcugggcacaguggcucacgccuguaaucccagcacuuugggaggccaagacaggcaaaucacuugaggucaggaguucgagaccagccuggccaacauggugaaacuccaccucuacuaaaaauacaaaaauuagccaggcgugguggcaggcgacuguagucccagcuacucaggaggcugaggcgggaggaucacuugaacccgggacgucaaggcugcagugagccaagaaugcgcgacugcacuccagccugggugacagagacuaucuuuaaaaaacaacacaaacaaaaaaaaaaaacaacccuguugaacacccagauguucacuagaggugccagagguacugaauuaugcccaucccuacaagugccaaaaauucaucaugacaagauccagcagauugacaaguaagucaacugccugccccccaagacauucaacacucucucuuuuuuuuuucucccuauucuugccauucuggauuucaguuagauauauguuaguuagaccuucucauuuuauucuccacgucccuuuguuguacuaguuuuccuuuuuuugcggggacagaguuuugcucuuguugcccaggcuagaguguaacagugugaucucggcucacugcaacuucugccuccuggguucaagugauucuccugccucagccucccgaguaccugagauuacaggcaugugccaccacgccuggcuaacuuuuguauuuuuaguagacaugggguuucaccauguuggccaggcuggucucaaacuccugaccucagguucaggugauccaccugccucggccucccaaagugcugggauuacagccgugagccaccucgcccggccaacacucuuuaaaagacaguaacaaagucaagacaugcaacauggcacugaaaugcccagugcccaaucaagaauuacuagauaugccaagaaccaggaaaaugugacccauagcccagagaaaaaucacucuguacaaaacagacgcagaaaugacagagaugauggaauucgcagacaaggauguuaaggcagcgacuaugcaugugcucaaggauucagggaaaacaaugcagagauaaauggguguuauauaaauaauccagugaauuaaagcugaaaugcaguaucuagaaugaaaaauuacuuguugggccgaauaucagaguagacuuugcgggaguugagugaguuugagauuauaacaguggaaacuagcugaacugaagcaccaaaagaaaaaaaugaugaaaaaaacgagaagggccucagcaaacugagacaaacaucagcgauucuaauaugccugugauuggaauccuaguaagagguugucggggggcagaaaagauuucaaaauuaaugcccuugaauuucccagauuugaugaaaacgauaaacccacagauacaagaagcucaauaaaccucaagcaggaucgacacaaaggaaaagagccacuguugggccuagcacugaccaggucaaaauaaggcuggagcugaaccucaguguacccgaggcaacgugcagugggggcuuaggauauuggugcugaaacuuaguuuuccucuuaggggauugcagugacauugucaaacugcagagucugagggcacaguccuccacaagacugccuuugcugcagacaccagccacacauuuggggucccuggggccacccucacuucuaaccagcagguuacaguucaggauccacccuccccagcucuucaggugacacauucgcaguacucacugggcgugcccuaauacgauuauagucaauuggaggaaaggaugcuuguuggaaggaugugcagggcaaagucugggagguuuccaugugcaaagcuuucccuguccucagggacgcaucacccuccgagcucugaggugggacgcuccucaggguacugccagccaggggcgcucacuugggcugugguguucaguuuuuauuggggcuucguugcaugggcacaguugacugaaucacuggccacguagcugagcucagccuccagcccuucaccucccaggaagucagcugaguucaccaggcacacagccccaggccucuaaccccaugcugucuuucugguguggccagccccauguugagucaucuugcuagcauaaagucagguguggccccgugauaccagucauuccugucacucagaaaugaggguguagagacugccuccuagaacugggccagaggccaccaaauccuacccaggagucaaucaguaucuaaacuugauaaaucaagaagaaguuguagaaauguauuauuuagaaauauagaggccgagcguaguggcucacaccuguaauaccggcacuuugggaggccaaggcaggcagauuguuugagcccaggaguucgagaccagccuggccaacguggcaagacccugucucuacaaaaaauacaaaaauuaaggccaagcacaauggcuuacgccuguaaucccagcacuuugggaggccgaggcagacagaucacgaggucaggagaucgagaccauccuggcuaacacagugaaaccccaucucuacuaaaaauacaaaaaguuagcugggcuugguggcgggcgccuguagucccagcuacuugggaggcugaggcaggagaauggccugaaccugggaggcggagcuuacagugagccaagaucacgccacugcacuccagccugggcgacagagcaagacucugucuaaaaaaaaaaaaaaaaauuagccaggcauggugaccuguagucccagauacucaugaggcugaggugggaggaugacuugaguccaggagguugaggcugcaguuagucaagaucacaccacugcacuccagugugggugacaaaaaaaaaaaaaauauauauauauauaaaauauauaauauauacauauagacuauaaauguauauauauaauuauauagaauaaauacauguauuauguuauguaucauauauauguauuuugauuaaaauuuuaaauaauauuauaaagaguaauugcauuacuucaacaguucuguaucugaguuauaucauagacaaaauaaauuaaggccugcuuucuaaauuuaaccaucauuuuaaacauucuaagcagggaaaacauuguguucuaagcagacauaguaguaaagccuccucuaggccgggcgugguggcucaugccuguaaucccagcacuucgggaggccaaggugggcggaucacuugaagucaggaguucaagaccagccugaccaaaauggagaaacccugucucuacuaaaaauacaaaauuagccaagcguugguggcacaugccuguaaucccagcuacucgggaggcugaggcaggagaaucguuugaauccggaaggcggagguuguggugagccaagaucacaccacagcacuccagccugggcaucaagagcaaaacuccaucucagaaaaaaaaaaaaaaaaaaaaaaaaaagaaaagucugcuguaauauaaguggcaucauauccuggcgcuuggcucccugcauggauuuuuacucugauuuuccauuuguugucuucucccgcaccccgccgucaccauuguagguggacggaggcugacgugugugccguagcuuugcaggugugucaccaucggagguggacagagguugaugagugugccguggcuuugcaggugugcugcugucaagggugugagcagugcccaggaaucucugggaaaugggguucccuuuucugagcaucacccugaccguagcgccuccugauggaauguacuuccuggaacggguguuaagaacacaggcgcagggacacacagacaugcacacauccuguugcagacacaucugcagauaacacaucuccauacauggacucacgcagaugcaggugcacagagacaugcagacagacaugcaugccaagcacugaggacuguggcacccagggauauuggcauacugacagcacagggauuuaggauccguuuggaaaggcauacccagaaguacugcgguagguggucagggggccuaguggcugcuccucugugcagcacguccucucagaugcacacauugugugggacagcaguauuuucacaauuacaucuguuuccauuuccugaaguggaauaugaguuaaucaagugcuuggaauuacauaauuagcaaauccacaaaauugucuuucuuauacuucuuugcaaaaguuuuauguguuuaaacgaacccuuccaauuugaaaggcuuagcugaguuugauguuucugcaugaaaauggacacauucgauuuuaaguguccccuaauccauuaucaagacacaaucucuugacuaauugaguggguuacaaauaccuaagugucccuguccuucccugcugguguguaacuugugaucugaaccaccggggcgucgccguucucgucacaggcagcugccccaccguccucgccgugucuggaagcgcagcagagcccacgagcuaccugaggauugcguugggcucgaggcggcucugguacagcagaccagaccccggguguuccugcuguggccccugagcuuugggugcauuuauuauauuugaguauugagaucucauucguucuaugguuuucgauucacuagaauuuuccuauuugaugauuguaucaguugacugggaggaagauuuaguagauggauuauggaggacuucugaauuuuaaagaacuauuguuaaauuugguuucuuuuucuuuuuuaaaucuuucuuguuuagguuuguucggacaguguuaccauuuucucaggaauuucaaagagauaagcagccuaaugcacagccucaguaucugcauggauccaagguaggcuccaauguguucguguuacgagcuugaagcucauaaugaagcauguuuugaaguguaguuuaauugguuugguugcagugaccuaaauguaucacgcuguguauaaaauguuauuuuuuuuuuccauucuguuaacaucuuccugaaaaguagcaguaauuuaaaacaaaaacuagccaaccaacccaaaacagugcuuaucuagaacuagcgcguacguaguguugggacagcucuggccuugugauaggugucaggcugggccuggucucuuucccagcacaaacacaagugagauuguuggaagauuacagguuuaaaaacaucaagcugagaagacaaguggaagaggcucaggugcauuccugagauaaggaggcccaggguggcuguaaggccugaccggaggagcggagcuggaaaggugagcccagggaaggucugacauccagaaacaaggauguccgccugugccuggaggguggaaacccggagcacccgggucuaccaugugugagauaggaugauguccacgcuggggguggcuuggcuugucacaagucugaguauuauuaagggcuaguuucuucacguuucaagcacccgugugauuuaguaaggaaaauauaaacauuguagcaacgaagagagaugaaaugagcagauaccccacaaaaauagagcagagcaaauacaagcagauccccagccucagcggagcuggggaaggaacaaugauggcggcaagagccagcaggcccccaggaugaggccagaggauccggcucgccugugaagagcgaaagcgucuucccucugcgagcugcgguguccccgggcucugcggugggggcaggcugccagcacucaucaguauuuaaguguccucgcuuguaggaagcggggacaaucacaggacauugucugccccaucugcccaaugccuggagcugggauggagagggcccaggcccugccgcucacacgcugccugcaccuggacgcuuucuaacgcaccagcuggcucugaguggcggaaacaauguuuuccacucauuccuuucuaacccucuguucuucagagcgagaucuucucacuccaguccuuugggcgucuuccuucuccuuacagggcagugccuuggaccuggcaggagcgcaaguguuugcaccugggaaacggcaaacacccaaaucagggcauugguuuuuggagggcccaagccucggcauacgcugcccgucucucccgccccugaaaagagcgagugugggccgggggcggccuuuuuacggcacucagagcaucucugagcaggagagacaggucgucugaacugugugcagugaugaaggggaugugagauuccucuucgggaaacggggcccacguggaccaagggugacuguguaaacauuauguccuugaaaauauguucuuuuuauuuuuuauuuuuuugagauggagucucacuuugucgcccaggcuggagggcaguggcaugaucucggcucacugcagccuccgccuccuggguucaagugauccuccugccucaaccucccgaguagcugggauuacaggugugcaacaccaugccuggcuaauuuuuguauuuuugguagagacgggguuucaccauguuggccaggcuggucuccaacuccugaccucaggugaucugcccgcaucggccucccaaagugcucggauuacaggugugagccacugcgccuggccaucuuuaguguuuuagggguuauuuuuuuuagcaauguuaugauggcaauugaaaaaaauacaauucagauccucucuagggugcagauguuugaaggaaguggguucuugccuuucacaaagacaagguuaaaggugggggugggagguggcauugccugccuuggggagaaaaaugucagggcugggagccucgcugacacaugagggccagggucgccaaugccuggagaacaugggacaggcucauuccaucauuccacacuccgcguucucgaggcuguuggcaggugcggccuccgcugugccccuccacccugucucuguucguguucucgaggcuguuggcaggugcggccuccgcugugccccuccacccugucucuguucguguucucgaggcuguuggcaggugcggccuccgcugugccccuccacccugucucuguucguguucucgaggcuguuggcaggugcggccuccgcugugccccuccacccugucucuguucuuagcaacuccuaauggcuguggaacugugaguggacacacaguucgugugauucugggcuucauguggcuguguuggugccccaggagggcauccagacagguacccaggcgccaagaaugcagugaccgggccucuccucuguggggcaggguggggugcacgccugggcaggggugcgccacagcuguuacggggcucccccucacuucccgaagcccugugagugguuaagaauucaccuccauucugcuccaugugauacucccauguucuuucuagcaaggauugaaguugacuuuucuuuuuuuuuuuuuuuuugagauggagucuccucuaucaccuaggauggagugcagggcacaaucucggcuuacugcaaccuccaccuccuggguucaaacaauucuccugccucagccucccaaauagcugggauuaaaggcgccugccaccaugcccggacaauuuuuuguauuuuuuuuuuuuuuaguagagaugggguuucaccauguuggccagguugguuuugaacuccugaccucaaaugauccgcccaccuuggccucccgaaguguuggaauuacaggcaugagccaaugguggugcccaguugaagcugacuuuuaugcaauaauuaguuauacucaaaaggauguuucuuuaaaggauuagaguaaguguucugaggcuucugcuucugaaaguaaaauguaguguuuuaccuuuagaacugaaggaaauguuauuuuagaagauaggacuagaaaguuuggcgagugagaauaauuucuugggucucugugaacuaaaagauuugcucugggcuucucuugacuuugaaauuuuuaaucccuguuuuaggcauaacaauaaaguagguuuuugucacucccugauagagaggcauuugugcgcagagggcacugggcagagaggcuccucugucacccccaucuggagaggauggcuguggaagcgagggaggcaggcgggggguaggcaggcgacccgacugcguggggccgugcaccugcgguucugauggaucgaguccuggaaggggccucgugggguugguuuuugagaucccaggauagcacuguggugacaucuuugcugcccagugugucugugugcccuuugugguguuaaaggcucuugacacacguuuuuauucuccaggauuuucucccaggagugcagggaggcacuguugcuuccauuaagaugccaacaugagcgcgcuguuccagggugguggugcggggugcacauuugccuugagucagccccuacacugccagagcacccugcugcccugugugcaugggcaccaccucagggauggcuccagggaaugggcacuuggaggcauuugcaaagcugaugcucuuuuggagagaaagaaagauuugaugaugugaauuugauuuuuuuuuaaauucaacuauuugcaacugaacuugaaccucacuguaagagauuucugccuccguuucagaaacuguuugugucguuuuuguuaaaaccuaagcuaguacaugguuuuucuuuuuguuuuuuguuuuuuuuguguguuuuuuuuuuuugagacagagucuguccccuaggcuggaguacaguggugugaucuugccucacugcaaccuccagugauuauugugauuccagugauucgugugccucagccucccgaguagcugggauuacaggagugugccaccacgccuggccaauuuuuguauuuuuagucgagacaggguuucaccauguuagccaggcuggucucgaacuccugaccucaaaugauccaccugcuucagccucccaaagugcugggauaaaggcgugagccacugugccuggccauaaaccaguaauuuuuuuuuuuuuugagacaggguuuuugcuuugucacccauugcuggauugcaguggcgcaaucacaguucacugaaaccuccgccucccaggcucaagcaauccuccugccucagccucccaaguggcugggacuacaggcaugcaccaccacaucuggcuaauuuuuguguuuuuuguagagaugggauuucaccauguugcacaggcuggucgcgaacuccugagcucaaucagaucuccugccugggccucccaaagugcugggauguagccgugagccaccgugccuaguccuaaaccaguaauuuucuauuagauuauuuagacauauacaagugacacugauguugaccaccacccacucaagaagaggcuggauacuaaaagagaugaugucugagcugagucaugugcucacagcagacagcccuuguacucacaagcacucacauaugccacgugcacuugcuucugcugcaguaugagucacaguguauaucugugugauuauggaauacacaggaauccacucaaaaaacagauuagugcuuuuuuuaugaauagugaacuagggcugguaucuugcaggaauaaaauaaacuuagaugagggacccauuuaugcaauguuaucuuuuucguucuuggucaugucaccacuuacagcaugccugcuucucaguaagacacccuuuugagcacauuaacuaguauucuuuaucucauaaguaagauuguccccauuucacagaugaaggcucagagugucgugaaaguuagagcacccaaguugcacgacuggcgaguccagagccggcucugugugcugugacccaccuucucugcuugucgaacaaggcuggagacuguaucaggcacgggcagcagagucugucuugaacugagcugugugacuggacauccagagugcuuccucuucugagcuuaagucuuuuacagcacaguguuugugacggugcccuuccccagaaguagugccuccucccacuccccugaguaguuaagucacaucugcuguuuguuacccuagcuguguugucucucggaugugucaucuuuggggugagcuuagucuacugggaaaccggacacugggcagggggccagaggccugggaccauguguucauugagugaugccuccucugacagcugucauccugagccagucagggcgggucugagaaugaauucucucacuuguaacaugaggucauuagauuucacugaugacuuucguguucuucuuuucaaacauugaaccuguuaucaaccaaaaauauuacacagaaucccagcacauaaagcccagggugcugcucugaggagaggcugggaggagggggugugggcgaagauguguagaugguuucuucaagguugcagcgggccgcagggcuugggccugggacagacacugggugggguuucuguccuucaguguugucuaaucucgucacuguaaucaguuuuggcucuuuguuuuggggggucucaugacccucuacacaucugauaauucacuagaaggacucacauaacucagagucuuacagcugcaguuuauuccagcaaagggguacaaagcaggaucaguaauggaagcagacagaucaggcggaggcugaagaaagcaggaguggcuguauuaauauaagauaaaaucaacuucagagcaaagaauauugccagggagauuacauaauaauaagucaaaccaccacgaagaaaacauagcaaugcuagauguuuaugcgucaaacaacaaggcuucuguacuugaaggaaagacuaauagaaguaaaggagaagugaacaaucccacaguuacaguuggggacuucaacucucauuuuaguaauugacagaacaaguagacacaaaaucagcaacaguagaaaagaacugaacaccaccaucgaccaacaggaucuaacugacguguguagguuccucuaccccacaacagcagaauauauacguuuuucagauucccaugaaacauucaccaagauagaccauacgcugggccauaaaacucaccucaacaaaauuuaaagaacugaaauccuauggagaguguucuccaacuacaaugaacucaaaccagaaaccaauaauaaaaagauaaccagaaaaucucuauaugcucggaaauuagcacacuuuuaaauaauccuuggguugaagaggaaaucucaagagaaauuuaaaaauacauugaauugaaugaaauguaaauauaucaagauuugauauauacagcuaaagaagugauuuauuugauuugauuauucgauuuauuuauuugauuuauuugguauacagcuaaagugcugagagggaaauuuauagcacugaauacucacaguaggggucuccugcuaucugcacccguguccuuagacaagcugagggguguccuucugcaggaaccaccuugauauguuuuggcucuauguccacacccaaaucucaucugaaauuguaauccucauaacccccaugagucaagggagggaccuggugggaggugauuggaucaugggggugacgauguucucaugauagugaguucucacgagaucugaugguuuuauaagggguucuucccccuugcucucucuucucauuccugccaccuugugaagaaggugccugcucccccuucaccuuccgccaugauugaaguuuucugaggccuccccagccauguggaacuaugagucaguuaaaccucuuuccuuuauaaauuauccagucucagguauuuauuuuuagcagggugaaaauggacuaauacaguaaauugguacugguagaguggaguacugcuauaaagauaccugaaaauguggaagugacuuuggaacuggguaacaggcagagguuggaacaguucggagggcuccaaagaaggcgggaagaugugggaaaguuuggaacucucuagagacuuguugaauguuuuuuguuuguuuguuuguuuuuugaaauggagucucacccuguugcccaggcuggagugcaauggcgcaaucucagcucacugcaaccuccgccucccagguucaaauaauucuccugccucagccucccaaguagcugggauuacaggugcccaccaccaugcccaguuaauuuuuuuguauuuuuaguagagacagaguuucaccguguuggccaggcuguucucaaacuccugaccuugugauccacccaccucggccucccaacgugcuaggauuacaggcgugagccaccacgcccugccuguugaaugguuuugaccaaaaugcugauggugcuauggacaauaaagugcaggcuaacuaagguggucucagauggaauugaggagcuuguugggaacuggagcaaaggucacuuuuacuacacuuuagccaagagacuagcagcauuuugccccgcccuagagauacgugguacauugaacuugagagagaucugaaauuggaguuuguuuaaaagggaagcagaguauaaaaguuuggaaaauuugcagccugaggaugugauggaaaagaaaaacccauuuucuggagaggaauucaagcuggcugcagaaauuuugaaugucaaucaccaagacaauggggaaaaugucuccaggacauguacgaggcagccccucccaucauaaacccagaggccuaggagggaaaaaugguuuucuuggcugggcccagggccugcccugccccuaugguucccccucccccaccuccccaccccaccccccauccccgugcagcuucaggacuuggugcccugcaucccugcuuccuggucgcuaaaaggggccaacauacagcucaggcuguugcuucagagggugcaagccccaagccuugguggcuuccgcgugguguuggaccaccuagauuucaaaggacauguggaaaugccugaauguccaugcagagguuugcuguggggguggagccaucauggagaaccucugcuagggcagugaggaagggaaaugggggguuggagccccacacacagaguccccacuggaauacugccuaguggagcuguaaaaagagggccacccuccuccagaccccagucagcuuguacuguguaccuggaaaagccacagacacucaaugccagccugugaaaacagccaggagggggacuguacccugcaaagccacaggguggagcugcccaagacugugggagcccacaucuuacaucagugugaccuggaugagagacacggagucaaaggagauuauuuuaaagcuuuaagauuuaaugacugccccacuggacuuugggcuuccauggggccuggagccccuuuguuuuggccagucucucccauuugcaaugggagcauuuauccaaugccuguaccccuauuguaucuaggaaguaacuaacuuguuuuuuauuauauaggcucauagguggaagggacuugacuugucucagaugagacuuuggacuuggacuuuugaauuaaugcuggaaugaguuaagacuuuggggcacuguugggaaagcaugauugagauuugggaggggccaggggcagaaugauaagguuuggcugugucccccacccaaaucucaucuccacuuguaauccccauuaugcccacaugucaagggugggagcuggugggaguugacugguucaugggggcaguuuuccacaugcuguucuugugauagugagugaguucucacgagaucugaugguuuuauaaggggcuucgccuuuuguucucucuuaucuuuccugccuucuugugaagaaggugcuugcuuccccuuuaccuucugcauaacuguaaguuuucugaggccuccccagccauguggaacugugagucaguuaaaccugccuuuuuuuuuuuuuuuuuuuuugagaugaagucucguucugucacccgggcuggagugcaguggcgcgaucucggcucacugcaagcuccacaucccagguucaugccauucuccugccucagccucccgaguagcugggacuacaggcaccugccaccacgcccggcuaauuuuuuguauauuuaguagagacgggguuucaccguguuagccaggauggucuccaucuccugaccuugugaucugcccaccucggccucccaaagggcugggauuacaggugugagucgccgcgccuggccuaaaccugcuuuuuuuuaaaauaaauuaugcagucuuggguauuucucuauagcagugugaaaacggacuaauacacacccuaacuaccuuccucgccuucccacuccacaggggucucucucccggcuccgggggugcccugugcauccugagaaggcagcucccccggccccuucaggguccgaccuugggcauccugcugggagacugggaggcagggggaaacucugggucguauucauuucucauucuagacuucaaaauggcuucuagcgagucggcuauucaacaaauguugaaacaccaaaugguuuucuuuucuuuucuauuuuagcagguuucuuuuugguggcaggcuaaguagguuuuguaacuguaccaguuaagggcaguagauuuuacaagucaguagacucagacccgcucaccugagccuguguguguugagugaucuucucacacaguucuucaucugcacaugugugcggggaccaugcugagagcucugugcccuguuuuccaggcuuugaacuuggccuacuccagcauuuacggcagcuaccggaacuucgugggaccuccacacuuucaagucaucugccggcuucucggcuaccaggguaucgccguggucauggaggagcugcugaaggucgucaagagccuggugaguguucccuggacaugcuucuuucacacagccuggauucccuggggcacccaugccagagggucuucucugccuggacugugauucuccaacagcuggauucguucaauuaggcuucaaacauuucugaccauauauaguuugauacuucccucaucuuuucaaacucaagagaauggguccagguuauuuuaacugauacgcagaguuuuuauuuguauguguagagagggggucuugcuauguugcucaggcuguccuugaacuccugggcuccagagaucugcccaucuuggccucccaaagugcugggguuacaggcgugagccaccuuggccagccuggauuuaguuuucuagacauaacuuacuuuuuauaauuuuucauccuuuuuauuauuuuaaucuucugugacuugagaccauguaagaguuuggucacuuggcacagccaucagcccgugacccaaacagguccuuccaggacccgcuggggacucugucccaaaacauguggcagcuuggaggguguuaggauugcugaccucaccacagcugagccuggggccgcacccaggagcacagacagcguccugggggacccuggagcuggcagugcucacgaugcuggggugcauccccauaggagacaccuggcgacaaagcucuccccucauuguggcaccccgggaccacuuucaucuugaaagaggaguccaguuucagaacaugaauucagucaugggaagccaccuggugaugguugcucucucucccgggguggauuuuauuccccagccagacgauccugcagccuugcugguuaccgagcucuuugcuaacagacuuguuucaggguaugcgccggccacaggcguuagcagagcggagugggguggcugacgcagcccgucucaucuccccggcagcugcaaggcacaauccugcaguacgugaagacgcugauggaggugaugcccaagaucugccgccugccccggcacgaguacggcucuccuggugagugcgggcguguggagcucacagugcugucuguggagaggucagaaaggaauucaagucagaaauucuugagaaggauuagauuugccaugugggaagaggcaguagacagacaaaugcaccuuacaaccaggaagagguguguuggggucacugucugcaggcgaggaagcagaggucagccugcaagaguugagacaagagaccccugaacaccacgcucucgggcaccccuacgaaagaauugccacccaaugaggcgagagagccgacugcuggguccugcugcccugcugggccuauagggacuugaggcucagagacaggcccaccgagauggugcaaggccugccccugcccccaggccgucccauccaucugcagguccagcugcagggcccucaggcaggugugcucuuagggacaggcccacgugacuugcuguggguugguuuggggcaaugcaaauaaauagcuuuagugaucucagaaagcauugucucauaaaauuguaugacagggaccuuugucacguaacaaaacugcuuuuagucucuuaccuggccgaguuuucuugaaagcuggacaguugaacacuagccuuguguuguaaagcgacuugagccugcacgugggugaccgacgaggcacuguccugaugggcagucagucagcguggcugagcucuugaacacguggcucaggacuuuuugcuuuuuggcaacuccccagggcuguugcugguguuugaggagacgauaaggugucccccucagccaccauggggaaguagccaucagcacggcccuggcucaagagaaucuguuuucaguuuauugucagaaaguagaggaggaaugcugggaugauuaaaaccaaugcuuaugucgugacuagagauggaaauuucagauguugaggagggagccauuucccagugugguacagggaaagcuugcugggaaugacacaggugcaugagcguccccgcccccacccccgccaaguggggcugagucccugcagcggugcugagagcugggaggagcagaggggccgugucgggccgcugguccuuggggaaggggcacucgggcaagaccugcugggacaaggguuuaaggucugcugagccucccgcuuugcucuucccaggguaguuuaggccccuccugaugccacguucauugugcggucagcugccgguuucugucugggcuggaguugaagcuguagauuggcugggaaacguuggccuucugucccauauuugcaccuugcgucuuuuugugccuuauuccgcuguccgggaugccguugagacgccugccuugcucuggagcuggccuggugugcggccucccguugggcgugcuguuaguuagcugcaggcuuccuagaugcccuuucucagauuaggugcggccccuuccaugccugcgaagagagauugcauuuugucaaauaccuugucugcccccacuggggauguggugcagucuuuguucuugucauguggugacguuuccuaucaucauagccuucccuaaagauaugagguugaguugaaaagaggcuucagagccaaggcccggggucacaugguguguggagaacgugcccagguggcgaauaaaccaccgcugcagggaagaugcuggggaugggacguuguggcuguccuuauagccaggcuugauggcggugucagaacggcaggugcuccuggcuguggacccaggcugcuagggcccggcccccuccagucccccaaccccaccucacucccgccaccguagguauccuggaguucuuccaccaccagcugaaggacaucguggaguacgcagagcugaagacggugugcuuccagaaccugcgggagguggggaacgccauccucuucugccugcucaucgagcagagccuggugaguggccccccaacgccgccccuccccgccccagcccaccccaccccaccccaccggccaggggagggcuuucuuuggcggguucuuuaguggggguguggcaacagcugugcaucauuuuuuuuuuuuuguggcuguugagacuuuaguuugaauuuguucccuucaauugaaaaacaaaaauguacuguaguucacugucucaagaauguuuuucuguguuaacgucauaaaacuguuauauuaugugauguuuucaacaucuaaaugaacauauuuggugugccuguaagguauaaggcauugcugcgcaggagggcccucuguaugccugaggccgcugagcaguugaaguguggcucagugugacugaggaacugagugcuaaauguuacugaauuaucacugauuuaaaucugaauggcugcacgugccccaugguggacagcacgaguggccagcaugaaaggggagcccccgggagcccacccccucuuaggacguggcacaguggacgccucguguuuucgacuggccgccuuuuuguggugcugucuggcugucccucuguccuguacaucacagcagcucaguuuauaaccuccugggcugggaaagccagugggaaauggaaucucagguagcccucuccugccuuccaucgugacuaacgaggugggcaucucuucguucguugcgucuucuuguuucuuuuccugugaaaugccccauugaguucuucggccuauuuucuuuuucuuuuuuuuuuuuuuugagacggagucuugcucugucaccccggcuggagugcaguggcgugauguuggcucacugcaagcuccgccucccggguucacgccauucuccugccuccgccucagaaguagcugggacuacaggcgcccaccaccacgcccagcuaauuuuuuguauuuuuaguagagacgggguuucaccguguuagccaggcuggucuccaacuccugacuuugugauccacccgccuuggucucccaaagugcugggauuacaggcgugagccacugcgcccggccucuuuugccuauuuuucuacagcucauucuguguagacucuuuaugugcugcacauaucguaaauucuucucccauuuguggcuuaccuuuucacucugauaguggugauuuuugauaaaaugcucuuaauuuggauguagccuuuuuuuuuuuaaugauuagcacuuuuuuuuuuuuuuaaucuaccaucugcacauggaacuuucaguaucuuuuugaagauguuuucccugccuuggggucaugaagacauuccuuuacauugucaucuaaagauuugaagcuuugccuucugcauggaaguuuguaauccuucuggaguuggucuuuguguauaaugugagaggcagaggaagcuucuuucucucuguggagacccauuugucccuccucuaguggcugaagggcuccuccucccguugcugaccagugguguccccugccaucugccagcuuuucaugggcacaccggccugucuccuggcuuucugccacaucucgcugguccaggcaucugucucugacaucauagcacauugucuugcucaucguugcucuaacaugacucucgaguccccacuugccgcguucccugccuugcuccuucuucuucagcauguucccuccccagggcucucugcucugcccuguuuggggauugguucaccacauacccuggcgaagcguauuggcuugugcaugggaauggcacuucgucuccagagcugccuggggaggccuuuccuauguuguuucccaaagcagucucuugucuuuaggucucugguagcuuugcaaaggcagaguuguguuugggaagaacagggagaggguggucuguacacagcucagggcauugcugucagacugccaggccucuggggacugagccucuggaccagccgccucacaccagccugugcggugaaagagaauguguuggcucacaugucaggggaguccgaggucaggcgugacacgccugggagcugacagccuccaucagaccugcaucuucggcucccucuaugccugcacgccuaggcagacccucuccuggugguuucaaagagggacugcagcagccccaggccuucauuguccuggccacccacaggcucgguggggaccccaaguagcaucuccucccaugcuccccucaccacugugagugugagggguacaagauggagaacccaccagugucucagaccagcaagaagccaguguccaggguggcccugcucuaaggacauguuccccaaauaauugugaauuguuaaaaaccagauguuaggaagcaucucuuuaaguauaaucucucauuaugaauuuuaaauauuuaauacaggaauauuccuuucaugggugacuuuuccugaacuuacagcauaaggcgcgcccuaucucaucugcuaucuuaguccauuuuguguugcuguggcagugccugagacugaguaauuuauaaagaaaaggaguuuauuuggcucaugacucuggaggcugggaaguccaagaucaggcagcccaucugucagggucucaugcugcuucagcucugggggaacagagaaggggaagcggguguugccaagagaacaaacaugagaggcagccuugcuuacaacaaccugcucucgcaggagcuuauccauucccacaaaaacuaacccaauugugggagaacugacccagcccuguaagaaauccaucaccucucggaccaccuuccaacacugcuacauuggcaauuaaauuucaccaugaguuuuggcagggacaaaccacauccaaaccauagccucuguguauguccaagccugaggaugccugucuggucauuggccucaggucagggaggugagacccgagcuuucuuaauggggagacagccuuguggaauugauagagauagugucagagaccccuuagggcugguuucucuucuguccagcugcccuuuuuggaaauaagauaaagugucaaaagcuuuucuuuacaucauuucuuuuuuuuuuuagacuggaguuucacgcuuguugcccaggcuggagugcaguggcacaaucuugacucaccacaacuucuaccuccuggguucaagugauucuccugccucagucucccgaguagcugggauuacaggcaugugccaccacacccggcuaauuuuguguuuuuaguagagaugggguuucuccauguuggucaggcuggucuugaacucccgaccucccgccucgcccucccaaagugcugggauuacaggcgugagccacugcaccuggccugacauucuucacauaaacaaacucuugugguucuauaauuauuuauguccaucccaggacucauggacauaaauaauuauagaaccacaagaguuugaagcaggcagaauggaauuuacuaggauaaucucuuagcuuaaaggcacgguuucugugcauugucauggcaacaguuggcccucuguuggcuucuggauggagugugaugcugcauuagaaacagggaaagagaagcggagcagauggugucuggccggcgucuggcacuggauugacguugaugaguacggaaaagucugccuuucuuccucuuggucuuaguuuugccaucaucucugggagguccucagaaguuaaaaucucauugucgguauuucuugauuuucugauagcuguuucuuuguuuaaucauuucuuuuacuccuaugggacuuuaagauuucagcauggcuguggggucggaggcacugaaggcuccaucaccuucugccugcuccguggggguggugagcgcacuguggucugaagaggcccuuccugguggccuaagagcccucaccucuaaagaugaacagcaguugcucaauuuuugaccaucuuuggguucuugguggauuugggguguucugcuguccucaugauccuggagguacauuuucuuuauauauauauauguuauucuggagaacggaccuugugugguuuuuauuaccucuguaaaggagcuugugacccaagagcaguucggcaugauggccuagaacuuuguuuugggcucuguagggaaugaguggauguggacaccaggguaggccaccccuacuccuuccaucuccuguguuguuugcaggagacgccccuuccuucugucaguguggugggaucuugucauaaacugugguucuuaagagccugguggcaaauuagcagggaaggauggggcgagagcuuuuagacagguaaauccuggaaaacagagcacacauucaacacugggucuuaccugugucuauauuuacauuaauuaaauguaacuaaaaauaaaauucaguuccucaagugccaagccacauuccaaguacuuacuaggcaugcauggcuggcggcugccggaauggacaggacagacggaagcauuuccaucaucccagaaaucucuugacagagauaaaauaaacuuacagaguuuauuuuaugcuaaaaggcaaagaaguucuugguuuucagcaccagauugcucucuggcgagauacccuuccuagcuugacccucucuuucucugcucuagucuuuagaagaagugugugaccugcugcacgcggcuccuuuccagaacaucuugccgcgaguccaugugaaaggugagccugcugacccccaccagggaguccagacugcccucuguggggguggugcccacuguaugcaaccggagagcuaaggaccagugcagauuguggguuuggcgccuguucagucauacccagggguaaugaggaguguacagaaccuaguuaaaugaagauugagaaauagagcugcaaugauaugaugucuuagaauugcuuccaaauaucaauagcaugggagcagggggaguuggguauauaagaagcagaguggccaugaguugauaauuauagcagaugauggguacaggcucauugugccauuuucugcuuucgauuacauuuggaauauucaauaaaugaaaagugaauauugagcagaaaauugguucugccgguuugaauuaaaauauuaaaugagccaguucuguaaaauaauuuucaaagagaaucuguauccauaauguuaacuuaaaaaucuuuuguuuuuuaaacaaauguaaaccuuugcaauuaccguuucauacaaaggagcagaauauaguaaaauauuuuuucuacugcagagggggagagacuugaugccaaaaugaaaagacuagaaucaaaguacgccccgcugcaucuugucccacugauugaaagacuggggaccccucagguaacguguaccgugauggcuguggcuguugcaagcugggcauccaugccaggccagguggccugguugggagccagacuggaaggcaucgugaaguccagcggcugcguggcugcucaggccucaaguguugcaaguggggugugcaccaggacugcuucccuggguggugggaggauucagaugagcuaacaccuggaaagagcuuagcacaucaccuggcacguaaggcuuacacagaagacaucacuuucacuguccagcccuucaugaagaaggcuuucccauagguguuuaagaacagaagaaauuaggccaggaggcaaggugucaggguagaguucuacagugauccagcugcuuaugcuaagucaggguuucucagccauuuuggaccagauaacucuauggugggggcuggggcgcccugugcaucguaggaugguuagcagcaucccuggccuccacacuagcugccaguagacccgcuccacccaaaacauuuuuccagggccgggcaccgggguucauuccugucaucccagcacuuugggaggccaagacaggaguuugagaccagccugggcaacauggcgaaaccccaucucuacaaaaaauacaaaaauuauccgggugugguggcaugcaccuggucgcuugagccugggaagucaaggcugcagcgagcugugauugugccacugcacuccagccuaggcagcagagcaagacccugucucaagagaaaagagacauagaggauguggaguagcuggaugccuggaggcccacggcauuccacggcuuguccuuucugcagcaaauugccaucgcaagagagggggaccugcugacaaaggagcgccucugcugcggccuguccauguuugaggucauccugacacggauccggagcuuucuggaugaccccaucuggcgcgggccucugcccagcaauggggucaugcauguggacgaguguguggaguuucacagacuguggagugccaugcaguuugucuacugcauucccguggggacacacgaguucacagucgaguaagugugugcugagagcaggacaaagccccagaggaggggaggagcugugggggaggggaggcguguuaggcuaacaagcagccagccaugcucaggaaguggaccagaaacucacugagcggcuuuuaagccuccuguaguggggauucuuacuugaugccaaagagcugacucaggacucuaguauucagggagucucugaacccacggcaauuguaugcacguugggcgugcauuuuucuaggugggagguccauagagucauucaucacagaggggauaugaucuaaaaagggacaggaagcagcacaccagaagagcccaaaaaaguuauuuaucaaaaccagggaacagccaccuggcugcccggcauucucuuccuggcuguggaaggugacuguguaggcacagacaguaaugcagauggcuuggucacugacaucuggagacagacugagaaaagacuucauaacguaucacucaucucccauucuguuucugcuucuuguuccuaggcagugcuuuggugaugggcuacacugggcuggcuguaugaucaucguacuucuugggcagcagcggcguuuugcugugcuggauuucugcuaccaucuacuuaaaguccagaaacaugauggcaaagaugagauuauuaaaaaugugguauguggaugaaaaucucgcaccaucuauggaccuuuugcaaaagcauacuuucuuuguguuauaaguucuuguuucuggcaauguuuuucauccuaguacguaaggugccaccaacagaaacuuucuuuucguucccaaaaugaaucuaaauauaauuggccaguaaagcagucuggcagagaaaauacucauuguuccguuuuccuucucaagguacuuagauuuacuuccagucuuacaggaucugcauugucagaauauuggcaacuauagucuucgggccccuggaagucugugcuuucuuggcugcuuuaaaggccuuuugucuuuguugcuuuauggaucccucauaguugaauucuggaaaauacucagccauuaucuuugaaauauuucagccuccuuuccauucucccuauucuugccauucaggacuucaguuaaacauauguuagaccuucucauucuauucuccacaucucuuuguuguaucaguuuucuuuuuucuuucuuuuuuuuuuuuuuuuugagacaguuucgcucuuguugcucaggcuggggugcaaugccacgaucuuggcucacugcaaucucugcugcccagguucaagugauucuccugccucagccucccgaguagcugggauuauaggcaccugccaccacgcccggcugauuuuuguauuuuguaauuuuguauuuuuaguagagacuagguuucaccauguuggccaggcugaucuugaacuccugacauaaggugauccgcccaccucccaaagugcuaggauuacaggcgcgcccagcccuguuguauuaguuuucuauugcuuccaugacaacaaaucaccacaggcuuggcaguuuaaauaccacugauuaucucacaauucucuaagucagaugccugaguucagccaggcccagcuggguccucugcucagucucauggggccagugucugaggugcuggguucacccuggaggccuucaagcuuaugcacaguuggcucaauuauuccuugcagcuguaggacugggucccccuuccuucucaugcuuuccaaguggcccccuccagcaaugguggguugggcagucucagccucuagucuucugccaugucucuccugccuccggccagagaacauucccugacugugacuauauugagcccacuggacaaccccagauacucucccuguucuacaguccagucuuagccacaccugcccaggccccguggaguggaggcaaugcagucacaggcuccaggucaugggccucucucaggggcccuucugccucccacuccuccauuuccggggcucccagagcuguguccagauacuguauucaugugucuuaguuaacuuguuuacuucagcucuaaucugcugagcuuuuacucugaaaauauuauuaguucacuuuuuaaaguucaauuagguucuucaaaucuucuugguaacugacaguuuuauugucuuaacugaacuuuuuccaucucuuauuucuuuauccaauucauguauucuauauucuguguguuuuccuucuaguaucugaaggccuuggagguauuuaaaacuuugcuguuuccuuguguguuggguuauuugggagucuuuauuuaacuggaguuaauuuagauugcuuucccccaagaugugcauuuguaucugcccaucucuauggggugcuaccaacucagggccgcuuuagccgaauuggagguccuggcuucacuggggagucuucgguguggucccgcuugcuuacgcccgggcugcuccucaccccaccgccgcuguuggcaucugccccugaggaggcccuggcuucccccuuaccaccugcauagguagaaccagcuuuucaaagcguuuuguuugcguguauguucuuaauucguguucuuuauuccugugguagcaggagggucugucagaguaucccgucacaguauuuccaaacuggaagucuaaaacuuguguuaguugacuggccuuucuccacugaccacaucaucuucaucuggagauccccagcuuugagcagacaguagguucuuaauugccaauguggaaggaauaggccuaucaauugugcgcaugaaugaaucuacagcagcaugaagccaacagagggauucuaaauucaaaauauauucauccuuccaacuguugcauuaaagagaugguauguggcugggagugcuggcucauaccuguaaucccaacaguuugggaggcugaggcagaggaggauugcuugagcucaggaguucaagaccauccuggacagcauaauaagaccuugucuuuacaaaauuaaauuuaaaaauuagcugcguguggugguacacgccuguggucccagcuacucaggaggcugaggugggaggaugucuugaggcuacagugagccgugaucaugccacugcacuccagccugggcgucagagugagacccuaucuuacaaaaaaaaacccaaaaagaacaguaugugugucaauuccguuugcuauuauuuuucugagaaaauauaagaauccugacauuuugaaacaugaagaauaaauguugaaguguuaauaguaaaacauccucacuuugaugguuguagccuuugaagaagaugguggagagaauucgcaaguuccagauucucaaugaugagaucaucaccauccuggauaaguaccugaagucaggcgacggggagggcacgccaguggagcaugugcgcugcuuccagccgcccauccaccagucccucgccagcagcugagggcacgcgcugcacuccguaacucaacauggcaugccuuucucuccguaaacuauuuagugagauuuuuagggacuauuuuucaguaucucuguaccuguuaaagggggugcuuuucgaucuaaaaacuuaauuuuauaaaauugacuuauuuuucuagacuaaaauuguauaugcuuuugguaauuaggaacucuugagaauauuggcugcugauuguugccaucacguuccuacaaaauuguuuuucuaugggauguucuggcagcugugucauaaaaugcugcuggguucauucauucauuccauaagaaacuuaauaccagcaaaugcauuaaaucccuugccaguuaccauuaacuguaacuauuuagcuuuuguuuagggaucuuucugauggucuuuuaugagcaaucuuaguucuaagucauuguucccaucccuuuuuuguguguuucagaaaauagugaacuugauuccccugcuuccacuaaauccaguugugacaaaaucuaacgugacaucagaucgaaagguuauagaaauaaaacuaaugagaucua

SEQ ID NO: 191780 - RNA, 101780 nt, Homo sapiens
agccaguccucccgucuugcgccgcggccgcgagauccgugugucucccaagaugguggcgcugggcucggggugacuacaggagacgacggggccuuuucccuucgccaggacccgacacaccaggcuucgcucgcucgcgcaccccuccgccgcguagccauccgccagcgcgggcgcccgccauccgccgccuacuuacgcuucaccucugccgacccggcgcgcucggcugcgggcggcggcgccuccuucggcuccuccucggaauagcucgcggccuguagccccuggcaggagggccccucagccccccgguguggacaggcagcggcggcuggcgacgaacgccgggauuucggcggccccggcgcucccuuucccggccucguuuuccggauaaggaagcgcgggucccgcaugagccccggcgguggcggcagcgaaagagaacgaggcgguggcgggcggaggcggcgggcgagggcgacuacgaccagugaggcggccgccgcagcccaggcgcgggggcgacgacaggucaguguugccgcggccugcgccaggcggcgcuggcuccccuccgucacucggccggccuucggggcccgcuguggcgaggucgacaccccccuuccccgccccccgccgccgaggcgaguguuugggggcgcgugguccgaaggggcuggugccagaaguaggccccugguggccgcggcugcugcagccguaacugucaguccuggcugagcgacggcgggaggguuuugucgcccgaggggacgcgagcgggcccggggcggggcgggacgugcgaggcgucgagauuugggccuccuaggagccaggcucuucgagccagccggggccccagacagggaagggcaggcccuuuccuucaaaggggagcccuuucucggcguuuucaagguuuuuggcucucuuggggaagacauauuuagccgugugcuugguggguugggguuuuggggguggauugaugggaagggagggcggaugaagugguaugucaagcccaaggguugugcgcacagguuacucuguguuaccggccaccaggauuucugaaguugaacgugaguuauuggcuuugccagagacugcuguguuauaugcagaccuguaugcaagcaguuggccuuuuuuccccccccuuuucaguguagaaaaugaaaaggaugcuuuccucaucuuggugguaaaggcuuuuguugguaaagguagaauugaauguaccaaaugccuuaguccguaaaauuuuagaaauaauuuuaauacagacacuggugaagcuuggcaaccuugaaagagaauuuagcgucuacauuuuuuaaaugacuuuuuauggauaugcuaaauuaguaacaguccaaaaucuguuugagauuauuaaguggcgagggugcuguugaaaauguaaacuaauagcauaugggguuuacagugcacaguuaaccucaaucaugaagaaauguggauaugacccguaauuuuggaucauuuuacugccugcaauauugagagaagcagcaaauuauuacaguuuuuuuugggagacgaccuaaaguuuaagaaauacaacuguugaaaguuaccugucagagacacaaagguacccaaucaaucuuguugaauaaauuggacaagugggauaagguguuugucucacacuucugaucaauaaguacucuuacuuaagaagugauuugguaaaucauguaaaauuuagaauuuaggagagauaagaaaguuguaacuugguguguauaguggaaauagcuuugaaauuagauccuguuuuuaaauccaagcuacuuaccacauuuuuagugaaaugaauacauuauuaaugaugcuacugauaagcccuaaggaugaccagaagcccuuuuaagaaacacuaauacaguugaccaaaaaauaaaaaaggaaauagcuucaagaaauaauuuucaaucuuuguguauuuauaauauacacaggagaaauaaaagaacagaauaugaagagguaacuuauaaucuuuacaaaauuagaauguaaacuaugcuagucuuacugugucaauauuuauuaaccugcauuaguuugcuaaguaguaugcucacuauccucuggacauugccccugucccugaggagcuuaacuuuauacagagauacaaaauacuguguuuugauuuccuuucagaggauuuauaagcuacuuauguuuuaucuguccuaaauucugcccuuuuuuuucccauggcugaaaaaauaacuuccuaagaaagguacauacuagucagagguguggggaaaacguguucucaucccacuugugcaguccauuuaacaggauuuauuggguaccuacagugucuuugacauguaacauuuaaucaguuguauuucuuaaacuuuagauaauuucuauuucgaucauuucuauuucaaucuccucccucuccccuccaaaaaaauuuacuguguaaacugugauaauacacuguuucucucagugucagucaguggaaugauccagauuuauaggucauagcaaaauuuuucaucccaagcucuugaaaugauguuuccaaauguccauuuucuuaaaugacugcuaguuauguucuccaaucauguuacacauauuuuguuuagacuuauaauuguguaggucuaaauguagaaacauuacauuauguacauaugcagcugcugaaagaaaauuaguuuucuaauuuuuagaucggggugaagacaaacuuuuagaagugaucuuucgguaaaauacuggaugaagucuuaggugcucuuuuuauguugguucaggacaaaaguuuuuugacugcuuuuugaguuuuccccucacugccaaauguaaggauaaaauguaguaacaagacaucuugguauguauagugguaauaucuuuggaauuagacccuaauuuuaauucuggccuuauuaaucuugguaagccacaguuuugucaucuguaaaauggguuggugaaacuuccccagaguugugaggcuuaaaguauguaaaacgccuaacacguaggcacucaauaaguauuaccuuagaaaucuuccuauccaguuuuucugaauggucuggaagcaccuuguauguaguggacuacagcauguuauccuuuauguuguuuauuucuuuucucauuagcuaugaacuuuuuaaggccaggaauuccuaguguuuaccagagaauguguuacuagaugucuuagucuguucuggcugcuauuacaaaacaccacagacagcauggcuuauaaacaacagaaguuuauuucucacgguucugggggcugagaaguccaagaucaagguaccaacaaauuugacaucuuagugagggcccucuucccuuguucauagauagcuagcugucuuuucaccauuaccucauguaguagaagaguagacggggcucuauagggccucuuuuauagaggcauuaauuccauuaaugauggcaaagcuucccaaaggccccaccucuuaauacuaucaccuuggagguuaggcuuucaacaugaauuuugggggacacauucagaccacagcacuagagcaggcaugaauugguuauugguaaaucaguaaaugaucaacuaacauuuauuagguuccuccuguggcuucuaugagcugagcuaaguacaggacccacaaagacaagaaagaugucugucuuuuuugaaugcuuauaguugagugacuuucucacauuuguguguguguguguguguguguguguguaaaacccuaucacauaauggaacuucauuuucccaugcccuuccaaucuaagagcaguucuauggacucaauaccuccuacccaccagcugcuacuguaaagauuuacuuuuuuacuccuuuuaaaaaguucaacccucuggcacaugcauuacuucauuccuuggucccagcccaccaccccaguaucuggcacguaguguauuaguauuuguguguguguguguguguguguguguguguguguguguguguguguguguauguauauagaauuuaaaauuuuuacuccggcaguugucuucaaauacucuaauuuuggggggcaugauuaucauucugucuucuggcaguacauggauagaugcuaccugaguaggauugucuaugaggucagcugcuccagucauuuuauacaagaggaaauuggagugcaaagcuuuaaaaugauuuucuuaaagucacccaggugucagaaccagaaccagaguccaugucucuaguucaggacucugcacacauuggcacauguucuguccuaccuuuugggaugaauaguuauacuugcuuugugauuacucacccaccuuuuuggagacauaugaguguuuuguacacuauuaauagaaggcagccuucacaaaaugccaucugcagaucuguuauuucuucuaauaaaggaaaugauguaaaauuaccuuaaauagaaauaguguuaauucuucuggagacauauuccauaauccaaacacgaaauguuugaaauacuugaagaugccauauaaauaaguccuuuguaaaaagauaauauuaaaaauuuuuguuuuauagagaugggggucucacuguguugcccaggcuggucuugaacuccucagcuuuuacuuuagcuucccaguguguugggauuacaggcaugagccacaauaccuggccaaguccuuuuuuuuaaucaaaugacuuauuaauacacaguuucuuugccagcuuuuguuuucauuugcuaucaaaaauguugcuuaguagugcuuugaucugaguuaucaauaacagguaaaugccauuauggauaauaauucaaaaagaagcuuauuaauuauuaggccuaucugagagugaaguaaaguuagcauuuucuuuuuguuuauuuuacuuauuguuuauuuguuuagagacagggucucgcuguguugcccaaguuggagugcaguggugcugucauaacucauugcagucucaggcuggagugauccucccaucucacccuccugaguaggugggauuagcauaugccaccaugccuggcuaauuuuuuuauuuuuuaauuuuuuuguggagauggggucuugccguguucagguugguuucaaacuccuggucucaagcggcuuggccucccaaggugcuaggauuacaggugugagcuaccaugcccagcugagcauuuuuaaaaaauacuggucuuuguacaugagucguuacuauuugauucuaagccuuaugacugauaucccuaaaaauuauuuauaaaauuuuaagugcaucagagucauugaaauggaaugagcacugucuuuuggucuugagguuguuuuaacuagcuucguaauggucaugagcagguuauuuagcuuuugaagccuucguuccuucuuuugucaaaugaaagugauaguugcuuuguuuuaaaagaguaugcuuuucaaacgugaucauucuugaaaauguagauuaagagcuuuuuagaggccaagugccauggcucacgccugucaucccagcacuuugggaagccgaggcgggcggaucacgagaucaggagaucgagaccauccuggccaacacggugaaaccucaucucuacuaaaauacaaaaaaaaaauuagccggacgugguggcgcaugccuguagucccaacuacucaggaggcugaggcaggggaaacgcuugaacacgggaggcggagguugcagugagccaagaucaugcuacugccuggcgacagagugagacugccucucaaagaaaaaaaaaaaaacuuuuuagaaacguuguuuuggggaauuuuuagugugugaauucauuuuaaauaugugaacuccauuugacauggacaauggaucuuaauaguuugugauacauuauucaguguauuaaucaaaagucaaaucucuuuuguaauuugcuguaccagaccuguuguguuaaucugaucaauggcaagugaaucauaagauugaccugaaaggaaaagauauuuuuaggggacauagaaucauauuggauaagauuauuccuauaguucauuuucaggaaaucugaacaggaaucucguguaaggaaucacaugugaauuauagaagagagucugauguaagacuuuauuuauuaaggucugcaucuguguuucaaguaagagcauagagguaguauaugagcccugaacacucauacaaguaggauaaaauuuuucuuaaaacuguuggcuggacaguguagagucuaaugcugugacucuuaacaguuuuguguguuccagaaguucaucuccucaggaucaauugagguuagucuagcacagacuuuaguuauagaaaccaaacaugagaaaaauuuuuugacccaugucuucguagcaugcaggcuugguagcucuuuccuaguucuggaugugugcccguuguauauacuuucagcaauucaggauguuccuuuucauauuuaagacaagcacucuugcauacaaauuacauagcugugggcugaaugaagaugcuaccauugcuguacuucuacacagguucuuuucauguaaugaaaucagaagggauggcuuuuccauuucaagcuucuguuaauaaguagucuuagaauugccuuuguguacuguagccaacaccccaacucauauauuuuuauaaucuuugugaugcagaauaaauucugaaacuuuccaccuccuaauuaaauauagaaauacugaaaacaauaaagcaccauguauucacuauggacauaugucacauuuugucacuuucuugcacucuuguaaucccucucuaaagcucauguuaaacucauguucuuuauuuucuucucagaugauuccuuuggcacugcauguaacaguacaggaauuucuuccuuucguacuuccaacaaauacuuuuuugucucuuaacagaugugaaccauaaugcuguucuuuagaaagcaaaggaugaagugcacagcaguguuuucuauauaaagcuaaugggucauaaggggaaauauggguuauuuccagcuuguuaauugucuuaauacauuuuuccuaagaauucuauugugccucugugguuauaugcaccaauauugauaaucuuacagcgugccauaaauaaggauuuuuauauuaucuuugcuaaauauuuuaaguuuuuguuuugggaauugaaaaaaucuuuugugcaucuaugguaugugauacguauacuaauggauaaauccuguuucacacaaagauuaauuggguaacauuuuucuuuccuaguuuucugaagucaguggucauguuguguguuggugauugaaaauaugcuguuuaggcugggcgccuuggcucacuccuguaaucccagcacuuugggaggccgaggcacacggaucaccugaggucaggaguucgagaccagccuggccaacauggugaaacccugucucuacuaaaaauacaaaaauuagcuaggcgugguggcacacgucuguaaucccaguuacuugggaggcugaggcacgagaaucgcuugaaccugggaggcagagguugcagugagcugagaucacaccauugcacuccagccugggcaagcaagauuucaucucaaaaaagaaaagaaaagaaaagaaaauaugcuguuuaagaucauucaaauucaguuucuaagaaguguaaaguuuuccuaauuacuuaagcugcuucauucucauucccuuuuguaacacauuuugccaucucuguaacauguugaacauguuuaaagaacagagugggagaauaggaaguuacguggauaaaguuugguaaucaagguaggaauacauccugcuucacagaaugggaauauuucugaaaaguugacuguaguauugaagaacacuuaaguguaguguauuagacgaacugagcuaauuuuggucuuuuauacacauaaaucaagauuucugcauuucaaaucaugcauauuucuuuaaauuuauugcucaguguacuguauuucaaauauuguaaaaaugaaaagaucuuguggucuuauuuaacucaguaugggauaaguccuucccaccuucccauucuuauucccucuuuuaggcugaaugaaaggcugggggagugaauuuaaaaauagauggaucucagcuggagaauggguuggucacguaucucaacugauauuaaauaauuucuuaaauccuggauugaagauuauaagaaaacaguaaauguuugcucucaguucauuucuuuguuuuguuuuuucauguacaguuuuaggcacuuguaacugcuggaugcaugaacuacuuucuaguucuuucaggccuacuuuuagauaucugcuguggggacaguccucaacacuuaaaguaauuuuaaauagugauaggcagaacuaggggucaguuuuacugccuaugccugugcugaauuugacauggcauuccuaggaggggagguggaacgagggcggugcacacauuguccauauugcuagucagugccagauuuugagaaacuggggcuaaucucucucuuaaauggucaagaucuaauuccccaaagugcuguuucagauaaccuaguauuuguccaaaauugcccugcuacaauaguauuuaucuuauauauauguauuauauauauaauauauauauaaucuuauauauauguauuauauauauuauauauauaaucuuauauauguauuauauauauaauauauauauaaucuuauauauauguauuauauauauaauauauauauaaucuuauauauauguauuauauauauaauauauauauaaucuuauauauauguauuauauauauaauauauauauaaucuuauauauauguauuauauauauaauauauauauaaucuuauauauauguauuauauauauauaauacauauaaauauauauauauauauauauauagguuuuuuuuuguuuuuccuccugagauguagucucgcccuguugcccaggcuggugugcaauggugcagucuuagcucacugcagccuccgccuccuggguucaagugauucuccugccucagccuccugaguagcagagacuacaggugugcacuaccacgcccggcuaauuuuuguauuuuuaguagauacaggguuucaccauguuggccaugcugguuucaaacuccuaaccucaggugaucugccugccucaaccucugaaagcacugggauuacaggcaugagccaccacaccaauccuauuacauucuuaaaaaaauguuuguuuguuuguuuuuguagagaugaaguuucacuauauuacccagccuggucuugacuccugggcucaagugauccuccugccuuggcgucccaaagugcugggauuauagacaugagccacugcguccagccuguaucauauuuuuauucugauaucuuuuguaauuuuguuuuuagugaaguagggagguuuauauuagauaaucuuccaagguaauuaucagcuuggacauuauaugcuaauaugucuuuuguuuguuuuuaaaauaaguguauauguuuuaauuguaaaauuuuuaaaacauccagaaaaugacauagcaagugccuauuuauccaccaccuggaaauauaaauuauguccauuuuuaucccuugggggaaaggaugcaguuauauaaucacuuuuaacaaccccaacuguucaaguccuguuacccgucucuacacaaaguaacaacugucuugagauucuuaaguaaauuucacauccuuguuuuauacuuuuacuauacauguguacauguaucuguaagugauaugugguguugguuuuuguauuaaauuuuuacagacauguauaacgcugucuuucaauagcuugauuuuuuuaaacucaguaucaaguuuuugagguguauauguugaugcguguacauguaguuuauucaguuucacugcuguauggcacuucauuuuaugcauagauaaaauguaugugucccacuauugauggauauuuugaguuguuuucuuuuugcuauuauaaauaaugcugcaguguuuauuuuuacaugaguguaugugcagguguuuugggaaaaaccguagaagugaaauugcugguuacuagauauugguaaauucuuuuccuaaauggauaugcccauguauacuuuaucagcauuaugugggcauuucuagcauccucacccauacuugggauugucagauuuuaaaauaguuacuaauuugaggcaugugaaaugcuaucucauuuuaauuuacaguugcuugauuauucugaaucguagguaaaaggauaggaaauuuauuauuuucuguauguuuuaaauaucucaaaaauaaauguuuuuaaaggaaaggcacacuaucguacaacauuuauguugaaaaggaccaugaagaucauuucauccaaccuucuuacuuuacagugcagccaaagaaaguuaccagaauaagaguaaaauauaaaauccugcccauuguaguauucucugguaguaugagccuuaauuuuugauguaaaaaucaugucuuuuucuuuaugauugugcuuuuuguuuaagaaauccucuuuuuauauugucugcuaauaguugaggauuuuuuguuacucuuuguuauuugcauuuagguucaucugaaaggaguuaggauuuuuuauuuuaaauaugaaaagcuaguuguuccagcauuaaguauugaauuuuuaaaauuuuguauugagguuaaauauacauacauaauuuaccaucuuuuuuaaguguacaguucauuuuuaaugauuuuuuaaguguacaguuuuuuaaguguacaguucagcaauaauaaauacaguuauguucuucugccuuuguccucucacuccccacuucggcugcuaguaaccaccagucuaugcuuaucuucuugagauauacuuuuuuagcccauguaugagugagaacaugugguauuugucuuucuguguuuggcuuauuucacuuaacauaauggcuucuuguuccauccguguuccugcaaauuacaggguuuuauucuuauuuuuauagcugaguaguauuccacuguguguauaaacuacauuuuaaagucuauucguccuaauuauugaauucuccccaccccacccaccuuuuuuuuuuuuuuuuuuuuuccaggagacagggucucccucucuuccccaggcuggagugcagugccaugaucauagcucccugcauccuugaacccccuggccucaagcgauagucuugccucagccucccaaguagcugggacugcaggcaggcaccuccaggcccugcuaaguuuuguggguuuuuuuuuuuuuuuuuuuuuuuuuuuuuguagagauggggucuuccuauguugcccacuuugguuuguuaguuuuaguaguuuauaauuccuuuguauuauugugaacaaauaacaguuauuuugaaauagaagagugcuuucuauuuaaaauuuugcuuugauaggguucugucuacuuucugagccuuaccuuccugugcauuccccuuuggucaguaccaucuuaccacacaggcugcuuuuaguuucuugaguuauccaucuuccuucuaucuuauagggcucaaccuaaauauuacucagggaagccuuccuugagagucuuucuuuuugcacucauugguuuggggcuucuuuauauuauacuguuaauugaauucugagucguguuuaucucaacugagauuagguaauuuauuuugagaacaguaaauguuuaucaucugucauucuuuuuuucaugcccacauucaguuauuuguaagugcugaauguauaaguguucaucuacagauaaggaucaguucuuuuuuccccaacuagaaauguuacuccaguugauaauaacagcucaaacggaaauauaaggcagaggugagagagucacuugaggccacgaauuggagaccagccugggcaacaaagugagaccuuaucccuaugaaaaauaaaauuagcccagcuugggaggcugagguggggggauugcuugaacccuggaguuccaggcugcagugaguuguuaucacaccacugcacuccagccgcggugacagacccugucccuuaaaaaaaaaaaaauuauaaccagccacauugaaauauuuuguaagacauuaauagaagacuaaauguucucauauguuuacuguuuguguuaaguacguaugguuuuuagaacaacaguuuucuaucaaguguggucugguucacuuagaauuagaugggguagauuuuuugaaaagcguuuugaaguuaaauuagaagcuaaugguuuuuugucacuaaaucaaauuuuguuuuaugcguuuaagugcuacauuuauuugauaggcaggugaauguaacagauuaaacuugaaaauaauguagcuaugauuccuucaaggaaaaacccaccuaccuuuaguucuuuuaguauauugcauuauaagucuuuugugugugcauauauagcaggcauaaauuggcauaauucuggguuuaauuuuaggcuaggcgcuauggaaguuugaacucuaauuacaguguaaaaauaacccagaggaaaauuucagaauaauaaaucauugggacuauaugguacagaugucccuguuuucagauuguagaauuguugaccaguaggaaugcuuuaugauuaaaagccaggaaauuaaaguaauucugaugauuugguauuucuaaagauuuucauagaugacaguugagaacuacucucagaugagauucuuccauugcugguaagucauguaauaaaacacuuaaguaaauauuuuaaugaggaaugauaacauuuuaauauuggcacauugugagucuaccuucuguaguuaguagguaaauaagaaauaaacauaccuuauuuaaaaaaaaaauuucaaagaacccaagggaggggagagccaaggugcacauuagaaggagauuacaguacucuuccagugcacaguggauguguugugauuccagaguucuauguauguaugacuguguagcccagauuuaccagcaugggcucaguuuuaaauguuagguuaggcucauaaaucaugaaaaguuccuaggaauucuaacauuuuuacauuuccagaagagagccucuuguauuuugugguaguugccccaccaucccucaaauauugguguguagaaucuauuuuugaggaugaggaaauacagaaaagaaaaauaaaaagcuauuuuuuuuuaaguauaagaagaaaugaaagguuucucuucgcuucauagccaauucuaaaacuuaacaguuguuaaguguguuuaacuguagagggaaaaaaaugccuggaaggaaauuaccaaucaaauauaaaauguaagauagcuguaaaaguacugauauacauacagcuuuuuuccuuuuggggaggcaguauuuaaaaaaaauccuaccaaacauauucucuaacuuucaaaacuguuaauagcuuuauugagauaauucacauacuauaaaauucacccuuuuaaaguuuuuaguauauucacaguucugcagccaucaccacuauugaauuuuagaacauuuucaucauccccaaaauaaauccuaaccuguuagcagccauuccccauucuuuccuggccucuggaaaccacuaaucugcuuugucucuaugaauuuauuuauucuggauauuucauauaaaugggaaucauacaguauguguccuuuuguguguggguucuuuuacuuaccaugguauuuucaagguauguucauugacauguaugucuguuuuuuuuggguaacacacacucuugauuacuguagcuuuguaguaagucuugaaaccaggaaaugugaguauucuaacuuauucuuuuucaaaauuguuuugggucucuggguuucucaaauuuccauagaauuuuaggguuagcuugcaaaaaaaugcaacugggauuuuaauaggacuuggauuuguguugaaucuguaggucuauuugggaaguauugcuaccuuaauacugucuucucauucaugagcaugggauaucuuuccauuuauuaagguguucuuuaauuucuuucauguuuuguaguuuucaguauacaggucuuguacuuauuacuuuaaaaauuuauuucuaagaauuuuauguuuugaugguauugcaaauugaauuuuuuaaaauuucauuucagguuuuuaauuccuugugcauagauuuuuguguacuaaaacuuguguuucauauaauuuuuuuuuccucuuaacuguguuauaggaaucuuucaaaugguuggcuacauacacauccaucugauucacuuaguaaacauuucuugaacaccuacuguguagugggccuuuuuuucuagguccugguagagacagcaguguauaaaacccacucaguccuuugcuuucauggcacuuaaauccuaaaaagagaucauaaagauagguaaaauauauguuacauagugcuaaggagaagaaacaaauaagggaaguguuugcaggugaaaaggaugaugggaaauuuuagauaggguagguagagaaaacuucacugaaaugguaacuugggugaagaacugagggagaugagagagcuagccauguggauauuugggggaagagcauuucaggcagaguguagugaauagggaaaccccaaagugagagugccugauguguuugaagaacucgagguguggccaguguagcuuuagaaaaguaauugaugggaaauagagagaauggaggguacagauauuuugaucauaauaagguguuugauuuuuaccuauaagugagaugggaagcuauuggaagucuuugagcagaguagugaaaaaguaugacuuauguuuagcaaggucacucugguugcuguguuaaucauagacugaaaaaggggacaagggcagaaacagaccaauugguagaccauuaguacagauuaagacgugacugaaauggacagaguggucacagugaggguggugagaagugguugaauucuugauauauguugaaauagaguccauaggauuugguaguagaccagaugaaagugggaaauaaagggaggaguaaaacaugaugccaaaguuuuuugaccagagcagcugagagaauggaguuggauaauucuuauaaauuauugcauuaaaucugugcaucauaucacaugcccacuuaacuacagguaauuuuaccauauaagcuuguggggggaaaagaggaaaaacagaaaaaaggauggaaaagcauguuuuaaaauauaauaaauuaggccuuaaugaaaaauuguccuugagaaaccugagauggaauacucuaaaucugauguguucucucaaucuuuagaacugaacuaggaauuaacucugagaguucaugauguuaugagacccuuugccuguuuuggaaauucgguuguuuucaauauuugcuuuugcaaugaugguaccuguuauuuuuucuguaagguagauuccuacaaauaagaugucaggccauuagaucaugucaaucuaaauauuugauagguuuugccaauuaccuuuuaaaaaauaauuuuagcaaguuucauuccuuaaaauauauuagggacugcucauuuaccuuguuuugauucauguauauauaaaaucuguuuaagucuuuauaaauaaccugggaaauugccugguuuuuugguccauuucuauugugguguuuguuuuuuaaauuuguaagcauucuuuauauaucauuuaauucuuuauuauaauuugcaaauauuaucucuaccuaccuuuaauuuuauaguaucuagucaugugaaauuuuaaaguuuuuauguaggcaaaucuguccaucuuuuaugguuucuggguuucagcaugcuaacaaaguugauauaaauaugaucucauauauauauuacaaaaacuuuuuagagauaggaucucacucugucacccgggcuggagcaaccauagcucccugcaaccucaaacuccugggcucaagugauccuccugccucagcuucccaaguagcuaagauuauagacaugugccacuauagcuaguugguuuuuuuuugguugguugguuuuuuuuuuuuuuuuugguagagaacguaucucaguguguugcccagacuggucucaaacuucuggccucaagcuauccucccaccucagccucccaaagugcugggauuacaggcaugagcuacuauaccuggccaaucucuuguauuuucuucugauacuuuugugauuuuacuuuauagacuuuaauuuagaaaguuagauaugagcauucagcauauuuuuggauaugguaugauaugguuuagaucuggauugcauuugucaugguuugggaauuauaucuaccuuuuauuuucuuccacuuggguagcugauugucuuguaaggcauccuuuccccacugauaaugccaccuuuuucuauauuaaguucucacaaacuuugaaaaaaaucaaguuuauugauguauaauugauacacaaugaaaugcacccauuuuaacuauauaguuuuauugauuuugauaaauauauacacuaucacugcuacuacaaucaagcuuuagaacaauugaauuaccuccaaaaaguuccuuccugucuguagucauuucucccucuuggccccaggcaaccacugaucuguuuauuaguuuuccuacucuagaauugcauauccauggaaucaaguaacauguacucuuccaugccugguuucuuucacuuggcauguuuuugagauucauccaauuuguguuugucacagauuuuuguuuguuucguuuuuuuaaauacaauaugacuauaccacaguucauucauuuucuggugaacauuuaaauuguuuucaguuuuaggcuguugcgaauaaagguacuguuuugugugcauguuuuugugugaacauauguuuucauuuuucuaggguaaauaccuuaaauuggaauuacugggucacaugguaaguuuauguuuaaauguauaaggaacugccaaacuauuuuccagaugauuauacuacuuuacauucccaucaucaguguaugagaguuccaguucuccaaaugucagcauuugauguucucagucuuuaauugcacacguucugagagguguguagugguaucccauugcaguguuuuuuuuuaagugguacuaaaauacacaacaucaaauauaccauuuuaacuauuuuuaaguguacaguucagugacauaaaguacauucacauuauucugcagccaucaccacuauccaucucugaaacuuuuucaucuucucagucugaaacccuauccauuaaacaguaacucuucauugccuacucucccuaucugcugguaaucacuguucuacuucauaugugaauuugacucuuccagguacuucauauaaguggaaucauacgauuuuuguccuuuugugucuggcacauuucauuuaauaauaauaauguccuugcguuaggccauucuugcguugccuuaaaugaauaucugagacuggguaauuuaaaaagaaaagaaguuuauuuggccccuggugcugcaggcuguacaagcauggcgccaccaucugcucagcuucuggggagcccucauggugaguuuacucaugguggaaggcaaagggggagcaggcgugucauauggcgagagcaggagcaagagagaggguggggaaguggcacacccuuuuuaaacgaccacaucugcgaacucacucuguaucccaaggagagcaccaagcuaugagggauugcucccaugacccaguuaccucccaccaggccccacccccaacauuggggauuauauuuuaacaugagauuugggcaggacaaauauucaaaccguaucagucaucaaaguucauucauguuguagcauguauccaaauuugauucuuuaagguugaguaauauuucauugugugcauauaucacuuuuuguuuuauuuauuuauuugucaguggacauuuggacucuuuguaacuuuuaacuaugugaaugaugcugcuaugaacauugguauauaaguaucuguuugagucccuucuuuuaauucuuuugguuauguacuuaggaguggaauugcugggucaugugguaauuguauguuuaauuuuuuuagagacugccauacuguuuuccacagugacugcaccauuuuacauucccaccagcagugaauaaggguuccaauuucucugcaucuuuucuaacacuugguaauuucuguuuuuuauuuaaaauaauugccauucuaauggguguaaaaagucauuauggucuuaauuuacauuuucuucaugacugcuguugagaaguuuucuuuugugugucuguucaaauauuuucacauucuuuucagaacauauguucuuugucagauagauaaauguauuucuucuguauccuuacugauuuucuguccacuuacuaauuaccgagagaggaauguugaaaucuucaacuauaauuuugaguuuaucuuccuucugcucuguucauuuuuucuucauaugcuuugaagcaaagucuuuaaaguuguguccuuagguguguucacauuuaggacuguuagaucuccuugauuaauugaugucuuuaucauuaugaaaugucucuguuuaucgcugguaauguuccuuaucuaaagucuacuuugauauuaguguauccauuccuuucuuaugauuaauuuuugcacauuauaucauuuugcuguguuuuuauuuucagcuuauuggucauuuaaugucuuucuuuuagauagcauauaguugcaucuugcuuucagauugacuuuuuacgaucguugcuuuuugauuaaguccauuuacauuuauugcaguuggcaauauaauuguguuuaagacacuauuuguuuucuauuugucuaaucuuuucuuccuuuucugccuucuuuucgguuaauggagcauuuuuggaauuuuguauugucuccauuauuagcuugucccucuguuuuuuuuccccccagugauacuucuaggauuuacaauaugcaccuuuaacuuaccucaaucuaccuucaaaaauauuauuccucuuaauguauaauguaagaauuuuggaauaguauacauccauuuacucucccucauucuuuuugguauuaugaucuuaacauuuuacuucuauauguguuauagauuccacagcagcguuugaaacuauuucuuucaaaggccaguugucuuacgaagaaacuuaaaaacuaagaauaacauuccuuuauauuuaccuucauauuuaccauuuuuauuuauuuuucuuuguggagauuccuuuuuguagauccaaguuuguugcugguguuauuuuccuuuuacuugaaaaaauuucuuaaacauuucuaaaguauaggucuacuggcuacaaaaucuuucagcuuuuguuuguauggaaaugucuuuauuucacucuucauuuuaucguacaauuuuucaaaccacacagacuuuaaaauaauuguagaauauaauuucacaacauuuuguucuauuuguuauugucuucuaucuuguccaucuauccauccugucuucuucuagugucuuuuuuuaugcuuuucaaaguaaguugcaguuguuaguauaccacacccuuaacuugagcauguauguuaacuaaaacuuaguaguuuaguauuuuuaacuagaauuuacuaugcuguuccaguuauuuauugcuguguaauacauugccccaaacuuagugccuuaaauaucagcaacuauuuauuuugcucaugaaucucucauuuggucagggauuggcaaggagagcuugucuuugacaauacauuguaacaacuguuuacauagcauuacauuguauuugguauuauaaguaaucuagagaugguuuaacauauuugaagaugcauguagguuauaugcaaauaccaugccauuuuauauaagggauucgaagcauccuuggauuuugggauccaugggaguccuggaaccaguccucuguagauaguugagguaugacuguagucuuuggauugaaagacucacuaauuucacucagauucaaggagaagggccauagacuccaccaccugaugaaaaaaugacaguguuacauuguuaagagcauguggaauggcuucuauugugaccaucuuuggaaaauacaguugaccacauauaccauuucaugagcugugacaaauguauacaccuuugccagaaaguucuaucaggguauagaaccuacaccucuuccuaguuauuccuuccccccacaccaccccuagaaccuaacauuguucagauuguuuucaucuuaguuuagcuugcgcagaacuuuauguaaguagagucauacaauacuuauauguuguaaaaaguuucuuuuugcucaacauaauguuuuugagauucauccauauuguugaauguuucggugguuugugacuucaucuguuaagggacaccugggcuguuuucaguuccaggcuguuuucaguucccagcuauuauaaaaagguacaaugaacauuuguguaaaaaaagaagucucuguguggacauauauguuucuuuuuucuugguuaguugauguguuuuucuuucagcauuuguuuuugaugagaagucugguuauacagucaugugccgcaugcugacauuucagucaacgagaucauaguugacaauagucauuuaagauuauaccaccauauuuucacuguaccuuuucuagguuuagauguauaaauacuuacacuuuguuacaguugcuuacaguauucauucaguauaguaacaugcuguacagcuuuauaaccuaggagcacccgggcuauaccauguauccuaguucuguaguaagcuauaccaucuaaucuagauuuguguaaguacguucuaugauauuugcacaaugauuaccaugcugagaguuguugggguuuuguuuuuuuuuucuuuuugaaucuguacauuuaugguuuuccuuaaauuuggaagauuguugccauuguuucuucuauauauauauuuuuuaccaccuuuacuccucuuucaucauuuccucuuuuucugggacuccaguuacacauauguuagacuguuugguauuauccacaggucauuaacaucauauucauuauuuuucagucuuuuuauuucccugugcuucaguuugcuuugucuucuauuuuacuguuuuuucuccucccuuguuaaauaauuucagauauuucgcuuuauauuucaagaaauuccauuugauucauuuuauucauguauuuuuuugaauucuugagcauauuuguaauagcuguuugaaaaucagguuacuuauugauuucuugaauuuuuucacucugaauuuguugguugguuuuuucucuuggucauggguuguauuuuccuaguauuuauuuuauuuuauuuuuuguuuuuuacauauuuaaugauuuuuuaagauuggaugcuggacauuguaauauuuuguuguugggugucuagauuuuguuuucuuuuagaguguuuuguuuuguagccaccuaaauaacuugcuggucaguuuuaucccuucagggcuacauuggaguuugucuagagaaggcuuugcuuuaaugguaguagcuccuaccuaaggcaugauccuucugagucuuuacuaaaugcucccagugucaccguguucucuucacucagguuagagagaauuuuaggagucucccaguccuuuauaaguacugggaauauuucagcuuacugccccucuuucacuagcuucauggagucacuuaccuuaaucguguacaguuaguacucagcaguggacucucaaauggcagauuucugaagccauuucucugccuucucagacaagcacuugucuggcacuugucaucaauuuuacccacuucagcuuucucagcucugaucucuugauucugaacucaguaaaacugcugucuucucacuggauuuccccuccauugacugcagguuggaaauuaccuccaggcagacauccaagcaguggauggcucaccuccuuuguuuuuguccuuucaugcauuauaguccucugcugccuguuauccaaggucugaaaauucucguuugagaaggagcaacugucagauacuuucggaucuuucucugaaauuagcuuucuguugugcuuguugugcuuaccucuuugucuaaugcuaauaccauaugagguuuuuuuuuuuuuuuuuagaauguuuuaagcuauacacuucuaaguguauagcuuguugcacuuucacacacugagcacccguuuagcuagcauucagaucaaaaaacagcagcagcuccugcguagccccuugugcucugugucacuaccccuuuucuuccauguguaaccacuguccugacuucucauagcauagauuagauuugccuguuuucauccuuuaacuagaaucaagcacauuuaguugugucugacuucuuuuaauguauuugugagauuuauucacauuguugguuguaguaauuguuuaugauagucgcuguauauuccauuuuaagaauggaagugauauuccauuuuaagaauaugccauaguuuaaucugcuguuacggacauuuaaucauuuuugguuuggaacuguuaagaauauugcugcugcucuaaacauuucagugauugucuucuugugaauauguuuacuucuguuugguauacuuaagagugaaauuuuuaagucauaagguaugcauauauuuaguguauacucaguuuuuuaaaggcaugccgauuuuaauuauuccauuuaaguuaauauguuuuaauaucugguagagaaaggaacauuauuagaaacaauuguuuugguuauucuuacauauuuagucuuugaaaaaacguuucuuaaauuggcauuuacuuauauuuguguuaauuugggaagaaaugguaucuuuguucaucuaugagucacauuuggaacuagcucaaaggccauggguccugauuccuuuuuuuuuuuuuuuuuuuucuuguagaggggagguauggugucaagaaaacauagucaccauuauuacgaaaaguaaaauauggaagagaugaucccuaccaucaaucagcuuacaacuagaggcacugacaaauguauacagauagcuguaauguaagguauaacauaauaaauauaaggagaaauuaauaaauuauuuuaugguauuaagaauguauaauaagacaugaaggagauggugauuauguauaagaguuuagauaacccugugagauacaguguuuagaaugaggccaguuuuuaacauggcaugauaggugggugggggauagagguuaguaauggauagaggaccauuuccgagugaagucuccucagaagcaaaagcauugaagucagaaacacaaauauccaguacauuauagccaauagucaaaugaugggacuagaucugguaacuggugaugaugucauauagugggcaguagugcugggauggcuggggucagggccacauggcaggggccucaaauaaaaugugaaggaguuagaaauuuauucuguuggcaugagaaaguguuaaagcuuuugaauauagaaugauauguguaacuuugaguuuuuaggaagauaauucuaguggcaaaguugaggauaaaggcaaaagggaaaccagaugaaauaauggggcacuguaguaggacaguguugguaaguuugaggaaaaaaggaguaagagauauuuuuaaggaaauucauaggguuugaguauaaauuagaaggcaaguacaagggaauaagcguggucuuuagaaucagacaaauuaggguuugaaucuuaaccuugcauuuacuaaaggacugaaagcuaguucccuaagagaaaaauuuucucuuuuguaagaugcuuauucuauaaacauuugcaagcacuggaaguauaaaagcaaaugauacacauguucucuugaagucuggucuagucuguaagaagaggcugcacuggcagguuuugaccaaauuguguagaaucucaucugacgugauugggagcuuuggcuuuauucuggaagcaacuaaaagcaaucaaaaaagacuggggaauaaugugagaauguagaaauguaggggaauuucuaaggaugaauugguagcaauugguaaacaauuugauauacugggaaagagagagacucuuuagaauaugacugagaaucuuccaauuugagcagcuggacugauagugcuaccaucauuaccucacaggguuuuucuuagugugucuuguaaaucuugcuugucccucauaaagaaugguuuuccuuuucuucagacuaaggacuuuuuauuacaguacacaacuuaacacccccuguaucucuccaucacaacacuuaacugugcauuguuauugcauaauuaauugugguuuuuauuugugcccauuuccuucaccacaugagggcaagaaauuaugucuaguuuuucuaccucugcaucuucauccaccuaguaggcacucaaaaucuaguagacaguuuuugaauuaaugauuaugaagaauuugaaggcugaacaaguaucaaccuacacagugguuagggcaaauaaaaaugagggggagaaaguaaugaauggcaccaauuuuuuuaguccuuaaccaggacagugagauuaggcagagugaguucuuugggaaaauaauugaguuugauauuagauacguugaauguagauguuaaugagacauccaaauggauguguaccguugguaauauguaguugcaggcauaccaugccagacauaaggacuuaaagauacagaguuagggguuuguaagcauagaggugcuaugggaauggaugacauugcgcagaaaauugguuuagguuaagaaaaguggcuauugacagaaacuuggagagaggccauguaugagguaggaagaugaacuagcagaagaccuuauugccuuuagagagauggaagaaaaugaguggauacaacauuagggaagccagaggaggugaggagucauuagcagucuuaaaagcuacaaaaauuaaguaggauuaaggggccaaagcacugggaauauacagaaaugauggaaacuuuacaagaaaaauuucaguagauagaaaaauagcagcugagcuagugguuuucacgucuuuuuggcaguaaaaggaaagaagauaaagaaaugguacucugaggagcuaauggaguugagggaauuauguugcaaguauuauuugaaagcaguauuuaaaacuuuuuaagucuuaacugcagaauggacuggaauaaggagaaacuaaagcaggaggacuuaggaaaauuguuguaguaguccuuuaauugugaaauguguaaacggacaaaacuuagacaguuuuaauaaguagcauuauccauaaauauaagacaccauaaacaugaugcaaaggagaacagaaguguuggguguuauaauaaaaagugauagaaaaaaacaguuugugaaauuaaguuuugaaacagcuuuagaaggaggugaaggaaaaauagaaaugaauaaaaugaaaauuuuagggagguagauauagaucaacauaggcauuuauuauuagacuauacuuauuuauaagauuauuagacugagcccucuguugaagagauaaaguaagagaacuaugucugguauuaggauucuuaugguuaaauuggcaagugagugugccuaauauuuguagugcuuacaguuuuuguuauucuguauuuuuauagauuugguauauuuccuccaugauuauguguuccuaacucauaauuuggaaggcagggcuucuuaaaaugagaucugugugucaugugaaguauauguuaaaaugcaaauucauuucugcguucuuggguuggucugaaaaaaauuaaaaaaaaaauucauuuaccccuacuucaugcacugaaugaaaaucuuugcgaguagagcccaaguaguugcauuuuuagauuuccccagguaauucuauuauagacugaaguuugaaagucagucucuaaaaccuuaaaaguugguuaauuuuauuucaaaauguuuuauaugcaguguauucacuuucuaccaucaaccucuaggacacuggauagguuucuuaaccuuugagauuugcuuucuuuauauguaaugcaguacaugaaaggacuuuauuuuuguuccauugaggaauguucugauuguauacaaacaaguuaagaauuuacagugauaauuuaggggcuugcuuuaagcuucaggauuuuuuuuuaagaguuaaguuuugauauauauuaagugguugauuuaauaaauuauaauuaucgucguauauugaaguccuguuuugugccagguaggcauuauacuauaacuuuuuaacgcauuuucucugcuacaauaaccugacauuggagacucaagggucagagggucggcccaaggcugcuacucuagaaagugguagaugcccagauuuguaccuaacauagccgaugcuuagcauauagaauuuaauuaaaaacaaaauugcuauagguauuugaaaggauuagagggauauagucaaauaguuuucauauguguuuagcccuuuuggagggaggauagaguaaauaaauagaaggcacuaagcuuuauggaugaauaugggaaauauggcuuugccugcugaaagcacucaggccacagggccugccuaccuaugcuuuccucaucccggcaacagcaguaauuuguuucuugauacguuuuuggauguucauaauuauagaaaauaaauuugccuuuaugaugaaauuuaguaccuuuuuuuuugaaaguucauccaguuguuuauguaaaaagaauugagugagguguuuuauauuuuagguuaaaaaucuguaagagccugauuuuagaauucaccagcuccucagaaguuuggcgaaauaugguauguuuuuguuuuauuuuuuggaauucguauugcauguguaucuuaaugucauaauaaugacagauguguucagcaaauuugggccccugccauuuuuaaagcauugugucaggugcucacuaacuacacuuccaagacuguaugagggacccagguagggugcugaaaaaauuuacaagagauuagugugcuaugagagguaaaauaauaugcauaaaaagauugagagggcagguuuggauuuugggcuaugaguauuaauaauagcuuucauuuguuguuguuguugcugcugcugcugcugcuguuguuuuugagacagagucuugcucuguugcccaggcuggagugcaguggcaccuucuugacucacugcaacguccaucucccagguucaagugauucucaugccuuggccucccagguagcugggauuacaggcgugugccaccacaccuggcuaaguuuuguauuuuuaguagagacgggguuucaccguguuggccaggcuagucucgaacuccuggccucaagugauccacccgccuuggccucccaaagugcugggauuacaggcguuagccaccacgcccagccauuugugagcacauuaugucaggcacuguucugagauacuuagauguuagcuuguuuauccaugacagcucuauggaauagguacuauuauccuaguucuaccuauaaggaaacugagacucggagagguuaaguaacuugcccaagauuucucagcuagugaaugaccaaacagagacauaaguccagccuggccuuggagccuuuugagcaccggaucucauaaaagaggggacuggaagagaggacuugacucuaguuuucaaaauacauauagcucuuuaauuacauugaggucaauuagucaauuaaaagauauuuuaacuuuauuauuuuuguguuuacaagauggaaaguuagacuuguuugaaucuucuaauuccacauaccauuagucucuugagaacccaaggggaagcuguaucaugaccacauuguuuauuuuagggaaggugguguuucccauaugaccucagcaaugucuaaguucuuauuaggcaauguauaguuaggauaggaguaucugggagauugcguuauuucuuacagauacuauaaaucccauuuauuggaauccccugcaauuauuuuuauauauucaggccaauccucaccuaaucuggauuuugaagcccugcguucauagcugcauagguaugggcucaaacauucauguuuuaaccguugguauucgcagauaccuugcuguuuuauauuggguucugaauccacacugguaaccaccuuuuacgcuugacuauuguugcuuugaggauguuaauuaugaaagguuucuuccuccuaauuuccucaucuuuccguaguugaugccucagauuuggccuggauaggggaaucgugaggggaaagaacuaguugcacaaaaugaucuuuugauacugggauauuucagauguaugguaucuuugccagaacuacagugucaguaaagaggccugcuaaauuugaacugugacaaucagaaaaguucagcuaaggccauguaagggguuaaaaagauauuugguugagggaggaggauaugcuuucaucuuuugccauacuuuuucaugaaauuaaaucuuaguagauuuauggccaagaaagaguagaauauauuuuuaugcaguacuuaagggguuuugacugauguuuuuuauuauuauuauacuuuaaguuuuaggguacaugugcacaaugugcagguuaguuacauauguauacaugugccaugcuggugugcugcacccauuaacucgucauuuagcauuagguauauuuccuaaugcuaucccuccccuuccccccaccccacaacaguccccagagugugauguuccccuuccuguguccauguguucucauuguucaguucccaccugugagugagaacaugcggugacugauguuaaaugacuuuacguacauacagaauuagugggacuagacuuuguguuuauguguguguguuuauguguauguauauaacuauuccauuaagcaguugcccuccuuggugacugauugcucuaucagcuuaggaaucuuuugacugaauuuguccguauuugaaagaucucaaucuguguucugaaucuuuacucauuuacauauacuuaaaucuugaaacccaguauagcaaaacuaagccaaaacaaacaaaaaaauccaucccuugauaggaagucaguauaucuggguuuuagucaguccuucaacacuaguuccaaaaucuugggcaagucaguuaaucacucggaggcugcuuaauuuuuuuuuuuuuuaauucuuaguauauuaucugucuugauuagguaaagccaaaguuguuauaagacucaagguacuauugaccaaaaugcuucagaaacuauaacauuacauaaaaguacaaggaauuauuacauuuucucaaaugaagagaucauuuaagaaaaacaaaaugcuggaaaauaguccuuaaaaacuuuucuauaauaauuacucuucugaugaauuuuacauugacaccuaauuugaagcuuugaauauuauuuuuugaacaaugaauuggguuuauauauuaaaguguucuaaccaaagguuuguuuaauuuauuagaguuauuaagccuacgcucagaucaagguagcagcuagacuggugugacaaccuguuuuuaaucagugacucaaagcugugaucacccugaugucaccgaauggccacagcuuguaaaagguaauuuugaauuauuuuacagccuuuaaaaggcugucauuguaaagugaaauacauacuguaaaaaugaagacaauguauaguuggcaggaauacugcuaagaauagugggccugagaguugaccuacuucauuuaaucuccuuaaaauauuuuagugucuuuuuuucucauuaaaaauaucaguagccacuaucaaagaccuaucuguauguauaaacaggaaaguauuucucaaaaaaacuucaagguuuuaaacauuuuacuauaaacauuauagaaaacauuaaaaauuucuuaauaugcauuuuaaaguaugccuuuuauguggugaacguuuuaacuaaacauuucucuagaaguuuuuauaacauuaauaaaacuaguauacuuuucucuccuagagaguuacaguggagguaaaaggaguggcuugcaggauggagaagcugcaccaguguuauuggaagugagccaccauuugaauuugcuagcucaugcugcaguauucagauuaguggguguuuugugaucauauuuucugcgauucaaaucaagaccuaaaauugauucucauucugagauuuacauuuuauuauccaauguuauuugguuauuguuucaguuuuaaaauuucugacuuguuauucugacacacuuuaggauaaccuaagucaauaguuuaauacaaaaauuucccuuugguuauauguuuugaauuagguuauauguucugcauuuacaagcacauacaggauucuuacuuccagcaacuuggcaguaaaagaauaaguagacucuuuaggagccaaagucaagcuugggaacuguugcuaggugguauauauuucauaguuuauguuuguuuccaagacaaggucucacuccaucgcccaggcuggagugcaguggcacgaucacaguucacugcaacuuugaccuucugggcucaagugacccucccaccucagccucccaaguugcugggacuaaaggcacccaccaccacacccggcuaagagacgagguuucaucauguugcccagguugaccuugaacuccugagcucaagugguccuuaugucuugaccucccaaagugcugagauuacagacaugaacuaccacaccuggcauaugucauaguuuugagaguuugaauucuaaccucgggacuuugguaacuuauuuauaauauucuagaaauauacuguuauuaggaugaguagaaauucauucagacagaaacuauuauaaauuacugcaagaaaaaugucugcuaguucugcauauauucauuuuucucuugauuaaaaaacaauuuccaauuugaguagaacaacuuugcuauguuuaauagacccaggacagauuuauuuuaagguaauaaucuuucaauccuucuucuucuauacuggauugguuuaaauuacuuagcuugucuuaucaaugguuuuuaauagccuacuuuaauauauguaaaaaguaguaauuaauauguuacaguuugguggcaaacauuuugaugccaaaguucacauauucucuugcuuagggaacagaaauugggaagauagauguaguuaucauuugauaauguauuuaaacucuaucccauuucaggaucucaaaacuuuguaacaguuacauauuguacuucuaagacuuagauuuguuuuucuucuugugucuuaccuuuuugcaguaauauuuuuauuuuccuaucaucauguccucauuuuuucccucucuucucuuucccuguuaauuuugaaaguuuugcugccuacguguuugaaaacuucuaaucugccucucuucccucagugccagcagguuuauuuuuuguuuugcaagccagcucugccuccuuacaguaugacaucugaugcuggagggucgcacuuucaaaaaugagucagcugguacaugggguuaucaucaauuuuuagcucuucugucugggagauacaaguuuggaagcaaucuugggguacuuacccacaaggcugguggagaccaggugugucacauaggugauuugcuugcucccugggggagaggguggagugaaauuuuugcauuugugucacagccaagucacugccaccuccagcaugccccaguuuuuaguuguuauguaauuuugugcaaaauugaaaauuuaaauacauugcaaagaagaucuaaaauaaauauuugagcugcuggagucuuuuuuuuuuuuuuuuuuccuuuuccauucuuguccuuggaaucugaaugaauugcagugaggguaauuuugagagucugauaaagaagugagggguuguuuuuuguuuuuguuuuuguuuuuagcuaagaaauuuagaaaacagguuugugugugugcgugugugugugugugugugugugugugacugauuuuaagauucuuguuagaguugcuuaaaguuggaagccuaaagucagugagaaguucacaaaucaggacuuuguaaugccaauuugaaaauuuagcuuuugaccucaaaaaacauuuuuuaucuaguuugggaauuucuaaguguuagaaaucaauauuauauugacucauucauuguugcugaugcuguuuauaaaagugaauagauagggaaauacugauucauaucucgugaaaugaaaaugaaaggcuuuuuagugacuuagaauuuuaaauauuucuacaugagagagcaguaguauauuuagaaauaacaaaguaacuggcaacuguuuaaaacugaaguuaauucacagcuauccagugcaaaacuucaccucaggugauacacuuuugacagguaauacauacaguaaguguauuuuuagggaaacaguuucauuguugaaccaagauaaucaucauuagaauguuguaucugauuuaagugucuuuaaacuuaccaagguauuagauuuuaguuugaauugucuggaguagcgguagcgguuggcacauuuguucuuaaagggccagaaaauaaauauuuuaggcuuuaugggccaugugguuucugccacaaguccucagcucuguucuuuuagugugaaagcagccauagaugauaccuaaaugaaugaguauggcugcaucccaauaaaacuucauuuacaaaacuacauggcuggccuaagcuuuagucugucugccuagggaguaguuuacugagccacuaaucuaaaguuuaauacugugagugaauaccagugaguaccuuuguuaauguggauaaccaauacuuggcuauaggaaguuuuuuaguuguguguuuuauuacacguauuugacuuugugaauaauuauggcuuauaauggcuugucuguugguaucuauguauagcguuuacaguuuccuuuaaaaaacaugcauugaguuuuuuaauaguccaacccuuaaaauaaauguguuguauggccaccugaucugaccacuuucuuucauguugacaucuuuaauuuuaaaacuguuuuauuuagugcuuaaaucuuguuuacaaaauugucuuccuaaguaauaugucuaccuuuuuuuuuggaauauggaauauuuugcuaacuguuucucaauugcauuuuacagaucaggagaaccucagucugacgacauugaagcuagccgaauguaaguguaacuugguugagacugugguucuuauuuugaguugcccuagacugcuuuaaauuacgucacauuauuuggaaauaauuucugguuaaaagaaaggaaucauuuagcaguaaaugggagauaggaacauaccuacuuuuuuuccuaucagauaacucuaaaccucgguaacaguuuacuagguuucuacuacuagauagauaaaugcacacgccuaaauucuuagucuuuuugcuucccugguagcaguuguagggaaauagggagguugaggaaagaguugaguuuaacagucucaacgccuaccauauuuaaggcaucaaguacuauguuauagauacagagaugcguaauaauuaguuuucacccuacagaaauuuauauuauacucaagagugaaagaugcagaagcaaauaauuucagucacugagguagaaugguauccaaaauacaauaguaacaugaaggaguacuggaguacccagguaugcaauaggaaucuaguguagauggcagggaaguaagaguggccaggaaaugcuaaguucagucuugaaaugugacugggaaucaggcagcuagaagcaugagcggcuuauuccaggcagaaguaugagccaaaguuagaagcagcauagggaguaggggacaauaggcaguugaggacuuuuagaucauaaacuagcugagagguaggaaaaugaagaagauaagaugugauagaagguauuagggagucagcaaagaauuugcucaguagguagauaguaaguuugucaaacguguauuuuuaauaaccuugcaagagagaaaggauugaagagaaacguguggugguaagguaguucagucagugagagccuugacaaugacagugguauaauaggaauucaaaauaaauuuuucuggauuuaagacaaauauuuaggacaugaaguaaguaagacuuuagugauuuauugugaagacuaaagauguuucagauaauagagguaguaauuaucaaagcaaaguuuuucgagguauuaaggguuggaaugaaaaauacagguguaucucucauacagguaauauaaaaaaagaaaaaugcagauauagugauugaccuugaauaagaggaaagaugcccaucuaaugaaauuagaacaaggaaguaaagauggaugugugauauuaauuguaauugugggugaggguggaaaaaucaagauuuuuuuacugaaaauauuggaaccuuauuuaaaugccgguauauauugugaaucugcaagaaacgacuauaaaauguauuucucaaauuuaugugacccaaccaugugacuugucuuuuaagcuuuaaaaaauuguaguaaaauacacauaauguaaaauuuuccauuucaccauuuuuaaguauuuggcucaaugguauuaaguauauuaauauuguugcacagucacgaucagaacucucuguuuugcagaacugaaacucuguacccauuaaacaauaauuccucauuuccuuaucuucacagccucugacaaccauuauucuacuuugugucuaauuuugacugcucuaaguacccccuauaagugcaaucauacaguuuuugcccuuuuaugauuggcuuauuuuacuucgcagugucaucaaguuucauccaucuuuagcauguuucaaaauuugcauccuuuuucaggcugaauaauguuuuauuguauguauauaccacauuuugcuuauccauuuaccuguugaugagcgcucagguugcuuccauguuguagcuauuacagauaauguugcuaugaacaggaguguacaaauaucuuuuugagacccugcuuugaauuguuuucccagaaguggaauuguuggaucauaugguaauuuuauuuuuaaaauuuugagaaacugccauacucuuccagagcaacuguaccuauuugcguuucuaccacuagugcacaagggguccaguuucucuacauccuugccaucacauauugugugagaguguguguguguguguacuucaauaguagucauuguaguggauauaagguaguauguuacuguagguuagugaccacgaaacuuuuuaugaaacauuuuuuaauaauauuuuguggaauacaagguuuguuuagagguuuugagaagacugaaaacuuaggaagcuacugaggggaaugggugaagaaguggaucagaaguugagagucuugacuggcuggcuaccugaaaucagaaaccguaucagaguaggagaaucucauuccacugagugacuaguuaagauuaaagacuuuaucacauuugaaauuuaaagacuuuucuccaauagccagaagauuaugcaugguauuuuaggguuggauauuagcagagcugauggaacagaaucauuaguggcaugugcauaagauguuaacauuggaguauuugaauuuauaugcuguggaugauggccaugauuggaaagguugggaugccagaccaaaguguugaguuguuuuaagaaaagccugaggucuagauaacagcaagauggcagacuagcacuuugcagcacucaucucauuguagaaccaucaauuugaacaacugucuacacacaaaaauauaagagcuaagaaaccagacgagagauuaccugaauguggcacacagauaagaaaagacacauugaaaaggguaagaaggacaguuuuacauuacuugugucacaccucccucagucccugagaucccagcauggagagagagacuguucaccugggggaaggaggggaaguguacaccagacuuagacccuaacauugagcucgccccaguaaaacucaaugcuaggcaggcccccauggccccaaacuucaggccaauacccacaaaccaagcuuggaggcccaccccagcaccaagcuggaucccacagcccuaggcucuaagccugucuagugcuaggguggucccugcagcccugcccucuagaucggccccuguggccucacaucacugcagaacaaggguccaaacccaguacuuggccagccccuugugauccaaauucuaggccaacauccaccuacccagccuucacacugguccuugcagauccaagguucaggcucacucuaguagaccaggaugccaggccagcagcaccuguguaccaaggcuccaggaccuacccugcugacccagacuccaggccagccccgguagacucaggcugcauaaucucuggacaggcugacuggugaagggcuuuacccaauaaagucacucugcaaagacuggaacaagucucagcuucuucaaaugugcaggugccaacacaugacuacagggaucaagaacagucagggaaacgugacaccagucaaaggaacacaauaaggcaccugaaccaaccauaaagaaauggagauauaugaacugccugacaaagaauucaaaguaauuguuuaaggaagcucaaugaauuucaagaaaaugcagauaaacaauucaacaaaaucaggaaaacagcaaucaaaaugagaaauuuugagauugaaauuauuuuuuaacaaauucugaagcugaaaaugcaauaaauggaaugaaaaaugcaaaagagcauuaaaagcagaauugagcaagcagacaaaagaaucugaacucaaaagacagguuauuuggcuagacuaaggaaaaaagagaugacucaagauaaaaaaaauaaagaguuguguuuuuugaugauaaaagcaacaagucuuuagcuagacuaagaaaaaaagagaugacucaaguuaaaucagaaaugaaagaggaaccauugcagcugauaccagagaaguacaagaaauaagaggaucauaagagacugaacaauuauaugccaacaaauugauuaccauagaagaaauggauaaauuccuagacacaugcaacuuguccaagcuuaaucaugaaaugaaaaaugugaacaguccagugacaaggauuguaucagucauaaaaauaucucccaccaaaggaagcccaagacuuggugacuuuacugcugaauucuagcagacauuuaaagaagaacuaguacagauuguucucauaauuuuaugagaaauuuaagaagagggaguaauuucaaacucauuuugggagaugagcauuaccuagauaccaaagccagacaagaacucuccaggaaaagaaaauuacagacccguauucuuaauuuagaugcagaaauucugaagaaaauaauaacuaaauucaacaguguauuagaaggaucauuuacugugaucauaugggauuuaccucaaggguacaaggauuauccaacagaccugaauccauaaaaugugauauacaacauuaggagaacaaaggccaaaaccauguuaucauuucaauagauaauugagauaauugagaaaaagcauuugacagaauucaguauucucuugugcuacaaaauuuuaaaaaauuaaguauagaaggaauguaccucuauaaaauaaaggccauauugacaaacacacugcuaacguuauacugaauguugaaaaguuaaaagcuuuucuuuugagaucaggaagaaaacgagaaugcccacuuuugccauuucuauucagcacaguaccggaaguccuugcaagagcaauuaggcaagagaaagaaaaggcaucccaguaggaaaggaagacauuguugucccuguuugaagaugacaugaucuuguauauagaaaaaccuaaagacuccaccagagaauuguuagaacugauaaauucaguaaaguuguaagauauaaaaucaagauacaaaaauccguagaauuucuguacauuaaugacaaauuaucuaaaagaaaaaucaagaagacaauuccauguauaauagguaccaaaaacaaaacaugcaguggcucccaguaucagugguucugcauuugcaaauugaaccaacauuuggaugaaaauauuugagaaaaaaauacaacaauaaaaauacuguuuucuuauacaauaaggaaacuacaguauagcaacuauuuacauagcauuuacguuguauuagguacuaaguaaugauuuaaaguauacacgaggauguguguagguuguaugcaaauacuauaccauuuuauauaauggacuugagcauccauggauuuugguaucuacaggagauccuggaaccaauauccugcagauaccgagggaugauuguacuuagaaauaacuuuaaccaaagaguugaaaacuauguaacauugauuaaagaaauugaagaugauacaaauaauggaaaguuaucuuguguuuauggauuggaagaauuaauauuguaaaauguuuuuauuauccaaagcaaucugcaguuuuaaugcaauccugaucaaaauuccaauguuaaauuucacagaacuagaaaacagugcuaaaauuuauauggaaccacauaagauccuaaauagccaaagcugucaugagugaaaagaacaaagcuggagacaucacacuaucugauuucaaaauauaguucaaagcuacaguaauuauaacagcaugauagucacauagaaguagacaggccaggcacaguugcucacacguguauucccacacucugggagacugaggcagaaggauuacuugaaaccaggaguucgagagcagccugggcaacauagugagacccugucucuaaaauuaaaaaaaaaaaaaauuuuuaaagccaggcgcggugcuguguaucuguaguccuagcuacccgagaggcugaagaaggaggauugcuugagcucaggagcuuaagguggcagugaacugugauugcaucacugcacuccagccuggaugacagcgugagacccugucuuuuaaaaacaaaagaaacaaaaaaacagacacaucgacccacaaaacagaauggagagcacagaaauaaauucguguacuaucaguugauuuuggacagggugcaaagaacacagcggggaaagggaagucuguucaauaggugguguugggaaaauggaauaucuacaugcaugagaaugaaaucagaccuguaucucacaucauauaccaaauucaaguuaaaauggauuaaggucuuaaauauaagaccugaaacuguagaacuaccagaauaaaguauaggagaaauguacaugacauugguuuggacagugauuuuuuuggauaugacccccucgaagcacaggcaacaaaaauaaaaauugaugaaugagaucacaucaaacuaaaaagcuucugcauggcaaaaagaaaaaaucuacagaaugaaaaaacucacagaauggaagauaguauuuccaaaccauauaucugguaagggguuaauaugcaaaauauauaaggaacucagacaucucaauaguaagaaagcaccucacuuaagaaaugggcaaaggacuugaauagacauuucucaaaauaagacauacaaauggccauuagaauggcuauuaaaguaugaugaggauuugcagacaagagauauauugcgcauggcaggaauguaaauuaguacagcauuuauggaaaauagcaugacguuugcucagaaauuaaaaaauagaacuaccauaugauucagcagucacacuuggauauauauguauuuuuauauauauauauauauauauauauauauauauauauauauauaaauaaaagaauaaaaucagugcgcugaagagaucuguacucccauguuccuuucgguaucauuugcaauacccaugauacagcaucagccuaaguguucauggauaaagaaaaugugguauguauacacaguggaauauacuucagccauaaaaaggaggaaaugcugucauuugugacagcagggaugaaccuggagggcauuguugaaaguaagccagccacagaaaggcaaauacuacaucucucuuaaauguggaaucuuaacucagggauguaaaauggugguuaccaggggcugggggugaguggacuggguugcagagguguuggucagaggacacaaaauuucaauuaagaggaauuuguucaagguaucuauuguacaacauggaaacuaguuaauaacaguguauuuuuggaaaucacugagaguagauuuuaaauguucugccauaaaauauaaguaugugagguauugcauguauuaauuagcuugaucuagccauuccacaguguauacauauuuuggaacaucaugugaauacaauaaauauguauccuuuuuuuuguuuuuuguguuuuuuuuuuuuuuuuuuuuuuuugagacagagucuugcuuugucacccaggcuggaguguaguagcaugaucuuggccacugcauccucugcuuccuggguucaaaugauucuccugccucagccucccaaauacguaucauuuuuauuugucaccaaaccuggugucuugacaggugaaaggagauaugaguaugagugaaacucuuacaaagauagcugagaugaucauugucagagguuuuaguaugucuaacaaagacaagggagugauuugcugaaaugaggaggugaagaugucucaaauuuagaaaggcaaauauuuugggggccuagaguauugggauagaaccauguacagggacauugaagucacuuugcugaugauguaacugggggcaaaguggaggcuuaaauauguggguuuaauugaccagaacagggagggaaagagaaggcauucgguuagaugacaugaguuucaaauuacaagcuguuuuuuuguuguuuuuaauacagggaauuuugccguuuauuuuuaauacagggaauuagaagaauaaugguggacuuaggaguuuuaggagucacauaaaaggguugcaugauaggcagugccuuuggggaggagccaggcuuucaugaaagcuaagaaguugaggggccauuauguaaaguaguugaagaugggggauagccuaugggucuucagaaagccucuggguuucuagagaucuuucuggaagagguuaggaggaugagucaaguuuagaauggaagaggauagaugaagcuugcauuugguaguaaaaaccaaggaugaaugugugaggcaugauuauuugucacaaguuuccaggugacacucuggcacucaguccuuguugaauuaagcaagcuuucuuacuguuuuacuuggcuguguuaaaguagaguaacaggaaauuagacuucccauaaugucucaauagagcuguuuuaaguuucuagccauaauugguaugggaauauagcucuaaaccuucaaggcugcuaccauuucucacauuccuauaucuagaaacuguagccaggcagcacuuucagugaggugaguggguccagguuuguucaauuacuuuuguaccaaccuaauaccuuaauaguauuuguccuaauuuacaaaaauagguaaugaaggauucuugguuuuaccucagagcuaacuguccauuaauggcaacaucccacauuuguugaagcaugauuuuguuguuuguacuuugacaugcauuugauauuuuaaguaacgccuugaaugcaucuuaaauaauaauuuauauacaguuaacacuccuguuuguuuuuaggaauucuuaguguugccaauuuccuaggauguagaagagcauaguaaaaaaaaaaauuauuaauacucuuaaacaaguguuuuuaacaacuggacaccauuuuguaguuaagccuagaaacagaacuaaugcaauaacccagaucuuuucauuuauucguauguuuauuuuaccuggauuuacuuuaguuuuuuguuuuguuugcuuguuguuugagauauugucuugcucugucauaagugauacagcuagagugcaguggugugaucagagcucacuacaacuuugaauuccugggcucaagugauccucaugccucagccuccugaguagcugggacuacaggcaugugccaccaugccaggcuaaaacaguguuuuuguuuguuuguuuguuuuuuguagagacagggucucacuauguugcccaggcuggucuugaacucuuggccccaaaguaauccuucugccuuggccucacaaagugcugggacuacagacgugagccaccgugccuggccauggauuuuguuuaaauuuauaaauaccguguuguagaaucucuuuguauguauuaauuuagacaccuuaguuuucuuaaugauuucauaccaguuucucaguaacuucagauuuuuuuuuugagauggaaucuugcucugucacccaggcuggagugcaguggcgcaauuuggcucacugcaaccccugccucccaggaugaagcaauucuccugccucagccacccgaguagcugagauuacaggcaugugccaccaugccuggcuaauuuuguauuuuuaguagagacagaguuucaccauauuggccaggcuggucuugaacuccugaccucgugaucugccugccucggccuuccagagcgcugggauuacaggcuugagccaccgcacccaaccagaucagauuuuuuauguuugguauuuacucuuuaccucuaacacuaaggcuauguuuccagauguauaacuauaaauggagcagggguaaauacaacaagugauuuaugguucaguaaagcaaguuaguuuuaauaaaugcucaguuuacuguaaaugucagaaaugccccaggacucugucuauugacaacucuucuauuuccaucgucagcucuugcccucugaacuguagacugauuuauccaacaguuaagucugguucucaaacuuaaccuguccuaaguggagcuccugauuuucaucaucccaaaccuacgucucucauaauauuuugccaucucagucaauaacagcuuuuuuccccuccugugcagccagaagccuuggaagcaucuuuuaauuucucuaugucacauacucaaauuauugguaaaucuuguuggcuacaccuuccaaauacccauaauucauuuuauuuuuuuuaaccauuauacuucuguuuacucuguuuaaaggcaucaucuuuuggcaaaagaaagaaauuguuucccaggagucuugugcuuuacaguguauucucuaguagcagccggaaugaucuuuuuaaaaucugaguuaaaccauguuauuuacuaugcacagaacuuuucagaggcuucccaucuuaaaaguaaaaucuggagauuuacauggcccugugugaacuggcuuccuuucauuucugugaucucucuaccgcacuugcucaucucugucuaaaauggcuguaucuuugucaucuuaaggcuuguaacuauugucugugacccugugacccuucucugugauaauccauguggcuuccuuccucacuugauucagagagcucucugcucaaaugaugcuuuuccugaccggcugcaucaaagaaugaucauguucuucugcauuccccuuaacuugcugcauuuuucuucaugggauuuaaugucauuugacuucuugcauauugauuucuuuguuguuuugcuucuuuaccacuagaauggaagccuaaugacagugccuggcauacaguagguagucaguaacuacuuccuacaugaaagaaugaagcuaguaaauuuaugcaaaauguuuguuucugccuuuuuaauuaucuugcagaaauguaggaagaauuuuuuaggaucaguuuauguauauauauaaacugauaaguauguacacagccuguagaauguggguaauaccaccuaucaucuuuuugagcauuuaccauguagcaagugacugugcuccauaauccacaugcauuaucuugaauuugauaggagagcugagcuuuuuaaucagaguagaccauagaaauauagcuuggaugcuuuuauuuccuauaugacuucuucgguguacuuacacaucuauaagcauuuaugggucaaguaacauacugaaauauuuucugaaguaaaagaaaucucuuuaaucaaauaagugguucuccuauagguucucauaucauauucuuggucuccagauugagaagguccuuuuguaugcuuccaguauacucgaaaccaggagguagucugacaucuauuucccuucaaggucaaauaauuagagaaagguuuaauugacacuguuaucgagacaguaucagaagagaaauugaaaaaucucuguugagacucuguaauuugcuagguucugaggauacgacaguaaauaaguuauuaggucauauaccucagcuucccauuuaauuaauaggcaguuauuauauauaauagaauagguacugguugguaugagacuacagaggaagaauaccuaauuaucuuaaaagugguauauaagcugaaaccuugaggaugcuugggaauagcuaagaaucauaguguucuaggcaggaagaauaacaccuggaaucagagaagacagcagaacaaguccacugaguaguaagaaguuccguauugcaguaauguagaguuagcugaugggagaaggugugaaaaaaugcauuuggauauagaaagccaggagcacgcuaaggcccuuugcuuucuucugacagacacaggagcccaugaaaggcaucacguguggaaggaagugacacgagucauagucugcccugcuuuucuaccaccugaagcaucauauaaaccuauaucuucuguuucaaauguaaggaaacauacuucuaguucacaguagggauaguugaauggaugaacuguuucuggcugaaucuucucaaaguagaaugagcaaaacauggcuauauuaugagauuaucuaaggaaagauuuuuauaaucaugugaauuuugaauuucuuuauaucuuaauuauuccaagagauuuuugggaacauuaaugagaauaguuuaccuuuaguacauagaacuucuugucagcuauaaaugaggaucaaacccaaaagagauuaacaaaaauaaaagggaugcuauuuccccaaauuagcagaacuuuuugauucaccgaguucuuuguuuuuuaacugcugucugccucuuaacauaauugaguauucagugauauaauauaaauaaaucacuuacuaaaugcugaugaacgcuuguuuuuacuaacaucucagcuuguagcauaucuuguugcccauaccagaaacccuacccauuaccucuggcucuuccagcuuauuuaccucuuacaaacuacuuauuuuaaauauuuccugggucaauuucaucuuuuuuuuucuuccuacugcuacauuauuuguccggacuauuacaguagucauuaccuaacuggauugcuugccuccaguuuugcccacuuugguuucaguuauugaaaaggcaaauuuugucagucacuuaaccugcuuaaaacccuucagugacuccuuguguuuuaguucuuaucuaaugguuuaugaauguaguggguuacgaaucuuccggaagagugcauuugcacuccugaagugugcauguauuuuuaugaggagaagaucuuuagcuuuuauuagauuacuccucuuuuggcuaaaaaaagaauuacuuaucauggcuauugaggucuuccaugaucuggcuuuucccugccucuccauuuucauauuuuugaaacuuuucuugaacuuuaggcucuugaagugcuuggaauugucuuauaauaucauguuuucaggccccugugcuuuuacucauuuuccucuaucugaaacauucuuccccugucugaaacauucuucccacccauagugucaucagcuccuagucaucuuuugugauucaccucuccuaaguugccucucuuuuuauugcuauuccucuguagucaucucugugauauugaaaucguggcuuucucuuucuuuagacaucauaauuccuugaagagcccuuuuuauguagccugacaagcagaauuuauacugaaguagacauuuggaagucauuuaguuauugcucaauccuugaaagaugaaacuguccaaagggaaauuuaaaagggaaaguaucuaauagcugaucccuggagaauacaaaugucucuagauuuggaagggaagucucugaaaaacagccagagagaagggaggaaaccaagaaauaguguccuagacccaaaagucaauaauuuccaaaaggucuauauuucuuaggaaggccaaguaaaauaaguagugaaaagugaugaccugacuagagcagauucuucauuuccaguuacagaagcuagguuauagguacaguaagcucuggacauguucuuuucccacauggaacguuauucguguucuccacugcugcuuugaacuauuccuuuuacucucucagcauaaaaaucccugcuccuuugaagcuuaugccuucugguuuugucuuccucugucugccuucagugagcuaucaguuucuucucgguuuuugaggacugcuaccugaacuuauucuucuucacucuuucccaaaucugcugccaucuuuauuuauaugauuaaccccucagucccuagcaagucaaauucccauccguuuuuaucuacaguaauguucaccucugcaucacugcugcuucccaugucuacaggcaugccaacucaaaacuguuuuaccccaaaagcuucagugaaaacaccuuaccucagguugccgucuuugaaugcuuuucuacuaucuuaaacuuguuuucuuucauugcgccuuuucuuccuucucuuagagacuuguccuauggcucuucuacugucuuccagcuacaauucccucuuguuccugacauguacugcucagagccaggagauggauaaguaguaguauuucacaugcacuuuuuucucuggggagcaguagucauacaauaauugauuaagauaaaacagguuuuuaucaguuuauauaagagguaaagaaaacaaugggguagaguuuuaaaaauugucaaaaacaacacauuuuaccauauuaaugauuugaaguguacgguacaauugugguaacugugcacauuguugugcagcagaucucuagaacuuuuucaucuuguaaaacagaaacucuacauucauugaacaacucuucuuuucccccuucuuccuauuccuuggcaaaugccauucuacuuuuugccucuaaaauuugacuguuuuggcuacuucaugucaguggaaucauuaaguauuugucuuuuguugacuggccuauuucacauagcaauguccucaagguucauuuguguuguagcauauuacagaauuucuuucuuuucuuuuaggcugaauaacauuuuguuauauauguauaccacauuuucuuuaaccauuuguugauggauguuuagguuccuuccacuucuugaauauuguaauguugaaauaaacauggguauacaaauauuuuuuugagaaccuguuuuuaauauauuuggaaguauacccagguguaggauuacuggaucauauguauucuauuuuuuuuuagauuuuuuuuuuuuuuacaggaguucuagguucacagaauugagaggaagguacagagauuuccccuguaccuccuuccacacacauguauggauucucucauagccagugugcaucucccaccagagugguacaugucuuucugaugaaccuauauugauacaucauaauuacccaaaguccguaguuuauauuagggaucauucuuagugcuguacguucuguggcuuugaacaaaguacaaugacauguaucuaccauuauaucauacagaauguuuucacugccccaaaauccucuguguucugccuauuuaucuuuccuucccucccacuccuuggcaaucaccgauccuuuuacugugucucuaacuuugccuuuuccagcauauuauauacuuguaaucauacaguauauagcccuuucagcuugacuauuuuuacuuacuaauaugcauuaaaguuucuuccaugucuuuucauagguuguuaguaccucucuuuuuccauuuucuggacauaucacaguuugugaaugaauauucaccuaaugaaggacauugugguugcuuccacauuuugcuaauuaugaauaaaacugcuguagauaucggugugcagguuuuuguguggacuuagguuuucagcgacuuucuguaaauacuagggagugcaauugcuggaucuuaugguaaaaguguuuaguuuuguaggaaacauccaaacugucuucuaauaugacgcuauccuuuuacauuuuucaccagcaaugagugaguguuucuuuugcucuacaucuucaccaguauuugguguuaucaguguucugaauuuuguccauucugauagguguguagagguaucuuauaauuuuaauuuguguuucucugaugccauaugaugugugggacaucuuuucauaugcugaauugccaucuguauaucuuuggugaggugucuguuaagguuguuggccaauuuuuuaauuggguuguuuguuuucuuguggaauuuuaagaguuccuuacacugucucugucugucuugucugucugucugucugucuguugagacagagccucgcucugucacccagguugcaguacaguggcacagucuuggcucccugcaaccucugccaccuggguucaagugauucuccugcgucagccucccgaguagcugggauuauacccgugcaccaccacaccuggcuaauuuuuguauuuuuaguagacacgggguuucacuauguuagccaggcuggucucgaccuccugaccucaggugauccacccaccuuggccucccaaagugcugggaugugagccaccacacccagccuccuuacacauuuuaguuaauaguucuuuaucagaugugucuuauguaaauauuuccucccuaucuguggcuugucuuuucauacucuugacauugucuuuugcaaaagacaacaauuuuuaagaaacaaguagacaauuuuaaugaagucuggcuuaucaguucuuuucuucaugguugguaccuuuggugccguaucuaaaagucaucaccaaacccaagaucuagauuuuuucuuauguuauccucuaggaguuuuauaguuuugaguuuuacauuuaauucucugguuuauuuugaguuuauuuuugugaaggguguaagaccugugucuagacucuuuuuuuuuuugcauguggauguucaguuauuaccacuguuuauugaaaaagacuauuuucuucauuguauugccuuugccucuuugucaaauacugccauugcuccuuugacuauguggguccauuucugggcucucuauucuguuucguuggucuguuuugucaguucuuuugucaguaccacaccaucuugacuacuguagcuuuacaguaaaucuugaaaucaguaguguccaucugacuuuuucugucaauauugaguugucucucacgggucauggaauagcucuucauuauuuaguuauuugauuucuuucaucagaguucuaaaacauuuuuccucauauaucuuguacuaauuuuguuagaucuguacuuaaauauuucauuuugggacacgcuaauguaaaaugguauuguguuuuuaauuucaaauucaacuuaugcauugcugguuuacaggaaagcuauuaacuuuuuuauaugaaccuuguauccugcagcuuugcuauaaucacuuauuaguucuaggagguuuuuguuguuuuucuuuuucuuuuuuucaauuccugucuauguucuacacauauagucauuucaucugcaaacaaaggcaguuguauuuuuuuguuccccguuaguauacccuuuauuuccuuuucuugucuuagcuaggacuuccaguauggaguggugagguggggauauucuuuucuuguuccugaucuuaguaagaaaguuucuaguuucucaucauuaaggaugguguuagcuguauguuuuuuguaaacguucuuuaucaaguugaagguguucccucuauuccuaguuuacuaguuucuaucaugaguggguguuaaauuuugucacauacuucucuccaucuaugguauggucaugugauuuuucuucuuuagucuguugauauggugaauugcauuaauugauuuuccaauauugaaccagucuugcauaccugggauaaauccuacuuugugcugguguauacuucuuuuuauacauuguaguaaaauuuaguuugcuaauacuuugcuaauacaaagauuuuugcaucuuuguucaugacaaauaugggucuguaguuuucuuuucugauaaugucuuugucugguuuggguauuagaguaaugcugacuucauacaaugagauaggagcaucuccuuugcuucugucuucugaaggagauuguagagaacuggugugguuucuuccuuaaauguuuaguagaauucaucagagaauccaucugggccugaugccuucucuuuuagaacauuauuaauuauggauuuaauuucuuuaauauaugcuuuuuaaucaagauuauuucuucuuagaguucuaauagauugugucuuuuaaggaauugauucauuucaucuagguuaccaaauucguggccguaaaguuguucauaauaucccuugauuauccuuuuaauguccaugagaucuguaaugauguccacucuuuucauucugauauuaguuauuuuguccuuugucucuuuuucuuagccuggcuagaggcuuauugauuuuauugaucuuuucagagaacuaguugauuucuuugauuuuucucuauugauaucuuguuuucaauuucauugauuucugcucuaauuuuuauuacuucuauuuggauuuaauuugcuuuuucuaguuucauaaguugguagcucagauaauugauuuuuagaucauucuuuucuuuucuuuuuuuuuugagauggagucucgcuuugucgcccaggcuggagugcaguggcucgaucucggcucaccgcaagcuccgccucccggguucacgccauucucuugccucagccucccaaguagcugggacuacaggcgccugccaccacguguggcuaauuuuuuuguauuuuuaguagagacgggguuucacuguguuagccaggauggucuugaucuccugaccaugugauccacccgccucagccucccaaagugcugggauuacaggcgugagccacagcgcccggccuagauaauucuuuucuaauaaaugcaucaguguuguauguuucuuucuaagcgcugcuuucacuguaucccacaaauuuggauaaguuguguuuucaugauauuuucaauuuauaaugguauugggacacaacccaauaaguaaguuuaggagcauuuguaugcauaagcacaauuguugacauuauuuugaacaaauucuuauuuguuagaucaauuaaguauaagaaaaauaaaagguuuuauuuuacuuucaguguuuccuucuuuugaugcucuauauauguagauuucaguuucugaacuucccaacacuuauugcaaggcagguguacugacaacaaauuuccuuaauuuuugucugagaaaguguuucuuuuuaacuuuugaauaauaaucucacaagguagagugcuagguuuaugguuuuuuuuucucucaacacuaugaauauuucacucuuuuucuuguuggaagucacauguauuuuuucuuuuuuuucuuuuuuuccucuacagguaaggugauuuuuucccucuggcuuacuucggauuuuuuucuuauccuugaauuucuguaauuacaacguuuuaugcccagauguaguuuuuuggcauauuuucaagcucagagauucuucauccaugcccagccuacuaauaagcccaucaaaggcauucuucauuucucuuacaguguucuguuuuuuguuuuuguuuguguuuuaucucuagcacuuccuuuugguucuuaggauuuucaucucuacuuuuuuaacauguuguuuacucaguucguuagggcccuuagcauauuaaucauaguuguuuuagauuccaaguuugauaauuccaaaucccugcuguaucugguccuggugcuuguuuuuuaccuuuuauuaugcccuguaauuuuuuucuugauagcuuggacaugauguacuagguaaaaggaacuguuguaaaugagcauuuaguaaugugguuguaagguguagggagaggagaagaguucuguagucuuaugauuaggucagucuuuuuagugagcuuaugccucuggacugugaacuucacaaguguuucucaaucccaccccucccucauucccuuaguuagaacaagauagcuauaauggccugaaguuggguuauuucucuucccccacaucauuuuggcuuugcuacaaccccagcagguuaggcucugguuaacuaguuucuccugaggacaaaccuuguuaagacuggaauagucuaguguacuugaaaaucauuucucuuugccuccccugcugaggguugaggauuuuucuccuauauuuacugugagaagcuggucaauugccuggauguaaaacuuagaaaauuguagggcucccccuauaauuggguaacucuggaguuuuuagcuuucagaguuguccacacugagccuucaucaauuugucuauuacacuucaggauuuccuaccccguggagguuucugcuuguguuuuucaucucagauaaauggugaugcuauguguucaccuguucucugcucucacaggcagucauuugcccugugaccucacuuauccuaucucagauuuguuuauuuuuaaguuugucauuuuuuacuuguuguuaggauggaguggugacuuccaagcucuucauauguggaacuggagguaauucuauuucaaauuuuuugagggaccuucauguuguuuuccacagugccuggcaccauuuuacauuuucaccaguggugcauaaggguuccaguuucuccauaucuucaccaauacuuauuuucuguuuuuuuaaugguggccauccuaaugguuucagaugauguaucauugcaguuuuaauugacauuucucccuacugaucagugauggugagaaucuuuucaugggcuuauugcccauuuguauauauucuuuggaaaaaugacuauucaaguccuuuguccacuuuuuaacuagauuuuuuguuguugaauuguaggaguuauuuauauauucuggauauuaaccaaauaacagauacaugguauagaaauauuuucuccuguuuuguagguugccauuuuacuccauuuacuguuugcuuuguagaaauuuuugaguuuauguauccccaguuugucuauuuuugcuuugguugcuugugcuuuuggugaucuauucaagaaaucauugccaaguccaaugucaugaagcuuuuucuccauguuuucuuguaguaguuuuauaauucgauguuuuaaguuuaggucuguaauccagcuugaguucaucuuuguauauggugugagauaaggcuccaacuucauucuuuugcauguuagauuccagauuucccaauacaguuuguugaagaaccucuuuucccuauuucuguguucucucuucugcucacuuggucuguauaucugucuuuaugccagcaccauaguguuuugauuacuauagcuuugcaauaucuuuagaaaucagggaaugugaggccucuagcuuuguuuuuuguccagauuguuacggcuauucaggguccuucaagauucuguauuaauuuuaagauuuuuuuuuucuguuucuguagaaaaugccauugggauuuugauagggauugcuuugaauuugcagauugcuuuggguaguauugccaucuuaacaguacuaaaucuuccaauucauaaacuuggaugucuuuccauuuauuuguauugucuuuaauuucuuucagcauuguuguauaauuuucuuuuucuuuuuuuuuuuuuuuugagacagagucucacucugucaccaggcuggaguagaguggcgugaucuuggcucacugcaccucugccucccaaauucaagugacaacuccugccucagccucccgaguggcugggauuacaggcgcgcgccaccaagcccagcuaauuuauuuuguauuuuuaguagagacaggguuucaccauguuggccaggauggucucaaucucuugaccucgugaucagcccaccuuggccucccaaacugcugggguuacaggcgugagccaccacguccggccuauguuguuuaauuuucaauguacaugucuuucauuugcuuggugaaaauauucccuaaguauuuuuuacucuuugauuucauuuuaaauggguuuaaaaaauuaauuuccuuuuuggauucuucauuuuuaguauuuagaaaugcaacucuuuucuuaauauugguuuuuauauccuguaacuuuacugaauuccuuuauucuaacgguuuuuuuucuuuuugguaggcuagaguuuucaacauaaaagaucaugucauuugcuaacagaaguaauuuuacuucuuacuuuucucauuuaauaccuuucauuucuuuuucuugcccaguugcuaacucuggcaggaugucuaacaguauguugaauagaaguggugaaugugugcauucuuguuccauuugugaucuuagagggaaaacuuucaguuuuucaucauugaauaacauuagcuguggucuuucuauauauggccuucauuauguugaaguaauuuccauaucuuucuagcgaauugagcguuuuuguuuuuguuuuuuugagacagaaucuugcucuugucacccaggcuggagugcaaugaugcuaucucaccucacugccagcuccgccucccggguucucaagugauuguccugccucagccucccgaguagcuggaauuacaggcgcccaccaccaugcccgauuaguuuuuguauuuuuaguagagacaggguuucacuguguuggccaggcuggucucacacuccugaccucaggugauccacccaccuugcccuucuaaagugcugggauuacaggcaugagccacccugucuggccuuuuuuuaaauccuaaaaggguguugauuuuugucaaaugcuucuucugagucaguugagauuauugguuuuuguccuaagaaugcaguguauuaaagugauuuuuuuguauguugaaccauccuuggauuuuaugaauaaauuccaguugagaauuuaugaaauauaaucuuuuuaaugcauuguugaauucuguuucuugguauuuuguugauuuuuuuugcaucaguauuuauuagggauucuuuuuucuuguaaauuugucugauuucgauaucuaaguaaugcuuaccucauaaaaugauuuugaaaguguucuguccucuaguuuuuucaaagaguuugagaaggguuguuaguuuuuaaauguuugguagaguuuucagugaagcccuggcguuguuggacaguuacugauucaaucucuaauaguuauagguccauucagaaguuguauguauuuguggcucagucuugguggguuugaugugucuauccguucucaaagguuaucaaauuuuuuugggucauaguuguucauauuagucuuuuaagguccuauuuauuucuguggcagcaguuguuguaucgccuuucuaauuuccaguuguugcuguuugugucuauucucuucauuucuuaaucuaagaauuugccaguuuuguugaucuuuucaauaaaacagcuacuccuaauuuuguugauuuuuuuucuauugcaaaaauuuucuauuuuucucuauuuuauuuuagcuguaauuuauuuuuauuuuuuuuauuuuuugguaaguuugagucucauuuguucuucauuuccuaauuccauaagauguaaaguuaauuuguugauuuaagguuuuucuuccuuucuaacugugaaauaugacacuguaaaacagauuuucauuuuacagaugaauuauguaaauauuuaguucuacaauuuuacuuuuuuuuuuaucauauaucacgcauucuggauauugagacuauaaaaaugaaaaaaacaguucuuuucuuuucuuuuuuuuuuuugagacagagucucgcucuuuugcccaggccacagugcaguggcucugucucggcucacugcaagcuccgccucccggguucaugccauucuucugcaucagccucccaaguagcugggacuauaggcgcccaccacggcgcccagcuaauuuuuuuuuguauuuuuaguagggacguaguuucaccauguuagccaggauggucucgaucuccugaccucaugauccgccugccucggccucccaaagugcugggauuagaggcguggcgugagccacugcacccggccauaaaacaguaauugaagguuaaccuauauuucaaacaacugaaaauacugauuuguucauauuuauuuuuucaugaaaaucgucuuguucuauauuuaauagguuuuuguucgguucaugguacuaaugaguucacaauuguagguuuagucuugaaauaaucuaaauucacuucaucccauuguaacagacccuacaucauacugaauauaguugugucacagaugucucuuacagucuauuucuacaaggccuagaacuauuuaggauaccguugcucacucuuacaaauuuuaacauuaaaaauaacuuugagauggaauggaguuuugcaacgucucagaacaaagagacuccacuuacgagaaauuacuaagcagugguuccuagcuuuauagacuaauuauauaagccuucaguuguuucuauuuuauaucuguuuuuuagauuccucacauguucauucugcuuuaccuucuguauaauauaaaggucacucuacuuacagucacauuuuccuuuuaaucuuuccguuuuuauuuuuuauucuuugcuuuguucaccauuaguuuuuauauugcaucucacaguucauguuucuuuuuugucauuucugauucuaauuguaauucuaaucuuacuuguuuggcguucacugucacaucuucacuuucuggcagcuguuucuauggcuucaucuucuuagugcuuguauucauugcuuauauuccaguugucuuguaaauucauuuuuuuagugaacuaagccagacacggaaagacagauaucacauguucucacugauaugugggaacuaaaaaaacauugaacacaaauuuuacagcugacacacauaugccugccaccuagauucugccauuaauacuuacauugcuuuaucguauaaccauccuuguauccaucaauccaucuuaauuuuuaugccuuucaaaguuaauugcuaacauuaguacacaucccucuaggugaaaccauuuuuaaacugauugcugucaaguugucuagaguaaacucugaucuuccaaguaugacuuauuccauaggacuucuguuuguagcacugucccauuaauucaaucauagaaauaaauaauuggaaaguauugucuguuuuaaauggauaaguauuuucaugugucugacuuuagaggacuuuuacuagaaggucucacuugaccuucauugcugacuaaauaagaaaaguuuguuuuauuuuaaaaaucaacacauuauaacauacuuuguuuuuugaguaauaagaaaagucaauggaaugugaagaaauuauagcaaguaagcuguuguuccucuucuaggaauuuugauuaugaacagcugauaagguauuacuaagggaucucaucagggaaauuccuuucuuuccuucuuuuucuuuugcauccucucccuuuccucacuuucuuuuccccuuuuucccuuuuccccucuccucuucuuuucuuuaauaguacuuggggaaagguauaccuuuuauuuuacggauuugcucaggguaaagagagaguuaagaggccaaaugauuagauggcagggucacuggagggcagagauaaauaauagauccuaaacuaaggguuggcaaacauuuucuguaaagggcaggugguauuuguuuuagguuuugcaggccuaaaguacucaacucugccauuguaguaugaaaaacagccauaaacuauauaguauauuguauuaguccuuuuucacgcugcugauaaagacguaccugagacugggaaaaaaaaaagaaguuuaauuggacuuacacuuccacauggcugggaaggcuucagaaucauggcgaaaggugaaagacacuucuugcauggcagugacaagagaaaaugagaaggaugcaaaagcggaaaccccugauaaaaccaucagaucucgugagacuuacuaccacaagaacagcaugugggaaacugcccccaugauucagauuaucucccagggggucacuccuacaacacaugagaauuaugggaguacaauucaagaugagauuuggguggggacacagagccaaagcauuaucauauauaguauauuuauaaaucaaugaacuuggguauguuccaguacacuugauggauacuggaacuugaauuucuuauaauuuucacguuacaaacuauuauuauuuuucaaacuuuuuccagccauuuaaaaauguaaaauauucuaagcuugagagacauaaacaggugguggacucgauuugacuuacgagcuaugauuuggugacccauaugguacaaggauuucccuugcgcaggaacuauaccaaaaagucguuauuaguguauacuuuuccaacguagaggcccuuuuaugugcucuaaauuuuguaugccuuuuacauauccuaaauuagauagugaugcagaugaggucagauaaauuaaggugucauuggagugaggaaaaaagaagaaugcuuaauauaguugauuccaccauuaacuuggagguucuggcauggcuuccuuuaguccugucucaucaguguagcugcuauuuguuaaacuuggcacagaaaggcagaucaaauauagagggcuacuuucagauccuccucuuaauaguuauuaaaagcucaaguuuaguagcugaguucaaaucucuuauuagauguaugacuuauguaauuucucugagcaucagcagaaugaagguuuauagugcuaacucauacacuugugagggugauaguaacaauuacaacaauaauaguaguagcuaacacuuucauagugcuuaguaugugccaggcaauguucuaagcacuuuauauauauuaacacauuuaauuuucucacaauugguaaugugaagaagaauaauacucucaccaugauaaugcucguagauacuaccauuuaaauuacgaggaaacuuacguccagaaagaucaaguaauucauucagggucacauaguuaauuaagagguagagccauuaugugaacuugggcaucuggccucagaaugcgagcucuuaacuguuaagguuuauuccccucuaaagugggaaugucuauaaaaugcauagcacauagguccucaacaaauuagagagaaauuaacuuugcagaauauagugguuccauuuccucaagaaacuuggucugccuuugugguaccagauagaugcauaaaugugagguucacguuaugauucuucagauuuuuuucccaguugcacauuaguuaugagauuuuuuuccauagaauucuucaguauuacucauguuaaaaaauaauuauuuugaaaugaaucaccuucugcaaaacaauauagucaaaaugacuuagacucugaagcugaaagacuccuggacuccuauucuugucuugguucuguacuuucuuugagaucuugguuucgugauuugacuccaguucuauuucucucuuuggcuguggacugaagauaauccucaaugucaugguauucaaaugagauaacccaugucaaagugccccgcaguguguguaauaaguuaucaggcauccagcaaauacuaguuucuugcucaccucccuauuacauaaaauaacuuuaaaauuagaacugaagggacucauaaagcugggaaaacugaggcccagacaauuguuucccuaggauccuacagcugcuuagggacagaaggaugacacuuaaugcagaucuucugauuuuucagucucguucuguuugugcugaucacucuccuccuauguaguauauaaagaaguacuauguaucugacaaguuuuggggagguuauuuuaguauaaaagcucacauuaaaaauaucuauuuugguauuuugacuuuuguaauuuuuuuaaaaaucagagacaauuuaguaaaucucggggccauucaaaucauguauaugaaguuuuauaacugcuauuguuuuccccuuauaguuauuaauuuuuaauaugcaaguagcauccuuacuauggaaagaauaaauaagaaaucaaaagauggaagaaguuuuaaaacucacuuaaucacaucauccagagaaaaugcuauuaaugcuuugaaauaacaauggguucauccuacaccugcuacuuuuuaacugacuuuugucaguuagugauauaucaggaagacuaggcaguucuuugucgaauucaaaucuugauaguuuuuauuuuauugugugaccuauuaucaguucauuuaaguaaucuuuuauuagacauguuuuuuucagauauagaaacaaugcauuuuuguaaaauugucaaauuauuuuccacaaguaggaucucauucacacgguauucguguuuuuaagacuuucgauacauguucacuguuuuccuccagaaaggaaauaccuacuuacauuuucaccagggaagucacuguaguuugggagaacaugacauuaucucccuuucuuuacugaaggguagcaauauauauuuuaaauuuucuagauucugcauuuccauuuuauuuuuacauguuuucacuuucauauuuugcauagugcuaaaucugugauaacaguuuuuaauuuucaggugggguuuauagcuucauagauagcaaaaugucuuuaagucauguuuaugcaauuuuuacaugugcuuuguggguuuucuuuuuucucuguuugcaugcagugagugguaaauuugcauggaacauuugaaaaauaagcaccagaaugaauugaaugugugugaauuaucacuuuuugucaccuaccuggacagagagugaaaguucuucuguugagacaaaauuggaucucguguguuucuucacuuacuugcugccuuguuaauuguugaguuucucaugauuagcaagauguaaacucuggcauuggucaucuaguccuacauguuagauaauucugugaauguuuugaaaaucagcugaacuauuuuucuuauaauuuugauucuuuguaguuguuauuuccaugcuugugaauuugggaccaaaaggaauggcuaugacuuauguuucuuuggauccaguaguuuauucuacugaaauuaugguaauuuuaucaguuaguagaagcauagacucuuuaguguugaauauaaugucaucuaacuucuuacauggucacauaauuccucccucaguuuugguagcucuccugaaacagccauaauaggacauuaaucuguguacuuuaaguugacagaguaaaaggaauauaagauuucacgugauggaacuuaaaauauuccaucuugugacguggaacuaaugaggagguuuagugacaaguuuuagauuuaagauucuacacuuuggagccucuuuuucuuuuucuuuuugguuuuuguuuguuuguuuguuuuugagacaaagucuagcucuguugcccaggcuggagugcaguggugcaauuucagcuuauggcagccuugacucucaggcucaagugauccucagccucccaaguagcugggacuacaggugcaugccaccacacuuggcuaauuuuuuuuaaaaaaguuuguagagaguagccucacuauguugcccaggcugguguugaccuccugggcucaaguagucggccugccucagccucccacaguuaugggauugauuacagucaugaucugccucacucaggcugcagccgcuuucuuucaguguaacacuaucuuuggauauuccacuuacaaauuuauuuuuaagucucccauguuguugauaauugggaaaaauaguuuuuauuccagauagauauucuguguuaacuauaagucaaauguuuacaagcuguuaaaaaugaaauacugauuauguaaaagaaaaccggauugaugcuuuaaauagacucauuuuccuaaugcuaauuuuuaaaaugauagaauccuacaacucuuagcuguaaaccuugugauuuuucagcuguuguacuaaacaacuuaagcacauauaccaucagacaagccccccuccccccuuuuaaaccaaaggaauguauacucuguuaauacagucaguaagcauugacauucuuuaucauaauauccuagaaaauauuuauuaacuauuucacuagucaggaguugugguaaauagugcaucuccauuuucuacuucucaucuucauacacagguuaaucacuucagugcuugacuaacuuuugccuugaugauauguugagcuuuguacuugagagcuguacuaaucacugugcuuauuguuugaauguuugguacaggaagcgagcagcugcaaagcaucuaauagaacgcuacuaccaccaguuaacugagggcuguggaaaugaagccugcacgaaugaguuuugugcuuccuguccaacuuuucuucguauggauaauaaugcagcagcuauuaaagcccucgagcuuuauaagauuaaugcaaaacucugugauccucaucccuccaagaaaggagcaagcucagcuuaccuugagaacucgaaaggugcccccaacaacuccugcucugagauaaaaaugaacaagaaaggcgcuagaauugauuuuaaagguaagauguuuuauuuucaauugagaauuguugccugaaaaccaugugggagauuuaaauguauuaguuuuuauuuguuuuuucuucugugacauaaagacauuuugauaucguagaaccaauuuuuuauugugguaacggacaggaauaauaacuacauuuuacaggucuaaucauugcuaauuagaagcagaucauaugccaaaaguucauuuguuaauagauugauuugaacuuuuuaaaauucuuaggaaaaauguauuaagugguagugaaucuccaaaacuaggccacaacaucuauuuaaguuauagaauaacuggacuaaguaucuggcaugaguucuggaaccucaggaugaugugaugaaagaagcagaaagaggaaacaguggguuuuuuccauuuuugaaggcaagacaaaauuuugugauaguuaugugagaauucuacguuuccuucagauauaugcuucucacucuccuuccggacauuugguacagucaugcugccaaggaucaugaccuaccaaugacagucuucacucaggucuuuuguuuucuaaaugguccuacguccaaaauucagaauucgauuaccuugucgcuaauacuaaaacuccaaguuauuuucuucagugaagguaauuaguaacaaaguaaucaaauuuuugaaugacuaccagggcuuagcgccccuccacucucaccccuacacacacccagaggcaauuguauuuuaagagagaaagcuuuuuuuuuaugacauacaagucagagaauuuuagaggcauuugccucuaaaacuuucacuaacaucauuugaaucaaguuugaaagaauuagugaaguggcauuguguuauaaccucuacucuguuuccacaauaaaauuauuuucgucacuuuacacaacuuuguugcuucagaguguauaauucuguuucaugaauuaguucacacacuaugggaaaauagguaaauguugucuguauauauagugugucaguauaauguggaagcugcauugacuuuauuguacacaguucuccaguaagugugcaccagagaguaccaguaacugaauguagagugcuggcacaguggaaugcagccagcugcgggggaugugguacaugaggaaugugcucaucugcucuuuuggccacgugcuccaucuuagaggugcuuauuguguggcuuuauccagucuuuaugcccccuccucuuuuugcucaagucugcauuauagcaguugugaccuuuccuuaucccuguuuucuaauaugcuacuguuacuguucccuguucguuacugguuuuuuuguuuuuguuuuugcauuguucuauaguuacuauuguauauuggaaauuagagaugcuuucuguacacuaguacucuuauuuugauuauuaauuauguuuguuaacacuaauuacaaaguugcauaaguauuaaguagucugcaccaaacuguuuuugcguaggagguuuuuaagugcaaaauuuaaaagauugaguauuuucagggacacauuuaucacaagaaaucuuauaaaaaugucuuucucaguagaacaccuguaucaauaaaccaaacuuuuugaauguucauaucuaauuacaguguuuuuugacuaauuuuuaucuauauaccugaaaaauucaguuuaacauauuaaacacuacaggccaggcacaguggcucacgccuguaaucccagcacuuugggaggcugaggcgggcgaaucacgacgucaagagaucgagaccaaccuggccaacguggugaaacccccucucuacuaaaaauacaaaaaaauuagccaguugugguggcgugcaucuguagucccagcuacuugggaggcugagguaggagaaucguuugaacccgggaggcagaaguugcagugagccgaaauggugccacugcauuccaaccuggcaacagagugagacuccaugucaaaaaacaacaacaaaaaacacuccuuggaaaaaguauagguacauucuauauaggauuaguagacugucagaaucacuugaagauguuccgaaagcaugacauaucaacaaaggacaugugagucuagaauggugaucccuaggacaggccauauuacugcaugcaaagcaagucuuuguuaaccuuaugacuugcucaggaagcaaaguguuucauguccuaauaggauaguaguauuuucuguuauguuacauuuuaggaaauuaggaguuuugcauugucuuguaagaagguauuuuaaaaauuuucaaugaaaauaaugagaaauagguuuccagugguuuuaugcuuuuggggaagagguuacugauguuuagcaaaagaugcuuauauauucuuaauagaacaaaccugagaauuaguucuuaaagaguuaaggcccauaaaagaaacuguaaguguugguacucuuguagcugggccacagaucagauccuuaguaugauaaaauuugguauuuuugugcuucaauuuuuggagaccauucaaugaucacuuacauuuuauauugucuuucauugugaaacauauauuauagcagaggugggagucauuaaaaauucuacauguuguacacuacauguauaaggguauauuuggcgcaauggagguaggauugucugugugccucuaaaauuaaccucucaaguaguuaaucugaugaugacaaguaugucacuuuauugauaaaagggagaauuaagacuauucucaguauuauguuggucaguacacaaaauauaucauuuguuuuuaccugugaaaugaaauaucuuucauccuauuagccagaagggagaaagccuuggccugaaaauaacacuuaucucaaaaaguugggaaaugugguccaacucugugcccaggaaaagaggaaauagauuuugaugacuacauagucucugcacugcuugccagcucauaaguuuacuucuuugcacuguuuguuuucauugcucaaaaacuauuuucugucacucuaugagauuuagucuaaccugauuccuggcuguggaaagcaguuucuacuuaagagccgaugagaaaugguauauucuucucaaucacucacagaaugacuacccuggaacaaacuaggaagacccaaaaugaaccaguuugauuuuaauacauacauagaugcugaaggagccuuuuuuuaagaccuugccuucuuagucuuuggagaacagaguacugaaacaagaaaacucacagauuaguaguauuucuguguguucuacagugagguuuuaagagcuguauuaugauuaaucaguacaugacauauugguucauauuuauaauuaaagcuauacauuaauagauaucuugauuauaaagaaaguuuaaacucaugaucuuauuaagaguuauacauuguugaaagaauguaaaagcaugggugaggucauugguauagguagguaguucauugaaaaaaauagguaagcauuaaauuuuguuugcugaaucuaaguauuagauacuuuaagaguuguauaucauaaaugauauugagccuagaauguuuggcuguuuuacuuuuagaacuuuuugcaacagaguaaacauacauauuaugaaaauaaauguucucuuuuuuccucugauuuucuagaugugacuuacuuaacagaagagaagguauaugaaauucuugaauuauguagagaaagagaggauuauuccccuuuaauccguguuauuggaagaguuuuuucuagugcugaggcauugguacagagcuuccggaaaguuaaacaacacaccaaggaagaacugaaaucucuucaagcaaaagaugaagacaaagaugaagaugaaaaggaaaaagcugcauguucugcugcugcuauggaagaagacucagaagcaucuuccucaaggauaggugauagcucacagggagacaacaauuugcaaaaauuaggcccugaugaugugucuguggauauugaugccauuagaagggucuacaccagauugcucucuaaugaaaaaauugaaacugccuuucucaaugcacuuguauauuugucaccuaacguggaaugugacuugacguaucacaauguauacucucgagauccuaauuaucugaauuuguucauuaucguaauggagaauagaaaucuccacaguccugaauaucuggaaauggcuuugccauuauuuugcaaagcgaugagcaagcuaccccuugcagcccaaggaaaacugaucagacuguggucuaaauacaaugcagaccagauucggagaaugauggagacauuucagcaacuuauuacuuauaaagucauaagcaaugaauuuaacagucgaaaucuagugaaugaugaugaugccauuguugcugcuucgaagugcuugaaaaugguuuacuaugcaaauguagugggaggggaaguggacacaaaucacaaugaagaagaugaugaagagcccaucccugaguccagcgagcugacacuucaggaacuuuugggagaagaaagaagaaacaagaaagguccucgaguggacccccuggaaacugaacuugguguuaaaacccuggauugucgaaaaccacuuaucccuuuugaagaguuuauuaaugaaccacugaaugagguucuagaaauggauaaagauuauacuuuuuucaaaguagaaacagagaacaaauucucuuuuaugacaugucccuuuauauugaaugcugucacaaagaauuugggauuauauuaugacaauagaauucgcauguacagugaacgaagaaucacuguucucuacagcuuaguucaaggacagcaguugaauccauauuugagacucaaaguuagacgugaccauaucauagaugaugcacuuguccggguaaguugggcugcuagauuaaaaaccuaauaauggggauaucaugauacaguucagugaauucauuuuaaaagugacugaaaaaaaugauaccauauagcauaggaacacauggacauuucugaucuuauauaaguauuauacuuuuguuguuccugugcaaguuuauagauguguucuacaaaguaucgguuguauuauauaauggucaugcuaucuuugaaaaagaauggguuuucuaaaucuugaaaacuaaauccaaaguuucuuucauucagaagagaauagaguguuggacaaagaccagaacaagagaaauguggagauacccaauaauaaguguggaugugcagucuugaacugggaguaaugguacaguaaaaccauaccauaaaauuauagguaguguccaaaaaauuccaucguguaaaauucagaguugcauuauuguggacuugaugaagugaccauggcagaucagugccuguugccaguaagaguugaguccugcugggccacuuagaauaucccuguguggacggcacugccuggcugugguaguuucuucccacuuaaaaauucauagagacaacucugggucuuggaacuucuggaaaacagcagcuauuccaaaaaucuggggauuaguggugccuguaacaucaaguccagggagauugagcagggaaauacuggaaacucagguacucauccuaacuuccugguuuuccagaugggguugccauuuguuccuuuucuuuccuccacaagauaauuuuaguguaucuguuuaagaauauaagaguggccagaagacagaaagcagucgucagucacauuucaccaaaauuuacauuugucucaggugcauuaucgcagagcuuuauuguauuucuaguauuagcuaucccugucauugcugcuacuuuuuuaucaucuucaaguaaaauuuaaugucaacaaaaauuaagguaguuaauaauacuauaguauacuaguaaaguugucugacacagacaacuaggaaaugugauuuuuacuuuaaaauguauuuuaguuuuagaaugucuaaauuuuaguuuuagaauugucuaaauucgagaauucauaaagcuguagcccgguggaaaaaguuauuugacaucucagaaauuaaaaauugcagagauuuuguguguuuuuuuuuuuuuuguuacugguuuguuuuuuuuuuuuaaugucagauauguuuauaguguuggagaaagauucugcauuauuuaagcaacucaggugguuuucuagcagagacaaaagggggcuuuaacugccugaagucauuauuauugcuugcuuucugguacccuuuuuauuucacuuacauaguuuugagacacaugaauaauuaauacacuuaaugacugaucauaaggcagccagcaccuuacuuuacauaguuuagcagaaugauaggguauuuuauaagaaugugagugauguuuuaugaaagguauguugaggucugucuaugacuauccauuguuggagcagaacugcaaaugccaaagcuacauacuuuauguuuggcuucuugaggugagaucccuucagcugucuucaucaaaagcuaugucuagccuuuaaaaggcaaugaaauuacacuguaagaaucauuccaggguucaaaaaauugucuaccuuccuuaucugucuuucgcucagaagucuacucagucuuauuuuccucagucccccauuuuuuucucuaguaaagcaagacuaaaaacaaaaguuuaaguacuugguauauacuuuauucuauauuuuaaauucuauucuagaauuuuaaggaaacaacugcuuuuaaagccuuagguguuaguguaaaauuaacugugagcucuuuaauuaugguaacuuguuuuuagcaaguucugcuuaauuauaucaaaauuagauaauauaguguggccuaucauaaaucaggauucacuagauaguauauguacuugaauauugccagcccacaaaagcaguucacuucagaaaucauguguguuaggcaguuuaauaaacugugaaaauagaaagagaugaugcuuacagagaagcuuccuuaggggcucugaaugcucacacuaagcagauuuuacucuuaacuuucuuucucccuugcuuuuucuuccuuuucuuuuuuuuaaaaaaauaacagaaugugaaaagacuagaaaaaccagcaucgaaauaggucuuauaaguaaaauugauaaccuguguaauuuuuugaaguaaguauucacagcaggugaugauuaugauaaagccacauauuuuaguaacacauaguagaaguucuauaauagaaagugguuuaagauuauucucucauaugaaagcucaaaagugaugaauuuuucaagaucuuauuucccaaggaucucugcuuuuuaagccucauucuuauauaucacagugaacaaacuaguggccacuuuuuuaugacuugcuaauuuuggaauuguauagcaggguuggguggaaaagaagaaaugagaaacuuugugguaagcuuaauauugauaaauaaaauuaugggauccuaggcuuuaagagcuaaaagaaaccuuagaguuauccacuccuuaguuuagaaaucaagcccagaaaauagugacuucauauaugagacucuuguauguuuucuguugaggagugguaacuugaauuaauaauuguggauuuuuuuaaaaaagaaaaauauauucauugcuuuuauauauugugaaauucaaaccagacuagcagcuuuuuuccugagguuuuuagagaaauugucuuugaugacaagagaagaauucauguugauaguauuuucacuaaucucugauuguaggaaacacuaucauuuuauuacugcuaagacagaaaaauaccagcaauucauuguaagaugcuaucauuuguaugguguaaucugauuucagagauaaugugaaaaaagugaauuuuagaaucaauagaauauaaguugucucuucacaaauaccuuagaacugcuuaagaacacccccacccuacccguuuaacuuacugccauaguuccccuaggacuuauuuucaguauuuuuucguuauuguuccuuagaaaacaguacagugauaaacaugagcuuagacuucaccuuucauuugaaugacauuccuaaugugaugagguuuuuacaaauauguaaaaccauauuuacaaauuuacauuuuuaauauaaauauguaauuuaauuuaauauguaaauuaauuuaauuuaaauauguaaauauuuacauauuuacaaauaugcaaauauuuacauauuuacaaauauguaaauauuuacauauuuacaaauauguaaauauuuacauauuuacaaauauguaaauauacccauuuguguguucuuuuacaaguagauaauuucucauuuuucuuagaugaagcacuuccaaugauaguauguauuaagauuuuuuaaauuacuucuuaaaggagaagauagagguuauaaguuuauggaagaauauaguauugccaucaugaggucccucaaacugccuucacaucugaaugggaaaauuguuuaaaaaaaauaaauaaauaaauaaauaaaauccagggcccuaaccucuagagguuuagauuagaagcuguauuguagagccuaugaaucugaacuucugguaauacuccacaaauauuuugauaaagccagacuccaauauuugggaagauggccuuugguucagcucaggugggggugugugugcauguguguuuauguguguaugugugcauauauagagagaaagagaaaggccauuuugauauacaaguauguuuauguguuuuggaaacucagauuuuuaagaggaucauggggacagcaagcuuggaauagaggaugaugaugaugugaaacuugguuccaauuagucagggaguucuagcauuucacauaaauaucuaaaaaccaaaaggaauggcugagauguggaauugaauagggaaguucaaaaauaggaauuagcacagauaaaggugauuggcacagauaaaaagccccacuaccaggagguucugcaaaauccccucuaaaagucacuggcccuuuuuaucugguuucuaauagccuagucuaacccagcuuccagcauuuucagcucccagcuuccagcauuggugaacacucuuacuagugaaacaugaacguaauucuuuuauuuauucauugacucacagagcuuuaaaaaugagauuauucugugcugcacuagguauguuuaauuuugucuuacacauacacuauauugugguuaacauguaauuuccauuguucuuucuugugauuuauucuaauugaaaucaaaaaugaaaccaagaaauaugcuugguuuaugcccucaaaguaauuucucagaaacugaaugagagaaugaagccuauauauacauagauccucagcauuauauaauaauuuaagacaaugaaacaucaaacuuaguauuacaugugaggaaaaugaaaucuaaaagagauuccagccuacauaaauuaauggcagaauuggaaauagaagucaggauuccaggucucauggacgaacgugauuaugugauuugguguuacccaaacauuuaaacuacauuugagauauaacagacuuuucuucauguguuuaucgugaacaugaaaaaauuaauuuggauaaucuggaaaucucaagcaauaguuuaagccucaaguugacugaaguaguugaagcuagccuuucuuucuuuuuccucuuuuuuuuuuuuuuuuuuuagacggagucuugcucugucacccaggcuggagugcaguggcgcaaucuuggcucacugcaagccccgccucccagguucaugccauucuccugccucagccucccgaguagcugggacuacaggcgccugccaccaugcccagcuaauuuuuuuguauuuuuaguagagaugggguucaccguguuagccaggauggucucaaucuccugaccucgugauccgcccgccucggccucccagagugccgggauuacaggcaugagccaccacgcccggccuugaagcuagccuuucuuagaaaucccaggcauucuuaaguauuagaggucucuuuuaucugauuauugcuucuacuuaaauauucaugguauuaaggaauuuuuuuaaaaaauuaugaauugauuugauguaauagcucagaaaacuauaagauuuuaagugauaagguuuuccuuuugauuccuguaagucuaguaauaucauauuuugauauuaagaugucauccugcuagguauucugcaaaugcuuugauaucaggucagauuuuuuuuuuaaaaaaugaacucccuaggauuucaucaucauggccaauuaaaaaguucagaaauuaaaaaucauuuuauccagcaauugaugaaaucaagagucuuaaagaagaggaaguuacgcagugaagagguagauaugauuauauccaggauauuuuuguuuauuuuuccccaguaaucucugucuguugcuagucuccauguuaaauaaauacaacauacacuguacuuuuaaauauaccuaaaaauuggccuggcgcgguggcucacaccuguaaucccagcacuuugggaggccaaggcgggcagaucacaaggucaggagaccgaaaccauccuggcuaacacagugaaaccccaucucuacuaaaaaauacaaaaaaaaauagccaggcgcgguggcaggcgccuguagucccagcuacucgggaggcugaggcaggagaauggcaugaaccugggaggcggggcuugcagugcgccaagauugcgccacugcacuccagccugggcgacagagcgagacuccgucucaaaaaaaaaaaaaaaacaaacaaaaaaaacccuaaaaauccacguguguauuguaaauaaauucaggcaugcaugcacguucuccuuuucagaauguuuagacauaguccuccaaauuucaaauauccuaaugcauuuaaaacaacuucugacuuaaaaaauacaguuuuauggugagguuuggguuuaaacaacaacauacaauuuuaaauaauauagcuauuauguaaagaauacaccuuuacaguuuauuuguuaaaucuuuuuuaaauugaccgaacaauugauggagguuauuuuuaagaaaaagaauuaucaguacagcuguuuaugcaauaauggccuuuaucaaaaugguuauugcuaaauuuuauguguuaauaauuuaaaauaaaauaguuuuaaaggcuauuuauguauucuguuuuuacuauuuuauuuauuuuaauuuuugagacagggucuuaacucugucacccaggccuggaguacaguggcacgaucucuacugacugcagccuugaccucccaccucagccucccaaguagcugggaugacaggcgcaugccaccaccccccacuauuuuuuauuuauuuauuuauuuauuuauuuauuuauuuauuaguuuuuuguagaaacaagguuucaucauguugcccaggcugaucucaaacugcugggcucaggcaaucugccugcauuggccucccaaaguggugggauuacaggugugagccacggcgcccagccuuuauucuuaagugguacaguauuuuaugaaaucacuuauguguaccagaaugguaaucuaaaauagguaauaacaaaauuuuugccuacagaauucaguuaccaacuacuuuucaaauuauucuuuuuacauauuuauauuugaacacauucugacucugaaaaauguauuuguuguaaaaaauggaaaaauauggaaaagaauaaggaaaauaaaaaucacucauaauccuaaaaaaaaaauuuuuggucgucauugaagagagugaguaaagcauaguaguuaagagcuuguuuccuggauuaguaucucuguuccacaacuuacugugacuuacugugacuugaaguuauuucaccuuucaguaucuugggguccuuaucuguaaaguggaguuaauguuuccuuccucauaaggguguugugaagauuaaauuaguugcuaugugugaaaugcuacaaaagugcuauauauuauuguugcuguauucauggaauauuuuuguucuauaaugcuaugguagguuuucagaaaauauuuuagaaccaauaaaauaacagcaacaacagcuaguacuuuuaagcacuaacuuuaugcagggaauuaaucuaagcaguucauacauuaauuuauuacuauauuauuaugguuauuuuacagaugaaauaagagagguaaaguuguauguuugcauuuacaauagaacauauugcauugcauuacauucuuuuggcaccaagguggggagcauagaauagagaucaguggaaguggacagacauguaauauuuuauggagaauaaagauaaauuugcuucaguuaucauuugacaugucuuagguagagcuaagacuagauagaacacagggccucucaauccuguagaaauucaccaccacauccuuuaaaagguuuuacauugauaaggagucagcucucaucuaugaauguuaguggggaaaagcuguagaaugcacagucuaaauaccagauaaccuuuuuuuuccccacuuuggaauacauuauauuugauaaaagcaaguauaccuuuggauguaaagguaaauauaaacacugacuuacaucuuuaacaccuagccaguugggaacuggcauaaggaaacucagaauggauuacauggcaauauggaauguuggccuggucccacauuugagcuaagauguuaauucuaauuuuagucuccucagaauucuguauacuccguagcuugaaacagguuuccaacugaaacuauuuuuuuccccaagguuauuuucacaucuacauuuguuugacucuagaucuuggaacuagucuauaucaaguuccuuuggggacacaaaauugcaaaucuguuguucagagagcaaaacuauuuuaaaagguaacacucguucucauauauucuuaauaagccuucacaacuuacaguauguugaggaaacugaggcuuaauugaaucgcgugcuaaaguuuaaagguuaaaaguuaugguaagugagaguugggacuaguaaggugaauucugacugacucuuggucuuuccauaacaaaacauugucuaaaaguaaacuguguggccuaaaaaugauuuuguaaauauuagagaucgguguugaacaacaacagacauuauuuaaagcuaaagacuaaauucacagaauaggacccuaaaguugaagauacccagaagauaauuucagcuaguuuugucaaacucuuugacugcaaucccuaguauuuuacauagcaucccaguacaugcuuauccaucuguacaucuaauugaaacaaaaguuucacaaaacaguagguuccauuacuauguggaaugcauucugauuuucccauugcugauugcaaaccacuaaauggauuagacuacccacuaaugaguugcaggugacaaguuugaaaaaacaaugcucucgggcaaccugaccugaugcguuaauuuaugagauuuuauuuuuuguagacagacuagauuguccaaaugaguauuauuacuuuaacuacuauagugcuguguuacaguuguuucagugauuauugcauuuuucaaaaccauuuuuaaaauucuguuugaaauaguuggaauaaccugaaaacauuuaauauccuguuuugguaaauuuucaucuccaagauuaaauuuuuuuaaccagccaacagauguuugaaggcaaguuaggagauaugauggauacuggauacaguauccauccauguacuagauacaguauccauccauguacuggauacagucauacuguuagcaaauuuuagauacauaaaguaaaacaaacaaaaugcaguauaaacaguuaauauuggaaucuaguguugauuuuaugauuaaucucaaugagguuacuguauauucauaauucuauagguacacaaaaauauuugguaaaagauuuauaguugagaaaaugcuagacacuaaaguuuguuaacuuacaauuuaagaauaagggcugggugcaguugcucacgccuguaaucccagcacuuugagaggcugaggugggcggaucaugaggucaggaguucaagaccauccuggcaaacguagugaaaccccaucucuacuaaaaauaaaaaauuuagccaggcguaguggcgccugccuguaaucccagcuacucaggaggcugaggcaggagaauugcuugaacccaggaggcggagguugcagugagcugagaucgcgccacugcacuccagccuaggcgacagagugagauuucaugucaaaaaaaaaaaaaaaaagaguaaggacaugaguaagguuaugucucaccuguuuuuaaggaaauguggauauaagauggguucuaguccauuaaaaggugguaauuuauacuaagucuuacugugagagaccauaaacugcuuuaguauucaguguauuuuucuuaauugaaauauuuuacuuaugacuuaguagauacuaagacuuaacccuugaguuucuauucuaauaaaggacuacuaaugaacaauuuugagguuagaccucuacuccauuguuuuugcugaaaugauuuagcugcuuuuccauguccuguguaguccagacuuaacacacaaguaauaaaaucuuaauuaauuguauguuaauuucauaacaaaucaguaaaguuagcuuuuuacuaugcuagugucuguuuugugucugucuuuuugauuaucuuuaagacugaaucuuugucuucacuggcuuuuuaucaguuugcuuucuguuuccauuuacauacaaaaagucaaaaauuuguauuuguuuccuaauccuacuccuuguuuuuauuuuguuuuuuuccugauacuagcaaucaucuucuuuucauguuuaucuuuucaaucacuagcuagagaugaucgcuauggaaaauccugcagacuugaagaagcaguuguauguggaauuugaaggagaacaaggaguugaugagggagguguuuccaaagaauuuuuucagcugguuguggaggaaaucuucaauccagauauugguaaauacauuaguaaugugauuauggugucguaucaucuuuugaguuaguuauuuguuuaucuuacuuuguaaauauuuucagcuaugaagagcagcaaaagaaggauuugguauggauuacccagaaucacacaucaugacugaauuuguagguuuuaggaacugauuuguaucacuaauuuauucaaauucuuuuauuucuuagaaggaauauucuaaugaaggaaauuaucucuuugguaaacugaauugaaagcacuuuagaaugguauauuggaacaguuggagggauuucuuugcuuuuuguugucuaaaaccaucaucaaacucacgguuuuccugaccugugaacuucaaagaacaaugguuugaagaguauugagagacugucucacaaguaugucaugcucaaaguucagaaacacuagcugauaucacauuaauuagguuuauuugcuauaagauuucuuggggcuuaauauagguaguguuucccccaaacuuuuugaacuccagaacucuuuuucugcccuaacagaagaguuguuauugaacacaguuugggaaaggcugaugggauuuggaaauuugaaagugaaggaucagaauuuuaguuuuuucccuuuugugauaaaguagaacagggaaaagaugcagucuuuuggguagucuacuuaacuucauaauucugaacugguucaguuucuacuguaaauauaaccacuuaguaacugagcuugcuuacguuuaaaauugaguacaugacaauuacaggaaaagguuuccacugaagguaccaucagaauugugaggagugugcauagaauaauguaugucauuucccuucagcuuugagauuugagcuguuauagccuguugauucuaauugaguugaccuuucuguuacuguucuuagucacacacacacacacacacacacacacacacacacacacacacacgcaucccuuaucuauaaucuagcuaguguuuuauuaauaacuaaaaagcuaugccauuuguauguaguuuguucuaaguaaaucagagauacauaagacgacgcccuuuuugagauagaaaauuauaaacuucauaaaguucuuaaauuugguaaaccuuagcucuagcuuuugauguaucuagaaauguuaaaccuuagcuauaaagcauacuugcauuauaugcagaaauacuuguaagaaaaaacauagauuaagcaguuccaguaagauaacugaagugauggcaguagaaguaucaaaaaggaguauuuuaccaggagguuauggugcuuuucucccuggaacaugagaaaaugugccuaaaauggaacuucagaguuauauucugauuaacuuauagcuuguugcucuugguuccaaggaagggcauuugugacauuuuauuaaauucauuaauuuuuuagacacaccauugucagcuugaacaaauuuauuaauuguaauuauuugucagcuguucuugauccuguuaauaccauacuuauaacuaaaagcauuuccauggauguuguaacuuggccuguaaaaaaaauguuuagauagaaaccaugaaacucaaauaugaauuguuuaauuuucaaaccauuuugcauucagaaaauguccuaagcuuaauucauacuccuagugaucaaggaaacauguuaaagcuccuuauuuuuaaacuuaaagugacaaugacauuuucaaagauuuuaaaauucuuauaaacagguuaaaauacuuauauacuguauaauuugauuucugauuucuaagcucuacuuuucuauuggaaauuacagauuuuuuucagacuuaauucuuaagauguuuucauuguuucacaguagcaacuaaacauguaguaaaaugauuuaaauucaauuaaaauuuuuuuccuuagucauuuaaaagggaagaaaucaauuuuuaguaguacucauuccaaagauuccaauuuuccuuuuuuuuaaucuuuuauuuuuugguggagggaggcaggaucuggcucugaggcccaggcuggaguguagugguucugucucggcucacugcaaccuccaccucccaggcugaagacucaaaccauccccaugcaucacccucucaaguagcugagacuauaggcacaugcuaccacacccagcuuauuuuuuguguuuuuguagagaugggguuucuccaucuugcccaggcuggucuugaacuccugagcucaagugaucugccugccucagccuccccaaagugcugggauuacaggugugaacuaccacaccgggccccaauuuuccaaugagugauauaaaaaaggccuccacgcaggcgccuguagucccaacuacuccggaggcugaggccagagaauggcaugaacccgggaggcggagcuugcacuaagcugagugcugcugcacuccagcuugggcgacagagcgagaccgucucaaaaaaaaaaaaaaaaaaaaaagccuccaugauuggggcuugcauagugaagaccaugugaaauugaaagacuacgaaacuacuuuucuuuuacguauuggcccauaauuaacauguguauugaauagcuuuguuuaucuaaguucaucagauuuauccagguuuauguauuucagaucaucugauuuuauuaggaaaaugcuagaaaaauuucauggcaccauugucuaauuuugaaaaaacgaaccuuucuuuacugugauuaaaaauuguuuuuuaggccaggugugguggcucacgccuguaaucccagcacuuugggaggcugaggcuggcagaucacgaggucaagagguugagaccauccuggcaaacauggugaaaccccuucucuacuaaaaauacaaaaauuagcuggcgugguggugcacaccuguaguccuagcuacucaggaggcugaggcaggagaauuguuugaaccuaggaggcagagguugcagugagcugagaucgugccacuccagcccacccuggguaacagagcgagacuccaucucaaggaaaaaaaugaaaaauuguuuucaaaaauaguacgugugguacagauauaaguaauuauauuuuuauaaaugaaacacuuuggaaauguagccauuuuuuguuuuuuuauguuuauuuuucagcuauggguggauaaagcaugaauauaacuuuucuuauguguuaguagaaaauuagaaagcuugaauuuaauuaacguauuuuucuacccgaugccaccaaauuacuuacuacuuuauuccuuuggcuucauaaaauuacauaucaccauucaccccaauuuauagcagauauauguggacauuguuuucucaagugcuaauauaauagaaaucaauguugcaugccuaauuacauauauuuuaaauguuuuauaugcauaauuauuuuaaguuuauauuuguauuauucaucaguccuuaauaaaauacaaaaguaauguauuuuuaaaaaucauuucuuauagguauguucacauacgaugaaucuacaaaauuguuuugguuuaauccaucuucuuuugaaacugagggucaguuuacucugauuggcauaguacugggucuggcuauuuacaauaacuguauacuggauguacauuuucccaugguugucuacaggaagcuaauggggaaaaaaggaacuuuucgugacuugggagacucucacccaguaaguucuuugucauuuuuuuaauucagucucuuagauuuuauuuaaaugcaaaaauuuaauuuaugucaaaauuuuaaaguuuuuguuuagaaucuuuguugauacucuuaucaauaagauaaaaauguuuuaaucugaccgaaguaccagaaacacuuaaaaacucaaagggggacauuuuuauauauugcugucagcacgaagcuuuuguaagauugauuucauagagaaguguuucuaaacauuuuguuuguguuuuagugaaaucuuaagagauagguaaaaaucagaguagcccuggcuaagggucuugguaguuacaacgagugugccugcuccuaccacccccacccccaccuugagacaccacagaauuucucauagagcacagugugaauucuauugcuaaauuggugguaugggguuucucagcagagaaugggacaucacagugacugacaaucuuucuuuuauagguuggaaacuauuugggggacuggagggauacugucuacacuuuuuacaauuuuuauugauaagauuuuuguugucuucuaagaagagugauauaaauuauuuguuguauuuuguaguucuaugguggccucaauuuaccauuucugguugcuagguucuauaucagaguuuaaaagauuuauuggaguaugaagggaauguggaagaugacaugaugaucacuuuccagauaucacagacagaucuuuuugguaacccaaugauguaugaucuaaaggaaaauggugauaaaauuccaauuacaaaugaaaacaggaagguaauaaauguuuuuaugucacauuuugucucuucauuaacacuuucaaagcauguaugcuuauaauuuuuaaagaaguaucuaauauagucuguacaaaaaaaaaacaaguaacuaaguuuauguaaaugcuagaguccacuuuucuaaaucuuggauauaaguugguaugaaagcacacaguugggcacuaaagccccuuuuagagaaagaggacaugaagcaggagauaguuaauagcuaagugugguuguaguauaaagcaagaagcaggguguuucuuguauuaagcuguaagcaggaaccucaugauuaaggucuuuaucacagaacaaauaaaaauuacauuuaauuuacacauguauauccuguuugugauaaaaauacauuucugaaaaguauacuuuacgucagauuuggguuucuauugacuaaaauguguucaucgggaaugggaauaacccagaacauaacaagcaaaaaauuaugacaaauauauaguauaccuuuaagaaacauguuuauauugauauaauuuuuugauuaaauauuauacacacuaaggguacaaagcacauuuuccuuuuaugauuugauacaguaguuuaugugucagucaguacuuccacauuuuugcugaacuggauacaguaggcagcuuaccaaauauucuaugguagaaaacuugggacuuccugguuugcuuaaaucaaauauauuguacucucuuaaaacgguuggcauuuauaaauagauggauacaugguuuaaaugugucuguuuacauaccuaguugagagaaccuaaagaauuuucugcgucuccagcauuuauauucaguucuguuuaauacauuaucgaaauugacauuuauaaguaugacaguuuuguguauauggccuuuucauagcuuaauauuggcuguaacagagaauugugaaauuguaagaaguaguuuucuuuguagguguaaaauugaauuuuuaagaauauucuugacaguuuuauguauauggccuuuucauagcuuaauauuggcuauaacagagaauugugaaauuguuaagaaguagguguaaaauugaauuuuuaagaauauucuugaauguuuuuuucuuggaaaaauuaaaaagcuaugcagcccaauaacuuguguuuuguuugcauagcauauuauaagaaguucuugugauuaauguuuucuacaggaauuugucaaucuuuauucugacuacauucucaauaaaucaguagaaaaacaguucaaggcuuuucggagagguuuucauauggugaccaaugaaucucccuuaaaguacuuauucagaccagaagaaauugaauugcuuauauguggaagccggguaagaaagcaggugucugcaaaaagucauguaucgauuuauuguuuguaaugauacaguaguauagcagauaacuaagacauauuuucuugaauuugcagaaucuagauuuccaagcacuagaagaaacuacagaauaugacgguggcuauaccagggacucuguucugauuaggugagguacuuaguucuucagaggaagauuugauucaccaaaggggugugugauuuugcuucagaccuuuaucucuagguacuaauucccaaauaagcaaacucacaaauugucaucuauauacuuagauuuguauuuguaauauaaucaccauuuuucagagcuaaucuugugauuuauuucaugaaugaaguguuguuauauauaagucucauguaaucuccugcauuuggcguauggauuaucuaguauuccucacugguuagaguaugcuuacugcugguuagaagauaauuaaaauaaggcuaccaugucugcaauuuuuccuuucuuuugaacucugcauuugugaacuguuacauggcuucccaggaucaagcacuuuuugagugaaaugguagucuuuuauuuaauucuuaagauaauauguccagauacauacuaguauuuccauuuuacacccuaaaaaacuaagcccugaauucucacagaaagauguagagguucccaguucuaucugcuuuuaagcaaaugcccuuacuacucuacugucuacuucuguguacuacaucauccaauucugaaagacauaggcuuccccauccccugcuaagacugguucaaguggcagcuacugauggauugcagugagaaggcaugcaaacacguaccuuccuggaaguugucuccaaaggcuauugcucuaagacucaaguauauaaacacuagaaugaauaucaacucuaucuagcaauaaauguuauuuuuauauuacaguugacccuugaacaacacagcugugaacuucaugggcccucugacaugcagauuuuuuuucucaacuaagagcagauucaguauuggugggacucagaaccugcauauacagagggcugacuuucauacaugccaguuucacagggccaacugcagaacuugagcgugcauggauuuugguauacacacgugguccuggaaccaaucccugucacauauaccaagggauggcuguauguuacuuuauauucauuuguucuguuauuuuauaagguuguucgucgugguaugugggaauucaccaguauuucuucuuucuggugcaccguuggucauuucuggcagcaguggugaauguauuuacucuuagcaaccucugugcugcuaccuguucugaguuucaaaggugauucauuaaaggguugggauaacauggugauaggaaaaaccccccucaucagucacaaggaguauaacagcaauaucucuguaauaugauugaucauagauauaauuucuaguaggaaaaaaagucauaucuugaugcaucucugagaauaguugaacauaucuugugcuauucuuuauagagaaauuaucuuugaaauuaaagucuuaauuuuacuucuagcuuuuuauaacaacauaaucccuacuugguauguaucuuaagaucauuuuuaaauguaugauuugaagggcaaacuaguguuaugugaaaaaugacagauaaaguagcuuccaacucauccucaagaguugaugauauucuaaaccuuuucuaacuaaauucagcuucuuaauuuucucaauauaaauaugaugaaaauauuaauucauuaaauagucuacaaguauucgguaguugaagacuuaaaguagugcuuguaauaacagaagagaaaaaagacauuacaggcguaucucacuuuauugcacuuugcagauacugaguuuuuuugguggcaacccugcaucaagcaggucuaccagcaccauuuuuccaacaaaaugugcucacuucauuagcauuuuuagcaaugauuuuaaauuaagauaauguacuuauuuuuagacaaugcuguuacacacuugacuacaguauaauguaaacguaacuuuuauaagcacugggaaacaaaaaaauuugugugacucacuuuacugccauaaucacuuuauuugccauggucugaaacugaaccggcaguaucucugggguaugccuguauagauauuuugguugguauuuauuuauuguaugcagaauucauaaaaauaaaaacugcgaggcuguuuaauacauuucaacuaaaaguugccagcaucauuaauauguaaaccacuagaaauaagauuuuguuaauuuuuuguuuguuuguuuaaacagucuugcucugucacugaggcuggagugcaguggcgcagucucaguucacugcaaccuccgcuuccuggguucaagugauucuccugccucagccuccugaguagcugggguuacaggugcacaccacuacaccuggcuaauguuuguauuuuuaguagagauaaggguuuugccauguuggccaggcuggucucaaacuccugaccucuggugauccgcccgccucggccucccaaagugcugggauuacaggcgugagccaccauaccuagcaaaaucaacucugaaucugaaucaaaccuuugaaacaaaaauuaccaaucaaaaaaacgugcaaucccugcuccuaacuuugaaaaagugacaaggaaggacauuuggaaagaugucucuaagcagucaacaagaaaugaaaucagggagagcuuuuucagcaccugaaaaaauacaugcaaaaacgcccgaggcgggcagaucaccggaagccaggaguuugagaccagccuggcaaacaugggggaaaccccgucucuacuaaaaauacaaaaauuagcuggguuugguggcaggcagcuguaaucccagcuccucgggaggcugaggcaggagaaucgcuugaaccugggaggcggagguugcagugagccuagaucgugccacugcacuccagccugggcaacagagugagauuccaucucaaaaaaacgaaaaacagauucagaguuuauuuccuucccaaauacuucauagauguugguuuguaggaauaacuuaaaagucucacucgcuuucugucuuuucuaguaauuuuuaucguggauucugauugccuagaucugcuaauucauugaggguuacaaaauugugauacucgaauucuuuauuccuccuuccuuuauuaccuguaauacuucuuaagaaaaacucuuucucaucaacucuaugacuacccuaaauuacagauccacauauaggaucuguauacauguauauaaauauguacauaucauauacgauaaugcuuaauucuuucccauuacuuacuaauuuucaaaauaaugugauucccuaacugcucucugaauguuaucaauguggugguaauaaugguggugucgauguugugugggguaaaauuugaauacagugaaauacccagggcuuaauuggguuaguuuuuaaaaauuacauuuauguaaccauauuucagucaagguguagacuauguccaucagcacagaguucccauguuuucccuuccagugaaucuccaucccccauuagaacagacaauaacuguccuaauuacugucacuguagcuuacuuuugucugcucuagaauuucuuaugaauggaaucuuauguacuuguacugcaugaagacucuuuagauucauccauguuauugcauugauuuauagugccuuuuaaaaaauuauagaguaguguugcauuauaugaauacgcaaaguguuuuuuuuuuaccuguugguggacaguuggauuguuuccaguuugggacuauugugaauaaagcuguguagucuuauuguggaaauguuuuauuucuccugggcaaacauguaggaguggaguuuccaaagcauauagcaggugcauauuuaacuaaaagugucuuuuccucauuuuuaauauuggauuuuuguauuucuauugacuauagauauuuucuuaaaauauagcaguaugucuuauccuuaguuuugcuuuuuuuugguuucaguuaucuuuggucagcagugguccaaaaauauuuauuaaguagaaaauuccaugaauaauucaggguuuuugauguauguguguguuggcgggugcagggcagggagaguugguugguugguucguugguuuuuuuuuuuuuaaagagacaaagucucugucauccaggcuggagugcaguagcaugacuacagauuguuauaaacugaaacuccugggcucaugcaaucuucuuaccucaguccucugaguaucugggcucaugcaaucuucuuacgucagcccucugaguagcugguacuacaggugugcagcuaauuuuuaguugguuauuuuuuuguagaaacagggucucacuauguugcccaggcugguuucaaaccccuggacucuagcaauucuuccacuucagccuuccaaagugcugggauuacaggcgugagccacugcacccagccaacaacucuuaaguuuuaaauuacaugcuauucugaguaacauggugaaaucucccaccuuuccacccagggcaugaauuaucccuuuuuccaguauaucguuguugucuagacuacccaccacuuuuagucuacugguuaucagaucgacuguugcaguaucacaugcuuguguucaaguaacccuuauuuuacuuaauaauggcccuaaagcacaagagcagugauguuggaaauucgaauauauaugccaaagagaagcuggaaagugcuuccuuuaaggaaagaauuuaaaaaucauauguugagguugcuaaaaucuaugguaaaaaugaguauuguaucuaugaaauugugaagaaggaaaaauaaaucaugcauaguauauacaggguucaguacuauuugcaauuucagacaucacuggaggucuuggaacguauuccccauggguaaguggggaauacuguauauucuauauaaaaggcccauuucugauaaguaguuuaugauuauuuucuccaaguuuucauuuucuuaagugucuucuggugagcagaaauuauucauuuuuugaggucuaauuuauuuuuucuuuuaugguuuuuuauguccuuuuauaucuuugccuagcccaaagccacaaauaucuuauguuuucuucuaauuguguaauauagguuuaacuuuuauguguaaaucugugauccaccaccaauaaaauuuugugaugcuguuagacaguggaugucauucauuuucuaaauaguuuuauuuauuuguuccaguaccauuuguuaaagagacuuuucuuuccccauugaauugccuuugcaccuuuguugaaaaucaaucugugugugagccguguuucuggauucuccauucuguucuauuaauuuguuuuguccuuuugccaaaaugacacuguuaugguuacugcagcuucaaaucagaugcugugagucccacaacuuuuucauuagguugcuuugacuuuuauuugcauauaaauauuagaaucaguuaauuuuuacaaacaaaagggcaaagccugcagagauuuugauuuggguugccuugacuggggcaggucaauuuggagagaauucacauuuuaacaauauauucuuccaauccuugaacaccguacgucucuccauuuauuuagauguuuguuaguuuaucucagcacuguuuuauaguuuuuaauguugaaaucauguacucuuugguuaggaauaaacuuaaaauauguuucuaaugcuauuagugguauuuuuuaaauacugcuuuucacuuguuuauuacuaucuugaaauaaaaucgauuuuuauauauugaucuuauauccuauaaccuuucuaaauugacuuauucuaguaguuauuuaguagauuucauaggguuuucuaguaaacagcuaugucaucuacaaaucaagacagguuucuuucuuuccaauguuuauguuauuuauuacuguuccucuauugcacuggcuagaaccuuugguagaagguauucuuacuuuauuccucauuuuauugagagagacuauaauauuuaccauuaacugugauguuacuuguaaacaaaaaguuuguauuucucugggauuaaaaaccaagaguccauuugguuuuuuacuguugaguuuuaaggguuccuuauguauuuucuagguauguucuuccuucauugaauuguuuuuuucacauacguuaaaaaucacuugagaauauuuauauaggucugcuucugagauuuaucuguuuaucagguuuuguuucauuuauuuugaggcucuaucauuugguucauacccauuuagaauuacuaugucuuggugauugguccuuuaucauuauauaaguuuuuucuguuuugcgauuuucuuugcucugaaucugauaugaguguaaccauuuguuuuuuuuuaaauuaauguuugcaugaucugucuuuuacuaucauuuuacuuucauccuguguugcugaauuugaaacgaaucucuuguaaacagcauauaguugucauuuuaauaaaaacuguuagucucugccuuuuaauuuuuuuauuuagaccauuuauauuuaagguaauuauugauauguuagggagaggucugccauuuuauuauuuguuuucuguuucugucuucuguuuaugguuauuuauuuauugccuuccaugauuacuugaacauuuuuuaagauuuuuaagacccuugauuuauuuaguguuuggguuuuguuuuguuuguuuguuuguuuuuguuucgagacacagucucgcucuguugcccaggcuggagugcaguggcacaaucucagcucacugcaacaucggcuucccagguucaagcaauccucccgccucagccuccuggguagcugggacuacaggcacaugccaccacaccuggcuaauuuuuguauuuuuauuagagaugagguuucaccauauuggccaggcuggucucgaacucuugaccuugugaucuguccaccucagccucccaaagugcuggaauuacaggcaugagccaccaugccuggccuucuauguguuuuuuauaguuguuuucacggucauuguggguaucacauuauagauaaugugacuuaccaccauucacugccaucaauaccauuacauggaaugagauauggaaaccuuaauuucaguugggucucuuuccccacuuuuaaauaguauuguuuugaggauuaaugcuauuacaguuuuuguaucaguuauccaauaugacuuauagaacuuaucaagggagugaugcucuguuguauguacccauguuucugcuauuuccauuauuuuuuccaagauuccaucuuuuauuacuuccauuagccagucuucaaaggcaguucugcuagugagaaauucuuuuuguuuuucucuuucugaagaugacuuuauuuucccuuuauucccaaagaauaguuuuauuugugcuauuugggguucgcucagcuucuugaagcuguaaguuugugucuuuugccaaacauggaaaauuuucaaccauuauuucuucagguguucuuucagcgucacucuuuucuccauucuaggccucuaaugauacaaauguugagucauuuguuacuguuccacauggaccugaggcaugguucauuuuucagucuauuuucucucuuuuguucagauuucucuccuuugucaucuucacucuacuguugagcccaucuaaugauuauuuuucuccuauuguauuuuuuaggucuauaauuuccauuugcuuuuuuuuccuuguaucuuguuuccuugcugagauuuucuauuguuucguuuuugaaacaguagaacuuguaauugcuugucaaaucauuucucugauggcagcauuaagauccuugccagauaauuucagcaucuuacucaucccaguguuggcguuuucuuuccuucauguaauuuuccugguucuugguaugacagauaauuuuuggauugugucucggacauuuuaguuauuauaucaggagacucuguacuuuuuaaaaauuuuaacuucaguaguaaccuguuaagguauagcauguagguacuagcauauauuugugagcugugguuccagugaccauuuuucagaggcuuuauggugcuguuuugguuuguugcuuuuaucucaguccacuggggcucgcacugguuccuaguagugcugcuugaggggccuucuccaggcugagcugcgcagaguguguuugggugagggaagaggacccccacuagauuuucgugggcuggagagugcuuccugagccuugugccuguuguggcaggcucccccuugcugguguuccuggcagugcuccugaccacauugugucccugggcuguggaacacuugcaggaaaggugaacacugccaggaccaauuauagcagaauuccuccugccaguacacagcagcacuguggcucuggaccagcaaggagagucucaagcauggguuuguuucuuuuugauuuuaagauuuuucuucugccuucagguucugguauuauuguucuguuuuauucaccuuuauguuucuucuaguuuaguuuuaguuucuuuguauuugaugggauuuuuuuccuugcauuucuaauuacuccuuaguugugucaugucuuccuuuuuuucaguuacccucauucagaaauuucccauuucuaaugauuuguuauuuuuuaaauucuuuuuagcucaguuugaaauuuguuuacaguuuucauguuuuauuugcauauuguuucauguacuuugauuuucuguagggacaccauucucauguauaugcacauacuuuuucucuaauaauuacacuguuucacucuguucuguuauuuauuuauuugugugugugugugugugugugugagugaaaugaguuucucauacuuggacgagggagagaugggccaggauaacuuuuuucgcuuuuuagggacgaggagaagucuguguuuuuguaaaauggucaaaaauaugcccuugugcuuucugaaacugccuucuuuacuccucuaucccacacauauauuugaacuuuuuuuugguuuuuauuacugaccugguccauucggaaguuauucccagaaguuuuuccucgguacaagguuuguuucugguggggguuugguauucggguguuuuaagggcccagagcuuacuacaucaugaucccuuuguaaucaucugcaaauuagauccuguagaacuuuuuaaaacuuuaagcccuguuuucagauuggccugugcuuuccaguggguuggcaguguucucagggcugucagaaacccagucaguuaccuugcaucugcuuccuuacuaaccagucuuguaguugucagagcuuuguuucuguccaauuauaugcaaugguucaugguuuuguuguagauaaugucucugggucuuugguuuucucauucaguuugcuguuuuuguaggggagguugggagggaauaaaacaaaaaauaauaauaauaauaacuaugucguugccaucaucaucuuuccagaaccugcuaccugcccuucaccugauuuucguauuuaucaguaucauuaccuuaaucuguuaucucauuggggauugcaaaauggcuguuuggggaaaaaaaauuuccaucugcuuguccuacauauauaccuggcauucuuuuuucucaucauugggugccauuugauuaccuugaaaaacaguucuacagaaaaggcaugauaaaauagauuuaagguuuuuagaguaaggaguuaauguaauaauuuuaauagugacaauuuaauuuuguuuuuugguugguuuuugcugccuuuuugaauauuacgaacuaaugaauguuuuuguauuuaauacguuucacagucauuacucuaaaugauauucaaauugcuuagcuaucgugugcuuuuaaaaugacccuauuagauuuugagauuucuaacuaaucucgaacauucauucucaggccuggaauaaguuauuuuuccaauaaauuguuggagaauggcauuuagaagucagauuuuagaugcaaaguauggccuuugcuuuugaacguuacugcuuguaggccuuaucagaggacagaacuaggaaaauaaucuuccuaguguauccugagaaucaucccacauuauugcagagguguuuuccauuuuguuuuguaugacugaauacugcuccuuuguguggaugcagcauagcuuaucaauauuuaugggcaucgagguuauuuuuaaccuuuugcuguuaguacuaaugucacagugaauccucuuaauguucaugcauuauuccguacauauguaaaguaucauuaagauaaauuguuagaagugggauuguugcaucaaaugguagaugcauguguaauuuugcuagauacugccaaauccuccuucacagaaaaauaacauuuugcauucccaccagcaguuuacaacaguaucucuuuucuuaaaacuuuccaaacagaauguguuguuaaauguggauguuuacuuauuugccaauugagaaaugguauuuuacuauaguuacaauuuuugagcuuaccucaauuaugaaugauaauggacauuuuuucuuguagagcuguuuauaguuuuauauagucuuuugcucauuuugcugcucagcuggucguuuucuucacuuuuagaaacuuuauauguuaaggagauuaguccuuuaacgcugguaaauucgcaaauauuuuuucccaguuugucauuugucuuuuaaccuugcuuauaggauuuuuuugccaaaugaaagguuuuauguuuauguaguuagcuauuaaucuuuuucguuauuaugcuuugauaugcauuucuuuaguuauguuuauuuuauucauuuucuuuguuuuuuaauuuucuagagucuguccucaguagaaauuuuagucauacugcuucuucuuuggucaccuuauaauaaaauuagccuuuauuuccaaaguuaccuugcauauuucuucaguauuuuuuaguauucuuauuuuuauuuaagaugugcucauuucuuucugaauuuguauuucucaucacugguggucugucuugucugcugcugcauucuccuuuuguguuggaaugugguguuacuaguuucccauuguuuaugacugaauuuuucuggucuacuuuugucuaccggaaaguuuugcuucucauucgccagacucuucccauaauaacuuuauuuagacuuccgaauucuguuuuucuuguuuauguuucuauaacagauguuacuuuuuucuggaccuguuauuacuagaccucaugguggagcagggaggaauuguguggcuuuaggggucuugguugaagggaucccucuucuguugcuuuaguaagggcagaaucaccacuuucugauuuuucagcuccauguagcuuaaugaagacucuuuuucauuagcugcuuccaccccuuuacagccgcuuaagggacacuucugcuuuugaagguaccccccuuccuuucaugcauggugccuuccugagccugccauugcuggacccaaguacuuuucuguaguccuuccuuuaaccacccuguugccagugcucuaaccuacacucaguagugcucuguugaggggcaggugguggaggggguggggucuggccuugggugaucccuaaucaguaugauuccgcacaagccacucuucgauguagcuccugcuggacccugcucauuuccccacuucuuugguauuuggaguuuauuguucugucuccuaguuuuacucuagaccuaagucauagguuuuuuuuuuauuuuccccuuuuugauccggguagauuuuuagagaugugaguaggaugugaucgauacagccaccacuuuuauguggaaaccuggaagcuucuucguguuuucuucagcuuucuaaauauaugcauucuuguuuaauucaaaauguuaauguaacacacauaacacuuauaggaauagagaugcauuuuguucccuguuuucauuguauaaaauuuuuaaagguuucguuuaaaaguccaaagaaacagcuccguaauaauauagccagacuggucauugugaccacugcugaucugccacuuccugcagggucugucucuguucuucgguggugcucuuuggucuaccuccuuagguguagcugguucaguuaagcuucagagcccuccugcagugugaggaggcuuuauuaccacccacugcagggcagcuuuucugcuauguuggaggguucugugcuacagcagacuuguuuucucuugucagccuccccaaaaggaguaucaugaacugggguccgauuccucuccuccuuaccugagagaugcuccugcaaguuucauguccaguuuucuguuguuguguguuucuuuuuuguuuucucuugcugacugguggauuuguaaaggggcagggaagggaaguggcaagagauuggagaaagccaagaauucuaauaaaacuuuuaaguuauuucagauaaaugguguugcagcaccaaaaaugccagcauuuugguaauaaaaauaguauguugggauauuagaauaucaaaagguagaaaauuguaauuacugguuugggaugugugauguucucugcuaacauucuggaauuuuuuuuuuuuuuuuuuuugagaugaaauuuuuuuuuuuuuuugagauggcucaaaauguuucccaggcuagagugcaauggugugaucucagcucauugcagccuccgccucccauguucaagcaauucuucugccuuggccucccaaguagcugagauuacaggcaucugccaccacgcccggcuaauuuuuguauuuuaguagagacaggguuucaccacguuggucaggcugaucuugaaccccugaccucaggugauccacuggccucagccucccaaagugcugggauuacaggcaugagccaccacaccuggcucuggaaagaacuuucuaaauaacuauuaaaaugcauuuuauauuauauaagcaacuaaaaauacuuuuaauuuuuuuuuuaauuuuuuaaucuuaacauuauuuagcuauaggccaggcgcgguggcucaugccugcaaucccagcacuuugggaggccaaggugggcggaucacgaggucaggagaucgagacccauccuggcuaacauggugaaauccugccucuacuuaaacguacagaaaauuagccaggcgugguggcaggcaccuauagucccagccacuugggaggcugaggcaggacaauggcgcgaacccaggaggcggagcuugcaaugagccgagaucgcgccacugcacuccagccugagcgacagagcaagacucugucucaaaaaaaaaaaaauuuauuuagcuaugaacuaguguauauauguuuuauagaugccugauuauucaaauaaacuucaagauugcacuuuaugagcuuguauuucguuuuuuagaacucaaacuaacauaagugucauuaaaacauagcuuuuauuacauagauuuuaggaaugccacaggauaaaucauucucuuaaaauaacugcagguggcagaaaugucagaauaauucuccuccuccauacacagcacauauuacuuguuuaaaguauucuaguucauauaaaaauugaacuuuuguauuacugcuauuagguauguaguuguuugcauuuggggccaguugguuggggcagggggucuuuuuuucuuuuguccuuaaucuguaucacuuuuuccucccaaaguugaguuaaaggaugaguagaccaggagaauaaaggagaaaggauaaauaaaauauauacccaaaggcaccuggaguuaauuuuuccaaauauucauuucagucuuuuucaauucauaggauuuugucuuuugcucauuacugacugcauaaugugauuauaccauaguuuaaauagucacuuccuguuacuacacacuuggguuuucucaauuuuuuacuauuguaguacuaauauuuuacuauauuguaaucuaaucuaaauuuuuacguauucagagcuguucaggauaaauuugcuuggaaauuuuuaaaucaccagaagugauacuauccugauaauuaacuuccaaguugucucuuaauauaguuuuaaugcaaaucauaagcuuauguuaguaccagucauaaugaaugccaaacugaaaccaguauuguauuuuuucucauuagggaguucugggaaaucguucauucauuuacagaugaacagaaaagacucuucuugcaguuuacaacgggcacagacagagcaccugugggaggacuaggaaaauuaaagaugauuauagccaaaaauggcccagacacagaaagguagguaauuauuaacuugugacuguauaccuaccgaaaaccuugcauuccucgucacauacauaugaacugucuuuauaguuucugagcacauucgugauuuuauauacaaauccccaaaucauauuagacaauugagaaaauacuuugcugucauugugugaggaaacuuuuaagaaauugcccuaguuaaaaauuauuauggggcucacauugguuuggaaucaaauuagugugauucauuuacuuuuuugauucccagcuuguuaauugaaagccauauaacaugaucaucuauuuagaaugguuacauugaggcucggaagauuaucauuugauugugcuagaauccuguuaucaaaucauuuucuuagucauauugccagcaguguuucuaauaagcauuuaagagcacacacuuugcagucuuguaaaacagguuugaguauuuucuccaccuuagaggaaguuacuugacuucucagugaccuaaccucuaaagugcauuuacugauguccucucugugguuuuguuguggaaagauuuaguuaaaugaacuguaagaauucaguaccuaaaaugguaucuguuauguaguaaaaacucaauggauacaguaucuuaucaucgucacuagcuuugaguaauuuauaggauaaaggcaacuugguaguuacacaacaaaaaguuuaugauuugcauuaauguauaguuugcauugcagaccgucucaacuauauacaaucuaaaaauaggagcauuuaauucuaaguguauuucccaugacuuacaguuuuccuguuuuuuuccccuuuucucuauuuagguuaccuacaucucauacuugcuuuaaugugcuuuuacuuccggaauacucaagcaaagaaaaacuuaaagagagauuguugaaggccaucacguaugccaaaggauuuggcaugcuguaaaacaaaacaaaacaaaauaaaacaaaaaaaaggaaggaaaaaaaaagaaaaaauuuaaaaaauuuuaaaaauauaacgagggauaaauuuuugguggugauagugucccaguacaaaaaggcuguaagauagucaaccacaguagucaccuaugucugugccucccuucuuuauuggggacaugugggcuggaacagcagauuucagcuacauauaugaacaaauccuuuauuauuauuauaauuauuuuuuugcgugaaaguguuacauauucuuucacuuguauguacagagagguuuuucugaauauuuauuuuaaggguuaaaucacuuuugcuuguguuuauuacugcuugagguugagccuuuugaguauuuaaaaaauauauaccaacagaacuacucucccaaggaaaauauugccaccauuuguagaccacguaaccuucaaguaugugcuacuuuuuugucccuguaucuaacucaaaucaggaacuguauuuuuuuuaaugauuugcuuuugaaacuugaagucuugaaaacagugugaugcaauuacugcuguucuagcccccaaagaguuuucugugcaaaaucuugagaaucaaucaauaaagaaagauggaaggaagggagaaauuggaauguuuuaacugcagcccucagaacuuuaguaacagcacaacaaauuaaaaacaaaaacaacucaugccacaguaugucgucuucaugugucuugcaaugaacuguuucaguagccaauccucuuucuuaguauaugaaaggacagggauuuuuguucuuguuguucucguuguuguuuuaaguuuacuggggaaagugcauuuggccaaaugaaaugguagucaagccuauugcaacaaaguuaggaaguuuguuguuuguuuauuauaaacaaaaagcaugugaaagugcacuuaagauagaguuuuuauuaauuacuuacuuauuaccuagauuuuaaauagacaauccaaagucuccccuucguguugccaucaucuuguugaaucagccauuuuaucgaggcacgugaucaguguugcaacauaaugaaaaagauggcuacugugccuuguguuacuuaaucauacaguaagcugaccuggaaaugaaugaaacuauuacuccuaagaauuacauuguauagccccacagauuaaauuuaauuaauuaauucaaaacauguuaaacguuacuuucauguacuauggaaaaguacaaguagguuuacauuacugauuuccagaaguaaguaguuuccccuuuccuagucuucuguguaugugauguuguuaauuucuuuuauugcauuauaaaauaaaaggauuauguauuuuuaacuaaggugagacauugauauauccuuuugcuacaagcuauagcuaaugugcugagcuugugccuuggugauugauugauugauugacugauuguuuuaacugauuacuguagaucaaccugaugauuuguuuguuugaaauuggcaggaaaaaugcagcuuucaaaucauuggggggagaaaaaggaugucuuucaggauuauuuuaauuaauuuuuuucauaauugagacagaacuguuuguuauguaccauaaugcuaaauaaaacuguggcacuuuucaccauaauuuaauuuaguggaaaaagaagacaaugcuuuccauauugugauaagguaacaugggguuuuucugggccagccuuuagaacacuguuaggguacauacgcuaccuugaugaaagggaccuucgugcaacuguagucaucuuaaaggcuucucauccacugugcuucuuaauguguaauuaaagugaggagaaauuaaauacucugagggcguuuuauauaauaaauucgugaaga

SEQ ID NO: 191781 - RNA, 101780 nt, Homo sapiens
ucuucacgaauuuauuauauaaaacgcccucagaguauuuaauuucuccucacuuuaauuacacauuaagaagcacaguggaugagaagccuuuaagaugacuacaguugcacgaaggucccuuucaucaagguagcguauguacccuaacaguguucuaaaggcuggcccagaaaaaccccauguuaccuuaucacaauauggaaagcauugucuucuuuuuccacuaaauuaaauuauggugaaaagugccacaguuuuauuuagcauuaugguacauaacaaacaguucugucucaauuaugaaaaaaauuaauuaaaauaauccugaaagacauccuuuuucuccccccaaugauuugaaagcugcauuuuuccugccaauuucaaacaaacaaaucaucagguugaucuacaguaaucaguuaaaacaaucagucaaucaaucaaucaaucaccaaggcacaagcucagcacauuagcuauagcuuguagcaaaaggauauaucaaugucucaccuuaguuaaaaauacauaauccuuuuauuuuauaaugcaauaaaagaaauuaacaacaucacauacacagaagacuaggaaaggggaaacuacuuacuucuggaaaucaguaauguaaaccuacuuguacuuuuccauaguacaugaaaguaacguuuaacauguuuugaauuaauuaauuaaauuuaaucuguggggcuauacaauguaauucuuaggaguaauaguuucauucauuuccaggucagcuuacuguaugauuaaguaacacaaggcacaguagccaucuuuuucauuauguugcaacacugaucacgugccucgauaaaauggcugauucaacaagaugauggcaacacgaaggggagacuuuggauugucuauuuaaaaucuagguaauaaguaaguaauuaauaaaaacucuaucuuaagugcacuuucacaugcuuuuuguuuauaauaaacaaacaacaaacuuccuaacuuuguugcaauaggcuugacuaccauuucauuuggccaaaugcacuuuccccaguaaacuuaaaacaacaacgagaacaacaagaacaaaaaucccuguccuuucauauacuaagaaagaggauuggcuacugaaacaguucauugcaagacacaugaagacgacauacuguggcaugaguuguuuuuguuuuuaauuuguugugcuguuacuaaaguucugagggcugcaguuaaaacauuccaauuucucccuuccuuccaucuuucuuuauugauugauucucaagauuuugcacagaaaacucuuugggggcuagaacagcaguaauugcaucacacuguuuucaagacuucaaguuucaaaagcaaaucauuaaaaaaaauacaguuccugauuugaguuagauacagggacaaaaaaguagcacauacuugaagguuacguggucuacaaaugguggcaauauuuuccuugggagaguaguucuguugguauauauuuuuuaaauacucaaaaggcucaaccucaagcaguaauaaacacaagcaaaagugauuuaacccuuaaaauaaauauucagaaaaaccucucuguacauacaagugaaagaauauguaacacuuucacgcaaaaaaauaauuauaauaauaauaaaggauuuguucauauauguagcugaaaucugcuguuccagcccacauguccccaauaaagaagggaggcacagacauaggugacuacugugguugacuaucuuacagccuuuuuguacugggacacuaucaccaccaaaaauuuaucccucguuauauuuuuaaaauuuuuuaaauuuuuucuuuuuuuuuccuuccuuuuuuuuguuuuauuuuguuuuguuuuguuuuacagcaugccaaauccuuuggcauacgugauggccuucaacaaucucucuuuaaguuuuucuuugcuugaguauuccggaaguaaaagcacauuaaagcaaguaugagauguagguaaccuaaauagagaaaaggggaaaaaaacaggaaaacuguaagucaugggaaauacacuuagaauuaaaugcuccuauuuuuagauuguauauaguugagacggucugcaaugcaaacuauacauuaaugcaaaucauaaacuuuuuguuguguaacuaccaaguugccuuuauccuauaaauuacucaaagcuagugacgaugauaagauacuguauccauugaguuuuuacuacauaacagauaccauuuuagguacugaauucuuacaguucauuuaacuaaaucuuuccacaacaaaaccacagagaggacaucaguaaaugcacuuuagagguuaggucacugagaagucaaguaacuuccucuaagguggagaaaauacucaaaccuguuuuacaagacugcaaagugugugcucuuaaaugcuuauuagaaacacugcuggcaauaugacuaagaaaaugauuugauaacaggauucuagcacaaucaaaugauaaucuuccgagccucaauguaaccauucuaaauagaugaucauguuauauggcuuucaauuaacaagcugggaaucaaaaaaguaaaugaaucacacuaauuugauuccaaaccaaugugagccccauaauaauuuuuaacuagggcaauuucuuaaaaguuuccucacacaaugacagcaaaguauuuucucaauugucuaauaugauuuggggauuuguauauaaaaucacgaaugugcucagaaacuauaaagacaguucauauguaugugacgaggaaugcaagguuuucgguagguauacagucacaaguuaauaauuaccuaccuuucugugucugggccauuuuuggcuauaaucaucuuuaauuuuccuaguccucccacaggugcucugucugugcccguuguaaacugcaagaagagucuuuucuguucaucuguaaaugaaugaacgauuucccagaacucccuaaugagaaaaaauacaauacugguuucaguuuggcauucauuaugacugguacuaacauaagcuuaugauuugcauuaaaacuauauuaagagacaacuuggaaguuaauuaucaggauaguaucacuucuggugauuuaaaaauuuccaagcaaauuuauccugaacagcucugaauacguaaaaauuuagauuagauuacaauauaguaaaauauuaguacuacaauaguaaaaaauugagaaaacccaaguguguaguaacaggaagugacuauuuaaacuaugguauaaucacauuaugcagucaguaaugagcaaaagacaaaauccuaugaauugaaaaagacugaaaugaauauuuggaaaaauuaacuccaggugccuuuggguauauauuuuauuuauccuuucuccuuuauucuccuggucuacucauccuuuaacucaacuuugggaggaaaaagugauacagauuaaggacaaaagaaaaaaagacccccugccccaaccaacuggccccaaaugcaaacaacuacauaccuaauagcaguaauacaaaaguucaauuuuuauaugaacuagaauacuuuaaacaaguaauaugugcuguguauggaggaggagaauuauucugacauuucugccaccugcaguuauuuuaagagaaugauuuauccuguggcauuccuaaaaucuauguaauaaaagcuauguuuuaaugacacuuauguuaguuugaguucuaaaaaacgaaauacaagcucauaaagugcaaucuugaaguuuauuugaauaaucaggcaucuauaaaacauauauacacuaguucauagcuaaauaaauuuuuuuuuuuuugagacagagucuugcucugucgcucaggcuggagugcaguggcgcgaucucggcucauugcaagcuccgccuccuggguucgcgccauuguccugccucagccucccaaguggcugggacuauaggugccugccaccacgccuggcuaauuuucuguacguuuaaguagaggcaggauuucaccauguuagccaggaugggucucgaucuccugaccucgugauccgcccaccuuggccucccaaagugcugggauugcaggcaugagccaccgcgccuggccuauagcuaaauaauguuaagauuaaaaaauuaaaaaaaaaauuaaaaguauuuuuaguugcuuauauaauauaaaaugcauuuuaauaguuauuuagaaaguucuuuccagagccaggugugguggcucaugccuguaaucccagcacuuugggaggcugaggccaguggaucaccugaggucagggguucaagaucagccugaccaacguggugaaacccugucucuacuaaaauacaaaaauuagccgggcgugguggcagaugccuguaaucucagcuacuugggaggccaaggcagaagaauugcuugaacaugggaggcggaggcugcaaugagcugagaucacaccauugcacucuagccugggaaacauuuugagccaucucaaaaaaaaaaaaaaauuucaucucaaaaaaaaaaaaaaaaaaaauuccagaauguuagcagagaacaucacacaucccaaaccaguaauuacaauuuucuaccuuuugauauucuaauaucccaacauacuauuuuuauuaccaaaaugcuggcauuuuuggugcugcaacaccauuuaucugaaauaacuuaaaaguuuuauuagaauucuuggcuuucuccaaucucuugccacuucccuucccugccccuuuacaaauccaccagucagcaagagaaaacaaaaaagaaacacacaacaacagaaaacuggacaugaaacuugcaggagcaucucucagguaaggaggagaggaaucggaccccaguucaugauacuccuuuuggggaggcugacaagagaaaacaagucugcuguagcacagaacccuccaacauagcagaaaagcugcccugcagugggugguaauaaagccuccucacacugcaggagggcucugaagcuuaacugaaccagcuacaccuaaggagguagaccaaagagcaccaccgaagaacagagacagacccugcaggaaguggcagaucagcaguggucacaaugaccagucuggcuauauuauuacggagcuguuucuuuggacuuuuaaacgaaaccuuuaaaaauuuuauacaaugaaaacagggaacaaaaugcaucucuauuccuauaaguguuauguguguuacauuaacauuuugaauuaaacaagaaugcauauauuuagaaagcugaagaaaacacgaagaagcuuccagguuuccacauaaaagugguggcuguaucgaucacauccuacucacaucucuaaaaaucuacccggaucaaaaaggggaaaauaaaaaaaaaaccuaugacuuaggucuagaguaaaacuaggagacagaacaauaaacuccaaauaccaaagaaguggggaaaugagcaggguccagcaggagcuacaucgaagaguggcuugugcggaaucauacugauuagggaucacccaaggccagaccccacccccuccaccaccugccccucaacagagcacuacugaguguagguuagagcacuggcaacagggugguuaaaggaaggacuacagaaaaguacuuggguccagcaauggcaggcucaggaaggcaccaugcaugaaaggaagggggguaccuucaaaagcagaagugucccuuaagcggcuguaaagggguggaagcagcuaaugaaaaagagucuucauuaagcuacauggagcugaaaaaucagaaaguggugauucugcccuuacuaaagcaacagaagagggaucccuucaaccaagaccccuaaagccacacaauuccucccugcuccaccaugaggucuaguaauaacagguccagaaaaaaguaacaucuguuauagaaacauaaacaagaaaaacagaauucggaagucuaaauaaaguuauuaugggaagagucuggcgaaugagaagcaaaacuuuccgguagacaaaaguagaccagaaaaauucagucauaaacaaugggaaacuaguaacaccacauuccaacacaaaaggagaaugcagcagcagacaagacagaccaccagugaugagaaauacaaauucagaaagaaaugagcacaucuuaaauaaaaauaagaauacuaaaaaauacugaagaaauaugcaagguaacuuuggaaauaaaggcuaauuuuauuauaaggugaccaaagaagaagcaguaugacuaaaauuucuacugaggacagacucuagaaaauuaaaaaacaaagaaaaugaauaaaauaaacauaacuaaagaaaugcauaucaaagcauaauaacgaaaaagauuaauagcuaacuacauaaacauaaaaccuuucauuuggcaaaaaaauccuauaagcaagguuaaaagacaaaugacaaacugggaaaaaauauuugcgaauuuaccagcguuaaaggacuaaucuccuuaacauauaaaguuucuaaaagugaagaaaacgaccagcugagcagcaaaaugagcaaaagacuauauaaaacuauaaacagcucuacaagaaaaaauguccauuaucauucauaauugagguaagcucaaaaauuguaacuauaguaaaauaccauuucucaauuggcaaauaaguaaacauccacauuuaacaacacauucuguuuggaaaguuuuaagaaaagagauacuguuguaaacugcuggugggaaugcaaaauguuauuuuucugugaaggaggauuuggcaguaucuagcaaaauuacacaugcaucuaccauuugaugcaacaaucccacuucuaacaauuuaucuuaaugauacuuuacauauguacggaauaaugcaugaacauuaagaggauucacugugacauuaguacuaacagcaaaagguuaaaaauaaccucgaugcccauaaauauugauaagcuaugcugcauccacacaaaggagcaguauucagucauacaaaacaaaauggaaaacaccucugcaauaaugugggaugauucucaggauacacuaggaagauuauuuuccuaguucuguccucugauaaggccuacaagcaguaacguucaaaagcaaaggccauacuuugcaucuaaaaucugacuucuaaaugccauucuccaacaauuuauuggaaaaauaacuuauuccaggccugagaaugaauguucgagauuaguuagaaaucucaaaaucuaauagggucauuuuaaaagcacacgauagcuaagcaauuugaauaucauuuagaguaaugacugugaaacguauuaaauacaaaaacauucauuaguucguaauauucaaaaaggcagcaaaaaccaaccaaaaaacaaaauuaaauugucacuauuaaaauuauuacauuaacuccuuacucuaaaaaccuuaaaucuauuuuaucaugccuuuucuguagaacuguuuuucaagguaaucaaauggcacccaaugaugagaaaaaagaaugccagguauauauguaggacaagcagauggaaauuuuuuuuccccaaacagccauuuugcaauccccaaugagauaacagauuaagguaaugauacugauaaauacgaaaaucaggugaagggcagguagcagguucuggaaagaugaugauggcaacgacauaguuauuauuauuauuauuuuuuguuuuauucccucccaaccuccccuacaaaaacagcaaacugaaugagaaaaccaaagacccagagacauuaucuacaacaaaaccaugaaccauugcauauaauuggacagaaacaaagcucugacaacuacaagacugguuaguaaggaagcagaugcaagguaacugacuggguuucugacagcccugagaacacugccaacccacuggaaagcacaggccaaucugaaaacagggcuuaaaguuuuaaaaaguucuacaggaucuaauuugcagaugauuacaaagggaucaugauguaguaagcucugggcccuuaaaacacccgaauaccaaacccccaccagaaacaaaccuuguaccgaggaaaaacuucugggaauaacuuccgaauggaccaggucaguaauaaaaaccaaaaaaaaguucaaauauaugugugggauagaggaguaaagaaggcaguuucagaaagcacaagggcauauuuuugaccauuuuacaaaaacacagacuucuccucgucccuaaaaagcgaaaaaaguuauccuggcccaucucucccucguccaaguaugagaaacucauuucacucacacacacacacacacacacacaaauaaauaaauaacagaacagagugaaacaguguaauuauuagagaaaaaguaugugcauauacaugagaauggugucccuacagaaaaucaaaguacaugaaacaauaugcaaauaaaacaugaaaacuguaaacaaauuucaaacugagcuaaaaagaauuuaaaaaauaacaaaucauuagaaaugggaaauuucugaaugaggguaacugaaaaaaaggaagacaugacacaacuaaggaguaauuagaaaugcaaggaaaaaaaucccaucaaauacaaagaaacuaaaacuaaacuagaagaaacauaaaggugaauaaaacagaacaauaauaccagaaccugaaggcagaagaaaaaucuuaaaaucaaaaagaaacaaacccaugcuugagacucuccuugcugguccagagccacagugcugcuguguacuggcaggaggaauucugcuauaauugguccuggcaguguucaccuuuccugcaaguguuccacagcccagggacacaauguggucaggagcacugccaggaacaccagcaagggggagccugccacaacaggcacaaggcucaggaagcacucuccagcccacgaaaaucuaguggggguccucuucccucacccaaacacacucugcgcagcucagccuggagaaggccccucaagcagcacuacuaggaaccagugcgagccccaguggacugagauaaaagcaacaaaccaaaacagcaccauaaagccucugaaaaauggucacuggaaccacagcucacaaauauaugcuaguaccuacaugcuauaccuuaacagguuacuacugaaguuaaaauuuuuaaaaaguacagagucuccugauauaauaacuaaaauguccgagacacaauccaaaaauuaucugucauaccaagaaccaggaaaauuacaugaaggaaagaaaacgccaacacugggaugaguaagaugcugaaauuaucuggcaaggaucuuaaugcugccaucagagaaaugauuugacaagcaauuacaaguucuacuguuucaaaaacgaaacaauagaaaaucucagcaaggaaacaagauacaaggaaaaaaaagcaaauggaaauuauagaccuaaaaaauacaauaggagaaaaauaaucauuagaugggcucaacaguagagugaagaugacaaaggagagaaaucugaacaaaagagagaaaauagacugaaaaaugaaccaugccucagguccauguggaacaguaacaaaugacucaacauuuguaucauuagaggccuagaauggagaaaagagugacgcugaaagaacaccugaagaaauaaugguugaaaauuuuccauguuuggcaaaagacacaaacuuacagcuucaagaagcugagcgaaccccaaauagcacaaauaaaacuauucuuugggaauaaagggaaaauaaagucaucuucagaaagagaaaaacaaaaagaauuucucacuagcagaacugccuuugaagacuggcuaauggaaguaauaaaagauggaaucuuggaaaaaauaauggaaauagcagaaacauggguacauacaacagagcaucacucccuugauaaguucuauaagucauauuggauaacugauacaaaaacuguaauagcauuaauccucaaaacaauacuauuuaaaaguggggaaagagacccaacugaaauuaagguuuccauaucucauuccauguaaugguauugauggcagugaauggugguaagucacauuaucuauaaugugauacccacaaugaccgugaaaacaacuauaaaaaacacauagaaggccaggcaugguggcucaugccuguaauuccagcacuuugggaggcugagguggacagaucacaaggucaagaguucgagaccagccuggccaauauggugaaaccucaucucuaauaaaaauacaaaaauuagccaggugugguggcaugugccuguagucccagcuacccaggaggcugaggcgggaggauugcuugaaccugggaagccgauguugcagugagcugagauugugccacugcacuccagccugggcaacagagcgagacugugucucgaaacaaaaacaaacaaacaaacaaaacaaaacccaaacacuaaauaaaucaagggucuuaaaaaucuuaaaaaauguucaaguaaucauggaaggcaauaaauaaauaaccauaaacagaagacagaaacagaaaacaaauaauaaaauggcagaccucucccuaacauaucaauaauuaccuuaaauauaaauggucuaaauaaaaaaauuaaaaggcagagacuaacaguuuuuauuaaaaugacaacuauaugcuguuuacaagagauucguuucaaauucagcaacacaggaugaaaguaaaaugauaguaaaagacagaucaugcaaacauuaauuuaaaaaaaaacaaaugguuacacucauaucagauucagagcaaagaaaaucgcaaaacagaaaaaacuuauauaaugauaaaggaccaaucaccaagacauaguaauucuaaauggguaugaaccaaaugauagagccucaaaauaaaugaaacaaaaccugauaaacagauaaaucucagaagcagaccuauauaaauauucucaagugauuuuuaacguaugugaaaaaaacaauucaaugaaggaagaacauaccuagaaaauacauaaggaacccuuaaaacucaacaguaaaaaaccaaauggacucuugguuuuuaaucccagagaaauacaaacuuuuuguuuacaaguaacaucacaguuaaugguaaauauuauagucucucucaauaaaaugaggaauaaaguaagaauaccuucuaccaaagguucuagccagugcaauagaggaacaguaauaaauaacauaaacauuggaaagaaagaaaccugucuugauuuguagaugacauagcuguuuacuagaaaacccuaugaaaucuacuaaauaacuacuagaauaagucaauuuagaaagguuauaggauauaagaucaauauauaaaaaucgauuuuauuucaagauaguaauaaacaagugaaaagcaguauuuaaaaaauaccacuaauagcauuagaaacauauuuuaaguuuauuccuaaccaaagaguacaugauuucaacauuaaaaacuauaaaacagugcugagauaaacuaacaaacaucuaaauaaauggagagacguacgguguucaaggauuggaagaauauauuguuaaaaugugaauucucuccaaauugaccugccccagucaaggcaacccaaaucaaaaucucugcaggcuuugcccuuuuguuuguaaaaauuaacugauucuaauauuuauaugcaaauaaaagucaaagcaaccuaaugaaaaaguugugggacucacagcaucugauuugaagcugcaguaaccauaacagugucauuuuggcaaaaggacaaaacaaauuaauagaacagaauggagaauccagaaacacggcucacacacagauugauuuucaacaaaggugcaaaggcaauucaauggggaaagaaaagucucuuuaacaaaugguacuggaacaaauaaauaaaacuauuuagaaaaugaaugacauccacugucuaacagcaucacaaaauuuuauuggugguggaucacagauuuacacauaaaaguuaaaccuauauuacacaauuagaagaaaacauaagauauuuguggcuuugggcuaggcaaagauauaaaaggacauaaaaaaccauaaaagaaaaaauaaauuagaccucaaaaaaugaauaauuucugcucaccagaagacacuuaagaaaaugaaaacuuggagaaaauaaucauaaacuacuuaucagaaaugggccuuuuauauagaauauacaguauuccccacuuacccauggggaauacguuccaagaccuccagugaugucugaaauugcaaauaguacugaacccuguauauacuaugcaugauuuauuuuuccuucuucacaauuucauagauacaauacucauuuuuaccauagauuuuagcaaccucaacauaugauuuuuaaauucuuuccuuaaaggaagcacuuuccagcuucucuuuggcauauauauucgaauuuccaacaucacugcucuugugcuuuagggccauuauuaaguaaaauaaggguuacuugaacacaagcaugugauacugcaacagucgaucugauaaccaguagacuaaaagugguggguagucuagacaacaacgauauacuggaaaaagggauaauucaugcccuggguggaaaggugggagauuucaccauguuacucagaauagcauguaauuuaaaacuuaagaguuguuggcugggugcaguggcucacgccuguaaucccagcacuuuggaaggcugaaguggaagaauugcuagaguccagggguuugaaaccagccugggcaacauagugagacccuguuucuacaaaaaaauaaccaacuaaaaauuagcugcacaccuguaguaccagcuacucagagggcugacguaagaagauugcaugagcccagauacucagaggacugagguaagaagauugcaugagcccaggaguuucaguuuauaacaaucuguagucaugcuacugcacuccagccuggaugacagagacuuugucucuuuaaaaaaaaaaaaaccaacgaaccaaccaaccaacucucccugcccugcacccgccaacacacacauacaucaaaaacccugaauuauucauggaauuuucuacuuaauaaauauuuuuggaccacugcugaccaaagauaacugaaaccaaaaaaaagcaaaacuaaggauaagacauacugcuauauuuuaagaaaauaucuauagucaauagaaauacaaaaauccaauauuaaaaaugaggaaaagacacuuuuaguuaaauaugcaccugcuauaugcuuuggaaacuccacuccuacauguuugcccaggagaaauaaaacauuuccacaauaagacuacacagcuuuauucacaauagucccaaacuggaaacaauccaacuguccaccaacagguaaaaaaaaaacacuuugcguauucauauaaugcaacacuacucuauaauuuuuuaaaaggcacuauaaaucaaugcaauaacauggaugaaucuaaagagucuucaugcaguacaaguacauaagauuccauucauaagaaauucuagagcagacaaaaguaagcuacagugacaguaauuaggacaguuauugucuguucuaaugggggauggagauucacuggaagggaaaacaugggaacucugugcugauggacauagucuacaccuugacugaaauaugguuacauaaauguaauuuuuaaaaacuaacccaauuaagcccuggguauuucacuguauucaaauuuuaccccacacaacaucgacaccaccauuauuaccaccacauugauaacauucagagagcaguuagggaaucacauuauuuugaaaauuaguaaguaaugggaaagaauuaagcauuaucguauaugauauguacauauuuauauacauguauacagauccuauauguggaucuguaauuuaggguagucauagaguugaugagaaagaguuuuucuuaagaaguauuacagguaauaaaggaaggaggaauaaagaauucgaguaucacaauuuuguaacccucaaugaauuagcagaucuaggcaaucagaauccacgauaaaaauuacuagaaaagacagaaagcgagugagacuuuuaaguuauuccuacaaaccaacaucuaugaaguauuugggaaggaaauaaacucugaaucuguuuuucguuuuuuugagauggaaucucacucuguugcccaggcuggagugcaguggcacgaucuaggcucacugcaaccuccgccucccagguucaagcgauucuccugccucagccucccgaggagcugggauuacagcugccugccaccaaacccagcuaauuuuuguauuuuuaguagagacgggguuucccccauguuugccaggcuggucucaaacuccuggcuuccggugaucugcccgccucgggcguuuuugcauguauuuuuucaggugcugaaaaagcucucccugauuucauuucuuguugacugcuuagagacaucuuuccaaauguccuuccuugucacuuuuucaaaguuaggagcagggauugcacguuuuuuugauugguaauuuuuguuucaaagguuugauucagauucagaguugauuuugcuagguaugguggcucacgccuguaaucccagcacuuugggaggccgaggcgggcggaucaccagaggucaggaguuugagaccagccuggccaacauggcaaaacccuuaucucuacuaaaaauacaaacauuagccagguguaguggugugcaccuguaaccccagcuacucaggaggcugaggcaggagaaucacuugaacccaggaagcggagguugcagugaacugagacugcgccacugcacuccagccucagugacagagcaagacuguuuaaacaaacaaacaaaaaauuaacaaaaucuuauuucuagugguuuacauauuaaugaugcuggcaacuuuuaguugaaauguauuaaacagccucgcaguuuuuauuuuuaugaauucugcauacaauaaauaaauaccaaccaaaauaucuauacaggcauaccccagagauacugccgguucaguuucagaccauggcaaauaaagugauuauggcaguaaagugagucacacaaauuuuuuuguuucccagugcuuauaaaaguuacguuuacauuauacuguagucaaguguguaacagcauugucuaaaaauaaguacauuaucuuaauuuaaaaucauugcuaaaaaugcuaaugaagugagcacauuuuguuggaaaaauggugcugguagaccugcuugaugcaggguugccaccaaaaaaacucaguaucugcaaagugcaauaaagugagauacgccuguaaugucuuuuuucucuucuguuauuacaagcacuacuuuaagucuucaacuaccgaauacuuguagacuauuuaaugaauuaauauuuucaucauauuuauauugagaaaauuaagaagcugaauuuaguuagaaaagguuuagaauaucaucaacucuugaggaugaguuggaagcuacuuuaucugucauuuuucacauaacacuaguuugcccuucaaaucauacauuuaaaaaugaucuuaagauacauaccaaguagggauuauguuguuauaaaaagcuagaaguaaaauuaagacuuuaauuucaaagauaauuucucuauaaagaauagcacaagauauguucaacuauucucagagaugcaucaagauaugacuuuuuuuccuacuagaaauuauaucuaugaucaaucauauuacagagauauugcuguuauacuccuugugacugaugagggggguuuuuccuaucaccauguuaucccaacccuuuaaugaaucaccuuugaaacucagaacagguagcagcacagagguugcuaagaguaaauacauucaccacugcugccagaaaugaccaacggugcaccagaaagaagaaauacuggugaauucccacauaccacgacgaacaaccuuauaaaauaacagaacaaaugaauauaaaguaacauacagccaucccuugguauaugugacagggauugguuccaggaccacguguguauaccaaaauccaugcacgcucaaguucugcaguuggcccugugaaacuggcauguaugaaagucagcccucuguauaugcagguucugagucccaccaauacugaaucugcucuuaguugagaaaaaaaaucugcaugucagagggcccaugaaguucacagcuguguuguucaagggucaacuguaauauaaaaauaacauuuauugcuagauagaguugauauucauucuaguguuuauauacuugagucuuagagcaauagccuuuggagacaacuuccaggaagguacguguuugcaugccuucucacugcaauccaucaguagcugccacuugaaccagucuuagcaggggauggggaagccuaugucuuucagaauuggaugauguaguacacagaaguagacaguagaguaguaagggcauuugcuuaaaagcagauagaacugggaaccucuacaucuuucugugagaauucagggcuuaguuuuuuaggguguaaaauggaaauacuaguauguaucuggacauauuaucuuaagaauuaaauaaaagacuaccauuucacucaaaaagugcuugauccugggaagccauguaacaguucacaaaugcagaguucaaaagaaaggaaaaauugcagacaugguagccuuauuuuaauuaucuucuaaccagcaguaagcauacucuaaccagugaggaauacuagauaauccauacgccaaaugcaggagauuacaugagacuuauauauaacaacacuucauucaugaaauaaaucacaagauuagcucugaaaaauggugauuauauuacaaauacaaaucuaaguauauagaugacaauuugugaguuugcuuauuugggaauuaguaccuagagauaaaggucugaagcaaaaucacacaccccuuuggugaaucaaaucuuccucugaagaacuaaguaccucaccuaaucagaacagagucccugguauagccaccgucauauucuguaguuucuucuagugcuuggaaaucuagauucugcaaauucaagaaaauaugucuuaguuaucugcuauacuacuguaucauuacaaacaauaaaucgauacaugacuuuuugcagacaccugcuuucuuacccggcuuccacauauaagcaauucaauuucuucuggucugaauaaguacuuuaagggagauucauuggucaccauaugaaaaccucuccgaaaagccuugaacuguuuuucuacugauuuauugagaauguagucagaauaaagauugacaaauuccuguagaaaacauuaaucacaagaacuucuuauaauaugcuaugcaaacaaaacacaaguuauugggcugcauagcuuuuuaauuuuuccaagaaaaaaacauucaagaauauucuuaaaaauucaauuuuacaccuacuucuuaacaauuucacaauucucuguuauagccaauauuaagcuaugaaaaggccauauacauaaaacugucaagaauauucuuaaaaauucaauuuuacaccuacaaagaaaacuacuucuuacaauuucacaauucucuguuacagccaauauuaagcuaugaaaaggccauauacacaaaacugucauacuuauaaaugucaauuucgauaauguauuaaacagaacugaauauaaaugcuggagacgcagaaaauucuuuagguucucucaacuagguauguaaacagacacauuuaaaccauguauccaucuauuuauaaaugccaaccguuuuaagagaguacaauauauuugauuuaagcaaaccaggaagucccaaguuuucuaccauagaauauuugguaagcugccuacuguauccaguucagcaaaaauguggaaguacugacugacacauaaacuacuguaucaaaucauaaaaggaaaaugugcuuuguacccuuaguguguauaauauuuaaucaaaaaauuauaucaauauaaacauguuucuuaaagguauacuauauauuugucauaauuuuuugcuuguuauguucuggguuauucccauucccgaugaacacauuuuagucaauagaaacccaaaucugacguaaaguauacuuuucagaaauguauuuuuaucacaaacaggauauacauguguaaauuaaauguaauuuuuauuuguucugugauaaagaccuuaaucaugagguuccugcuuacagcuuaauacaagaaacacccugcuucuugcuuuauacuacaaccacacuuagcuauuaacuaucuccugcuucauguccucuuucucuaaaaggggcuuuagugcccaacugugugcuuucauaccaacuuauauccaagauuuagaaaaguggacucuagcauuuacauaaacuuaguuacuuguuuuuuuuuuguacagacuauauuagauacuucuuuaaaaauuauaagcauacaugcuuugaaaguguuaaugaagagacaaaaugugacauaaaaacauuuauuaccuuccuguuuucauuuguaauuggaauuuuaucaccauuuuccuuuagaucauacaucauuggguuaccaaaaagaucugucugugauaucuggaaagugaucaucaugucaucuuccacauucccuucauacuccaauaaaucuuuuaaacucugauauagaaccuagcaaccagaaaugguaaauugaggccaccauagaacuacaaaauacaacaaauaauuuauaucacucuucuuagaagacaacaaaaaucuuaucaauaaaaauuguaaaaaguguagacaguaucccuccagucccccaaauaguuuccaaccuauaaaagaaagauugucagucacugugaugucccauucucugcugagaaaccccauaccaccaauuuagcaauagaauucacacugugcucuaugagaaauucuguggugucucaaggugggggugggggugguaggagcaggcacacucguuguaacuaccaagacccuuagccagggcuacucugauuuuuaccuaucucuuaagauuucacuaaaacacaaacaaaauguuuagaaacacuucucuaugaaaucaaucuuacaaaagcuucgugcugacagcaauauauaaaaaugucccccuuugaguuuuuaaguguuucugguacuucggucagauuaaaacauuuuuaucuuauugauaagaguaucaacaaagauucuaaacaaaaacuuuaaaauuuugacauaaauuaaauuuuugcauuuaaauaaaaucuaagagacugaauuaaaaaaaugacaaagaacuuacugggugagagucucccaagucacgaaaaguuccuuuuuuccccauuagcuuccuguagacaaccaugggaaaauguacauccaguauacaguuauuguaaauagccagacccaguacuaugccaaucagaguaaacugacccucaguuucaaaagaagauggauuaaaccaaaacaauuuuguagauucaucguaugugaacauaccuauaagaaaugauuuuuaaaaauacauuacuuuuguauuuuauuaaggacugaugaauaauacaaauauaaacuuaaaauaauuaugcauauaaaacauuuaaaauauauguaauuaggcaugcaacauugauuucuauuauauuagcacuugagaaaacaauguccacauauaucugcuauaaauuggggugaauggugauauguaauuuuaugaagccaaaggaauaaaguaguaaguaauuugguggcaucggguagaaaaauacguuaauuaaauucaagcuuucuaauuuucuacuaacacauaagaaaaguuauauucaugcuuuauccacccauagcugaaaaauaaacauaaaaaaacaaaaaauggcuacauuuccaaaguguuucauuuauaaaaauauaauuacuuauaucuguaccacacguacuauuuuugaaaacaauuuuucauuuuuuuccuugagauggagucucgcucuguuacccagggugggcuggaguggcacgaucucagcucacugcaaccucugccuccuagguucaaacaauucuccugccucagccuccugaguagcuaggacuacaggugugcaccaccacgccagcuaauuuuuguauuuuuaguagagaagggguuucaccauguuugccaggauggucucaaccucuugaccucgugaucugccagccucagccucccaaagugcugggauuacaggcgugagccaccacaccuggccuaaaaaacaauuuuuaaucacaguaaagaaagguucguuuuuucaaaauuagacaauggugccaugaaauuuuucuagcauuuuccuaauaaaaucagaugaucugaaauacauaaaccuggauaaaucugaugaacuuagauaaacaaagcuauucaauacacauguuaauuaugggccaauacguaaaagaaaaguaguuucguagucuuucaauuucacauggucuucacuaugcaagccccaaucauggaggcuuuuuuuuuuuuuuuuuuuuuugagacggucucgcucugucgcccaagcuggagugcagcagcacucagcuuagugcaagcuccgccucccggguucaugccauucucuggccucagccuccggaguaguugggacuacaggcgccugcguggaggccuuuuuuauaucacucauuggaaaauuggggcccggugugguaguucacaccuguaaucccagcacuuuggggaggcugaggcaggcagaucacuugagcucaggaguucaagaccagccugggcaagauggagaaaccccaucucuacaaaaacacaaaaaauaagcugggugugguagcaugugccuauagucucagcuacuugagagggugaugcauggggaugguuugagucuucagccugggagguggagguugcagugagccgagacagaaccacuacacuccagccugggccucagagccagauccugccucccuccaccaaaaaauaaaagauuaaaaaaaaggaaaauuggaaucuuuggaaugaguacuacuaaaaauugauuucuucccuuuuaaaugacuaaggaaaaaaauuuuaauugaauuuaaaucauuuuacuacauguuuaguugcuacugugaaacaaugaaaacaucuuaagaauuaagucugaaaaaaaucuguaauuuccaauagaaaaguagagcuuagaaaucagaaaucaaauuauacaguauauaaguauuuuaaccuguuuauaagaauuuuaaaaucuuugaaaaugucauugucacuuuaaguuuaaaaauaaggagcuuuaacauguuuccuugaucacuaggaguaugaauuaagcuuaggacauuuucugaaugcaaaaugguuugaaaauuaaacaauucauauuugaguuucaugguuucuaucuaaacauuuuuuuuacaggccaaguuacaacauccauggaaaugcuuuuaguuauaaguaugguauuaacaggaucaagaacagcugacaaauaauuacaauuaauaaauuuguucaagcugacaauggugugucuaaaaaauuaaugaauuuaauaaaaugucacaaaugcccuuccuuggaaccaagagcaacaagcuauaaguuaaucagaauauaacucugaaguuccauuuuaggcacauuuucucauguuccagggagaaaagcaccauaaccuccugguaaaauacuccuuuuugauacuucuacugccaucacuucaguuaucuuacuggaacugcuuaaucuauguuuuuucuuacaaguauuucugcauauaaugcaaguaugcuuuauagcuaagguuuaacauuucuagauacaucaaaagcuagagcuaagguuuaccaaauuuaagaacuuuaugaaguuuauaauuuucuaucucaaaaagggcgucgucuuauguaucucugauuuacuuagaacaaacuacauacaaauggcauagcuuuuuaguuauuaauaaaacacuagcuagauuauagauaagggaugcgugugugugugugugugugugugugugugugugugugugugugugacuaagaacaguaacagaaaggucaacucaauuagaaucaacaggcuauaacagcucaaaucucaaagcugaagggaaaugacauacauuauucuaugcacacuccucacaauucugaugguaccuucaguggaaaccuuuuccuguaauugucauguacucaauuuuaaacguaagcaagcucaguuacuaagugguuauauuuacaguagaaacugaaccaguucagaauuaugaaguuaaguagacuacccaaaagacugcaucuuuucccuguucuacuuuaucacaaaagggaaaaaacuaaaauucugauccuucacuuucaaauuuccaaaucccaucagccuuucccaaacuguguucaauaacaacucuucuguuagggcagaaaaagaguucuggaguucaaaaaguuugggggaaacacuaccuauauuaagccccaagaaaucuuauagcaaauaaaccuaauuaaugugauaucagcuaguguuucugaacuuugagcaugacauacuugugagacagucucucaauacucuucaaaccauuguucuuugaaguucacaggucaggaaaaccgugaguuugaugaugguuuuagacaacaaaaagcaaagaaaucccuccaacuguuccaauauaccauucuaaagugcuuucaauucaguuuaccaaagagauaauuuccuucauuagaauauuccuucuaagaaauaaaagaauuugaauaaauuagugauacaaaucaguuccuaaaaccuacaaauucagucaugaugugugauucuggguaauccauaccaaauccuucuuuugcugcucuucauagcugaaaauauuuacaaaguaagauaaacaaauaacuaacucaaaagaugauacgacaccauaaucacauuacuaauguauuuaccaauaucuggauugaagauuuccuccacaaccagcugaaaaaauucuuuggaaacaccucccucaucaacuccuuguucuccuucaaauuccacauacaacugcuucuucaagucugcaggauuuuccauagcgaucaucucuagcuagugauugaaaagauaaacaugaaaagaagaugauugcuaguaucaggaaaaaaacaaaauaaaaacaaggaguaggauuaggaaacaaauacaaauuuuugacuuuuuguauguaaauggaaacagaaagcaaacugauaaaaagccagugaagacaaagauucagucuuaaagauaaucaaaaagacagacacaaaacagacacuagcauaguaaaaagcuaacuuuacugauuuguuaugaaauuaacauacaauuaauuaagauuuuauuacuuguguguuaagucuggacuacacaggacauggaaaagcagcuaaaucauuucagcaaaaacaauggaguagaggucuaaccucaaaauuguucauuaguaguccuuuauuagaauagaaacucaaggguuaagucuuaguaucuacuaagucauaaguaaaauauuucaauuaagaaaaauacacugaauacuaaagcaguuuauggucucucacaguaagacuuaguauaaauuaccaccuuuuaauggacuagaacccaucuuauauccacauuuccuuaaaaacaggugagacauaaccuuacucauguccuuacucuuuuuuuuuuuuuuuuugacaugaaaucucacucugucgccuaggcuggagugcaguggcgcgaucucagcucacugcaaccuccgccuccuggguucaagcaauucuccugccucagccuccugaguagcugggauuacaggcaggcgccacuacgccuggcuaaauuuuuuauuuuuaguagagaugggguuucacuacguuugccaggauggucuugaacuccugaccucaugauccgcccaccucagccucucaaagugcugggauuacaggcgugagcaacugcacccagcccuuauucuuaaauuguaaguuaacaaacuuuagugucuagcauuuucucaacuauaaaucuuuuaccaaauauuuuuguguaccuauagaauuaugaauauacaguaaccucauugagauuaaucauaaaaucaacacuagauuccaauauuaacuguuuauacugcauuuuguuuguuuuacuuuauguaucuaaaauuugcuaacaguaugacuguauccaguacauggauggauacuguaucuaguacauggauggauacuguauccaguauccaucauaucuccuaacuugccuucaaacaucuguuggcugguuaaaaaaauuuaaucuuggagaugaaaauuuaccaaaacaggauauuaaauguuuucagguuauuccaacuauuucaaacagaauuuuaaaaaugguuuugaaaaaugcaauaaucacugaaacaacuguaacacagcacuauaguaguuaaaguaauaauacucauuuggacaaucuagucugucuacaaaaaauaaaaucucauaaauuaacgcaucaggucagguugcccgagagcauuguuuuuucaaacuugucaccugcaacucauuaguggguagucuaauccauuuagugguuugcaaucagcaaugggaaaaucagaaugcauuccacauaguaauggaaccuacuguuuugugaaacuuuuguuucaauuagauguacagauggauaagcauguacugggaugcuauguaaaauacuagggauugcagucaaagaguuugacaaaacuagcugaaauuaucuucuggguaucuucaacuuuaggguccuauucugugaauuuagucuuuagcuuuaaauaaugucuguuguuguucaacaccgaucucuaauauuuacaaaaucauuuuuaggccacacaguuuacuuuuagacaauguuuuguuauggaaagaccaagagucagucagaauucaccuuacuagucccaacucucacuuaccauaacuuuuaaccuuuaaacuuuagcacgcgauucaauuaagccucaguuuccucaacauacuguaaguugugaaggcuuauuaagaauauaugagaacgaguguuaccuuuuaaaauaguuuugcucucugaacaacagauuugcaauuuuguguccccaaaggaacuugauauagacuaguuccaagaucuagagucaaacaaauguagaugugaaaauaaccuuggggaaaaaaauaguuucaguuggaaaccuguuucaagcuacggaguauacagaauucugaggagacuaaaauuagaauuaacaucuuagcucaaaugugggaccaggccaacauuccauauugccauguaauccauucugaguuuccuuaugccaguucccaacuggcuagguguuaaagauguaagucaguguuuauauuuaccuuuacauccaaagguauacuugcuuuuaucaaauauaauguauuccaaaguggggaaaaaaaagguuaucugguauuuagacugugcauucuacagcuuuuccccacuaacauucauagaugagagcugacuccuuaucaauguaaaaccuuuuaaaggaugugguggugaauuucuacaggauugagaggcccuguguucuaucuagucuuagcucuaccuaagacaugucaaaugauaacugaagcaaauuuaucuuuauucuccauaaaauauuacaugucuguccacuuccacugaucucuauucuaugcuccccaccuuggugccaaaagaauguaaugcaaugcaauauguucuauuguaaaugcaaacauacaacuuuaccucucuuauuucaucuguaaaauaaccauaauaauauaguaauaaauuaauguaugaacugcuuagauuaauucccugcauaaaguuagugcuuaaaaguacuagcuguuguugcuguuauuuuauugguucuaaaauauuuucugaaaaccuaccauagcauuauagaacaaaaauauuccaugaauacagcaacaauaauauauagcacuuuuguagcauuucacacauagcaacuaauuuaaucuucacaacacccuuaugaggaaggaaacauuaacuccacuuuacagauaaggaccccaagauacugaaaggugaaauaacuucaagucacaguaagucacaguaaguuguggaacagagauacuaauccaggaaacaagcucuuaacuacuaugcuuuacucacucucuucaaugacgaccaaaaauuuuuuuuuuaggauuaugagugauuuuuauuuuccuuauucuuuuccauauuuuuccauuuuuuacaacaaauacauuuuucagagucagaauguguucaaauauaaauauguaaaaagaauaauuugaaaaguaguugguaacugaauucuguaggcaaaaauuuuguuauuaccuauuuuagauuaccauucugguacacauaagugauuucauaaaauacuguaccacuuaagaauaaaggcugggcgccguggcucacaccuguaaucccaccacuuugggaggccaaugcaggcagauugccugagcccagcaguuugagaucagccugggcaacaugaugaaaccuuguuucuacaaaaaacuaauaaauaaauaaauaaauaaauaaauaaauaaauaaaaaauaguggggggugguggcaugcgccugucaucccagcuacuugggaggcugaggugggaggucaaggcugcagucaguagagaucgugccacuguacuccaggccugggugacagaguuaagacccugucucaaaaauuaaaauaaauaaaauaguaaaaacagaauacauaaauagccuuuaaaacuauuuuauuuuaaauuauuaacacauaaaauuuagcaauaaccauuuugauaaaggccauuauugcauaaacagcuguacugauaauucuuuuucuuaaaaauaaccuccaucaauuguucggucaauuuaaaaaagauuuaacaaauaaacuguaaagguguauucuuuacauaauagcuauauuauuuaaaauuguauguuguuguuuaaacccaaaccucaccauaaaacuguauuuuuuaagucagaaguuguuuuaaaugcauuaggauauuugaaauuuggaggacuaugucuaaacauucugaaaaggagaacgugcaugcaugccugaauuuauuuacaauacacacguggauuuuuaggguuuuuuuuguuuguuuuuuuuuuuuuuuugagacggagucucgcucugucgcccaggcuggagugcaguggcgcaaucuuggcgcacugcaagccccgccucccagguucaugccauucuccugccucagccucccgaguagcugggacuacaggcgccugccaccgcgccuggcuauuuuuuuuuguauuuuuuaguagagaugggguuucacuguguuagccaggaugguuucggucuccugaccuugugaucugcccgccuuggccucccaaagugcugggauuacaggugugagccaccgcgccaggccaauuuuuagguauauuuaaaaguacaguguauguuguauuuauuuaacauggagacuagcaacagacagagauuacuggggaaaaauaaacaaaaauauccuggauauaaucauaucuaccucuucacugcguaacuuccucuucuuuaagacucuugauuucaucaauugcuggauaaaaugauuuuuaauuucugaacuuuuuaauuggccaugaugaugaaauccuagggaguucauuuuuuaaaaaaaaaaucugaccugauaucaaagcauuugcagaauaccuagcaggaugacaucuuaauaucaaaauaugauauuacuagacuuacaggaaucaaaaggaaaaccuuaucacuuaaaaucuuauaguuuucugagcuauuacaucaaaucaauucauaauuuuuuaaaaaaauuccuuaauaccaugaauauuuaaguagaagcaauaaucagauaaaagagaccucuaauacuuaagaaugccugggauuucuaagaaaggcuagcuucaaggccgggcgugguggcucaugccuguaaucccggcacucugggaggccgaggcgggcggaucacgaggucaggagauugagaccauccuggcuaacacggugaaccccaucucuacuaaaaauacaaaaaaauuagcugggcaugguggcaggcgccuguagucccagcuacucgggaggcugaggcaggagaauggcaugaaccugggaggcggggcuugcagugagccaagauugcgccacugcacuccagccugggugacagagcaagacuccgucuaaaaaaaaaaaaaaaaaaagaggaaaaagaaagaaaggcuagcuucaacuacuucagucaacuugaggcuuaaacuauugcuugagauuuccagauuauccaaauuaauuuuuucauguucacgauaaacacaugaagaaaagucuguuauaucucaaauguaguuuaaauguuuggguaacaccaaaucacauaaucacguucguccaugagaccuggaauccugacuucuauuuccaauucugccauuaauuuauguaggcuggaaucucuuuuagauuucauuuuccucacauguaauacuaaguuugauguuucauugucuuaaauuauuauauaaugcugaggaucuauguauauauaggcuucauucucucauucaguuucugagaaauuacuuugagggcauaaaccaagcauauuucuugguuucauuuuugauuucaauuagaauaaaucacaagaaagaacaauggaaauuacauguuaaccacaauauaguguauguguaagacaaaauuaaacauaccuagugcagcacagaauaaucucauuuuuaaagcucugugagucaaugaauaaauaaaagaauuacguucauguuucacuaguaagaguguucaccaaugcuggaagcugggagcugaaaaugcuggaagcuggguuagacuaggcuauuagaaaccagauaaaaagggccagugacuuuuagaggggauuuugcagaaccuccugguaguggggcuuuuuaucugugccaaucaccuuuaucugugcuaauuccuauuuuugaacuucccuauucaauuccacaucucagccauuccuuuugguuuuuagauauuuaugugaaaugcuagaacucccugacuaauuggaaccaaguuucacaucaucaucauccucuauuccaagcuugcuguccccaugauccucuuaaaaaucugaguuuccaaaacacauaaacauacuuguauaucaaaauggccuuucucuuucucucuauauaugcacacauacacacauaaacacacaugcacacacacccccaccugagcugaaccaaaggccaucuucccaaauauuggagucuggcuuuaucaaaauauuuguggaguauuaccagaaguucagauucauaggcucuacaauacagcuucuaaucuaaaccucuagagguuagggcccuggauuuuauuuauuuauuuauuuauuuuuuuuaaacaauuuucccauucagaugugaaggcaguuugagggaccucaugauggcaauacuauauucuuccauaaacuuauaaccucuaucuucuccuuuaagaaguaauuuaaaaaaucuuaauacauacuaucauuggaagugcuucaucuaagaaaaaugagaaauuaucuacuuguaaaagaacacacaaauggguauauuuacauauuuguaaauauguaaauauuuacauauuuguaaauauguaaauauuuacauauuuguaaauauguaaauauuugcauauuuguaaauauguaaauauuuacauauuuaaauuaaauuaauuuacauauuaaauuaaauuacauauuuauauuaaaaauguaaauuuguaaauaugguuuuacauauuuguaaaaaccucaucacauuaggaaugucauucaaaugaaaggugaagucuaagcucauguuuaucacuguacuguuuucuaaggaacaauaacgaaaaaauacugaaaauaaguccuaggggaacuauggcaguaaguuaaacggguaggguggggguguucuuaagcaguucuaagguauuugugaagagacaacuuauauucuauugauucuaaaauucacuuuuuucacauuaucucugaaaucagauuacaccauacaaaugauagcaucuuacaaugaauugcugguauuuuucugucuuagcaguaauaaaaugauaguguuuccuacaaucagagauuagugaaaauacuaucaacaugaauucuucucuugucaucaaagacaauuucucuaaaaaccucaggaaaaaagcugcuagucugguuugaauuucacaauauauaaaagcaaugaauauauuuuucuuuuuuaaaaaaauccacaauuauuaauucaaguuaccacuccucaacagaaaacauacaagagucucauauaugaagucacuauuuucugggcuugauuucuaaacuaaggaguggauaacucuaagguuucuuuuagcucuuaaagccuaggaucccauaauuuuauuuaucaauauuaagcuuaccacaaaguuucucauuucuucuuuuccacccaacccugcuauacaauuccaaaauuagcaagucauaaaaaaguggccacuaguuuguucacugugauauauaagaaugaggcuuaaaaagcagagauccuugggaaauaagaucuugaaaaauucaucacuuuugagcuuucauaugagagaauaaucuuaaaccacuuucuauuauagaacuucuacuauguguuacuaaaauauguggcuuuaucauaaucaucaccugcugugaauacuuacuucaaaaaauuacacagguuaucaauuuuacuuauaagaccuauuucgaugcugguuuuucuagucuuuucacauucuguuauuuuuuuaaaaaaaagaaaaggaagaaaaagcaagggagaaagaaaguuaagaguaaaaucugcuuagugugagcauucagagccccuaaggaagcuucucuguaagcaucaucucuuucuauuuucacaguuuauuaaacugccuaacacacaugauuucugaagugaacugcuuuugugggcuggcaauauucaaguacauauacuaucuagugaauccugauuuaugauaggccacacuauauuaucuaauuuugauauaauuaagcagaacuugcuaaaaacaaguuaccauaauuaaagagcucacaguuaauuuuacacuaacaccuaaggcuuuaaaagcaguuguuuccuuaaaauucuagaauagaauuuaaaauauagaauaaaguauauaccaaguacuuaaacuuuuguuuuuagucuugcuuuacuagagaaaaaaaugggggacugaggaaaauaagacugaguagacuucugagcgaaagacagauaaggaagguagacaauuuuuugaacccuggaaugauucuuacaguguaauuucauugccuuuuaaaggcuagacauagcuuuugaugaagacagcugaagggaucucaccucaagaagccaaacauaaaguauguagcuuuggcauuugcaguucugcuccaacaauggauagucauagacagaccucaacauaccuuucauaaaacaucacucacauucuuauaaaauacccuaucauucugcuaaacuauguaaaguaaggugcuggcugccuuaugaucagucauuaaguguauuaauuauucaugugucucaaaacuauguaagugaaauaaaaaggguaccagaaagcaagcaauaauaaugacuucaggcaguuaaagcccccuuuugucucugcuagaaaaccaccugaguugcuuaaauaaugcagaaucuuucuccaacacuauaaacauaucugacauuaaaaaaaaaaaacaaaccaguaacaaaaaaaaaaaaaacacacaaaaucucugcaauuuuuaauuucugagaugucaaauaacuuuuuccaccgggcuacagcuuuaugaauucucgaauuuagacaauucuaaaacuaaaauuuagacauucuaaaacuaaaauacauuuuaaaguaaaaaucacauuuccuaguugucugugucagacaacuuuacuaguauacuauaguauuauuaacuaccuuaauuuuuguugacauuaaauuuuacuugaagaugauaaaaaaguagcagcaaugacagggauagcuaauacuagaaauacaauaaagcucugcgauaaugcaccugagacaaauguaaauuuuggugaaaugugacugacgacugcuuucugucuucuggccacucuuauauucuuaaacagauacacuaaaauuaucuuguggaggaaagaaaaggaacaaauggcaaccccaucuggaaaaccaggaaguuaggaugaguaccugaguuuccaguauuucccugcucaaucucccuggacuugauguuacaggcaccacuaauccccagauuuuuggaauagcugcuguuuuccagaaguuccaagacccagaguugucucuaugaauuuuuaagugggaagaaacuaccacagccaggcagugccguccacacagggauauucuaaguggcccagcaggacucaacucuuacuggcaacaggcacugaucugccauggucacuucaucaaguccacaauaaugcaacucugaauuuuacacgauggaauuuuuuggacacuaccuauaauuuuaugguaugguuuuacuguaccauuacucccaguucaagacugcacauccacacuuauuauuggguaucuccacauuucucuuguucuggucuuuguccaacacucuauucucuucugaaugaaagaaacuuuggauuuaguuuucaagauuuagaaaacccauucuuuuucaaagauagcaugaccauuauauaauacaaccgauacuuuguagaacacaucuauaaacuugcacaggaacaacaaaaguauaauacuuauauaagaucagaaauguccauguguuccuaugcuauaugguaucauuuuuuucagucacuuuuaaaaugaauucacugaacuguaucaugauauccccauuauuagguuuuuaaucuagcagcccaacuuacccggacaagugcaucaucuaugauauggucacgucuaacuuugagucucaaauauggauucaacugcuguccuugaacuaagcuguagagaacagugauucuucguucacuguacaugcgaauucuauugucauaauauaaucccaaauucuuugugacagcauucaauauaaagggacaugucauaaaagagaauuuguucucuguuucuacuuugaaaaaaguauaaucuuuauccauuucuagaaccucauucagugguucauuaauaaacucuucaaaagggauaagugguuuucgacaauccaggguuuuaacaccaaguucaguuuccaggggguccacucgaggaccuuucuuguuucuucuuucuucucccaaaaguuccugaagugucagcucgcuggacucagggaugggcucuucaucaucuucuucauugugauuuguguccacuuccccucccacuacauuugcauaguaaaccauuuucaagcacuucgaagcagcaacaauggcaucaucaucauucacuagauuucgacuguuaaauucauugcuuaugacuuuauaaguaauaaguugcugaaaugucuccaucauucuccgaaucuggucugcauuguauuuagaccacagucugaucaguuuuccuugggcugcaagggguagcuugcucaucgcuuugcaaaauaauggcaaagccauuuccagauauucaggacuguggagauuucuauucuccauuacgauaaugaacaaauucagauaauuaggaucucgagaguauacauugugauacgucaagucacauuccacguuaggugacaaauauacaagugcauugagaaaggcaguuucaauuuuuucauuagagagcaaucugguguagacccuucuaauggcaucaauauccacagacacaucaucagggccuaauuuuugcaaauuguugucucccugugagcuaucaccuauccuugaggaagaugcuucugagucuucuuccauagcagcagcagaacaugcagcuuuuuccuuuucaucuucaucuuugucuucaucuuuugcuugaagagauuucaguucuuccuugguguguuguuuaacuuuccggaagcucuguaccaaugccucagcacuagaaaaaacucuuccaauaacacggauuaaaggggaauaauccucucuuucucuacauaauucaagaauuucauauaccuucucuucuguuaaguaagucacaucuagaaaaucagaggaaaaaagagaacauuuauuuucauaauauguauguuuacucuguugcaaaaaguucuaaaaguaaaacagccaaacauucuaggcucaauaucauuuaugauauacaacucuuaaaguaucuaauacuuagauucagcaaacaaaauuuaaugcuuaccuauuuuuuucaaugaacuaccuaccuauaccaaugaccucacccaugcuuuuacauucuuucaacaauguauaacucuuaauaagaucaugaguuuaaacuuucuuuauaaucaagauaucuauuaauguauagcuuuaauuauaaauaugaaccaauaugucauguacugauuaaucauaauacagcucuuaaaaccucacuguagaacacacagaaauacuacuaaucugugaguuuucuuguuucaguacucuguucuccaaagacuaagaaggcaaggucuuaaaaaaaggcuccuucagcaucuauguauguauuaaaaucaaacugguucauuuugggucuuccuaguuuguuccaggguagucauucugugagugauugagaagaauauaccauuucucaucggcucuuaaguagaaacugcuuuccacagccaggaaucagguuagacuaaaucucauagagugacagaaaauaguuuuugagcaaugaaaacaaacagugcaaagaaguaaacuuaugagcuggcaagcagugcagagacuauguagucaucaaaaucuauuuccucuuuuccugggcacagaguuggaccacauuucccaacuuuuugagauaaguguuauuuucaggccaaggcuuucucccuucuggcuaauaggaugaaagauauuucauuucacagguaaaaacaaaugauauauuuuguguacugaccaacauaauacugagaauagucuuaauucucccuuuuaucaauaaagugacauacuugucaucaucagauuaacuacuugagagguuaauuuuagaggcacacagacaauccuaccuccauugcgccaaauauacccuuauacauguaguguacaacauguagaauuuuuaaugacucccaccucugcuauaauauauguuucacaaugaaagacaauauaaaauguaagugaucauugaauggucuccaaaaauugaagcacaaaaauaccaaauuuuaucauacuaaggaucugaucuguggcccagcuacaagaguaccaacacuuacaguuucuuuuaugggccuuaacucuuuaagaacuaauucucagguuuguucuauuaagaauauauaagcaucuuuugcuaaacaucaguaaccucuuccccaaaagcauaaaaccacuggaaaccuauuucucauuauuuucauugaaaauuuuuaaaauaccuucuuacaagacaaugcaaaacuccuaauuuccuaaaauguaacauaacagaaaauacuacuauccuauuaggacaugaaacacuuugcuuccugagcaagucauaagguuaacaaagacuugcuuugcaugcaguaauauggccuguccuagggaucaccauucuagacucacauguccuuuguugauaugucaugcuuucggaacaucuucaagugauucugacagucuacuaauccuauauagaauguaccuauacuuuuuccaaggaguguuuuuuguuguuguuuuuugacauggagucucacucuguugccagguuggaaugcaguggcaccauuucggcucacugcaacuucugccucccggguucaaacgauucuccuaccucagccucccaaguagcugggacuacagaugcacgccaccacaacuggcuaauuuuuuuguauuuuuaguagagaggggguuucaccacguuggccagguuggucucgaucucuugacgucgugauucgcccgccucagccucccaaagugcugggauuacaggcgugagccacugugccuggccuguaguguuuaauauguuaaacugaauuuuucagguauauagauaaaaauuagucaaaaaacacuguaauuagauaugaacauucaaaaaguuugguuuauugauacagguguucuacugagaaagacauuuuuauaagauuucuugugauaaaugugucccugaaaauacucaaucuuuuaaauuuugcacuuaaaaaccuccuacgcaaaaacaguuuggugcagacuacuuaauacuuaugcaacuuuguaauuaguguuaacaaacauaauuaauaaucaaaauaagaguacuaguguacagaaagcaucucuaauuuccaauauacaauaguaacuauagaacaaugcaaaaacaaaaacaaaaaaaccaguaacgaacagggaacaguaacaguagcauauuagaaaacagggauaaggaaaggucacaacugcuauaaugcagacuugagcaaaaagaggagggggcauaaagacuggauaaagccacacaauaagcaccucuaagauggagcacguggccaaaagagcagaugagcacauuccucauguaccacaucccccgcagcuggcugcauuccacugugccagcacucuacauucaguuacugguacucucuggugcacacuuacuggagaacuguguacaauaaagucaaugcagcuuccacauuauacugacacacuauauauacagacaacauuuaccuauuuucccauagugugugaacuaauucaugaaacagaauuauacacucugaagcaacaaaguuguguaaagugacgaaaauaauuuuauuguggaaacagaguagagguuauaacacaaugccacuucacuaauucuuucaaacuugauucaaaugauguuagugaaaguuuuagaggcaaaugccucuaaaauucucugacuuguaugucauaaaaaaaaagcuuucucucuuaaaauacaauugccucuggguguguguaggggugagaguggaggggcgcuaagcccugguagucauucaaaaauuugauuacuuuguuacuaauuaccuucacugaagaaaauaacuuggaguuuuaguauuagcgacaagguaaucgaauucugaauuuuggacguaggaccauuuagaaaacaaaagaccugagugaagacugucauugguaggucaugauccuuggcagcaugacuguaccaaauguccggaaggagagugagaagcauauaucugaaggaaacguagaauucucacauaacuaucacaaaauuuugucuugccuucaaaaauggaaaaaacccacuguuuccucuuucugcuucuuucaucacaucauccugagguuccagaacucaugccagauacuuaguccaguuauucuauaacuuaaauagauguuguggccuaguuuuggagauucacuaccacuuaauacauuuuuccuaagaauuuuaaaaaguucaaaucaaucuauuaacaaaugaacuuuuggcauaugaucugcuucuaauuagcaaugauuagaccuguaaaauguaguuauuauuccuguccguuaccacaauaaaaaauugguucuacgauaucaaaaugucuuuaugucacagaagaaaaaacaaauaaaaacuaauacauuuaaaucucccacaugguuuucaggcaacaauucucaauugaaaauaaaacaucuuaccuuuaaaaucaauucuagcgccuuucuuguucauuuuuaucucagagcaggaguuguugggggcaccuuucgaguucucaagguaagcugagcuugcuccuuucuuggagggaugaggaucacagaguuuugcauuaaucuuauaaagcucgagggcuuuaauagcugcugcauuauuauccauacgaagaaaaguuggacaggaagcacaaaacucauucgugcaggcuucauuuccacagcccucaguuaacuggugguaguagcguucuauuagaugcuuugcagcugcucgcuuccuguaccaaacauucaaacaauaagcacagugauuaguacagcucucaaguacaaagcucaacauaucaucaaggcaaaaguuagucaagcacugaagugauuaaccuguguaugaagaugagaaguagaaaauggagaugcacuauuuaccacaacuccugacuagugaaauaguuaauaaauauuuucuaggauauuaugauaaagaaugucaaugcuuacugacuguauuaacagaguauacauuccuuugguuuaaaaggggggaggggggcuugucugaugguauaugugcuuaaguuguuuaguacaacagcugaaaaaucacaagguuuacagcuaagaguuguaggauucuaucauuuuaaaaauuagcauuaggaaaaugagucuauuuaaagcaucaauccgguuuucuuuuacauaaucaguauuucauuuuuaacagcuuguaaacauuugacuuauaguuaacacagaauaucuaucuggaauaaaaacuauuuuucccaauuaucaacaacaugggagacuuaaaaauaaauuuguaaguggaauauccaaagauaguguuacacugaaagaaagcggcugcagccugagugaggcagaucaugacuguaaucaaucccauaacugugggaggcugaggcaggccgacuacuugagcccaggaggucaacaccagccugggcaacauagugaggcuacucucuacaaacuuuuuuaaaaaaaauuagccaagugugguggcaugcaccuguagucccagcuacuugggaggcugaggaucacuugagccugagagucaaggcugccauaagcugaaauugcaccacugcacuccagccugggcaacagagcuagacuuugucucaaaaacaaacaaacaaacaaaaaccaaaaagaaaaagaaaaagaggcuccaaaguguagaaucuuaaaucuaaaacuugucacuaaaccuccucauuaguuccacgucacaagauggaauauuuuaaguuccaucacgugaaaucuuauauuccuuuuacucugucaacuuaaaguacacagauuaauguccuauuauggcuguuucaggagagcuaccaaaacugagggaggaauuaugugaccauguaagaaguuagaugacauuauauucaacacuaaagagucuaugcuucuacuaacugauaaaauuaccauaauuucaguagaauaaacuacuggauccaaagaaacauaagucauagccauuccuuuuggucccaaauucacaagcauggaaauaacaacuacaaagaaucaaaauuauaagaaaaauaguucagcugauuuucaaaacauucacagaauuaucuaacauguaggacuagaugaccaaugccagaguuuacaucuugcuaaucaugagaaacucaacaauuaacaaggcagcaaguaagugaagaaacacacgagauccaauuuugucucaacagaagaacuuucacucucuguccagguaggugacaaaaagugauaauucacacacauucaauucauucuggugcuuauuuuucaaauguuccaugcaaauuuaccacucacugcaugcaaacagagaaaaaagaaaacccacaaagcacauguaaaaauugcauaaacaugacuuaaagacauuuugcuaucuaugaagcuauaaaccccaccugaaaauuaaaaacuguuaucacagauuuagcacuaugcaaaauaugaaagugaaaacauguaaaaauaaaauggaaaugcagaaucuagaaaauuuaaaauauauauugcuacccuucaguaaagaaagggagauaaugucauguucucccaaacuacagugacuucccuggugaaaauguaaguagguauuuccuuucuggaggaaaacagugaacauguaucgaaagucuuaaaaacacgaauaccgugugaaugagauccuacuuguggaaaauaauuugacaauuuuacaaaaaugcauuguuucuauaucugaaaaaaacaugucuaauaaaagauuacuuaaaugaacugauaauaggucacacaauaaaauaaaaacuaucaagauuugaauucgacaaagaacugccuagucuuccugauauaucacuaacugacaaaagucaguuaaaaaguagcagguguaggaugaacccauuguuauuucaaagcauuaauagcauuuucucuggaugaugugauuaagugaguuuuaaaacuucuuccaucuuuugauuucuuauuuauucuuuccauaguaaggaugcuacuugcauauuaaaaauuaauaacuauaaggggaaaacaauagcaguuauaaaacuucauauacaugauuugaauggccccgagauuuacuaaauugucucugauuuuuaaaaaaauuacaaaagucaaaauaccaaaauagauauuuuuaaugugagcuuuuauacuaaaauaaccuccccaaaacuugucagauacauaguacuucuuuauauacuacauaggaggagagugaucagcacaaacagaacgagacugaaaaaucagaagaucugcauuaagugucauccuucugucccuaagcagcuguaggauccuagggaaacaauugucugggccucaguuuucccagcuuuaugagucccuucaguucuaauuuuaaaguuauuuuauguaauagggaggugagcaagaaacuaguauuugcuggaugccugauaacuuauuacacacacugcggggcacuuugacauggguuaucucauuugaauaccaugacauugaggauuaucuucaguccacagccaaagagagaaauagaacuggagucaaaucacgaaaccaagaucucaaagaaaguacagaaccaagacaagaauaggaguccaggagucuuucagcuucagagucuaagucauuuugacuauauuguuuugcagaaggugauucauuucaaaauaauuauuuuuuaacaugaguaauacugaagaauucuauggaaaaaaaucucauaacuaaugugcaacugggaaaaaaaucugaagaaucauaacgugaaccucacauuuaugcaucuaucugguaccacaaaggcagaccaaguuucuugaggaaauggaaccacuauauucugcaaaguuaauuucucucuaauuuguugaggaccuaugugcuaugcauuuuauagacauucccacuuuagaggggaauaaaccuuaacaguuaagagcucgcauucugaggccagaugcccaaguucacauaauggcucuaccucuuaauuaacuaugugacccugaaugaauuacuugaucuuucuggacguaaguuuccucguaauuuaaaugguaguaucuacgagcauuaucauggugagaguauuauucuucuucacauuaccaauugugagaaaauuaaauguguuaauauauauaaagugcuuagaacauugccuggcacauacuaagcacuaugaaaguguuagcuacuacuauuauuguuguaauuguuacuaucacccucacaaguguaugaguuagcacuauaaaccuucauucugcugaugcucagagaaauuacauaagucauacaucuaauaagagauuugaacucagcuacuaaacuugagcuuuuaauaacuauuaagaggaggaucugaaaguagcccucuauauuugaucugccuuucugugccaaguuuaacaaauagcagcuacacugaugagacaggacuaaaggaagccaugccagaaccuccaaguuaaugguggaaucaacuauauuaagcauucuucuuuuuuccucacuccaaugacaccuuaauuuaucugaccucaucugcaucacuaucuaauuuaggauauguaaaaggcauacaaaauuuagagcacauaaaagggccucuacguuggaaaaguauacacuaauaacgacuuuuugguauaguuccugcgcaagggaaauccuuguaccauaugggucaccaaaucauagcucguaagucaaaucgaguccaccaccuguuuaugucucucaagcuuagaauauuuuacauuuuuaaauggcuggaaaaaguuugaaaaauaauaauaguuuguaacgugaaaauuauaagaaauucaaguuccaguauccaucaaguguacuggaacauacccaaguucauugauuuauaaauauacuauauaugauaaugcuuuggcucuguguccccacccaaaucucaucuugaauuguacucccauaauucucauguguuguaggagugacccccugggagauaaucugaaucaugggggcaguuucccacaugcuguucuugugguaguaagucucacgagaucugaugguuuuaucagggguuuccgcuuuugcauccuucucauuuucucuugucacugccaugcaagaagugucuuucaccuuucgccaugauucugaagccuucccagccauguggaaguguaaguccaauuaaacuucuuuuuuuuuucccagucucagguacgucuuuaucagcagcgugaaaaaggacuaauacaauauacuauauaguuuauggcuguuuuucauacuacaauggcagaguugaguacuuuaggccugcaaaaccuaaaacaaauaccaccugcccuuuacagaaaauguuugccaacccuuaguuuaggaucuauuauuuaucucugcccuccagugacccugccaucuaaucauuuggccucuuaacucucucuuuacccugagcaaauccguaaaauaaaagguauaccuuuccccaaguacuauuaaagaaaagaagaggagaggggaaaagggaaaaaggggaaaagaaagugaggaaagggagaggaugcaaaagaaaaagaaggaaagaaaggaauuucccugaugagaucccuuaguaauaccuuaucagcuguucauaaucaaaauuccuagaagaggaacaacagcuuacuugcuauaauuucuucacauuccauugacuuuucuuauuacucaaaaaacaaaguauguuauaauguguugauuuuuaaaauaaaacaaacuuuucuuauuuagucagcaaugaaggucaagugagaccuucuaguaaaaguccucuaaagucagacacaugaaaauacuuauccauuuaaaacagacaauacuuuccaauuauuuauuucuaugauugaauuaaugggacagugcuacaaacagaaguccuauggaauaagucauacuuggaagaucagaguuuacucuagacaacuugacagcaaucaguuuaaaaaugguuucaccuagagggauguguacuaauguuagcaauuaacuuugaaaggcauaaaaauuaagauggauugauggauacaaggaugguuauacgauaaagcaauguaaguauuaauggcagaaucuagguggcaggcauaugugugucagcuguaaaauuuguguucaauguuuuuuuaguucccacauaucagugagaacaugugauaucugucuuuccgugucuggcuuaguucacuaaaaaaaugaauuuacaagacaacuggaauauaagcaaugaauacaagcacuaagaagaugaagccauagaaacagcugccagaaagugaagaugugacagugaacgccaaacaaguaagauuagaauuacaauuagaaucagaaaugacaaaaaagaaacaugaacugugagaugcaauauaaaaacuaauggugaacaaagcaaagaauaaaaaauaaaaacggaaagauuaaaaggaaaaugugacuguaaguagagugaccuuuauauuauacagaagguaaagcagaaugaacaugugaggaaucuaaaaaacagauauaaaauagaaacaacugaaggcuuauauaauuagucuauaaagcuaggaaccacugcuuaguaauuucucguaaguggagucucuuuguucugagacguugcaaaacuccauuccaucucaaaguuauuuuuaauguuaaaauuuguaagagugagcaacgguauccuaaauaguucuaggccuuguagaaauagacuguaagagacaucugugacacaacuauauucaguaugauguagggucuguuacaaugggaugaagugaauuuagauuauuucaagacuaaaccuacaauugugaacucauuaguaccaugaaccgaacaaaaaccuauuaaauauagaacaagacgauuuucaugaaaaaauaaauaugaacaaaucaguauuuucaguuguuugaaauauagguuaaccuucaauuacuguuuuauggccgggugcaguggcucacgccacgccucuaaucccagcacuuugggaggccgaggcaggcggaucaugaggucaggagaucgagaccauccuggcuaacauggugaaacuacgucccuacuaaaaauacaaaaaaaaauuagcugggcgccguggugggcgccuauagucccagcuacuugggaggcugaugcagaagaauggcaugaacccgggaggcggagcuugcagugagccgagacagagccacugcacuguggccugggcaaaagagcgagacucugucucaaaaaaaaaaaagaaaagaaaagaacuguuuuuuucauuuuuauagucucaauauccagaaugcgugauauaugauaaaaaaaaaaguaaaauuguagaacuaaauauuuacauaauucaucuguaaaaugaaaaucuguuuuacagugucauauuucacaguuagaaaggaagaaaaaccuuaaaucaacaaauuaacuuuacaucuuauggaauuaggaaaugaagaacaaaugagacucaaacuuaccaaaaaauaaaaaaaauaaaaauaaauuacagcuaaaauaaaauagagaaaaauagaaaauuuuugcaauagaaaaaaaaucaacaaaauuaggaguagcuguuuuauugaaaagaucaacaaaacuggcaaauucuuagauuaagaaaugaagagaauagacacaaacagcaacaacuggaaauuagaaaggcgauacaacaacugcugccacagaaauaaauaggaccuuaaaagacuaauaugaacaacuaugacccaaaaaaauuugauaaccuuugagaacggauagacacaucaaacccaccaagacugagccacaaauacauacaacuucugaauggaccuauaacuauuagagauugaaucaguaacuguccaacaacgccagggcuucacugaaaacucuaccaaacauuuaaaaacuaacaacccuucucaaacucuuugaaaaaacuagaggacagaacacuuucaaaaucauuuuaugagguaagcauuacuuagauaucgaaaucagacaaauuuacaagaaaaaagaaucccuaauaaauacugaugcaaaaaaaaucaacaaaauaccaagaaacagaauucaacaaugcauuaaaaagauuauauuucauaaauucucaacuggaauuuauucauaaaauccaaggaugguucaacauacaaaaaaaucacuuuaauacacugcauucuuaggacaaaaaccaauaaucucaacugacucagaagaagcauuugacaaaaaucaacacccuuuuaggauuuaaaaaaaggccagacaggguggcucaugccuguaaucccagcacuuuagaagggcaagguggguggaucaccugaggucaggagugugagaccagccuggccaacacagugaaacccugucucuacuaaaaauacaaaaacuaaucgggcaugguggugggcgccuguaauuccagcuacucgggaggcugaggcaggacaaucacuugagaacccgggaggcggagcuggcagugaggugagauagcaucauugcacuccagccugggugacaagagcaagauucugucucaaaaaaacaaaaacaaaaacgcucaauucgcuagaaagauauggaaauuacuucaacauaaugaaggccauauauagaaagaccacagcuaauguuauucaaugaugaaaaacugaaaguuuucccucuaagaucacaaauggaacaagaaugcacacauucaccacuucuauucaacauacuguuagacauccugccagaguuagcaacugggcaagaaaaagaaaugaaagguauuaaaugagaaaaguaagaaguaaaauuacuucuguuagcaaaugacaugaucuuuuauguugaaaacucuagccuaccaaaaagaaaaaaaaccguuagaauaaaggaauucaguaaaguuacaggauauaaaaaccaauauuaagaaaagaguugcauuucuaaauacuaaaaaugaagaauccaaaaaggaaauuaauuuuuuaaacccauuuaaaaugaaaucaaagaguaaaaaauacuuagggaauauuuucaccaagcaaaugaaagacauguacauugaaaauuaaacaacauaggccggacgugguggcucacgccuguaaccccagcaguuugggaggccaaggugggcugaucacgaggucaagagauugagaccauccuggccaacauggugaaacccugucucuacuaaaaauacaaaauaaauuagcugggcuugguggcgcgcgccuguaaucccagccacucgggaggcugaggcaggaguugucacuugaauuugggaggcagaggugcagugagccaagaucacgccacucuacuccagccuggugacagagugagacucugucucaaaaaaaaaaaaaaaagaaaaagaaaauuauacaacaaugcugaaagaaauuaaagacaauacaaauaaauggaaagacauccaaguuuaugaauuggaagauuuaguacuguuaagauggcaauacuacccaaagcaaucugcaaauucaaagcaaucccuaucaaaaucccaauggcauuuucuacagaaacagaaaaaaaaaaucuuaaaauuaauacagaaucuugaaggacccugaauagccguaacaaucuggacaaaaaacaaagcuagaggccucacauucccugauuucuaaagauauugcaaagcuauaguaaucaaaacacuauggugcuggcauaaagacagauauacagaccaagugagcagaagagagaacacagaaauagggaaaagagguucuucaacaaacuguauugggaaaucuggaaucuaacaugcaaaagaaugaaguuggagccuuaucucacaccauauacaaagaugaacucaagcuggauuacagaccuaaacuuaaaacaucgaauuauaaaacuacuacaagaaaacauggagaaaaagcuucaugacauuggacuuggcaaugauuucuugaauagaucaccaaaagcacaagcaaccaaagcaaaaauagacaaacuggggauacauaaacucaaaaauuucuacaaagcaaacaguaaauggaguaaaauggcaaccuacaaaacaggagaaaauauuucuauaccauguaucuguuauuugguuaauauccagaauauauaaauaacuccuacaauucaacaacaaaaaaucuaguuaaaaaguggacaaaggacuugaauagucauuuuuccaaagaauauauacaaaugggcaauaagcccaugaaaagauucucaccaucacugaucaguagggagaaaugucaauuaaaacugcaaugauacaucaucugaaaccauuaggauggccaccauuaaaaaaacagaaaauaaguauuggugaagauauggagaaacuggaacccuuaugcaccacuggugaaaauguaaaauggugccaggcacuguggaaaacaacaugaaggucccucaaaaaauuugaaauagaauuaccuccaguuccacauaugaagagcuuggaagucaccacuccauccuaacaacaaguaaaaaaugacaaacuuaaaaauaaacaaaucugagauaggauaagugaggucacagggcaaaugacugccugugagagcagagaacaggugaacacauagcaucaccauuuaucugagaugaaaaacacaagcagaaaccuccacgggguaggaaauccugaaguguaauagacaaauugaugaaggcucaguguggacaacucugaaagcuaaaaacuccagaguuacccaauuauagggggagcccuacaauuuucuaaguuuuacauccaggcaauugaccagcuucucacaguaaauauaggagaaaaauccucaacccucagcaggggaggcaaagagaaaugauuuucaaguacacuagacuauuccagucuuaacaagguuuguccucaggagaaacuaguuaaccagagccuaaccugcugggguuguagcaaagccaaaaugaugugggggaagagaaauaacccaacuucaggccauuauagcuaucuuguucuaacuaagggaaugagggaggggugggauugagaaacacuugugaaguucacaguccagaggcauaagcucacuaaaaagacugaccuaaucauaagacuacagaacucuucuccucucccuacaccuuacaaccacauuacuaaaugcucauuuacaacaguuccuuuuaccuaguacaucauguccaagcuaucaagaaaaaaauuacagggcauaauaaaagguaaaaaacaagcaccaggaccagauacagcagggauuuggaauuaucaaacuuggaaucuaaaacaacuaugauuaauaugcuaagggcccuaacgaacugaguaaacaacauguuaaaaaaguagagaugaaaauccuaagaaccaaaaggaagugcuagagauaaaacacaaacaaaaacaaaaaacagaacacuguaagagaaaugaagaaugccuuugaugggcuuauuaguaggcugggcauggaugaagaaucucugagcuugaaaauaugccaaaaaacuacaucugggcauaaaacguuguaauuacagaaauucaaggauaagaaaaaaauccgaaguaagccagagggaaaaaaucaccuuaccuguagaggaaaaaaagaaaaaaaagaaaaaauacaugugacuuccaacaagaaaaagagugaaauauucauaguguugagagaaaaaaaaaccauaaaccuagcacucuaccuugugagauuauuauucaaaaguuaaaaagaaacacuuucucagacaaaaauuaaggaaauuuguugucaguacaccugccuugcaauaaguguugggaaguucagaaacugaaaucuacauauauagagcaucaaaagaaggaaacacugaaaguaaaauaaaaccuuuuauuuuucuuauacuuaauugaucuaacaaauaagaauuuguucaaaauaaugucaacaauugugcuuaugcauacaaaugcuccuaaacuuacuuauuggguugugucccaauaccauuauaaauugaaaauaucaugaaaacacaacuuauccaaauuugugggauacagugaaagcagcgcuuagaaagaaacauacaacacugaugcauuuauuagaaaagaauuaucuaggccgggcgcuguggcucacgccuguaaucccagcacuuugggaggcugaggcggguggaucacauggucaggagaucaagaccauccuggcuaacacagugaaaccccgucucuacuaaaaauacaaaaaaauuagccacacgugguggcaggcgccuguagucccagcuacuugggaggcugaggcaagagaauggcgugaacccgggaggcggagcuugcggugagccgagaucgagccacugcacuccagccugggcgacaaagcgagacuccaucucaaaaaaaaaagaaaagaaaagaaugaucuaaaaaucaauuaucugagcuaccaacuuaugaaacuagaaaaagcaaauuaaauccaaauagaaguaauaaaaauuagagcagaaaucaaugaaauugaaaacaagauaucaauagagaaaaaucaaagaaaucaacuaguucucugaaaagaucaauaaaaucaauaagccucuagccaggcuaagaaaaagagacaaaggacaaaauaacuaauaucagaaugaaaagaguggacaucauuacagaucucauggacauuaaaaggauaaucaagggauauuaugaacaacuuuacggccacgaauuugguaaccuagaugaaaugaaucaauuccuuaaaagacacaaucuauuagaacucuaagaagaaauaaucuugauuaaaaagcauauauuaaagaaauuaaauccauaauuaauaauguucuaaaagagaaggcaucaggcccagauggauucucugaugaauucuacuaaacauuuaaggaagaaaccacaccaguucucuacaaucuccuucagaagacagaagcaaaggagaugcuccuaucucauuguaugaagucagcauuacucuaauacccaaaccagacaaagacauuaucagaaaagaaaacuacagacccauauuugucaugaacaaagaugcaaaaaucuuuguauuagcaaaguauuagcaaacuaaauuuuacuacaauguauaaaaagaaguauacaccagcacaaaguaggauuuaucccagguaugcaagacugguucaauauuggaaaaucaauuaaugcaauucaccauaucaacagacuaaagaagaaaaaucacaugaccauaccauagauggagagaaguaugugacaaaauuuaacacccacucaugauagaaacuaguaaacuaggaauagagggaacaccuucaacuugauaaagaacguuuacaaaaaacauacagcuaacaccauccuuaaugaugagaaacuagaaacuuucuuacuaagaucaggaacaagaaaagaauauccccaccucaccacuccauacuggaaguccuagcuaagacaagaaaaggaaauaaaggguauacuaacggggaacaaaaaaauacaacugccuuuguuugcagaugaaaugacuauauguguagaacauagacaggaauugaaaaaaagaaaaagaaaaacaacaaaaaccuccuagaacuaauaagugauuauagcaaagcugcaggauacaagguucauauaaaaaaguuaauagcuuuccuguaaaccagcaaugcauaaguugaauuugaaauuaaaaacacaauaccauuuuacauuagcgugucccaaaaugaaauauuuaaguacagaucuaacaaaauuaguacaagauauaugaggaaaaauguuuuagaacucugaugaaagaaaucaaauaacuaaauaaugaagagcuauuccaugacccgugagagacaacucaauauugacagaaaaagucagauggacacuacugauuucaagauuuacuguaaagcuacaguagucaagauggugugguacugacaaaagaacugacaaaacagaccaacgaaacagaauagagagcccagaaauggacccacauagucaaaggagcaauggcaguauuugacaaagaggcaaaggcaauacaaugaagaaaauagucuuuuucaauaaacagugguaauaacugaacauccacaugcaaaaaaaaaaagagucuagacacaggucuuacacccuucacaaaaauaaacucaaaauaaaccagagaauuaaauguaaaacucaaaacuauaaaacuccuagaggauaacauaagaaaaaaucuagaucuuggguuuggugaugacuuuuagauacggcaccaaagguaccaaccaugaagaaaagaacugauaagccagacuucauuaaaauugucuacuuguuucuuaaaaauuguugucuuuugcaaaagacaaugucaagaguaugaaaagacaagccacagauagggaggaaauauuuacauaagacacaucugauaaagaacuauuaacuaaaauguguaaggaggcugggugugguggcucacaucccagcacuuugggaggccaagguggguggaucaccugaggucaggaggucgagaccagccuggcuaacauagugaaaccccgugucuacuaaaaauacaaaaauuagccaggugugguggugcacggguauaaucccagcuacucgggaggcugacgcaggagaaucacuugaacccagguggcagagguugcagggagccaagacugugccacuguacugcaaccugggugacagagcgaggcucugucucaacagacagacagacagacagacaagacagacagagacaguguaaggaacucuuaaaauuccacaagaaaacaaacaacccaauuaaaaaauuggccaacaaccuuaacagacaccucaccaaagauauacagauggcaauucagcauaugaaaagaugucccacacaucauauggcaucagagaaacacaaauuaaaauuauaagauaccucuacacaccuaucagaauggacaaaauucagaacacugauaacaccaaauacuggugaagauguagagcaaaagaaacacucacucauugcuggugaaaaauguaaaaggauagcgucauauuagaagacaguuuggauguuuccuacaaaacuaaacacuuuuaccauaagauccagcaauugcacucccuaguauuuacagaaagucgcugaaaaccuaaguccacacaaaaaccugcacaccgauaucuacagcaguuuuauucauaauuagcaaaauguggaagcaaccacaauguccuucauuaggugaauauucauucacaaacugugauauguccagaaaauggaaaaagagagguacuaacaaccuaugaaaagacauggaagaaacuuuaaugcauauuaguaaguaaaaauagucaagcugaaagggcuauauacuguaugauuacaaguauauaauaugcuggaaaaggcaaaguuagagacacaguaaaaggaucggugauugccaaggagugggagggaaggaaagauaaauaggcagaacacagaggauuuuggggcagugaaaacauucuguaugauauaaugguagauacaugucauuguacuuuguucaaagccacagaacguacagcacuaagaaugaucccuaauauaaacuacggacuuuggguaauuaugauguaucaauauagguucaucagaaagacauguaccacucuggugggagaugcacacuggcuaugagagaauccauacauguguguggaaggagguacaggggaaaucucuguaccuuccucucaauucugugaaccuagaacuccuguaaaaaaaaaaaaaaucuaaaaaaaaauagaauacauaugauccaguaauccuacaccuggguauacuuccaaauauauuaaaaacagguucucaaaaaaauauuuguauacccauguuuauuucaacauuacaauauucaagaaguggaaggaaccuaaacauccaucaacaaaugguuaaagaaaaugugguauacauauauaacaaaauguuauucagccuaaaagaaaagaaagaaauucuguaauaugcuacaacacaaaugaaccuugaggacauugcuaugugaaauaggccagucaacaaaagacaaauacuuaaugauuccacugacaugaaguagccaaaacagucaaauuuuagaggcaaaaaguagaauggcauuugccaaggaauaggaagaagggggaaaagaagaguuguucaaugaauguagaguuucuguuuuacaagaugaaaaaguucuagagaucugcugcacaacaaugugcacaguuaccacaauuguaccguacacuucaaaucauuaauaugguaaaauguguuguuuuugacaauuuuuaaaacucuaccccauuguuuucuuuaccucuuauauaaacugauaaaaaccuguuuuaucuuaaucaauuauuguaugacuacugcuccccagagaaaaaagugcaugugaaauacuacuacuuauccaucuccuggcucugagcaguacaugucaggaacaagagggaauuguagcuggaagacaguagaagagccauaggacaagucucuaagagaaggaagaaaaggcgcaaugaaagaaaacaaguuuaagauaguagaaaagcauucaaagacggcaaccugagguaagguguuuucacugaagcuuuugggguaaaacaguuuugaguuggcaugccuguagacaugggaagcagcagugaugcagaggugaacauuacuguagauaaaaacggaugggaauuugacuugcuagggacugagggguuaaucauauaaauaaagauggcagcagauuugggaaagagugaagaagaauaaguucagguagcaguccucaaaaaccgagaagaaacugauagcucacugaaggcagacagaggaagacaaaaccagaaggcauaagcuucaaaggagcagggauuuuuaugcugagagaguaaaaggaauaguucaaagcagcaguggagaacacgaauaacguuccaugugggaaaagaacauguccagagcuuacuguaccuauaaccuagcuucuguaacuggaaaugaagaaucugcucuagucaggucaucacuuuucacuacuuauuuuacuuggccuuccuaagaaauauagaccuuuuggaaauuauugacuuuugggucuaggacacuauuucuugguuuccucccuucucucuggcuguuuuucagagacuucccuuccaaaucuagagacauuuguauucuccagggaucagcuauuagauacuuucccuuuuaaauuucccuuuggacaguuucaucuuucaaggauugagcaauaacuaaaugacuuccaaaugucuacuucaguauaaauucugcuugucaggcuacauaaaaagggcucuucaaggaauuaugaugucuaaagaaagagaaagccacgauuucaauaucacagagaugacuacagaggaauagcaauaaaaagagaggcaacuuaggagaggugaaucacaaaagaugacuaggagcugaugacacuaugggugggaagaauguuucagacaggggaagaauguuucagauagaggaaaaugaguaaaagcacaggggccugaaaacaugauauuauaagacaauuccaagcacuucaagagccuaaaguucaagaaaaguuucaaaaauaugaaaauggagaggcagggaaaagccagaucauggaagaccucaauagccaugauaaguaauucuuuuuuuagccaaaagaggaguaaucuaauaaaagcuaaagaucuucuccucauaaaaauacaugcacacuucaggagugcaaaugcacucuuccggaagauucguaacccacuacauucauaaaccauuagauaagaacuaaaacacaaggagucacugaaggguuuuaagcagguuaagugacugacaaaauuugccuuuucaauaacugaaaccaaagugggcaaaacuggaggcaagcaauccaguuagguaaugacuacuguaauaguccggacaaauaauguagcaguaggaagaaaaaaaaagaugaaauugacccaggaaauauuuaaaauaaguaguuuguaagagguaaauaagcuggaagagccagagguaauggguaggguuucugguaugggcaacaagauaugcuacaagcugagauguuaguaaaaacaagcguucaucagcauuuaguaagugauuuauuuauauuauaucacugaauacucaauuauguuaagaggcagacagcaguuaaaaaacaaagaacucggugaaucaaaaaguucugcuaauuuggggaaauagcaucccuuuuauuuuuguuaaucucuuuuggguuugauccucauuuauagcugacaagaaguucuauguacuaaagguaaacuauucucauuaauguucccaaaaaucucuuggaauaauuaagauauaaagaaauucaaaauucacaugauuauaaaaaucuuuccuuagauaaucucauaauauagccauguuuugcucauucuacuuugagaagauucagccagaaacaguucauccauucaacuaucccuacugugaacuagaaguauguuuccuuacauuugaaacagaagauauagguuuauaugaugcuucaggugguagaaaagcagggcagacuaugacucgugucacuuccuuccacacgugaugccuuucaugggcuccugugucugucagaagaaagcaaagggccuuagcgugcuccuggcuuucuauauccaaaugcauuuuuucacaccuucucccaucagcuaacucuacauuacugcaauacggaacuucuuacuacucaguggacuuguucugcugucuucucugauuccagguguuauucuuccugccuagaacacuaugauucuuagcuauucccaagcauccucaagguuucagcuuauauaccacuuuuaagauaauuagguauucuuccucuguagucucauaccaaccaguaccuauucuauuauauauaauaacugccuauuaauuaaaugggaagcugagguauaugaccuaauaacuuauuuacugucguauccucagaaccuagcaaauuacagagucucaacagagauuuuucaauuucucuucugauacugucucgauaacagugucaauuaaaccuuucucuaauuauuugaccuugaagggaaauagaugucagacuaccuccugguuucgaguauacuggaagcauacaaaaggaccuucucaaucuggagaccaagaauaugauaugagaaccuauaggagaaccacuuauuugauuaaagagauuucuuuuacuucagaaaauauuucaguauguuacuugacccauaaaugcuuauagauguguaaguacaccgaagaagucauauaggaaauaaaagcauccaagcuauauuucuauggucuacucugauuaaaaagcucagcucuccuaucaaauucaagauaaugcauguggauuauggagcacagucacuugcuacaugguaaaugcucaaaaagaugauaggugguauuacccacauucuacaggcuguguacauacuuaucaguuuauauauauacauaaacugauccuaaaaaauucuuccuacauuucugcaagauaauuaaaaaggcagaaacaaacauuuugcauaaauuuacuagcuucauucuuucauguaggaaguaguuacugacuaccuacuguaugccaggcacugucauuaggcuuccauucuagugguaaagaagcaaaacaacaaagaaaucaauaugcaagaagucaaaugacauuaaaucccaugaagaaaaaugcagcaaguuaaggggaaugcagaagaacaugaucauucuuugaugcagccggucaggaaaagcaucauuugagcagagagcucucugaaucaagugaggaaggaagccacauggauuaucacagagaagggucacagggucacagacaauaguuacaagccuuaagaugacaaagauacagccauuuuagacagagaugagcaagugcgguagagagaucacagaaaugaaaggaagccaguucacacagggccauguaaaucuccagauuuuacuuuuaagaugggaagccucugaaaaguucugugcauaguaaauaacaugguuuaacucagauuuuaaaaagaucauuccggcugcuacuagagaauacacuguaaagcacaagacuccugggaaacaauuucuuucuuuugccaaaagaugaugccuuuaaacagaguaaacagaaguauaaugguuaaaaaaaauaaaaugaauuauggguauuuggaagguguagccaacaagauuuaccaauaauuugaguaugugacauagagaaauuaaaagaugcuuccaaggcuucuggcugcacaggaggggaaaaaagcuguuauugacugagauggcaaaauauuaugagagacguagguuugggaugaugaaaaucaggagcuccacuuaggacagguuaaguuugagaaccagacuuaacuguuggauaaaucagucuacaguucagagggcaagagcugacgauggaaauagaagaguugucaauagacagaguccuggggcauuucugacauuuacaguaaacugagcauuuauuaaaacuaacuugcuuuacugaaccauaaaucacuuguuguauuuaccccugcuccauuuauaguuauacaucuggaaacauagccuuaguguuagagguaaagaguaaauaccaaacauaaaaaaucugaucugguugggugcgguggcucaagccuguaaucccagcgcucuggaaggccgaggcaggcagaucacgaggucaggaguucaagaccagccuggccaauauggugaaacucugucucuacuaaaaauacaaaauuagccaggcaugguggcacaugccuguaaucucagcuacucggguggcugaggcaggagaauugcuucauccugggaggcagggguugcagugagccaaauugcgccacugcacuccagccugggugacagagcaagauuccaucucaaaaaaaaaaucugaaguuacugagaaacugguaugaaaucauuaagaaaacuaaggugucuaaauuaauacauacaaagagauucuacaacacgguauuuauaaauuuaaacaaaauccauggccaggcacgguggcucacgucuguagucccagcacuuugugaggccaaggcagaaggauuacuuuggggccaagaguucaagaccagccugggcaacauagugagacccugucucuacaaaaaacaaacaaacaaacaaaaacacuguuuuagccuggcaugguggcacaugccuguagucccagcuacucaggaggcugaggcaugaggaucacuugagcccaggaauucaaaguuguagugagcucugaucacaccacugcacucuagcuguaucacuuaugacagagcaagacaauaucucaaacaacaagcaaacaaaacaaaaaacuaaaguaaauccagguaaaauaaacauacgaauaaaugaaaagaucuggguuauugcauuaguucuguuucuaggcuuaacuacaaaaugguguccaguuguuaaaaacacuuguuuaagaguauuaauaauuuuuuuuuuuacuaugcucuucuacauccuaggaaauuggcaacacuaagaauuccuaaaaacaaacaggaguguuaacuguauauaaauuauuauuuaagaugcauucaaggcguuacuuaaaauaucaaaugcaugucaaaguacaaacaacaaaaucaugcuucaacaaaugugggauguugccauuaauggacaguuagcucugagguaaaaccaagaauccuucauuaccuauuuuuguaaauuaggacaaauacuauuaagguauuagguugguacaaaaguaauugaacaaaccuggacccacucaccucacugaaagugcugccuggcuacaguuucuagauauaggaaugugagaaaugguagcagccuugaagguuuagagcuauauucccauaccaauuauggcuagaaacuuaaaacagcucuauugagacauuaugggaagucuaauuuccuguuacucuacuuuaacacagccaaguaaaacaguaagaaagcuugcuuaauucaacaaggacugagugccagagugucaccuggaaacuugugacaaauaaucaugccucacacauucauccuugguuuuuacuaccaaaugcaagcuucaucuauccucuuccauucuaaacuugacucauccuccuaaccucuuccagaaagaucucuagaaacccagaggcuuucugaagacccauaggcuaucccccaucuucaacuacuuuacauaauggccccucaacuucuuagcuuucaugaaagccuggcuccuccccaaaggcacugccuaucaugcaacccuuuuaugugacuccuaaaacuccuaaguccaccauuauucuucuaauucccuguauuaaaaauaaacggcaaaauucccuguauuaaaaacaacaaaaaaacagcuuguaauuugaaacucaugucaucuaaccgaaugccuucucuuucccucccuguucuggucaauuaaacccacauauuuaagccuccacuuugcccccaguuacaucaucagcaaagugacuucaaugucccuguacaugguucuaucccaauacucuaggcccccaaaauauuugccuuucuaaauuugagacaucuucaccuccucauuucagcaaaucacucccuugucuuuguuagacauacuaaaaccucugacaaugaucaucucagcuaucuuuguaagaguuucacucauacucauaucuccuuucaccugucaagacaccagguuuggugacaaauaaaaaugauacguauuugggaggcugaggcaggagaaucauuugaacccaggaagcagaggaugcaguggccaagaucaugcuacuacacuccagccugggugacaaagcaagacucugucucaaaaaaaaaaaaaaaaaaaaaaaacacaaaaaacaaaaaaaaggauacauauuuauuguauucacaugauguuccaaaauauguauacacuguggaauggcuagaucaagcuaauuaauacaugcaauaccucacauacuuauauuuuauggcagaacauuuaaaaucuacucucagugauuuccaaaaauacacuguuauuaacuaguuuccauguuguacaauagauaccuugaacaaauuccucuuaauugaaauuuuguguccucugaccaacaccucugcaacccaguccacucacccccagccccugguaaccaccauuuuacaucccugaguuaagauuccacauuuaagagagauguaguauuugccuuucuguggcuggcuuacuuucaacaaugcccuccagguucaucccugcugucacaaaugacagcauuuccuccuuuuuauggcugaaguauauuccacuguguauacauaccacauuuucuuuauccaugaacacuuaggcugaugcuguaucauggguauugcaaaugauaccgaaaggaacaugggaguacagaucucuucagcgcacugauuuuauucuuuuauuuauauauauauauauauauauauauauauauauauauauauauaaaaauacauauauauccaagugugacugcugaaucauaugguaguucuauuuuuuaauuucugagcaaacgucaugcuauuuuccauaaaugcuguacuaauuuacauuccugccaugcgcaauauaucucuugucugcaaauccucaucauacuuuaauagccauucuaauggccauuuguaugucuuauuuugagaaaugucuauucaaguccuuugcccauuucuuaagugaggugcuuucuuacuauugagaugucugaguuccuuauauauuuugcauauuaaccccuuaccagauauaugguuuggaaauacuaucuuccauucugugaguuuuuucauucuguagauuuuuucuuuuugccaugcagaagcuuuuuaguuugaugugaucucauucaucaauuuuuauuuuuguugccugugcuucgagggggucauauccaaaaaaaucacuguccaaaccaaugucauguacauuucuccuauacuuuauucugguaguucuacaguuucaggucuuauauuuaagaccuuaauccauuuuaacuugaauuugguauaugaugugagauacaggucugauuucauucucaugcauguagauauuccauuuucccaacaccaccuauugaacagacuucccuuuccccgcuguguucuuugcacccuguccaaaaucaacugauaguacacgaauuuauuucugugcucuccauucuguuuugugggucgaugugucuguuuuuuuguuucuuuuguuuuuaaaagacagggucucacgcugucauccaggcuggagugcagugaugcaaucacaguucacugccaccuuaagcuccugagcucaagcaauccuccuucuucagccucucggguagcuaggacuacagauacacagcaccgcgccuggcuuuaaaaauuuuuuuuuuuuuuaauuuuagagacagggucucacuauguugcccaggcugcucucgaacuccugguuucaaguaauccuucugccucagucucccagagugugggaauacacgugugagcaacugugccuggccugucuacuucuaugugacuaucaugcuguuauaauuacuguagcuuugaacuauauuuugaaaucagauagugugaugucuccagcuuuguucuuuucacucaugacagcuuuggcuauuuaggaucuuaugugguuccauauaaauuuuagcacuguuuucuaguucugugaaauuuaacauuggaauuuugaucaggauugcauuaaaacugcagauugcuuuggauaauaaaaacauuuuacaauauuaauucuuccaauccauaaacacaagauaacuuuccauuauuuguaucaucuucaauuucuuuaaucaauguuacauaguuuucaacucuuugguuaaaguuauuucuaaguacaaucaucccucgguaucugcaggauauugguuccaggaucuccuguagauaccaaaauccauggaugcucaaguccauuauauaaaaugguauaguauuugcauacaaccuacacacauccucguguauacuuuaaaucauuacuuaguaccuaauacaacguaaaugcuauguaaauaguugcuauacuguaguuuccuuauuguauaagaaaacaguauuuuuauuguuguauuuuuuucucaaauauuuucauccaaauguugguucaauuugcaaaugcagaaccacugauacugggagccacugcauguuuuguuuuugguaccuauuauacauggaauugucuucuugauuuuucuuuuagauaauuugucauuaauguacagaaauucuacggauuuuuguaucuugauuuuauaucuuacaacuuuacugaauuuaucaguucuaacaauucucugguggagucuuuagguuuuucuauauacaagaucaugucaucuucaaacagggacaacaaugucuuccuuuccuacugggaugccuuuucuuucucuugccuaauugcucuugcaaggacuuccgguacugugcugaauagaaauggcaaaagugggcauucucguuuucuuccugaucucaaaagaaaagcuuuuaacuuuucaacauucaguauaacguuagcaguguguuugucaauauggccuuuauuuuauagagguacauuccuucuauacuuaauuuuuuaaaauuuuguagcacaagagaauacugaauucugucaaaugcuuuuucucaauuaucucaauuaucuauugaaaugauaacaugguuuuggccuuuguucuccuaauguuguauaucacauuuuauggauucaggucuguuggauaauccuuguacccuugagguaaaucccauaugaucacaguaaaugauccuucuaauacacuguugaauuuaguuauuauuuucuucagaauuucugcaucuaaauuaagaauacgggucuguaauuuucuuuuccuggagaguucuugucuggcuuugguaucuagguaaugcucaucucccaaaaugaguuugaaauuacucccucuucuuaaauuucucauaaaauuaugagaacaaucuguacuaguucuucuuuaaaugucugcuagaauucagcaguaaagucaccaagucuugggcuuccuuuggugggagauauuuuuaugacugauacaauccuugucacuggacuguucacauuuuucauuucaugauuaagcuuggacaaguugcaugugucuaggaauuuauccauuucuucuaugguaaucaauuuguuggcauauaauuguucagucucuuaugauccucuuauuucuuguacuucucugguaucagcugcaaugguuccucuuucauuucugauuuaacuugagucaucucuuuuuuucuuagucuagcuaaagacuuguugcuuuuaucaucaaaaaacacaacucuuuauuuuuuuuaucuugagucaucucuuuuuuccuuagucuagccaaauaaccugucuuuugaguucagauucuuuugucugcuugcucaauucugcuuuuaaugcucuuuugcauuuuucauuccauuuauugcauuuucagcuucagaauuuguuaaaaaauaauuucaaucucaaaauuucucauuuugauugcuguuuuccugauuuuguugaauuguuuaucugcauuuucuugaaauucauugagcuuccuuaaacaauuacuuugaauucuuugucaggcaguucauauaucuccauuucuuuaugguugguucaggugccuuauuguguuccuuugacuggugucacguuucccugacuguucuugaucccuguagucauguguuggcaccugcacauuugaagaagcugagacuuguuccagucuuugcagagugacuuuauuggguaaagcccuucaccagucagccuguccagagauuaugcagccugagucuaccggggcuggccuggagucugggucagcaggguagguccuggagccuugguacacaggugcugcuggccuggcauccuggucuacuagagugagccugaaccuuggaucugcaaggaccagugugaaggcuggguagguggauguuggccuagaauuuggaucacaaggggcuggccaaguacuggguuuggacccuuguucugcagugaugugaggccacaggggccgaucuagagggcagggcugcagggaccacccuagcacuagacaggcuuagagccuagggcugugggauccagcuuggugcuggggugggccuccaagcuugguuuguggguauuggccugaaguuuggggccaugggggccugccuagcauugaguuuuacuggggcgagcucaauguuagggucuaagucugguguacacuuccccuccuucccccaggugaacagucucucucuccaugcugggaucucagggacugagggaggugugacacaaguaauguaaaacuguccuucuuacccuuuucaaugugucuuuucuuaucugugugccacauucagguaaucucucgucugguuucuuagcucuuauauuuuuguguguagacaguuguucaaauugaugguucuacaaugagaugagugcugcaaagugcuagucugccaucuugcuguuaucuagaccucaggcuuuucuuaaaacaacucaacacuuuggucuggcaucccaaccuuuccaaucauggccaucauccacagcauauaaauucaaauacuccaauguuaacaucuuaugcacaugccacuaaugauucuguuccaucagcucugcuaauauccaacccuaaaauaccaugcauaaucuucuggcuauuggagaaaagucuuuaaauuucaaaugugauaaagucuuuaaucuuaacuagucacucaguggaaugagauucuccuacucugauacgguuucugauuucagguagccagccagucaagacucucaacuucugauccacuucuucacccauuccccucaguagcuuccuaaguuuucagucuucucaaaaccucuaaacaaaccuuguauuccacaaaauauuauuaaaaaauguuucauaaaaaguuucguggucacuaaccuacaguaacauacuaccuuauauccacuacaaugacuacuauugaaguacacacacacacacacucucacacaauaugugauggcaaggauguagagaaacuggaccccuugugcacuagugguagaaacgcaaauagguacaguugcucuggaagaguauggcaguuucucaaaauuuuaaaaauaaaauuaccauaugauccaacaauuccacuucugggaaaacaauucaaagcagggucucaaaaagauauuuguacacuccuguucauagcaacauuaucuguaauagcuacaacauggaagcaaccugagcgcucaucaacagguaaauggauaagcaaaaugugguauauacauacaauaaaacauuauucagccugaaaaaggaugcaaauuuugaaacaugcuaaagauggaugaaacuugaugacacugcgaaguaaaauaagccaaucauaaaagggcaaaaacuguaugauugcacuuauaggggguacuuagagcagucaaaauuagacacaaaguagaauaaugguugucagaggcugugaagauaaggaaaugaggaauuauuguuuaauggguacagaguuucaguucugcaaaacagagaguucugaucgugacugugcaacaauauuaauauacuuaauaccauugagccaaauacuuaaaaauggugaaauggaaaauuuuacauuauguguauuuuacuacaauuuuuuaaagcuuaaaagacaagucacaugguugggucacauaaauuugagaaauacauuuuauagucguuucuugcagauucacaauauauaccggcauuuaaauaagguuccaauauuuucaguaaaaaaaucuugauuuuuccacccucacccacaauuacaauuaauaucacacauccaucuuuacuuccuuguucuaauuucauuagaugggcaucuuuccucuuauucaaggucaaucacuauaucugcauuuuucuuuuuuuauauuaccuguaugagagauacaccuguauuuuucauuccaacccuuaauaccucgaaaaacuuugcuuugauaauuacuaccucuauuaucugaaacaucuuuagucuucacaauaaaucacuaaagucuuacuuacuucauguccuaaauauuugucuuaaauccagaaaaauuuauuuugaauuccuauuauaccacugucauugucaaggcucucacugacugaacuaccuuaccaccacacguuucucuucaauccuuucucucuugcaagguuauuaaaaauacacguuugacaaacuuacuaucuaccuacugagcaaauucuuugcugacucccuaauaccuucuaucacaucuuaucuucuucauuuuccuaccucucagcuaguuuaugaucuaaaaguccucaacugccuauuguccccuacucccuaugcugcuucuaacuuuggcucauacuucugccuggaauaagccgcucaugcuucuagcugccugauucccagucacauuucaagacugaacuuagcauuuccuggccacucuuacuucccugccaucuacacuagauuccuauugcauaccuggguacuccaguacuccuucauguuacuauuguauuuuggauaccauucuaccucagugacugaaauuauuugcuucugcaucuuucacucuugaguauaauauaaauuucuguagggugaaaacuaauuauuacgcaucucuguaucuauaacauaguacuugaugccuuaaauaugguaggcguugagacuguuaaacucaacucuuuccucaaccucccuauuucccuacaacugcuaccagggaagcaaaaagacuaagaauuuaggcgugugcauuuaucuaucuaguaguagaaaccuaguaaacuguuaccgagguuuagaguuaucugauaggaaaaaaaguagguauguuccuaucucccauuuacugcuaaaugauuccuuucuuuuaaccagaaauuauuuccaaauaaugugacguaauuuaaagcagucuagggcaacucaaaauaagaaccacagucucaaccaaguuacacuuacauucggcuagcuucaaugucgucagacugagguucuccugaucuguaaaaugcaauugagaaacaguuagcaaaauauuccauauuccaaaaaaaaagguagacauauuacuuaggaagacaauuuuguaaacaagauuuaagcacuaaauaaaacaguuuuaaaauuaaagaugucaacaugaaagaaaguggucagaucagguggccauacaacacauuuauuuuaaggguuggacuauuaaaaaacucaaugcauguuuuuuaaaggaaacuguaaacgcuauacauagauaccaacagacaagccauuauaagccauaauuauucacaaagucaaauacguguaauaaaacacacaacuaaaaaacuuccuauagccaaguauugguuauccacauuaacaaagguacucacugguauucacucacaguauuaaacuuuagauuaguggcucaguaaacuacucccuaggcagacagacuaaagcuuaggccagccauguaguuuuguaaaugaaguuuuauugggaugcagccauacucauucauuuagguaucaucuauggcugcuuucacacuaaaagaacagagcugaggacuuguggcagaaaccacauggcccauaaagccuaaaauauuuauuuucuggcccuuuaagaacaaaugugccaaccgcuaccgcuacuccagacaauucaaacuaaaaucuaauaccuugguaaguuuaaagacacuuaaaucagauacaacauucuaaugaugauuaucuugguucaacaaugaaacuguuucccuaaaaauacacuuacuguauguauuaccugucaaaaguguaucaccugaggugaaguuuugcacuggauagcugugaauuaacuucaguuuuaaacaguugccaguuacuuuguuauuucuaaauauacuacugcucucucauguagaaauauuuaaaauucuaagucacuaaaaagccuuucauuuucauuucacgagauaugaaucaguauuucccuaucuauucacuuuuauaaacagcaucagcaacaaugaaugagucaauauaauauugauuucuaacacuuagaaauucccaaacuagauaaaaaauguuuuuugaggucaaaagcuaaauuuucaaauuggcauuacaaaguccugauuugugaacuucucacugacuuuaggcuuccaacuuuaagcaacucuaacaagaaucuuaaaaucagucacacacacacacacacacacacacacgcacacacacaaaccuguuuucuaaauuucuuagcuaaaaacaaaaacaaaaacaaaaaacaaccccucacuucuuuaucagacucucaaaauuacccucacugcaauucauucagauuccaaggacaagaauggaaaaggaaaaaaaaaaaaaaaaaagacuccagcagcucaaauauuuauuuuagaucuucuuugcaauguauuuaaauuuucaauuuugcacaaaauuacauaacaacuaaaaacuggggcaugcuggagguggcagugacuuggcugugacacaaaugcaaaaauuucacuccacccucucccccagggagcaagcaaaucaccuaugugacacaccuggucuccaccagccuuguggguaaguaccccaagauugcuuccaaacuuguaucucccagacagaagagcuaaaaauugaugauaaccccauguaccagcugacucauuuuugaaagugcgacccuccagcaucagaugucauacuguaaggaggcagagcuggcuugcaaaacaaaaaauaaaccugcuggcacugagggaagagaggcagauuagaaguuuucaaacacguaggcagcaaaacuuucaaaauuaacagggaaagagaagagagggaaaaaaugaggacaugaugauaggaaaauaaaaauauuacugcaaaaagguaagacacaagaagaaaaacaaaucuaagucuuagaaguacaauauguaacuguuacaaaguuuugagauccugaaaugggauagaguuuaaauacauuaucaaaugauaacuacaucuaucuucccaauuucuguucccuaagcaagagaauaugugaacuuuggcaucaaaauguuugccaccaaacuguaacauauuaauuacuacuuuuuacauauauuaaaguaggcuauuaaaaaccauugauaagacaagcuaaguaauuuaaaccaauccaguauagaagaagaaggauugaaagauuauuaccuuaaaauaaaucuguccugggucuauuaaacauagcaaaguuguucuacucaaauuggaaauuguuuuuuaaucaagagaaaaaugaauauaugcagaacuagcagacauuuuucuugcaguaauuuauaauaguuucugucugaaugaauuucuacucauccuaauaacaguauauuucuagaauauuauaaauaaguuaccaaagucccgagguuagaauucaaacucucaaaacuaugacauaugccaggugugguaguucaugucuguaaucucagcacuuugggaggucaagacauaaggaccacuugagcucaggaguucaaggucaaccugggcaacaugaugaaaccucgucucuuagccgggugugguggugggugccuuuagucccagcaacuugggaggcugaggugggagggucacuugagcccagaaggucaaaguugcagugaacugugaucgugccacugcacuccagccugggcgauggagugagaccuugucuuggaaacaaacauaaacuaugaaauauauaccaccuagcaacaguucccaagcuugacuuuggcuccuaaagagucuacuuauucuuuuacugccaaguugcuggaaguaagaauccuguaugugcuuguaaaugcagaacauauaaccuaauucaaaacauauaaccaaagggaaauuuuuguauuaaacuauugacuuagguuauccuaaagugugucagaauaacaagucagaaauuuuaaaacugaaacaauaaccaaauaacauuggauaauaaaauguaaaucucagaaugagaaucaauuuuaggucuugauuugaaucgcagaaaauaugaucacaaaacacccacuaaucugaauacugcagcaugagcuagcaaauucaaaugguggcucacuuccaauaacacuggugcagcuucuccauccugcaagccacuccuuuuaccuccacuguaacucucuaggagagaaaaguauacuaguuuuauuaauguuauaaaaacuucuagagaaauguuuaguuaaaacguucaccacauaaaaggcauacuuuaaaaugcauauuaagaaauuuuuaauguuuucuauaauguuuauaguaaaauguuuaaaaccuugaaguuuuuuugagaaauacuuuccuguuuauacauacagauaggucuuugauaguggcuacugauauuuuuaaugagaaaaaaagacacuaaaauauuuuaaggagauuaaaugaaguaggucaacucucaggcccacuauucuuagcaguauuccugccaacuauacauugucuucauuuuuacaguauguauuucacuuuacaaugacagccuuuuaaaggcuguaaaauaauucaaaauuaccuuuuacaagcuguggccauucggugacaucagggugaucacagcuuugagucacugauuaaaaacagguugucacaccagucuagcugcuaccuugaucugagcguaggcuuaauaacucuaauaaauuaaacaaaccuuugguuagaacacuuuaauauauaaacccaauucauuguucaaaaaauaauauucaaagcuucaaauuaggugucaauguaaaauucaucagaagaguaauuauuauagaaaaguuuuuaaggacuauuuuccagcauuuuguuuuucuuaaaugaucucuucauuugagaaaauguaauaauuccuuguacuuuuauguaauguuauaguuucugaagcauuuuggucaauaguaccuugagucuuauaacaacuuuggcuuuaccuaaucaagacagauaauauacuaagaauuaaaaaaaaaaaaaauuaagcagccuccgagugauuaacugacuugcccaagauuuuggaacuaguguugaaggacugacuaaaacccagauauacugacuuccuaucaagggauggauuuuuuuguuuguuuuggcuuaguuuugcuauacuggguuucaagauuuaaguauauguaaaugaguaaagauucagaacacagauugagaucuuucaaauacggacaaauucagucaaaagauuccuaagcugauagagcaaucagucaccaaggagggcaacugcuuaauggaauaguuauauacauacacauaaacacacacacauaaacacaaagucuagucccacuaauucuguauguacguaaagucauuuaacaucagucaccgcauguucucacucacaggugggaacugaacaaugagaacacauggacacaggaaggggaacaucacacucuggggacuguugugggguggggggaaggggagggauagcauuaggaaauauaccuaaugcuaaaugacgaguuaaugggugcagcacaccagcauggcacauguauacauauguaacuaaccugcacauugugcacauguacccuaaaacuuaaaguauaauaauaauaaaaaacaucagucaaaaccccuuaaguacugcauaaaaauauauucuacucuuucuuggccauaaaucuacuaagauuuaauuucaugaaaaaguauggcaaaagaugaaagcauauccuccucccucaaccaaauaucuuuuuaaccccuuacauggccuuagcugaacuuuucugauugucacaguucaaauuuagcaggccucuuuacugacacuguaguucuggcaaagauaccauacaucugaaauaucccaguaucaaaagaucauuuugugcaacuaguucuuuccccucacgauuccccuauccaggccaaaucugaggcaucaacuacggaaagaugaggaaauuaggaggaagaaaccuuucauaauuaacauccucaaagcaacaauagucaagcguaaaaggugguuaccaguguggauucagaacccaauauaaaacagcaagguaucugcgaauaccaacgguuaaaacaugaauguuugagcccauaccuaugcagcuaugaacgcagggcuucaaaauccagauuaggugaggauuggccugaauauauaaaaauaauugcaggggauuccaauaaaugggauuuauaguaucuguaagaaauaacgcaaucucccagauacuccuauccuaacuauacauugccuaauaagaacuuagacauugcugaggucauaugggaaacaccaccuucccuaaaauaaacaauguggucaugauacagcuuccccuuggguucucaagagacuaaugguauguggaauuagaagauucaaacaagucuaacuuuccaucuuguaaacacaaaaauaauaaaguuaaaauaucuuuuaauugacuaauugaccucaauguaauuaaagagcuauauguauuuugaaaacuagagucaaguccucucuuccaguccccucuuuuaugagauccggugcucaaaaggcuccaaggccaggcuggacuuaugucucuguuuggucauucacuagcugagaaaucuugggcaaguuacuuaaccucuccgagucucaguuuccuuauagguagaacuaggauaauaguaccuauuccauagagcugucauggauaaacaagcuaacaucuaaguaucucagaacagugccugacauaaugugcucacaaauggcugggcgugguggcuaacgccuguaaucccagcacuuugggaggccaaggcggguggaucacuugaggccaggaguucgagacuagccuggccaacacggugaaaccccgucucuacuaaaaauacaaaacuuagccaggugugguggcacacgccuguaaucccagcuaccugggaggccaaggcaugagaaucacuugaaccugggagauggacguugcagugagucaagaaggugccacugcacuccagccugggcaacagagcaagacucugucucaaaaacaacagcagcagcagcagcagcaacaacaacaacaaaugaaagcuauuauuaauacucauagcccaaaauccaaaccugcccucucaaucuuuuuaugcauauuauuuuaccucucauagcacacuaaucucuuguaaauuuuuucagcacccuaccugggucccucauacagucuuggaaguguaguuagugagcaccugacacaaugcuuuaaaaauggcaggggcccaaauuugcugaacacaucugucauuauuaugacauuaagauacacaugcaauacgaauuccaaaaaauaaaacaaaaacauaccauauuucgccaaacuucugaggagcuggugaauucuaaaaucaggcucuuacagauuuuuaaccuaaaauauaaaacaccucacucaauucuuuuuacauaaacaacuggaugaacuuucaaaaaaaaagguacuaaauuucaucauaaaggcaaauuuauuuucuauaauuaugaacauccaaaaacguaucaagaaacaaauuacugcuguugccgggaugaggaaagcauagguaggcaggcccuguggccugagugcuuucagcaggcaaagccauauuucccauauucauccauaaagcuuagugccuucuauuuauuuacucuauccucccuccaaaagggcuaaacacauaugaaaacuauuugacuauaucccucuaauccuuucaaauaccuauagcaauuuuguuuuuaauuaaauucuauaugcuaagcaucggcuauguuagguacaaaucugggcaucuaccacuuucuagaguagcagccuugggccgacccucugacccuugagucuccaaugucagguuauuguagcagagaaaaugcguuaaaaaguuauaguauaaugccuaccuggcacaaaacaggacuucaauauacgacgauaauuauaauuuauuaaaucaaccacuuaauauauaucaaaacuuaacucuuaaaaaaaaauccugaagcuuaaagcaagccccuaaauuaucacuguaaauucuuaacuuguuuguauacaaucagaacauuccucaauggaacaaaaauaaaguccuuucauguacugcauuacauauaaagaaagcaaaucucaaagguuaagaaaccuauccaguguccuagagguugaugguagaaagugaauacacugcauauaaaacauuuugaaauaaaauuaaccaacuuuuaagguuuuagagacugacuuucaaacuucagucuauaauagaauuaccuggggaaaucuaaaaaugcaacuacuugggcucuacucgcaaagauuuucauucagugcaugaaguagggguaaaugaauuuuuuuuuuaauuuuuuucagaccaacccaagaacgcagaaaugaauuugcauuuuaacauauacuucacaugacacacagaucucauuuuaagaagcccugccuuccaaauuaugaguuaggaacacauaaucauggaggaaauauaccaaaucuauaaaaauacagaauaacaaaaacuguaagcacuacaaauauuaggcacacucacuugccaauuuaaccauaagaauccuaauaccagacauaguucucuuacuuuaucucuucaacagagggcucagucuaauaaucuuauaaauaaguauagucuaauaauaaaugccuauguugaucuauaucuaccucccuaaaauuuucauuuuauucauuucuauuuuuccuucaccuccuucuaaagcuguuucaaaacuuaauuucacaaacuguuuuuuucuaucacuuuuuauuauaacacccaacacuucuguucuccuuugcaucauguuuauggugucuuauauuuauggauaaugcuacuuauuaaaacugucuaaguuuuguccguuuacacauuucacaauuaaaggacuacuacaacaauuuuccuaaguccuccugcuuuaguuucuccuuauuccaguccauucugcaguuaagacuuaaaaaguuuuaaauacugcuuucaaauaauacuugcaacauaauucccucaacuccauuagcuccucagaguaccauuucuuuaucuucuuuccuuuuacugccaaaaagacgugaaaaccacuagcucagcugcuauuuuucuaucuacugaaauuuuucuuguaaaguuuccaucauuucuguauauucccagugcuuuggccccuuaauccuacuuaauuuuuguagcuuuuaagacugcuaaugacuccucaccuccucuggcuucccuaauguuguauccacucauuuucuuccaucucucuaaaggcaauaaggucuucugcuaguucaucuuccuaccucauacauggccucucuccaaguuucugucaauagccacuuuucuuaaccuaaaccaauuuucugcgcaaugucauccauucccauagcaccucuaugcuuacaaaccccuaacucuguaucuuuaaguccuuaugucuggcaugguaugccugcaacuacauauuaccaacgguacacauccauuuggaugucucauuaacaucuacauucaacguaucuaauaucaaacucaauuauuuucccaaagaacucacucugccuaaucucacuguccugguuaaggacuaaaaaaauuggugccauucauuacuuucucccccucauuuuuauuugcccuaaccacuguguagguugauacuuguucagccuucaaauucuucauaaucauuaauucaaaaacugucuacuagauuuugagugccuacuagguggaugaagaugcagagguagaaaaacuagacauaauuucuugcccucauguggugaaggaaaugggcacaaauaaaaaccacaauuaauuaugcaauaacaaugcacaguuaaguguugugauggagagauacaggggguguuaaguuguguacuguaauaaaaaguccuuagucugaagaaaaggaaaaccauucuuuaugagggacaagcaagauuuacaagacacacuaagaaaaacccugugagguaaugaugguagcacuaucaguccagcugcucaaauuggaagauucucagucauauucuaaagagucucucucuuucccaguauaucaaauuguuuaccaauugcuaccaauucauccuuagaaauuccccuacauuucuacauucucacauuauuccccagucuuuuuugauugcuuuuaguugcuuccagaauaaagccaaagcucccaaucacgucagaugagauucuacacaauuuggucaaaaccugccagugcagccucuucuuacagacuagaccagacuucaagagaacauguguaucauuugcuuuuauacuuccagugcuugcaaauguuuauagaauaagcaucuuacaaaagagaaaauuuuucucuuagggaacuagcuuucaguccuuuaguaaaugcaagguuaagauucaaacccuaauuugucugauucuaaagaccacgcuuauucccuuguacuugccuucuaauuuauacucaaacccuaugaauuuccuuaaaaauaucucuuacuccuuuuuuccucaaacuuaccaacacuguccuacuacagugccccauuauuucaucugguuucccuuuugccuuuauccucaacuuugccacuagaauuaucuuccuaaaaacucaaaguuacacauaucauucuauauucaaaagcuuuaacacuuucucaugccaacagaauaaauuucuaacuccuucacauuuuauuugaggccccugccauguggcccugaccccagccaucccagcacuacugcccacuauaugacaucaucaccaguuaccagaucuagucccaucauuugacuauuggcuauaauguacuggauauuuguguuucugacuucaaugcuuuugcuucugaggagacuucacucggaaaugguccucuauccauuacuaaccucuaucccccacccaccuaucaugccauguuaaaaacuggccucauucuaaacacuguaucucacaggguuaucuaaacucuuauacauaaucaccaucuccuucaugucuuauuauacauucuuaauaccauaaaauaauuuauuaauuucuccuuauauuuauuauguuauaccuuacauuacagcuaucuguauacauuugucagugccucuaguuguaagcugauugaugguagggaucaucucuuccauauuuuacuuuucguaauaauggugacuauguuuucuugacaccauaccuccccucuacaagaaaaaaaaaaaaaaaaaaaaggaaucaggacccauggccuuugagcuaguuccaaaugugacucauagaugaacaaagauaccauuucuucccaaauuaacacaaauauaaguaaaugccaauuuaagaaacguuuuuucaaagacuaaauauguaagaauaaccaaaacaauuguuucuaauaauguuccuuucucuaccagauauuaaaacauauuaacuuaaauggaauaauuaaaaucggcaugccuuuaaaaaacugaguauacacuaaauauaugcauaccuuaugacuuaaaaauuucacucuuaaguauaccaaacagaaguaaacauauucacaagaagacaaucacugaaauguuuagagcagcagcaauauucuuaacaguuccaaaccaaaaaugauuaaauguccguaacagcagauuaaacuauggcauauucuuaaaauggaauaucacuuccauucuuaaaauggaauauacagcgacuaucauaaacaauuacuacaaccaacaaugugaauaaaucucacaaauacauuaaaagaagucagacacaacuaaaugugcuugauucuaguuaaaggaugaaaacaggcaaaucuaaucuaugcuaugagaagucaggacagugguuacacauggaagaaaagggguagugacacagagcacaaggggcuacgcaggagcugcugcuguuuuuugaucugaaugcuagcuaaacgggugcucagugugugaaagugcaacaagcuauacacuuagaaguguauagcuuaaaacauucuaaaaaaaaaaaaaaaaaccucauaugguauuagcauuagacaaagagguaagcacaacaagcacaacagaaagcuaauuucagagaaagauccgaaaguaucugacaguugcuccuucucaaacgagaauuuucagaccuuggauaacaggcagcagaggacuauaaugcaugaaaggacaaaaacaaaggaggugagccauccacugcuuggaugucugccuggagguaauuuccaaccugcagucaauggaggggaaauccagugagaagacagcaguuuuacugaguucagaaucaagagaucagagcugagaaagcugaaguggguaaaauugaugacaagugccagacaagugcuugucugagaaggcagagaaauggcuucagaaaucugccauuugagaguccacugcugaguacuaacuguacacgauuaagguaagugacuccaugaagcuagugaaagaggggcaguaagcugaaauauucccaguacuuauaaaggacugggagacuccuaaaauucucucuaaccugagugaagagaacacggugacacugggagcauuuaguaaagacucagaaggaucaugccuuagguaggagcuacuaccauuaaagcaaagccuucucuagacaaacuccaauguagcccugaagggauaaaacugaccagcaaguuauuuagguggcuacaaaacaaaacacucuaaaagaaaacaaaaucuagacacccaacaacaaaauauuacaauguccagcauccaaucuuaaaaaaucauuaaauauguaaaaaacaaaaaauaaaauaaaauaaauacuaggaaaauacaacccaugaccaagagaaaaaaccaaccaacaaauucagagugaaaaaauucaagaaaucaauaaguaaccugauuuucaaacagcuauuacaaauaugcucaagaauucaaaaaaauacaugaauaaaaugaaucaaauggaauuucuugaaauauaaagcgaaauaucugaaauuauuuaacaagggaggagaaaaaacaguaaaauagaagacaaagcaaacugaagcacagggaaauaaaaagacugaaaaauaaugaauaugauguuaaugaccuguggauaauaccaaacagucuaacauauguguaacuggagucccagaaaaagaggaaaugaugaaagaggaguaaaggugguaaaaaauauauauauagaagaaacaauggcaacaaucuuccaaauuuaaggaaaaccauaaauguacagauucaaaaagaaaaaaaaaacaaaaccccaacaacucucagcaugguaaucauugugcaaauaucauagaacguacuuacacaaaucuagauuagaugguauagcuuacuacagaacuaggauacaugguauagcccgggugcuccuagguuauaaagcuguacagcauguuacuauacugaaugaauacuguaagcaacuguaacaaaguguaaguauuuauacaucuaaaccuagaaaagguacagugaaaauauggugguauaaucuuaaaugacuauugucaacuaugaucucguugacugaaaugucagcaugcggcacaugacuguauaaccagacuucucaucaaaaacaaaugcugaaagaaaaacacaucaacuaaccaagaaaaaagaaacauauauguccacacagagacuucuuuuuuuacacaaauguucauuguaccuuuuuauaauagcugggaacugaaaacagccuggaacugaaaacagcccaggugucccuuaacagaugaagucacaaaccaccgaaacauucaacaauauggaugaaucucaaaaacauuauguugagcaaaaagaaacuuuuuacaacauauaaguauuguaugacucuacuuacauaaaguucugcgcaagcuaaacuaagaugaaaacaaucugaacaauguuagguucuaggggugguguggggggaaggaauaacuaggaagagguguagguucuauacccugauagaacuuucuggcaaagguguauacauuugucacagcucaugaaaugguauauguggucaacuguauuuuccaaagauggucacaauagaagccauuccacaugcucuuaacaauguaacacugucauuuuuucaucaggugguggagucuauggcccuucuccuugaaucugagugaaauuagugagucuuucaauccaaagacuacagucauaccucaacuaucuacagaggacugguuccaggacucccauggaucccaaaauccaaggaugcuucgaaucccuuauauaaaauggcaugguauuugcauauaaccuacaugcaucuucaaauauguuaaaccaucucuagauuacuuauaauaccaaauacaauguaaugcuauguaaacaguuguuacaauguauugucaaagacaagcucuccuugccaaucccugaccaaaugagagauucaugagcaaaauaaauaguugcugauauuuaaggcacuaaguuuggggcaauguauuacacagcaauaaauaacuggaacagcauaguaaauucuaguuaaaaauacuaaacuacuaaguuuuaguuaacauacaugcucaaguuaagggugugguauacuaacaacugcaacuuacuuugaaaagcauaaaaaaagacacuagaagaagacaggauggauagauggacaagauagaagacaauaacaaauagaacaaaauguugugaaauuauauucuacaauuauuuuaaagucugugugguuugaaaaauuguacgauaaaaugaagagugaaauaaagacauuuccauacaaacaaaagcugaaagauuuuguagccaguagaccuauacuuuagaaauguuuaagaaauuuuuucaaguaaaaggaaaauaacaccagcaacaaacuuggaucuacaaaaaggaaucuccacaaagaaaaauaaauaaaaaugguaaauaugaagguaaauauaaaggaauguuauucuuaguuuuuaaguuucuucguaagacaacuggccuuugaaagaaauaguuucaaacgcugcuguggaaucuauaacacauauagaaguaaaauguuaagaucauaauaccaaaaagaaugagggagaguaaauggauguauacuauuccaaaauucuuacauuauacauuaagaggaauaauauuuuugaagguagauugagguaaguuaaaggugcauauuguaaauccuagaaguaucacuggggggaaaaaaaacagagggacaagcuaauaauggagacaauacaaaauuccaaaaaugcuccauuaaccgaaaagaaggcagaaaaggaagaaaagauuagacaaauagaaaacaaauagugucuuaaacacaauuauauugccaacugcaauaaauguaaauggacuuaaucaaaaagcaacgaucguaaaaagucaaucugaaagcaagaugcaacuauaugcuaucuaaaagaaagacauuaaaugaccaauaagcugaaaauaaaaacacagcaaaaugauauaaugugcaaaaauuaaucauaagaaaggaauggauacacuaauaucaaaguagacuuuagauaaggaacauuaccagcgauaaacagagacauuucauaaugauaaagacaucaauuaaucaaggagaucuaacaguccuaaaugugaacacaccuaaggacacaacuuuaaagacuuugcuucaaagcauaugaagaaaaaaugaacagagcagaaggaagauaaacucaaaauuauaguugaagauuucaacauuccucucucgguaauuaguaaguggacagaaaaucaguaaggauacagaagaaauacauuuaucuaucugacaaagaacauauguucugaaaagaaugugaaaauauuugaacagacacacaaaagaaaacuucucaacagcagucaugaagaaaauguaaauuaagaccauaaugacuuuuuacacccauuagaauggcaauuauuuuaaauaaaaaacagaaauuaccaaguguuagaaaagaugcagagaaauuggaacccuuauucacugcuggugggaauguaaaauggugcagucacuguggaaaacaguauggcagucucuaaaaaaauuaaacauacaauuaccacaugacccagcaauuccacuccuaaguacauaaccaaaagaauuaaaagaagggacucaaacagauacuuauauaccaauguucauagcagcaucauucacauaguuaaaaguuacaaagaguccaaauguccacugacaaauaaauaaauaaaacaaaaagugauauaugcacacaaugaaauauuacucaaccuuaaagaaucaaauuuggauacaugcuacaacaugaaugaacuuugaugacugauacgguuugaauauuuguccugcccaaaucucauguuaaaauauaauccccaauguuggggguggggccuggugggagguaacugggucaugggagcaaucccucauagcuuggugcucuccuugggauacagagugaguucgcagauguggucguuuaaaaagggugugccacuuccccacccucucucuugcuccugcucucgccauaugacacgccugcucccccuuugccuuccaccaugaguaaacucaccaugagggcuccccagaagcugagcagaugguggcgccaugcuuguacagccugcagcaccaggggccaaauaaacuucuuuucuuuuuaaauuacccagucucagauauucauuuaaggcaacgcaagaauggccuaacgcaaggacauuauuauuauuaaaugaaaugugccagacacaaaaggacaaaaaucguaugauuccacuuauaugaaguaccuggaagagucaaauucacauaugaaguagaacagugauuaccagcagauagggagaguaggcaaugaagaguuacuguuuaauggauaggguuucagacugagaagaugaaaaaguuucagagauggauaguggugauggcugcagaauaaugugaauguacuuuaugucacugaacuguacacuuaaaaauaguuaaaaugguauauuugauguuguguauuuuaguaccacuuaaaaaaaaacacugcaaugggauaccacuacacaccucucagaacgugugcaauuaaagacugagaacaucaaaugcugacauuuggagaacuggaacucucauacacugaugaugggaauguaaaguaguauaaucaucuggaaaauaguuuggcaguuccuuauacauuuaaacauaaacuuaccaugugacccaguaauuccaauuuaagguauuuacccuagaaaaaugaaaacauauguucacacaaaaacaugcacacaaaacaguaccuuuauucgcaacagccuaaaacugaaaacaauuuaaauguucaccagaaaaugaaugaacugugguauagucauauuguauuuaaaaaaacgaaacaaacaaaaaucugugacaaacacaaauuggaugaaucucaaaaacaugccaagugaaagaaaccaggcauggaagaguacauguuacuugauuccauggauaugcaauucuagaguaggaaaacuaauaaacagaucagugguugccuggggccaagagggagaaaugacuacagacaggaaggaacuuuuuggagguaauucaauuguucuaaagcuugauuguaguagcagugauaguguauauauuuaucaaaaucaauaaaacuauauaguuaaaaugggugcauuucauuguguaucaauuauacaucaauaaacuugauuuuuuucaaaguuugugagaacuuaauauagaaaaagguggcauuaucaguggggaaaggaugccuuacaagacaaucagcuacccaaguggaagaaaauaaaagguagauauaauucccaaaccaugacaaaugcaauccagaucuaaaccauaucauaccauauccaaaaauaugcugaaugcucauaucuaacuuucuaaauuaaagucuauaaaguaaaaucacaaaaguaucagaagaaaauacaagagauuggccagguauaguagcucaugccuguaaucccagcacuuugggaggcugaggugggaggauagcuugaggccagaaguuugagaccagucugggcaacacacugagauacguucucuaccaaaaaaaaaaaaaaaaaccaaccaaccaaaaaaaaaccaacuagcuauaguggcacaugucuauaaucuuagcuacuugggaagcugaggcaggaggaucacuugagcccaggaguuugagguugcagggagcuaugguugcuccagcccgggugacagagugagauccuaucucuaaaaaguuuuuguaauauauauaugagaucauauuuauaucaacuuuguuagcaugcugaaacccagaaaccauaaaagauggacagauuugccuacauaaaaacuuuaaaauuucacaugacuagauacuauaaaauuaaagguagguagagauaauauuugcaaauuauaauaaagaauuaaaugauauauaaagaaugcuuacaaauuuaaaaaacaaacaccacaauagaaauggaccaaaaaaccaggcaauuucccagguuauuuauaaagacuuaaacagauuuuauauauacaugaaucaaaacaagguaaaugagcagucccuaauauauuuuaaggaaugaaacuugcuaaaauuauuuuuuaaaagguaauuggcaaaaccuaucaaauauuuagauugacaugaucuaauggccugacaucuuauuuguaggaaucuaccuuacagaaaaaauaacagguaccaucauugcaaaagcaaauauugaaaacaaccgaauuuccaaaacaggcaaagggucucauaacaucaugaacucucagaguuaauuccuaguucaguucuaaagauugagagaacacaucagauuuagaguauuccaucucagguuucucaaggacaauuuuucauuaaggccuaauuuauuauauuuuaaaacaugcuuuuccauccuuuuuucuguuuuuccucuuuuccccccacaagcuuauaugguaaaauuaccuguaguuaagugggcaugugauaugaugcacagauuuaaugcaauaauuuauaagaauuauccaacuccauucucucagcugcucuggucaaaaaacuuuggcaucauguuuuacuccucccuuuauuucccacuuucaucuggucuacuaccaaauccuauggacucuauuucaacauauaucaagaauucaaccacuucucaccacccucacugugaccacucuguccauuucagucacgucuuaaucuguacuaauggucuaccaauuggucuguuucugcccuuguccccuuuuucagucuaugauuaacacagcaaccagagugaccuugcuaaacauaagucauacuuuuucacuacucugcucaaagacuuccaauagcuucccaucucacuuauagguaaaaaucaaacaccuuauuaugaucaaaauaucuguacccuccauucucucuauuucccaucaauuacuuuucuaaagcuacacuggccacaccucgaguucuucaaacacaucaggcacucucacuuugggguuucccuauucacuacacucugccugaaaugcucuucccccaaauauccacauggcuagcucucucaucucccucaguucuucacccaaguuaccauuucagugaaguuuucucuaccuacccuaucuaaaauuucccaucauccuuuucaccugcaaacacuucccuuauuuguuucuucuccuuagcacuauguaacauauauuuuaccuaucuuuaugaucucuuuuuaggauuuaagugccaugaaagcaaaggacugaguggguuuuauacacugcugucucuaccaggaccuagaaaaaaaggcccacuacacaguagguguucaagaaauguuuacuaagugaaucagauggauguguauguagccaaccauuugaaagauuccuauaacacaguuaagaggaaaaaaaaauuauaugaaacacaaguuuuaguacacaaaaaucuaugcacaaggaauuaaaaaccugaaaugaaauuuuaaaaaauucaauuugcaauaccaucaaaacauaaaauucuuagaaauaaauuuuuaaaguaauaaguacaagaccuguauacugaaaacuacaaaacaugaaagaaauuaaagaacaccuuaauaaauggaaagauaucccaugcucaugaaugagaagacaguauuaagguagcaauacuucccaaauagaccuacagauucaacacaaauccaaguccuauuaaaaucccaguugcauuuuuuugcaagcuaacccuaaaauucuauggaaauuugagaaacccagagacccaaaacaauuuugaaaaagaauaaguuagaauacucacauuuccugguuucaagacuuacuacaaagcuacaguaaucaagaguguguguuacccaaaaaaaacagacauacaugucaaugaacauaccuugaaaauaccaugguaaguaaaagaacccacacacaaaaggacacauacuguaugauucccauuuauaugaaauauccagaauaaauaaauucauagagacaaagcagauuagugguuuccagaggccaggaaagaauggggaauggcugcuaacagguuaggauuuauuuuggggaugaugaaaauguucuaaaauucaauaguggugauggcugcagaacugugaauauacuaaaaacuuuaaaagggugaauuuuauaguaugugaauuaucucaauaaagcuauuaacaguuuugaaaguuagagaauauguuugguaggauuuuuuuuaaauacugccuccccaaaaggaaaaaagcuguauguauaucaguacuuuuacagcuaucuuacauuuuauauuugauugguaauuuccuuccaggcauuuuuuucccucuacaguuaaacacacuuaacaacuguuaaguuuuagaauuggcuaugaagcgaagagaaaccuuucauuucuucuuauacuuaaaaaaaaauagcuuuuuauuuuucuuuucuguauuuccucauccucaaaaauagauucuacacaccaauauuugagggaugguggggcaacuaccacaaaauacaagaggcucucuucuggaaauguaaaaauguuagaauuccuaggaacuuuucaugauuuaugagccuaaccuaacauuuaaaacugagcccaugcugguaaaucugggcuacacagucauacauacauagaacucuggaaucacaacacauccacugugcacuggaagaguacuguaaucuccuucuaaugugcaccuuggcucuccccucccuuggguucuuugaaauuuuuuuuuuaaauaagguauguuuauuucuuauuuaccuacuaacuacagaagguagacucacaaugugccaauauuaaaauguuaucauuccucauuaaaauauuuacuuaaguguuuuauuacaugacuuaccagcaauggaagaaucucaucugagaguaguucucaacugucaucuaugaaaaucuuuagaaauaccaaaucaucagaauuacuuuaauuuccuggcuuuuaaucauaaagcauuccuacuggucaacaauucuacaaucugaaaacagggacaucuguaccauauagucccaaugauuuauuauucugaaauuuuccucuggguuauuuuuacacuguaauuagaguucaaacuuccauagcgccuagccuaaaauuaaacccagaauuaugccaauuuaugccugcuauauaugcacacacaaaagacuuauaaugcaauauacuaaaagaacuaaagguagguggguuuuuccuugaaggaaucauagcuacauuauuuucaaguuuaaucuguuacauucaccugccuaucaaauaaauguagcacuuaaacgcauaaaacaaaauuugauuuagugacaaaaaaccauuagcuucuaauuuaacuucaaaacgcuuuucaaaaaaucuaccccaucuaauucuaagugaaccagaccacacuugauagaaaacuguuguucuaaaaaccauacguacuuaacacaaacaguaaacauaugagaacauuuagucuucuauuaaugucuuacaaaauauuucaauguggcugguuauaauuuuuuuuuuuuuaagggacagggucugucaccgcggcuggagugcaguggugugauaacaacucacugcagccuggaacuccaggguucaagcaauccccccaccucagccucccaagcugggcuaauuuuauuuuucauagggauaaggucucacuuuguugcccaggcuggucuccaauucguggccucaagugacucucucaccucugccuuauauuuccguuugagcuguuauuaucaacuggaguaacauuucuaguuggggaaaaaagaacugauccuuaucuguagaugaacacuuauacauucagcacuuacaaauaacugaaugugggcaugaaaaaaagaaugacagaugauaaacauuuacuguucucaaaauaaauuaccuaaucucaguugagauaaacacgacucagaauucaauuaacaguauaauauaaagaagccccaaaccaaugagugcaaaaagaaagacucucaaggaaggcuucccugaguaauauuuagguugagcccuauaagauagaaggaagauggauaacucaagaaacuaaaagcagccugugugguaagaugguacugaccaaaggggaaugcacaggaagguaaggcucagaaaguagacagaacccuaucaaagcaaaauuuuaaauagaaagcacucuucuauuucaaaauaacuguuauuuguucacaauaauacaaaggaauuauaaacuacuaaaacuaacaaaccaaagugggcaacauaggaagaccccaucucuacaaaaaaaaaaaaaaaaaaaaaaaaaaaaacccacaaaacuuagcagggccuggaggugccugccugcagucccagcuacuugggaggcugaggcaagacuaucgcuugaggccaggggguucaaggaugcagggagcuaugaucauggcacugcacuccagccuggggaagagagggagacccugucuccuggaaaaaaaaaaaaaaaaaaaaaggugggugggguggggagaauucaauaauuaggacgaauagacuuuaaaauguaguuuauacacacaguggaauacuacucagcuauaaaaauaagaauaaaacccuguaauuugcaggaacacggauggaacaagaagccauuauguuaagugaaauaagccaaacacagaaagacaaauaccacauguucucacucauacaugggcuaaaaaaguauaucucaagaagauaagcauagacuggugguuacuagcagccgaaguggggagugagaggacaaaggcagaagaacauaacuguauuuauuauugcugaacuguacacuuaaaaaacuguacacuuaaaaaaucauuaaaaaugaacuguacacuuaaaaaagaugguaaauuauguauguauauuuaaccucaauacaaaauuuuaaaaauucaauacuuaaugcuggaacaacuagcuuuucauauuuaaaauaaaaaauccuaacuccuuucagaugaaccuaaaugcaaauaacaaagaguaacaaaaaauccucaacuauuagcagacaauauaaaaagaggauuucuuaaacaaaaagcacaaucauaaagaaaaagacaugauuuuuacaucaaaaauuaaggcucauacuaccagagaauacuacaaugggcaggauuuuauauuuuacucuuauucugguaacuuucuuuggcugcacuguaaaguaagaagguuggaugaaaugaucuucaugguccuuuucaacauaaauguuguacgauagugugccuuuccuuuaaaaacauuuauuuuugagauauuuaaaacauacagaaaauaauaaauuuccuauccuuuuaccuacgauucagaauaaucaagcaacuguaaauuaaaaugagauagcauuucacaugccucaaauuaguaacuauuuuaaaaucugacaaucccaaguaugggugaggaugcuagaaaugcccacauaaugcugauaaaguauacaugggcauauccauuuaggaaaagaauuuaccaauaucuaguaaccagcaauuucacuucuacgguuuuucccaaaacaccugcacauacacucauguaaaaauaaacacugcagcauuauuuauaauagcaaaaagaaaacaacucaaaauauccaucaauagugggacacauacauuuuaucuaugcauaaaaugaagugccauacagcagugaaacugaauaaacuacauguacacgcaucaacauauacaccucaaaaacuugauacugaguuuaaaaaaaucaagcuauugaaagacagcguuauacaugucuguaaaaauuuaauacaaaaaccaacaccacauaucacuuacagauacauguacacauguauaguaaaaguauaaaacaaggaugugaaauuuacuuaagaaucucaagacaguuguuacuuuguguagagacggguaacaggacuugaacaguugggguuguuaaaagugauuauauaacugcauccuuucccccaagggauaaaaauggacauaauuuauauuuccaggugguggauaaauaggcacuugcuaugucauuuucuggauguuuuaaaaauuuuacaauuaaaacauauacacuuauuuuaaaaacaaacaaaagacauauuagcauauaauguccaagcugauaauuaccuuggaagauuaucuaauauaaaccucccuacuucacuaaaaacaaaauuacaaaagauaucagaauaaaaauaugauacaggcuggacgcaguggcucaugucuauaaucccagcacuuugggacgccaaggcaggaggaucacuugagcccaggagucaagaccaggcuggguaauauagugaaacuucaucucuacaaaaacaaacaaacaaacauuuuuuuaagaauguaauaggauuggugugguggcucaugccuguaaucccagugcuuucagagguugaggcaggcagaucaccugagguuaggaguuugaaaccagcauggccaacauggugaaacccuguaucuacuaaaaauacaaaaauuagccgggcgugguagugcacaccuguagucucugcuacucaggaggcugaggcaggagaaucacuugaacccaggaggcggaggcugcagugagcuaagacugcaccauugcacaccagccugggcaacagggcgagacuacaucucaggaggaaaaacaaaaaaaaaccuauauauauauauauauauauauuuauauguauuauauauauauaauacauauauauaagauuauauauauauuauauauauaauacauauauauaagauuauauauauauuauauauauaauacauauauauaagauuauauauauauuauauauauaauacauauauauaagauuauauauauauuauauauauaauacauauauauaagauuauauauauauuauauauauaauacauauauaagauuauauauauaauauauauaauacauauauauaagauuauauauauauuauauauauaauacauauauauaagauaaauacuauuguagcagggcaauuuuggacaaauacuagguuaucugaaacagcacuuuggggaauuagaucuugaccauuuaagagagagauuagccccaguuucucaaaaucuggcacugacuagcaauauggacaaugugugcaccgcccucguuccaccuccccuccuaggaaugccaugucaaauucagcacaggcauaggcaguaaaacugaccccuaguucugccuaucacuauuuaaaauuacuuuaaguguugaggacuguccccacagcagauaucuaaaaguaggccugaaagaacuagaaaguaguucaugcauccagcaguuacaagugccuaaaacuguacaugaaaaaacaaaacaaagaaaugaacugagagcaaacauuuacuguuuucuuauaaucuucaauccaggauuuaagaaauuauuuaauaucaguugagauacgugaccaacccauucuccagcugagauccaucuauuuuuaaauucacucccccagccuuucauucagccuaaaagagggaauaagaaugggaaggugggaaggacuuaucccauacugaguuaaauaagaccacaagaucuuuucauuuuuacaauauuugaaauacaguacacugagcaauaaauuuaaagaaauaugcaugauuugaaaugcagaaaucuugauuuauguguauaaaagaccaaaauuagcucaguucgucuaauacacuacacuuaaguguucuucaauacuacagucaacuuuucagaaauauucccauucugugaagcaggauguauuccuaccuugauuaccaaacuuuauccacguaacuuccuauucucccacucuguucuuuaaacauguucaacauguuacagagauggcaaaauguguuacaaaagggaaugagaaugaagcagcuuaaguaauuaggaaaacuuuacacuucuuagaaacugaauuugaaugaucuuaaacagcauauuuucuuuucuuuucuuuucuuuuuugagaugaaaucuugcuugcccaggcuggagugcaauggugugaucucagcucacugcaaccucugccucccagguucaagcgauucucgugccucagccucccaaguaacugggauuacagacgugugccaccacgccuagcuaauuuuuguauuuuuaguagagacaggguuucaccauguuggccaggcuggucucgaacuccugaccucaggugauccgugugccucggccucccaaagugcugggauuacaggagugagccaaggcgcccagccuaaacagcauauuuucaaucaccaacacacaacaugaccacugacuucagaaaacuaggaaagaaaaauguuacccaauuaaucuuugugugaaacaggauuuauccauuaguauacguaucacauaccauagaugcacaaaagauuuuuucaauucccaaaacaaaaacuuaaaauauuuagcaaagauaauauaaaaauccuuauuuauggcacgcuguaagauuaucaauauuggugcauauaaccacagaggcacaauagaauucuuaggaaaaauguauuaagacaauuaacaagcuggaaauaacccauauuuccccuuaugacccauuagcuuuauauagaaaacacugcugugcacuucauccuuugcuuucuaaagaacagcauuaugguucacaucuguuaagagacaaaaaaguauuuguuggaaguacgaaaggaagaaauuccuguacuguuacaugcagugccaaaggaaucaucugagaagaaaauaaagaacaugaguuuaacaugagcuuuagagagggauuacaagagugcaagaaagugacaaaaugugacauauguccauagugaauacauggugcuuuauuguuuucaguauuucuauauuuaauuaggagguggaaaguuucagaauuuauucugcaucacaaagauuauaaaaauauaugaguugggguguuggcuacaguacacaaaggcaauucuaagacuacuuauuaacagaagcuugaaauggaaaagccaucccuucugauuucauuacaugaaaagaaccuguguagaaguacagcaaugguagcaucuucauucagcccacagcuauguaauuuguaugcaagagugcuugucuuaaauaugaaaaggaacauccugaauugcugaaaguauauacaacgggcacacauccagaacuaggaaagagcuaccaagccugcaugcuacgaagacaugggucaaaaaauuuuucucauguuugguuucuauaacuaaagucugugcuagacuaaccucaauugauccugaggagaugaacuucuggaacacacaaaacuguuaagagucacagcauuagacucuacacuguccagccaacaguuuuaagaaaaauuuuauccuacuuguaugaguguucagggcucauauacuaccucuaugcucuuacuugaaacacagaugcagaccuuaauaaauaaagucuuacaucagacucucuucuauaauucacaugugauuccuuacacgagauuccuguucagauuuccugaaaaugaacuauaggaauaaucuuauccaauaugauucuauguccccuaaaaauaucuuuuccuuucaggucaaucuuaugauucacuugccauugaucagauuaacacaacaggucugguacagcaaauuacaaaagagauuugacuuuugauuaauacacugaauaauguaucacaaacuauuaagauccauuguccaugucaaauggaguucacauauuuaaaaugaauucacacacuaaaaauuccccaaaacaacguuucuaaaaaguuuuuuuuuuuuucuuugagaggcagucucacucugucgccaggcaguagcaugaucuuggcucacugcaaccuccgccucccguguucaagcguuuccccugccucagccuccugaguaguugggacuacaggcaugcgccaccacguccggcuaauuuuuuuuuuguauuuuaguagagaugagguuucaccguguuggccaggauggucucgaucuccugaucucgugauccgcccgccucggcuucccaaagugcugggaugacaggcgugagccauggcacuuggccucuaaaaagcucuuaaucuacauuuucaagaaugaucacguuugaaaagcauacucuuuuaaaacaaagcaacuaucacuuucauuugacaaaagaaggaacgaaggcuucaaaagcuaaauaaccugcucaugaccauuacgaagcuaguuaaaacaaccucaagaccaaaagacagugcucauuccauuucaaugacucugaugcacuuaaaauuuuauaaauaauuuuuagggauaucagucauaaggcuuagaaucaaauaguaacgacucauguacaaagaccaguauuuuuuaaaaaugcucagcugggcaugguagcucacaccuguaauccuagcaccuugggaggccaagccgcuugagaccaggaguuugaaaccaaccugaacacggcaagaccccaucuccacaaaaaaauuaaaaaauaaaaaaauuagccaggcaugguggcauaugcuaaucccaccuacucaggagggugagaugggaggaucacuccagccugagacugcaaugaguuaugacagcaccacugcacuccaacuugggcaacacagcgagacccugucucuaaacaaauaaacaauaaguaaaauaaacaaaaagaaaaugcuaacuuuacuucacucucagauaggccuaauaauuaauaagcuucuuuuugaauuauuauccauaauggcauuuaccuguuauugauaacucagaucaaagcacuacuaagcaacauuuuugauagcaaaugaaaacaaaagcuggcaaagaaacuguguauuaauaagucauuugauuaaaaaaaaggacuuggccagguauuguggcucaugccuguaaucccaacacacugggaagcuaaaguaaaagcugaggaguucaagaccagccugggcaacacagugagacccccaucucuauaaaacaaaaauuuuuaauauuaucuuuuuacaaaggacuuauuuauauggcaucuucaaguauuucaaacauuucguguuuggauuauggaauaugucuccagaagaauuaacacuauuucuauuuaagguaauuuuacaucauuuccuuuauuagaagaaauaacagaucugcagauggcauuuugugaaggcugccuucuauuaauaguguacaaaacacucauaugucuccaaaaaggugggugaguaaucacaaagcaaguauaacuauucaucccaaaagguaggacagaacaugugccaaugugugcagaguccugaacuagagacauggacucugguucugguucugacaccugggugacuuuaagaaaaucauuuuaaagcuuugcacuccaauuuccucuuguauaaaaugacuggagcagcugaccucauagacaauccuacucagguagcaucuauccauguacugccagaagacagaaugauaaucaugccccccaaaauuagaguauuugaagacaacugccggaguaaaaauuuuaaauucuauauacauacacacacacacacacacacacacacacacacacacacacacacacacacaaauacuaauacacuacgugccagauacugggguggugggcugggaccaaggaaugaaguaaugcaugugccagaggguugaacuuuuuaaaaggaguaaaaaaguaaaucuuuacaguagcagcugguggguaggagguauugaguccauagaacugcucuuagauuggaagggcaugggaaaaugaaguuccauuaugugauaggguuuuacacacacacacacacacacacacacacaaaugugagaaagucacucaacuauaagcauucaaaaaagacagacaucuuucuugucuuuguggguccuguacuuagcucagcucauagaagccacaggaggaaccuaauaaauguuaguugaucauuuacugauuuaccaauaaccaauucaugccugcucuagugcuguggucugaaugugucccccaaaauucauguugaaagccuaaccuccaaggugauaguauuaagagguggggccuuugggaagcuuugccaucauuaauggaauuaaugccucuauaaaagaggcccuauagagccccgucuacucuucuacuacaugagguaauggugaaaagacagcuagcuaucuaugaacaagggaagagggcccucacuaagaugucaaauuuguugguaccuugaucuuggacuucucagcccccagaaccgugagaaauaaacuucuguuguuuauaagccaugcugucugugguguuuuguaauagcagccagaacagacuaagacaucuaguaacacauucucugguaaacacuaggaauuccuggccuuaaaaaguucauagcuaaugagaaaagaaauaaacaacauaaaggauaacaugcuguaguccacuacauacaaggugcuuccagaccauucagaaaaacuggauaggaagauuucuaagguaauacuuauugagugccuacguguuaggcguuuuacauacuuuaagccucacaacucuggggaaguuucaccaacccauuuuacagaugacaaaacuguggcuuaccaagauuaauaaggccagaauuaaaauuagggucuaauuccaaagauauuaccacuauacauaccaagaugucuuguuacuacauuuuauccuuacauuuggcagugaggggaaaacucaaaaagcagucaaaaaacuuuuguccugaaccaacauaaaaagagcaccuaagacuucauccaguauuuuaccgaaagaucacuucuaaaaguuugucuucaccccgaucuaaaaauuagaaaacuaauuuucuuucagcagcugcauauguacauaauguaauguuucuacauuuagaccuacacaauuauaagucuaaacaaaauauguguaacaugauuggagaacauaacuagcagucauuuaagaaaauggacauuuggaaacaucauuucaagagcuugggaugaaaaauuuugcuaugaccuauaaaucuggaucauuccacugacugacacugagagaaacaguguauuaucacaguuuacacaguaaauuuuuuuggaggggagagggaggagauugaaauagaaaugaucgaaauagaaauuaucuaaaguuuaagaaauacaacugauuaaauguuacaugucaaagacacuguagguacccaauaaauccuguuaaauggacugcacaagugggaugagaacacguuuuccccacaccucugacuaguauguaccuuucuuaggaaguuauuuuuucagccaugggaaaaaaaagggcagaauuuaggacagauaaaacauaaguagcuuauaaauccucugaaaggaaaucaaaacacaguauuuuguaucucuguauaaaguuaagcuccucagggacaggggcaauguccagaggauagugagcauacuacuuagcaaacuaaugcagguuaauaaauauugacacaguaagacuagcauaguuuacauucuaauuuuguaaagauuauaaguuaccucuucauauucuguucuuuuauuucuccuguguauauuauaaauacacaaagauugaaaauuauuucuugaagcuauuuccuuuuuuauuuuuuggucaacuguauuaguguuucuuaaaagggcuucuggucauccuuagggcuuaucaguagcaucauuaauaauguauucauuucacuaaaaaugugguaaguagcuuggauuuaaaaacaggaucuaauuucaaagcuauuuccacuauacacaccaaguuacaacuuucuuaucucuccuaaauucuaaauuuuacaugauuuaccaaaucacuucuuaaguaagaguacuuauugaucagaagugugagacaaacaccuuaucccacuuguccaauuuauucaacaagauugauuggguaccuuugugucucugacagguaacuuucaacaguuguauuucuuaaacuuuaggucgucucccaaaaaaaacuguaauaauuugcugcuucucucaauauugcaggcaguaaaaugauccaaaauuacgggucauauccacauuucuucaugauugagguuaacugugcacuguaaaccccauaugcuauuaguuuacauuuucaacagcacccucgccacuuaauaaucucaaacagauuuuggacuguuacuaauuuagcauauccauaaaaagucauuuaaaaaauguagacgcuaaauucucuuucaagguugccaagcuucaccagugucuguauuaaaauuauuucuaaaauuuuacggacuaaggcauuugguacauucaauucuaccuuuaccaacaaaagccuuuaccaccaagaugaggaaagcauccuuuucauuuucuacacugaaaaggggggggaaaaaaggccaacugcuugcauacaggucugcauauaacacagcagucucuggcaaagccaauaacucacguucaacuucagaaauccugguggccgguaacacagaguaaccugugcgcacaacccuugggcuugacauaccacuucauccgcccucccuucccaucaauccacccccaaaaccccaacccaccaagcacacggcuaaauaugucuuccccaagagagccaaaaaccuugaaaacgccgagaaagggcuccccuuugaaggaaagggccugcccuucccugucuggggccccggcuggcucgaagagccuggcuccuaggaggcccaaaucucgacgccucgcacgucccgccccgccccgggcccgcucgcguccccucgggcgacaaaacccucccgccgucgcucagccaggacugacaguuacggcugcagcagccgcggccaccaggggccuacuucuggcaccagccccuucggaccacgcgcccccaaacacucgccucggcggcggggggcggggaaggggggugucgaccucgccacagcgggccccgaaggccggccgagugacggaggggagccagcgccgccuggcgcaggccgcggcaacacugaccugucgucgcccccgcgccugggcugcggcggccgccucacuggucguagucgcccucgcccgccgccuccgcccgccaccgccucguucucuuucgcugccgccaccgccggggcucaugcgggacccgcgcuuccuuauccggaaaacgaggccgggaaagggagcgccggggccgccgaaaucccggcguucgucgccagccgccgcugccuguccacaccggggggcugaggggcccuccugccaggggcuacaggccgcgagcuauuccgaggaggagccgaaggaggcgccgccgcccgcagccgagcgcgccgggucggcagaggugaagcguaaguaggcggcggauggcgggcgcccgcgcuggcggauggcuacgcggcggaggggugcgcgagcgagcgaagccuggugugucggguccuggcgaagggaaaaggccccgucgucuccuguagucaccccgagcccagcgccaccaucuugggagacacacggaucucgcggccgcggcgcaagacgggaggacuggcu

SEQ ID NO: 191782 - RNA, 100374 nt, Homo sapiens
gcccuggccaaggaggaggcugaaagagccugagcugugcccucuccauuccacugcuguggcagguaagcucagaugcggguaagcacaggugaagggaggucaggugcagguauccucagguguggguaaacucaagcguggacaaacucaggugcagauaaccacagaugcaguuaagcucagguguugguaaccucaggugcagguaggcucaggugcaaguaagagcaggugcaggcaagcucaggugugcuuucuggggccuguuacucaucuccucuugaggcuggcuggacaggacccuauggagcagcuggugaaccuguguucagccuggguuccaagaggcugucucagcagaagggacccaccagguugauucacagaggggauaaguacucugucagcuggucucaaagaggcugaaacccucugagcuucccucagggccagcuucuaaauccaggugccagggaucugcucaggagccccggcuccaggccucaaccucuugccugucauuccuuagcaucuuacuuugcuucagggaaaaggugcaccuuccuuagaaccccagaaaaugcugaaguucuaggagagacaggguuuauacuuguaagccuuuaucagcugauauuucaccugugaaagccuuggggaagagauugguuacacggaacaggaucaggaggggagauuacugcucccucucacugcugggagcagugcaaacugguuucuggaaggcaguucaacaacaugcagcaaagcccugcaaguccacaccuaggaacccauccugaggagcgaauccugaagggaugccaacauugacacagcuuugugugcuaccgggaagcacagcaaacaacccaaacgcccagaagcagagggcuggacacaucaaucauggucuguccauaggaugaaacaucacgcagucacuuuuaaaaugacagagaaaaaggcauaauaaccguacagaauuauuguguuuuucauuacacacacaugcaccugucuaaucuauucacggaaaaagccuagaaauacaaggaaauaucaguuguuuuaggauggaggccuuaugggugguguuuauuuauucuuuuguacauuucuacauuuuuugucuucuuuaaucauuuucuaucacaaauuaauuuuccuuuuuuucccagaaaauauaucuuuuguacuuuuuauuaguacaucauaguugugcauauuguggggguacaugugauuuuuuggugcauguauacaauguguauguuuuuuuaaaccuuagcaaaaauuagcaaaaguagugggggagguagggaggaaugaaaauauuugcagggccaggcgcgauggcucauggcuguaaucccagcacuucgggaggcugaggcaggcagaucacgaggucaagagauagagaccauccuagccaacauggugaaacccugucucuacuaaaaauacaaaaauuagcugggcaugguagugcgcgccuguagucccagcuacucgagaggcugaggcaggagagguugaacccaggagguggagguugcagugagccgagacugcgccacugcacuccagccugggcgacagagugagacuccaucaaaaaaaaaaaaagaaggaaagaaagaaagaagaaagaaacaaagaaagaauauuugcauaaauuguguuugcguugacaagggauaggaacugagaauggggaaggaagaugagacacauuuucucugucugaaucagauauuuagggaggaauuaagaacggagcccugccucucuaugagugcacuugaugaauacgggacugauucugggaaagacugccuuuggucagguucucaaaacaccauuguuuugaacuauccagcagcaguuuuaauucauggcauuugcaauuauauuuauagcauaaauugucuauucucugcaguguauuuuuuagcccuccucccccagaaaauguaauuggaaauaucaacucauguugaauguguuugcuguaccuguuuauguuuuauugauuauuuucugggagaaguuuggaguuguguuugguuuggcucugugcaaccucauuuauuugcucuguaaagcugauaagcacaagaagugaaaugacacucaggcauuuuaagaugcgagucaucuucauucugaacuaagugaaaacaaaacagauuuucuaucaaccuaaaauccuccuacugggggcaguagauguuuuuagaaaauuggcuuuggcuuugauugacaauguuuggaagauguccuauaauuugagaguguaugugugugugucuggguguguguguguaaaugcuggaccugggaagauggaagcccucagccaggagaauaagaggacacaauacccccaagccuuccaugaccuagagauuaaggggauuuaacgucuuaaaaccuccauuaaguagacaguagcaagagacauguugcccucagugauaugcaaaggcauaucugaugggucaguaucugccauccuccucuuuugcaagcucugagguuagacucagccaugggugaaggaauuacagcauccauugggagcaggcagaguccaggaaagagauuuuucuguuaccucagaugcccaucgcgccaggagcaauuuucccagccucuuguagaaagcacauauuaguaucuaucucacugcuuuucagaaacuguaucuucaauugcuaaguggggaaaaaugcauuuacaaugcuagagcugacuuuaagaaaacaaguuaacaucaggccacagcacuccccucccccgcugcugagaccuugucgcugugcaccuuguccccucccucacggcuucuggcucccgcucccccaaucccuggcccccugucugccccugccauuaaaguggcaagcacagguauccuccucccucaucacaacuuauccauccugugucugcucccccaggguggguaaugccugaaaugccuuaagguagggguaacgcucauggcagguggcccuggcucuccuggagacagggcacaggaaugggcaaauucuucaggcuuggugagguggaaagcuugcuccucgggaaucauggccacagugcccuuuuuuguuuguuaaucauuaaaaagcauacuacaugaauauauaaaguuggaaaaccccacagaagagccaagugaaguccugcuuacacacuccuccugaucccuacucucccgugcuguggaccaugcuuaguguuugacguguauuauuauuauuuuugugugugugugacagagucuugcucuguugcucaggcuggagugcaauggcaugaucucggcucaccgcaaccuccgccucccagauucaagcgauucuccugccaacuagcugggauuacaggugcccgccaccacgcccagcuaauuuuguauuuuuaguagagacaaggcuucaccauguugaucaagcuggucucaaacuccugaccucaggugauccgcccaccucagccucccaaaaugcugggcugggauuacaggcgugagccaccacgcccggccugauguguauuauucuagaccucugcugccuaauagaaauagcacacgcgccacagacauaauuucaaacuguguaguagccacuuaaaaaggaaaaguaaaaacaaauaagugaaauuaacuuuaauucuauaauucauuuaacacaauauaucuaaaauaugauuguuucaacauguagucaauaccaaacacauacuaaugagguauuuuaugucuuucuuuauuguucuaagucuuugaaauccugccacacaccucguuuucagcucucaugucacagugaacauuagcgugccaucucacacucacagcaugucuccauucacccuggccacaucucaggugcgcaacagccccagguagccagggucuaccaugcgggacagcucugcucuugaauaucgggaaguuuguuccuguagagcuggaucacaucggaaauauuuuacuacgcuuuuuuuuucaauucauaauggagacguuuacacuuuagaguucuguguuagucuuguucaugguugcauaguccaugauuugguacgucguuaauugguuuaaucagucccccagguagacuaacaaaaaaguggagguuuccaauuuuucacuuagcuuaaaauacacugcaacaagcauccauacauugccuauuuacaugcaaaaguauuuccaggugaucgauccauggaagugaaagugcugggucaaagacaggcaugcacccuuugcucugagaggcaagccaguacucagccaagccggccaccaauuugccuugggguuuggacguuguucccuuagagguaaaagcaaagaguugggcuggauacccuccauaguuccuaaaugcucaguuccauggcccaaaggguggugauuccugccaaugccuuugguggacguagucuugggugggugggugggugacagcuaccugcucccacuggagggcaggccuggauugggcagauaagcaaaucaaccacacacaccuugucuagauaagcagaaaacacucagaaaagaccccaauuguuuuauuuguaaaauugcucuuuggcuaauuuucaugaauguggaucauucauuaaacguuaucauagaaaaagagcagagcaacaaaggggcccggcagucugauucccgugcuggcagccuccaccgucacgcugagcuguggugaaugccuaggguuucacccgccuaccccucacuccugcuggcgugcacccuuuccccacccugguggccccagcaaacaucacagucccugagggccaggaggcuuggguccccagaugcccacaccugacaggccuagugccugagcacucuggugagggacuucccuggaccaugggagcacugccagaggaggcucgagggcagggaccuggauggguagcaaaggacagagaacaucgggaaaggagaggguacuaccugugggaaccaggcaggcacaagaggcuggcccugagccucugcgcaucucuccugcagacacuggcugcaccugccuagccucugaaacccagaccaggcacucaggcaaugaggggagcuccuuaacacaacaccuucccaacugcugugcuuuucggagugagcuggccaggugauguuggccaaagcaggaaggggagcuguugaggugccccaagauccuugcuggaauccucagguucccagacaaucaggguagacccggugaugggagaaggagauggggacacacauggauccgaagcuacaagauucugcuucucucuccuguuuuuguuuauucuuuuaagauguuuuauugcuaaauaaagcauuuuaaaaaguguauaagaugucugcacauaguuuagagaaugauaaagcagauccuuguguuuuaccauggggcccuuucccacugcacuccuucccucccagaggcagcacugccugacuucugccuggcucguuccugccuuugcucuuucuuucucucuuuuucccucccuuccucccucccuuccuuccuucuucccuucccuucguuucuucuuuuucuuuccuuccuuccuucuuucuuuucuuuucuuuucuuuucuauuuuuauuuuuauuuuuuugagacagaguuuugcucuugucaccuaggcugaagugcaguggugcuaucucggcucacugcaaccuucaccucccauguucaagcgauucuccuaccucagccucccaaauaguugggauuacaggcaacugccaccacgccuggcuaauuuuuuuguauuuuuaguagcgaugggguuucaccacguuggccaggcuggucucgaacuccugaccuccagagauccacccaccuuggccucccaaagugcugggauuacaggugugagccacugcgccuggccccuggcuuuucuuuauguuucauuuaguuuaguuuugagguuuacauauuuuuuauauuuauuuauuuauuuauuuucaaauggagucucacucugucgcccaggcuggagugcaguggugugaucucagcucaccgcaaccucugccuccuggguucaagcuauucuccugccucagccucccgaguagcugggauuacaggcgccugucaccaugccuggcuaauuuuuguauuuuuaguagagacgagguuucaccauguuggccaggcuggucucgaacuccugaccucaggugauccacccgccucggccucccaaagugcugggauuacagacaugagccaccaugcccagccauauuuuuaaauaauuuauugagaugaaauuuguaucacauaaaauggaccauuuucaagugaccaauucagugguauuuaguacagucaugaggucaugcaacuaccuugucucucuguccuuacuuccaacacuacaaaguaaaacccccuacccauuaagcaguuccuccccauuuccucucccuguggccuugccccuggaaaccacuaguuugugcuuugucuguauggauuuaucuauucuggauguuucaucuaaauggaaucauacauaugucaccuuuuaugccuggcuucuaucaguuagcaucacguuuccaagguucacccauguggcaugcuucagaacuucguucauuuauguggcuaaauaauauucuuuuguuuguauaacauauaccacaauuuguuuauccaucuauccacugauggacaugugagcuauggccaccauuuggcuguuaugaauagugcugcaaugcuacauguuuauuugagucucuguuuucauuucucuuggguauauaccuagcaguaaaauugcugggucauaugguaauucuacauuuaacugaggaacugccaaaucauuuuccaaagugacuguaccauuuuacacuuucaccagcaaugucugaagguuccaauuccuccacauccuugcaaacacugguuacuauuuuuuuauuuugggauguuuuuaauuauaaucauccuaguaggaaugaaguggcaccucaucaugguuuugauuugcuuuucccuaaugucuaaagauguuggguaucuuuucauguguuuguuggccauuuguauaucuucauuggagaauugucuauucaaguccuuugcccaguuuuuaaucggguugucuuuuuguuguugaguuggaagaguucuuuuauauauucuggauauuagacccuugucauauuuugauuugcaaauaucguauuccauucuauagguuguggguuuuuuuccuuucuuaauaauguccuuugaugaauuugaugaacaguuuuucauuuuaaugaaguucaacuuaccugcuuuuucuuuucuuguucaugcuuaugguaucauaucuauaaauccaucgaucaugaagauaaugaaaauucacacauauauuuucuuuuaagaguuuuaugguuuuaggucuuacaauuuagucugauccauuuugaguuaauauuuauagcuagugugaaguagggguccaaauucauucuuuugcauguggauauccaauuuuccaagcacuauuaguugacaagacugucuuuucccccauugaauggucuuagcaccuuugcuaaaaaucacuuggacauagauauauggacuuauuucugaaaucucaaucuuacuccacuggccugcaugucuguccuuaugcuaguaccauacuucuuugauuacugacgcuuugaaauucugaaaucagaaaauaugaguccucuaacuuuguucuuuuuuucaagauugcuuugucggccaugugcggggaucauguuuguaaucccagcacuuugggaggcugaggcgggcagaucacuugaggucaggagucggaggccagccuggccaacauggugaaacccuaucucuacuaaaaauaaaaaaaauuagccaggcauaguggcacaugucuguagucccagcuacuccagaggcugaggcacaagaaucacuugaaccugggaggcagaggcugcagugagccgagaucaugccacugcacuccagccugggcaacagagcaagacuccaucucaaaauaaaaaaacaaaaaaaaaaaccagauugcucuguccauuuagcccauugcaauucaugaauacaggaugucuuuccauuuauuuauuuaugccuucuuuaauuucuuucagcgaggucuugucacuuucaguguacaaggccuucaccucuuugguuaaauuuauuucuagauacuuucugauuuuugauguuauuauaaauugaauuguuuuugcuguacagaaauacauccaauuuuuguauggugaucuuucacccuccacuucugcuauauuaguuuauuagcucuaguagcuuuuuuguggauucuuugggagcuuuuuuaaucuuuuuuuuuuuuuuuuuuuuuuuuuugagacaaagucucacucugucgcccaggcuggagugcagugucauaaucucagcuuagugcaaccucugccucccagguuaaagcaauucuccugccucagccuccugaguagcugggacuacaggugugugucaccacacccagcuaauuuuuuuauuuuuaguaaagacaggguuucaccauguuggccaggcuggucucgaacuccugaccucaggugauccacccgccucagccucccaaagugcugggauuacaggcaugaaccacugugcccggccccuuauuguuuuauuuugaacuucaucuguauuucuaaauaaugcauuguugagcuucaccugcuuuugaacuuuauacaaauggaaucacacuguguguaucuuugaugacucauuucuuuucuucugugcuguguuuggagagucacccauaugguagcugcaguuugucuguucucgcugcugugugauauuccugcgggacuauacggcaauguacuuguacaugcuaccgcggcugggcaucuagacggcucuguguugagugcuuaugaacagugcggucuccuggaagauacauacaugcacaaguauauuuccaguaaaccucaguguggaagugcugggcuguggaggauaugccugcuccacuuccugagacaacgagaaaucguuuucuguccuccugaaaggggaaggcucaaaagcaaaugcccauuuuggagaaaacauuuugaaucugccaaaggagacccugaguaaugagggacagggcuggggguccagguccggcugccuggccgcguggucggccugggcugguggcuccacugugacccuccaucuccucuuuuggugccacucgccucccagagccccuaccaaaacccuaacucauccacagccccaguuucuucguucguaaaaccaggagagcugguggucucugcagacuuacaacgcaccgacaccacaccuuuauucugugggaccgucacgguggucaccacaguuaagaaaugagacccugcacucugccuugccccugcuguucccacucccaagagcauuuuccccagagcuccugccuggaccaauccucucauccuucagggcuaagccagugucccaccccaccccaccccaccccucaagagccuccucaguccagagagaaaaacuuucucccucaucccggccccuccuagaccacuuuaugggggcuugggcccaccugggagcuccgaagggcugaguccccuugacauaucuggagccagcagagcccaccucguaagagggcuuugcaagcuaacaguugagccacaugcaugcugggcuuuuugugugacauucaaagugguccagguuacaaaggccccacugaacuuuugaagaagguguuuuuuguuuuguuuuguuuuguuuucccauaauccucccaaguuuuacaagcugaguugugagaugugugggaacguucaucuauaaauauaugagcagcccagacacugaccaugagucacuggucaccacagaccacacugggucaggacagccccagaggaacacagcgcacaugugaaccucuuugggggguucucccgcccucaccaccaagugccacuccuuauucuucucuguaggaccacucccacccggucagccucccaggaacaaccccugcugcucccaagcccagcccuucaggagugccccuccgugcccuucccugcccuucggaucugccccauccugggucuccaucccucagagccgacugcagcuaacuggccaaccugcuaaacagguggugcugagaucugagaggcgcuuacugacuuaacaugugcacgcugguccccagcagccccagaaguccauuuaacauggauagugacaucguccacaaagggcagagugggcaaauacuugcaaaagccuuggaaaaacacaaaccaagauuuacguccagcacuguuagggcugugaguucuggagugaagcaucucugucucauuguguccgaucuccagcacagcaggcgaggcccggguuucacucucagcucugccaucccacuggccugcugcuuccucggccauggaugagggaauugcagacaaugucaucaguccacccaaccuacccaacagaucccaggcauugaaacagaagcagaacuauuacccucguugcacuuuuuuuuaucagcuaaugcuuaagaaacuucaaaacuguuuacugaauacaaucgcugcuagacauugggcuugaaguuuuacacacuuaaucacacuuaauccuuacagaaaccaugagaaaucagccucauuacuccaugucauagacaagcuaaucaagacucaggaaaguuaaguaaguuggccaaggucauaaagauaagaaaugguggaucugggagcugacucagguacgucuaaagcccaaguucuccuuccaccacacuguuuacuguauuuuuuuuaaaaaaagagccacuuucaaagcuuaaacucgaagaaauggccuuaauaguaaagcuuuccagcaccauucagacuuguugggaagauuuuuuccagggugcaguuucuuuuuuuuuuuucuuuuuuguuuuugagauggagucucacucuguugcccaggcuagagugcaguggcacaaucugaggucaccguaaccucugccucccagguucaggugauucuccugccucagccucccgaguagcugggauuacaggugcccaccaccacaccuggcuaauuuuuguauuuuuaguaaagauggcauuucaccauguuggccaggcuggucuugaaucccugaccucgugaccggccugccucggcuucccaaagugcuaggaguacaggcaugagccaccacgcccagccccaggaugcaguuucauauggaaaauaccacauggaaucauuucuagaaagcaagaaucccggggacagccacaccggagaacaccaugcagcugguugaagggugaggaagcugucuguguaauggcucaaaaagacucccauaaauguugcuaaaguuuccuuuuaaaaaguccuuuacgagagcaugugugcugagaaccaggaagaaauagcugaagggaacgcaccaguguucauggggguuacugcuaggggcuaggguugcagaggaaaaaaagauaaucacuuuuuuguuucaauauuuccguauacuuuuaauuuguuccauugagcacauacuaguuuaggguuuuuucauuuguuuuaaauuuuaagcaaagaaaaaccaaacacacacacaccguagucacuucccacccccacacggugcucccggccaacccaggauccucugccccaggugacaucaguucccugugcgccacauggcacaguuauccccuuacucacaagggcaggcagaagugccuuccgcgguguucuggggcccaaaagcuuaugcacuuuggggacaccauguugaggaaaaugauacuaaccuauuacaagucuaaagcaagcuccaggccuuggagaggucauccaagugucggcccuggagcugacgcuuccucaaucauagggugaaccgucccaggguagcugggccuggacccgucucaucaauuacaaacucucccgagccagugacccugggccuccucgaguuacagagcaaacggugccgcucaggccugucucggccccccauccaccgcugcccgggaaugugcuauugcacacaggccuccccaguguucuccagcaguguugugggccagcacuaaggucagcaggccauggucaccaaugaccugucauaggcaucaagccaaauccuacuggacucuguagggaagaaacaacguauacuucauagauacuuaccaagauagccucccggauuuugaaccaagugggaaaaguuaacaaccaaaaaaacauaacuauauauaaacccucccgggcaauguuggcccaccauugccaacccucagaaacccacccagugggggacacgcuggccacauggucagagaauuacgaacuaccuagaaaugaccacuccuguugcacaauaaugcaacaccagaaggcaaacagcagcagccugucuucaguuuccacacuguauucaucacgaauuuucuguauugauuuuuguuuuuuaaaaauauggcauuaaauguuacuuauccuaauuacuggauuucugauacccccauuugagugccucacuugccucacccuaaaucuagaacugcccaucagccaagaaagugcugggagccccacugccucacagaggcgccagcagcuuccacgcaauucugccaccagacuucugguaggcaaacacugaucucccgcucgggggggccaaaugucaauacccgcagcagggcuuaucgcaucgccccgguacaaaggccuccucugacgcauccccccagcagaaagaacguucagguguuugauaccaugguugggaacguucccacagguagcaggaagacgaauaccgccgcuucagucaaucucauacgacggcccccaaaucccaaaaaggcuuaguaugaaaugcccauccuaguccgugaguguggcauguccgcaguuuguuccuucagauguuuccuacguuucuuccuuccgguggguucuuggccuugcucacuucagcagugaagccgcagacuuuugcagcaaguguuacagcucuuaaagguggcgcauccagaguugcucgucuuuccagguguguucgugggcuugcugacuucaggagugaagccacauaccguacagucaguguuacagcucuuaaagguggugccaacccagacacuuucugcuugcagcaauaacauuuauugccaagggagaaagaacaaaaagaagaaagcuuccacaaccaauaaggagacccgagcggauugccagggcuggcgcuggugaccagcuuuuauucccuuauuuggccccacccacauccugcugauugguccauuuuacagagagcagauuaguccauuuuaaagagugcugauugguccguuuuuacagcgugcugauuggugcguuacaaaccuuuagcuagacacagagugcugauuggugcauuuacaauccuuuagcuagacagaaaaguuccccaaguccccacccgacccagaagcccagucggcugcaccucucacaaggacuagagugaagcgcagauagcugcauuucuuaaaaaguuguuuuaauugugguaaaauacacauaacauaaaauuuaccaucuuaccaguuuuuaaauguacagauuguguuaaguacauucacauuguugugcgaccaauccccagaacucuuuucaucuuagaaaauggaaaaacuacccauuccucccucccaccagcuccuggcggccaccauuccauuuccugucucuaucaguuugacugcucuugguaccgcacaucacacagcaauuguccuuuugugacugacuuauuucacuuaucgccauguccucaaaguccaucccuguugugguauguucugaaugcccuuccugcugaaucauauuucauuguguggauagaucacauuuuguuuauccacucaucugucgaugaaaaccuggcuuacuccuaccucuuggcuauugugaauaaugcugcuaugaacacaaguguaaaagucccuauugaggccgggcaugguggcucacuccugcaaucccagcacuuugggaggcugaggcaggcagaucaugaggucaggagauugagaccauccuggcuaacauggugaaaccccgucucuacuaaaaauacacaaaaaaauuagcggggcguggugaugggggccuguaguccuagcuacaggacuacauggaggcugaggcaggagaauggcgugaacccgggaggcggagcuugcugugagccaagauugcaccacugcacuccagccuggggcacagagcaagacuccgucucaaaaaaaaaaaaaaaaaaaaaaaaaaaaaaaucccuauugagaccugcuuaacugcuggaucauaggauaauccuguguuucauuuucgaggaacugccauacugguuuccacaguggcuguacucuuuuacauuccugccagcaaugaacaaguuuuccgauuucuccacauccucaccagcacuuguuauuuccuguuuuuucagaguauccauccuaaugggcaugagauaguaucucauugugguuuuaauuuuuaguucccuaguuaagaugagugauguugaguaucuuuucauguuuguuggccauucauacaucuuccuuggagaaauguguaaaguccuuuuuuaaaucaguuuguucauuuguuugcuguuauuggguuguaagguauuguaaauauuaauauauuuuaaauauuaauugcuuaucagauauaugauuugcaaauauuucuccacauugcauagguugucagauauauacacuuuuaacaaccucccuuagaccaggggagaaaugcuuugaagaaccuggcacaggaucugugggccccuuucuagaagcaaguuucugggccagguuccaccuaggagcagggcccaaggggaggagacagggaggagugcuggcuccacucagacccuggagccccugcugggagagguggggaugcugaccuaggcacccacaggcacccagaagccagggccucccccauuuacagggcacaucaugucccuggucaccaccccucgaaagagcaugaugccaaaaagcccgggcugugccuggguccccucugcgauggggcagggggcugcacacaucugcaaggcgcagcuuguguuagaagcaccugccuggcuuaucuccaugugacucuguaaauggggagcaguggagucugauaccagcaggugcuccaggcauccagucugaugccucgcaggagcucccugcucugcuagcuccaccugaggggcuagaggccaaccuugccgcucccccucuccucccgucccuuccucccagccuggucugaugccccaugguucuccccacagcccccagguguuccccaguggucccacccuuuucuucagguccagcagaugccuuagcuggaguuaucugcuuaugacagcccuuguuuaugaccacugugaagguaguucucugaagggugagagaauuagauaauccaacacccagcccaguuuuccuuugcuuuucuccucggaacggucagagaucagugaucguacaaguuagucccacaggucuuccuuccaggacauccuacacccaucagucugggccuggggucuuucucuaagcgugaggccuguggcugcggguccaggguaucuuuucugccagugguaaaaaaugagaagcaaauaucaaaagauucaaaagccugacccuggcugcugucuguguccagccaggauaauucggggucugcauugcagcucuucuguuuuuguuugguuuuguucuccuaauugacuauuugcacuaaccaggucagggcuaacuaguaacacccuacauucugcacaaaaaaucagcaaccccaugaccugugaugaggguggccuggcaggaggcaaaagcgacaagcguuccugguaucugaccagcaccaccuugaauuaggacaucaacacaugcgauuggacuauaaaucauguaaugacaacugcaaugacaacucuaaaaacaauugggcgugugcucacauuuucacaguaaagccccgacaauguugacaaaauccacuguuugaauucugauacgacuuucuuccauuuugugaucuuuuuauugcucuuaauuacaacgguuagcauuagagacauacccuaugauuccauuauuugcaauugcagcuuaaauaugcauauguccuaaaugauggaaugauaaccagcagugccauuggaaaaugaaaauauuagugaugcugcagaaaugccaaggauguaaccaugaggcuggacucuuggaacuggccauagcuggggagaccuuggacugaggcacccugguauuggcugggugacccugggcacauucuccuuuuucucuuuuuuaaaauaagcuauguuggucuuuagaaaauuaaaaacacaacacggacaaugaagaaauuaaagaaaaagucuguauccccucccacaaacacaaaaugaacaaguuaaugaauuugcuuccuuuuuuccuagccauauuuuguauucacuuuaaaaagaaaaaauguuggcugggcacggcagcucauaccuguaaucccagcacuuugggaggcugaggcagguggaucaccugaggucaggaguucgagaccagccuggucaacauggugaaacacccaucucuacuaaaaaauaccaaaaaaaaaaaaaaaaaauuagccaggcgugguggcgggcgccuguaguuccagcuaugcaggaggcugaggcggggaaucacuugaacccaggagguggaguuugcagugagccaagaucgcgccacugcacuccagccuaggcgacagagugagacucugucucaaaaaaaaaaaaaaagaaaagaaaaaagaaagaaagagagaaaaaaugucuuacugauagcacuauucacaauagccaaaaguggaaacaacccaaauucaucaacugaugaauucauguaauggaauauuacagaggcauagaaaagaguaaaguccugaucugcgcuaccuggaugacccuugaaaacaugacgccgagcaaaaggagccagacacaaaaggccacacguugaaugauuccauucauauagagugcccagaauaggcaaauccauagagacagaaaguggauuugugguugccaggagcugggcagggucagggaggaaugaggagugacugcuaauggguaccggcuuuuuuuaggagugaucaaagugcucuggaauuagguaguggugaugguuucacagucuuggaacuauauguaaaacacugaacugcagacuuuaauaggugaauuuuaggguauguggauuauaucucgauuuuuaaaaaagaaaguacaaagaaaaauaucacugucuuuaaagauccagcucuguuuccuggacucuagucuagaggaggaucucucaguguccccagaggagagccccugggagagaagaaggcuagaaacccggaggaaagggaacccuggcccaggagaggggucggcugugacgaccuccagcauuuccugcaagccagcccugucaccuuccugcggauagugaugaugaagcagaggacaauagguuucaaaggucuuccaagcauggugucacuaggcucucacaccagccuguggggcagaugugagggguaucauuguccucauuuugcaggugacguuccacaagaugggacugaggugacccucagcugggcccuccuaccugugcucucugcagcuaggggcaggaggcugcaucugaccugagaguaucccugagaagccagagcaggacucucagcugaaccacccagaaauggccaguuggacccaggccaggaccuccaguggcaguggagcgagggggugggaggguggagcaggaaggagugguuguggcuuuuaauccuuucugcauauaaggcugggcggcuugugcuuuggcuggcaggcuuguuugauucuccugcauggagaguuucaggcaugcaggugccaccccagguggggcccacaggugccccuaggagccgggcaaaggcaggucccagggagcugucagggcacaugugggaacccgccgccaccugcagcugugccaggacaccagccagcguucccacauccugagggcuuucaagagaagccauaaguauaaucucccucuugguuaauaauggcagcuaaauguaguuuucacaaaagguuccaaccaagcccauaugugggccacauguagcugugggaaugagaguuugagucgucugcucuaaauauauacacaaaacaagcaguuucuucuggauaaacugguccacacaucauucauuucauugcgggguuugcuuguuaauuuuggcccaagacauagggcuuugaguaaacagagccucgcccggcaguacaccagcucuuacauucagaagccacuuccccgagccauguccucccagaccaaagucacacugugucuuugcagccuuccuccuugucuccguccagccuucucaagguaucccccugcaccuuccuguaccccuccuugugggucgcccccaccuguguguguaaacaccuucuagaaggucacauuguuaaagccccccaugacccuucauuccacuccagcucccaccauuucugggcuccccuucaggggaagacuucuccucgggguugacacuugcugucuacacuuccucggcccccucacucuaaaacuacguaaaugcccagagaauaacaugacaacgugcaccugagcaacccccacccagaugguacaaagguuuccuuggccauguuuguagcagauauuucuuucuuuaaaaaauaaauaaguacagagcuggcagaacauuucccauugcccuucagcccacuccucuuggacuuucuucccgcagccuccccguggcccuucauggacacaugguccuggcuacagaugaaaaaucgcuggguccucagcagggcagucauauuugauaaugaccaggauugcauuuaaaucuaguaccucccagauacuguacagauaagaucccagcuaaggcucaaaaccacucaaagccauuuccauuucagagaugagaaaaucacagcucagagggguugggggcgugguggcagugccagcaguccgccuccaguaugaccuccacugucccuucacucagccgggguagacagacuucccagcugggacaagcacucuuaaaaucucagugggauuuccaucuccagugccagugcuccuaucauccggcacagaggcauucaaaauaaccauuucugauggacuggaauauuuugcacaagugggcaguaucucaccuaauggggguggggagguuaugaaggguuugugaacaaaccacaggaagcccugcuuucuccuuucacaaggacagguggcaccugcagggucuccccugcaguggcguuaucguugcacugaaacuugcaugaccaaucuguaaggagucaggguggguucagccauuuguuaugaccuuggcauuguucagccccagagccuggcaggaggggaaggaggaaaguuugacugaggggccuccacccauugccuuucaccugcacacugccucugagcagauucaggagaccaagcuccuccccaggugagccaugccucuccuggggugaccuggcuuacuucaugugugcccugcuggcaaaugcucugcugcuguagguggcauuagcaagggcugagcagguggcacugcuccaccgggagguugaguaaaucacugagucauuaggagauguugagcucucgccaggcccuccuggaggcacaggggauacagcagagaacugaagggggcugcugccucuguggcuuuggugcgagguuggggaggaggggacaggcaggaggugggggagaagguuuauggagaacagagcgcagggguugggguagauggggagucagggagcccuggugaagaggccacauuagagcagagacuggaacaaagggagggcaggauuuguucaucuugcuucccaagaaagaggcugcaggcaaagugacucuuacuccucuuguuuauccucguagguucuagaagauuucugaggacucagcaguaacuugcagugcuggacugaggcuauuuccuuauaucaacuuuuugaaaacucaugguuaauaccuaaguaaagcacuuccaccuucccccccucccccccugagaaaguacguuagucacaugcuagcguuuuuauuaggaaaagacggauuuccagugaagcagagggaaguggauugagccuggcucgggccauggcgccaguugcacuugcccuggugccgagccacagcaagggcuggcacucggcaccaugaaaagcccuccuuuucggaaucugggggacaaaaugcaagaccgaugccccagagucaucacagaugaccuucauuggcacgauaaggggggggacagggggcccugccuugaaggaggcaucuaaacaccccuugugauggaacagacuuagccacaaaagccagcgaggggcacguuguugcucccucauccgccgguggcauuaaguccuguagggcaggcugcguuucccccuuucacgaugaggggccugagccuaagcgcucggagccugggcuuuaguuucugauuccccacgcugugcuggcacagguuuccuggacagcgccccagcgcggguuucuuauccuagggcggugagaggggcugccagggaaagugugggaaaggacgaggggcgggacuaugagagggagcggggcugggggcggggccuggaggaccgggcugagagggcgggaccgugagagguaacagggggcggggugagggggcggggucgaggacgaugggggcggacuugggggcggggccugggggcuagggaaggacagugccagaucuuguguccagccucuggaaucuucccucaguucuuccuugucuuuucguggccuugacguuuuugaggaacgcagguggguuauuucguaggauggcccucaguucgggcugucugaugauccuuccuccagaucagguucagaugauguacuuugggcacuuuuguuccucuuggugcguuuuauccagagccucauaauaaauauuuguuccaugacaggcgaugugcacuuuguuuuaggugguucuccccagaauucuccacugucaaguuacuaauuucuccuuuguaauuaauaaguauccaugggaaauacuuugagauuauguaaauacguuguuacucuucagacuuuuacccacuacuuuuagcauucaucagagauucuugaugguugccaaauggugauugucggauuccaucauuccuuccacauuuaauagggacuuuccacuggaagaaagagcuuucucccuccccugugcguuuauuuacauauguauuuauaucaguguggacccaugggucuuuauuuaagucuaaagguuauaauucuucauuguagucauuuauuuucaugcugaagggaccccagagaaagccacugggagccccuucaagcagccacuguguucuuuuggcauguucccaugucaaaaguaaaguuucucacuugcugguacaguaagguguuccaggcucuucuuauacuuccccgccccagcccuggauuccuuuuaguggagaaugguauuuggaaaccaguauuggagcaugaguaugcucauugcuauugaaguguuauugugaagcccauuaagggagccagggaauguaugaguguguaagcauacaggcaugcaugcauaugugcauauguauguaggcauauggccccaaggucccugccugcugauaugcaugcuuuguguaacccccucccuugagugugggauggacugagugacucaaugcuaaugaaugggcuacggcaaaagccaugggcugucacuuuggacaccagguuauaaagagaccuggcuucuguuuugcaugcacucuuuugcuugcgcacucagaggguggucagcugccccuucgugagcugcccuggagagcgguuucccuggcaaggaguuaagggaggccugggccaacaaccacaugagugagccuggaaacggauccuuccagguuuccuuccuucccuuaagaccacagcccccacccauagcucagucaaauccuugugagaaaccagagucagaagcacccagcuaagccacauucaacuccugguccauagaaacugggagauaauaauuguuuguuauucuaagccacuaaguuuuggggcaauuuguuuuguuacuccauaguuaauuaaugcaauauguuauaucucuauauauguguauauguauagacagggaccacacauacauuuauaucuguuuuuauaccugucucuauauauuacaaaccaugaguucacacugauaacuuuaauuuuagcucagugcuacaagguucauugugaccuuccccacuuuccauauuuguaacuccuuucuccagcagugagaaacccagcuccaaucaucugcaauguauuaauuuauuuguucaguccuagaggacacaaaaacagcuucagaauugcuauccuauguuccagaaaaaguaaccuacucaugggaguucaaucuuuguuuagaguucuugucuuuaguugucauauaguccaaauacugcaaccccuauguuauaaaaaacaagggcuucccagcuucucugggaaguaaggcaugagaugcaaaggggaaaagcacaguuucuuuccaggcagcaggugcugggcuucgcugucuugcgcuggagaagugcgaaacagacgggaaaagugcaaaacagaagggcagggcggggcuucagaggcucccgcuccaugcuuucuuucuccccugagcccacacugccugccucccuugcauuagcacaaaagcaccaaccucugaggccagcgauguuguuuuuaaacagucauuaaauuauuuacagagaaaaguguacgguguugcuuuuugaaggcuacugaggaagguuugaauuuucaucauuucuauuauucaaaaagccaaguaacaagccgacuuggaucuucccagaaaggcugaguuugggggguacuugcacgcccuaguccgcacagcugggacuagggcuggggcucuccuagaguaacaaauggggcaucggcaugaccucucugcggagggccucucugacaugcaguugucacugcagaccucugcagaggugaccuccccagagacaagggaccucccagagcagcacugcugcuuagguaaauggggacagccaggaggccagcuccaagccucaccccgcagauaccucagucccauccuggucacaggcacauggggcacuccucauggcaguugugggaaaguggccaaggacacaaggcucccgccggccaugguuucucuaagaucugacucaggauugucacaugcuaagcguucuacuuccccaugccugcaagcaccccacaagcuccccacagacauacacacuacacaggucauagucaugcacacgccacacuacacaggucauagucaugcacacaacacacuacacugcacacauaccacacacauaacaccacacacacaucacaaacacacaccacacaugcgugcgcacacacccacucacauacagacucaucacacacacacacaugcaucacgacacacucugcacucguacaacacacauccaucagacacauacacaaacauagcacacacacacacacaucauacauccacaaauagcacaaauacgcacugagccaggccucauggagauccagcgaagggugcuggcucucucccugccucccacgagcccuuccagggauccccgaggccccugccccacagccugccugcaccucccucccaccugcaggaagggcucuccccagcucucucugccaacugacuccacaaacccugggaagcagacccaauggggcccuucagaugcaggccgguucacuucccagugcccagccucugugugagaugucccuggugacagaacaagaggccaugugggauaaagccagcagaaaucgcugagcauccagcaccagcagggccuccacaggggauuucccucccaccuccuucugcuccagguggccucccugagccacaccccuaacgugccauuuccagaugguaaacaacacuugcacugcaguuuaucuccuuggaaauccccacagcucccaccccagaaccgugcacaaaaaauaucuucaacagguggauauggaugaauuaaggugcaaaaugagaaccauuaaauacauacuugcaagccauuucucuuaaaagguacuagagcuaagauccuuaaagacuugcauccaccauuauugcagaugacuauucagauguugugggcagacauauuguuuuauaaagguauaagaauggacucugaugauggcuugggaauguauugguccaauauccacuucucucucucuuccagggucagaaaucuuggauagagaaaaccuuuugcaaacgggaauguaucuuuguaauuccuagcaugaaagacucuaacagguaaauugaaauccacgauuaagacauuauccaaaccagugcuugucugccacuauucucauguuuguaagaggcagaaagaggaguccagaaggguggccagaauccauuccccaugggagucacuaacaagggagucacuggggcuccuuguuacuccauuaacaugcaaauggcuucagaaaagaguuuguguccaccacccacccuaaugcgaacucucauagccaacugggcccacaucauuccucuuagucucagcaagaucaaggaguugagggcuuucaacagguuuccaggauauuuuccaggccucuucaauagaguuucauaauguauuuagaugaaaaggaauuuccaucacaggaaagaucugagcgguugaaugaacuagcuauaacuuuauuaaaggauuuggcuuguacacaaaacauccaacaauuuuauucaccuacauuaaaaugcaucuguuauaagcugaacagaggccuuguaaagucauguaaguagagauuaauuuaacuaaaaugucucaucucuaagggcaaaagcuaugaggcugagucugggggaaggggaacaauuuauccauacauucguccaauaugaaauucaugcagguagaauaaugacacagaaguacacacucuucaagaucaccugcuucaaauuuguuucacacaugcaaucacagucccuccacauccccaagcugccccuugccccacaccacccugcagauucuccucccugcuuaaaccccagugauugccccccgagguaagaaaugccauuaugaaacaaugccaacggucacaaaagucuccccuuuguugcaucuacaugucccuucuuauuucaauggcacauaggccauccugggaacucucugugccagcacugcaguccuccaugaagccagaugcccaggcaauagagggcaaaaagugcuucugggcucacauacaagccuccuugaugcacuccaugcaguccccagcauggauuaaaaaaaaaaaaaaacuagaaugaaaaaaccaaccguuuaaacccuuggaaaugaucccaaagacaaacagcaaguaaaggaauaucuuuagagaaagccagcaaaaauucaguaagaaaggcuagagucugugggauuugaaccaagaguuuccucccucccucugcccagcucagcaagauagagacucuacuccagagugcugcagccaagaacacagagcucccucuccaccagcucccagucagggggcuuucuuccugggaggagcaggauuucagcauuucucauccugucccuuaccaccuguugcugaggcuaaguccugaaugaaugcaguugagagauagaggcucccuucuuccacccgugccccacucauguaagcagcaaccacagaaagugagagugguuauaauggauucagacaaaacauacuuuaaagcaagaaaauguaacuagagauauuaagaacauuuuauaaugauaaaugggacaaucgaucaggaaguuacaacaaauauaaacauauauguaccuaaaacagcaccaaaaugcaugaagcaaaacugacauaaacaaagggagaaguagacaauucaacaugacaguuggagacuucaauaccccacuuucaauaaugcauagaucaccuaaacagaagaccaacaagggaauagaaagcuugaacaacaucauaaaccaauuaggcuuaacagauaacuauagagcacaccacccaguaacaauagaaaacacauucuucucaagugcauauggaacauucuccagcauagaccauguguuaguccauuaaaaagccucaaaauaucuaaaaggauagaaauaauacaaacuguccuccaaccacaauguaauaaaauuagaaauaagaaaccaauaggaggaaaaaaauuggaaacucauaaauaugugaaaauuaauacacuaccagauaaccacuagguuaaagaaaaugucagaagguuaauuagaaaauacuuuuagguaaauggaaaugaagacauaacaaaccaaaacuuaggggaugcagguaaaguaguacggacagggaaauuuauaccuguaaauaccuauauuaagaaagauauuuaauaaguaacauaacuuucuaccuuaagacacuggaaaaagaagaguaaacuaaaccuaaagcaaguagagggaaggagauaaugauuaaaguggaauuaauggaaaagagaauagaaaaguagagaaauucaaugaaauuaaaagcucuucuuuaaaaaccucaacaaaauucacauaucuuuagcuagagucauaaaagaagagaaagauaagacucaaaugacuagacucagaaaugaaagaggggacauuacuaccaaccuuauagaaaugaguaugaaagaauacuaugacuuauaugcaaacaaauuagauaacuuagaugaaaugggaaaauucugagaaauauacaaucugccaaaacugacucaagaaaaaauguacaaucugaacagaucuauaaggaguaaagagauaggauuaguaauaaaaaaacuguccaaagaaaagcccaggcccacauggcuuuuucgaugaauucuaaaaaacauuuaaggaagaguuaauaccaauucuucacaaacucuucaagaaaauagcagagaagggaacauuucccaacucauuuaaugaggccaguacuacccagauaccaaacuagacaaagauaucacaagauagaaaacuauagaucaauaucuauuaugaacaugggugcagaaauucugaacaaaauacuaucaaaccaaauccagcaacauauaaaaauaaugauacaccaugaccaagcaggguuuaucccaggaauguaaaguugguuuacauuagaaaaauaaauaauguaauauagcauaucaauauaguagaaacaaaaaucacaugaucuuuucaauaggcacagcaaaagacuuggauaaaacucaacacucuuuauaaaaaaucacucggaaaaccaggaauagaagggaacuuccucaacccgauaaagaacagcuauaaagaauccacaguuaacaucagacuuaauggugaaagauugcuuuccuccuaagauuaggaacaagauaaggauguccucucucgcuacuucuauucaacauuuuaauggaaguacaggccaaagcaauuagguaagagaaauaaagaaagaaaaaauauugagauuggaaagagagaaguaaaacucucuauuugcagaugacauaaucuuauacauagaaaaauccuaaggaauccaccaaaaaauauuagaacuaauaaaugaguucagcaagauuguggcauauaagaucaauacacaaaaaucaaauguauuucuauacacuugcaaugaacuauauggaaaugaaacuggcaacauaauuuaucuauaauugcaucaaaaagaauaauaggaggacucacauuuucugauuucaaaacuuaauacaaagcuacaguaauaaaaggacaacgauacuggcauaggauagacauauagacaaauggaacagaauugacaguccagaaauaaacccauacaccuauggcaaauugauuuuuggcaagggugaaaaguacuuucaauggcgaaauaguagucgucucuucagcaaaugguacuggaauaacuggauagccacaugcaaaagaauagucuuggacccuuaccucaugcuaucuauaaaaguuaaaauggaccaaacaccuaaaugucaaagcuaaaacuauaaaacucuuagaagaaaauguaaggguaaaucaugaccugggauuuggcaaaugauucugagauauuacaccaaaaacauggacaacaaaaacaacaaaaaaauugucuuuaccaaaauuaaacacugugcuucaagggacgcuaucaagaaaguggaaagacaacccacagaaugggagaaaauauuugugaauuaugucucugauaagggacuuguauccagaauacggaaagagauccaauaauuaaaaaaaaauaaauaacccaaguuuuuuaaaugggcaaaggaaaugaauagacaucuuuccaaagaagauacacaaauagucaauaagcacaugaaaaaugcucaauguccuuauucuucagggaaaugcaaaucaaaaccaugaugauaaacugcuucacacucagaaggaagacuagaaugaaaauguaagauagugugugggagaggauauggagaaaucagaacccucagacacugcugguggaaauguaccaugauacagccaccuuggagaacaguuuggugguucuucagaagauuaaacauagaguaaccguaugacccagcaaucccaugccuaguguauacccaagaaaaaugaaaacauucauccacucaaaaacuuguuacauaaauauucauagcagcauuauucauaacagcugaagagugcgaauagcccaaauguccauuaaaugauaaauagauaaacaaaauguucauccauucauacgagaauauuauuaagccauaaaagggagugaaguaccaacacaugcuacaauauggaugaaccuugaaaacaugcuaagaagcugaucuccaaagaccagauauuacaggacugcauucauaugaagugucuagaacauggaaauccacagagauaaaaaguagacuugagguugcuuauggcuuggggaguggugcacagguagauagaugguggugagaaggaagauaacuuaaaauaugccaugccaaguuucuuuuugaggugaugaaaauguucgaaaauuaacugugaugaugguugcacauaucugucaauacuaaaaaccauuuaaucucucucucucucucucucucucucucucucuauauauauauauauauauauauauauauauauauauauguuuuuuuuuuuuuuuugagacggagucucacucugucaaccacgcuggagugcagugccacgaucccggcucauugcaaccucugccuccgggguucaaacgauucuccugccucagccucccaaguagcuggaauuacagacgugugccaccacacucagcuaauuuuuguguuuaugguggagacgggguuucacaauauugaccaggcuggucucggacuccugaccucaagugauccacaugccacggccucucaaaguguugggauuacaggcgugagccacugcuccuggccugaaucacauacuugaaauggguugauuauguauuacaugaauuauaucucaauaaaaggaaaaaagagagagagaaagagggagggagugagggagggaagauggaaggccaucagaaggagggugggagggagagaauggggaagcgaggagggaaaagaaaaaggaaaacaaaaggaaagacaaggcagggaggaagccccaaggcuggccccaugggagcacagaaagccuucuggcaagggcccugcacaugugcauuacacacgugcacgcauucgcacaucuagcccaguaaagacauccucucuaguccucaagccaacuccauccccagcucucccaccccauuugcuagggugcacggcugcccacacaggcuccugcuggguccaggaacagaccucccuccaugccuucccuggauuccaucuccaccaaggcaucacuccaggcuacugcaguucuuccuaacaaacuuuucaaguuuuugguggguccaguccacucaaaacaguggcagccaaaaaugauggaguaacagaugaaauccuaggcacacuaggaaaagaagcuggcacaaagccagggaacauguucagagaagacuagaaagccagaguucagggagggcgugagagguuggcuggguuuugggagagaugcuguagagcuagaagaucccugaugcuggggcggguuauggcccaaugggccaucuguccaaggcagaaaaagacauauuggucacuuuugaaauagccuuuuagcauuacuugaguggagaaauguuuuacuaaggaacagaacaauucaacaauauggaaaaauuuggcugacaccuaaguaaguaauuuuagaacuuugggaggccaaggcaggcggauugcuugagcccaggaguucgagaccagccuggguaacauggcaaaaugcugucucuacuaaaaauauaaaaacuagcugagcaugguagugugugccuguggucccaguuacuagggaggcugaggugagaggaucaccugagcuugggggaggucugggcugcagugagcuaugauagcgccacuacacuccaaccugaaugacaagagaaagaaaaaucuggaaggucaacucuauguucggagggcaugucuauacuuugucacagaauguuuaguacuugauguuuauacugauguuaucaagacaucaaaaaguugaaauauuuuccgaaagagcaaccauccaaugugucuaaaaucgacuggcauauaaagagaugugcacugauuaucuggaaaaggccaucagauggggcauuucugucccuaauaacgcuggcuuacugaaguguuaguaggcuccuguuugggcccaacucaccuguugagguuaauucauuuuugcuaaugaaggggaaagggggagauuguuguagaaagacccugcuuugccuuuguuuucagguguugcuguggccaguucaccaaccagcauauccccccucugccaagugcaacacccagcaaaaaugaagaggaaagcaaacagguggagacucagccugagaaauggucuguugccaagcacacccagagcuacccaacagauuccuauggaguucuugaauuccaggguggcggauauuccaauaaagccauggugagaaaggcauucagacauggugccacuaggaucacagcuuucauuggcggccagucucccagccccaaacugcagauaccuggucuucuucauggcuguggcucaaucuuccuagauauuucauugaaaaaccaagagauauaucugugcacauggcuuuuagccaugaggcuuggaaacuggacaccacuguaaagaacaucuagugucccguaaauccauaccaaagcucugaauccacaaaccaggcucuggcccaacccugcaaacacacuccauugcuccaucuucaguaaaggaagacaaauucauuuuucuaauaacuguggaccugcagcccccuuagauguguugagagucuuuggaaauauuuuccucugaggucuguccacagcuucccugggccugcgcucagcuggcccgagaaggaccaaggucccucacauuugcauguaaacagggagugcccucugcccuuccagugagcccugccagcgugggggaggcuucagcucugugauccguuccagcucacucugaauuacacuccuacaugcccagucacagacuuuuugcaauuucauuuuauuucacuggcccaacaucauuguuaaaauaaaauuuagcuguguuccaaaugcugcaauauacagucuucugaaauggcacccuacauauuagcccagacacaaagaagcaguuuauaggagacaaggcaucugagcauuauuagccuccuccucacuuugaagaggucaaguucaugggugggcccaugaucgccugacccauuuacucaacaacauccucauccaacuucuugggccacuguucuagcuaagccagcuuuggaaccuauuccuccaacauuaggauugccagauaaaauacaggacacccaguuauauuugaacuucagacauacauuggauaaauuuucaguacaaguaugucccaaauauugcaugauuuauugcauuuaauaaaaauguuguacugaaacauuuuucauuguuccucuaaaauucaaauuuaacugggugucuuggucuguuuggcugcuauaacaaauugccuuaggcuggggaauuuauaaacaacagaaauuuauugcucacauuucuagagucugggaggcccaagaucaaggugccagcagauuuggugccuggcgagggcccauccucugcuucauagauagcaccuucuugcuguguccucacauggcagaagcagagaacaagcucucugaguccucuuuuuuuuuuuuuuuuuuuuuuuuugaguuggaguuucgaucuuguugcccaggcuggaaugcaauggcucaaucuuggcucacugcaaccuccgccucccagguucaagugauccuccugccucagcuucugaaguagcugagauuacagguaugcgcuaccacaccuggcuaauuuuguauuuuuuuuaguagagacgggguuucaacauguuggucaggcuggucucgaacuccugaccucaagugauccaccugccucggcuucccaaagugcugggauuacaggcaugagccaccacgcccagcccugaguccucuuuuauaaggacacuagucccacucacgagggauccaugcucaugacguaaucaccuucuaacaucccaccucuuaacacuauugcauugggaaucagguuuccacgugaauuuuaggggaauacaaacauucagaccaugguaccaggcaucuuuuauuuguauuugcuaaaccugacaauccucuccaaaguucccuucagucacuuggccacagacucacacagagggcuccagggcccugaggaagagacaagccaggcaguucuugcuuggacaugagcaauagccucacuccccuuugacacgagaagcaaaaccaagaacagaggcugagugccacacacucuuucacaguauauccguguauccuaugacaccaagccagacucacugcuccaucucauggugaaagauuggcagcuggaacuccccaagcucuuaauaucugugcauggaggccuccagaacuuugagaugcagcccaagcugaaacaagucuuugggaaaggccugaucaaggcugcuaugaccaccggggccuggaucuucaccgggggugucagcacagguaagagcaggcccuuucccucccgauaaucaauguaccacccagaacucacugugguccccaaagagcuuccuaauaacuaaggacaacaaaacauauugcauccugauccuauuuaugacuaaagugaagucuuuauucccuagcuuguguuuuuuacuuugauaugacucuuaaaaaaaaacagcaaauauaguaaugauugucauaauggucaacaucucugggucacccaugacaugcaauauuccuugaacugagcccuguacaagcaucaucuucauuagaccucucgacaauccuuuuccuguuauaggacaggaaacugaggcacaaagacauuaaggaacauaccaggcaguauggcucucaauuuucacugaaggcagccaaggaaugccaaaaagacuccaguuauuuccagcuuuaggccuuagacaucuguaaaggaaaucccuacacaguugcuuugguuucuguuuuuguuuucccguuucuagaguuaaugcaagauugcucguuaucaugagcucagacuuucaguguacuuuguuuuaaugauaaagaugagugugucucaccccugaucuguagggaauguagggacucagggcaagugucccuaaauuucaugaaugauggugugcugggaaguaaaagagccuaaaauaugaccaauggcugcucacagguguuaucagccacguaggggaugccuugaaagaccacuccuccaaguccagaggccggguuugugcuauaggaauugcuccauggggcaucguggagaauaaggaagaccugguuggaaaggauguaaguguuuucucugcaaauguuggcaguuuuuuaaaauuaaugauugauuuugagguaaccguugauucagaugcaguuguaagaauaauaagagagcucccuugcagccuuucccauuccuccaaugguaacaucuugcaaaaccauaaugcaagaucacaacccggauacugucauugauaaggucaaggugcagaauguuuccaucaacacgaggaucccuccuguugcccuuucauauacauauaccucacuccuuccuacccccaccucuuccuuaaccccuggaaacaacuaaucugcaccaccccgcauuucaagaagguucuguaaauggaaucauacaguaauguaaccuuuggggauuggcuuuuuuuucacuccacauaguucucugaacacgcguccagguugccauauguauuggucuucauuccuuuuuacugcuggcugacaucccaugauauggaggcaccaguuucuuuaaccauuugucuguugaggaacaguuuggcuguuacaaguaaaguagccauaaacauuccagugcaggauuugagguuaacauagguuuucauuucucugugauaaaugccaggggugcaauugcuagguugucauuaucuaaaacaauuaacuuucuuucuauuuuaauguaacaauuggcaaaaauaaaaccuucaaaaggcaggguagagaugugagaauaaguuuuagugcagucacuccacacauauguauugugcuugcuucccuuguuggucuuaacauccaaguccugcaggucugauuugcgcugugcacuuugucagguaacaagaguguaccagaccauguccaacccucuaaguaagcucucugugcucaacaacucccacacccacuucauccuggcugacaauggcacccugggcaaguauggcgccgaggugaagcugcgaaggcugcuggaaaagcacaucucccugcagaagaucaacacaaguaagugcuggcaaaggcacgcaguccuccugggcugaugccaucacaguggaaacaaggcugagaaggagauugauugcccaaggggauuagaagauuaaccuugcuucuuguuaggucaacagaaaaugacucaccuagaugucuuaccuuagccaccuaccaaaucacauucacugggcuacauggggaugcuuugccccagguucacaaguuagcacgaaauaacccucagugcucgccauggugauggccuugcccacccuguugcccagugguucuuguucccuguaauuaguuguuauuuuuuaaguguuuuaacaggaaaacaauuucucaaagauuuaguaggauucuuucuauuugcugauaaguauuaugugauuauuaaauaucucuguaaugcugggccuuucauguagacuaagauggccagguggggacauaucuggagagggcugcaggagccaucugcuccugaaggggcaucauccuugcugguccugagggggagcugucacugucagacgaaagcugaggucgaacuagagagaaagacgcaaaccucaaccagaagaaacaaugauaacaacugguuagaauuacaauaacugguauaaucucuuggagcauguuuauacuccaguaauucuuaacgucaaacaauuguuaaaugaucugaaagagcaguuuguuuuucccauuacuggcaagauuuuugugggagaccaucuaguccuggcgaauggucauugggaaucaucauguaugggacugugaugcugcagaguggguagaauggggauggccuacuaggaaaaguuguagauuuccgagaaucagaucucgaagaauacauuggucgaugacugaauguuuuuuguucucacaucucuaauuuuucuggacuuguaaguuuuuacaacaccccauuucaccuggccaugugacuugugggcuucccuuugucauccuucgccuagggcucugagcagggcagggacagcaaaggggugcucaguugucacuucccacagcacggagcuucgaggacuccagccuaagccaagaagaaccuguucuacucuguugcucgaaaagaaggugauuuggccaccauauuccuaaagauugaaaauaucaauccuugcuuggguuggaaaucucaaaggcggaguccaggauaucuuaguucauuuuuccaauaucuccuggucagggcuuugcacaaagcagacccucaaugcaugucugcugaaaugaacuuagcuguaauuacucugguggacacagcagaguuauucaacauauguaagagucccugacuguagaaacaccucauggaagcaaauuagaaacucugaaauggcucauuugaaauucuccaaucuucucuuaaccaaugcuggcagauuuuuaucugaagcccuucagagcugagaccaacgauacuuccacuugccuuuaguuaauaucgaucaacuaauucccaucacaacuaauggacagcuggugaaauaggcucagagugugaucugucauggccaguguggcauaaaauuaggaaguaggcaaaugugccuccacucccauuuccuucccauuccagaaucccaacuuccuggaaucuuccugccaccucuugcuucccagagccaugccugcagguucugccaccaaaaguuaguugguacccacuguguucuugaagaguccuauuaacugauagagacagagggaggacucugggaacaggucauuaacugaugggccacuagugguccaaguggcugcguccaagaucugcacuuuauuccagccacugaagacagaaacgucaacaagaacaguguaccucauuuguaugcuacuuaacguuuacaaaauuauuugcuagccaaacacauauucugauauuuuuacaacugcaggaguuaaaggaagcacugugauuguucaccuuuuacaaauggcugucuaaggcucuuggugauuuggugauuggcccagugucauaagggagaagccaggaauugaacugcaauuucccuggcugguccagauccccuuucaucaucuuauucuucagggacagccaucagggugggaauuucagaccauaggcuaggacagccagggggauauuuuuccagccaggaauaccuuccaauauuucucaguggucaccuugaaguagccccaacaucagguggguggguuauucaggaguuuaaccauaugugagucagaaaguuucagacuuugagguccugguuuucccaaugaggccauaauaugugacagaaugcaagaaugauaacugggcugggcacaguggcuuacaccuguaauccuagcacuuugggaggccaaggcagguggaucacuugagcccagguguuugagaccagccugggcaacauggcaagacuucaucucuaccaaaaauuagccaggugugguggcaugugcccauagucccagcuacucaggaggcugaggugggaggauugccugagcugagagggagguugaggcugcagugagccaugaucaugccacugcacuccagcuugggggacagagugugauucugucucaaaaaagaaaaaagaaaagaaaagaaaaagaaaauuguuaucacaugccugaauuccuuccagccagauagaacaucccccaagucguaauguuuuuacucuuccccauacuucaggaguuaaaacgacuggguggacagugcagggcacaggugguaugggcgaaugugguuuguguugcaggacuggggcagggcgugccccucgugggucucgugguggaggggggcccuaacgugguguccaucgucuuggaauaccugcaagaagagccucccaucccuguggugauuugugauggcagcggacgugccucggacauccuguccuuugcgcacaaguacugugaagaaggcggguaggauuucugacgcgcgaggaagggcggguucguaacucccucuuugucgggccaaggagaaaaucuaaaguggucugcuuagacauuccaaacguguuuaaaucaggaagauuugcuagaucuccucucccauuuccucaggucagcauccaggggaaccaucagaggcaggguguuccugauggaauucucucucccucauuuccaacuucauuugcccuuagaaaguuugcaacaaagcuggaauuuaggacaagugagaauacgauguuugacuaugguuacuuuuugucuccugugucaggauauccucccacagcaaagucucaaaucaaagacagagauaugucugacucauucauauauagauuuaacuugccuuguuuuguucucuugcauuuucuuugaacagaauaauaaaugagucccucagggagcagcuucuaguuaccauucagaaaacauuuaauuauaauaaggcacaaucacaucagcuguuugcaauuauaauggagugcaugaagaagaaagaacucguaagugucuugaauuuauuuccaaacaagcucuguggagagaauuauguuuccuuuucuaauuccgcccaugugugcaugacaggguuauucauauuuuaguccggccuuuucugagagacaguacaaaugcauaccaaauugguggcuguguccacaugacagaagcugaacgagcccacacaggggagggccccuggugcuuucaaacuuuagcaaguggggcaugacaccacacaacacccucugaggcucauaauauuacucagauugauagucuuggggaaaagggccacauaccacccugucaggcauguuuacaaaguucuguuauuuuauuucccacuccuucccucuuccguuccauuuacaaggaauagguacucuugucgugcacauaagauggccucuucaaaauucuaauuccuacaaauaucuccugucugauuagauacgacuuugcaucuccgauggcgacugagauuucggaguguagcucccuccucucgagggugccagaagggauggggaaaauaauaaagucaguaugcaggcaggcaccccacggcaaugccauaacuucuggaaaucagccgggcacaguggcucacaccuguaaucccagcacuuuggggggcugagacaggcagaucaccugaggucaggaguuugagaccggccuggccaacauggugaaaccccaucucuacuaaaaauaccaaaacaauuagccaggcaugguggcgugcaccuguaaucccagccacuugggaggcugagauaggagaaucgcuugaaccugggagguggaguuugcagugacccaagauagcgccauugcacuccagccugggcgacaagagcgaaacuccaucucaaaaaaaaaacaaaaagaaaaaagaaaaagaaaagaaaaaaaagaaaucaacagcacuugcuuugaaacuguuuagugcucaggaucauuuuauuacgugucagucucuguggucauuuuguaacaacaccccauaucuccuucuuguuuucaacuuggcuuuaauucagucuuuucacauuuucaggucacuguguucagaauggguucugagggccagcaggacaucgagauggcaauuuuaacugcccugcugaaaggugagcucucaggaaauggugacuccugucccucugauguuggccuagccggcaauccuucccucccggccucccauggacuaugucugcuggugcuagacccugagccagccaggccacuugagcagucucagcaugaagccacggcagaaugacaaggcucgcuguuucuguggggcagaggucugugggugcuccuggaccaucaugggcugaggucagaaccguuucuauuuguaacugguucauugagggcuucagcuccuagaguguaaacaucagauggguuccuuugcaaucacugcauuccgcaguguucuguccaauuuccccgucuugguucuaaugacaggcuucaggccagcguucauggccgggcggggagggucugcucugggaugcacacuuccucccugccucucaguuagccuggugccaugagggggcagggaggacagagagaggggaagggucacugucaggcuggcugccuggcagucccaggguuccagccuuccuggagaucaucuccagggucccugagucacuggguuccuguucugucccucccaaggagaccaugcacagcuggcaugggaagaggcugccuccaccuuccuccagggaagcucuuucagcucggagccuuuguggucauucagggcaagagcaaagccagcaaugcuuaguucuaggccagcagcccaagggaagccugugcucaccacccagcaccugccaaacccuggcgguccaggcguggagugaaaaaucauuccgguuucuugccuuuccaggaacaaacguaucugcuccagaucagcugagcuuggcacuggcuuggaaccgcguggacauagcacgaagccagaucuuugucuuugggccccacuggccggugaaacuguuuuuuuucgauucauaucauugaucuugacuuuguacaagugaccuauuaguauguucucccuugugacauggaauucaggaaauuaugugggguuucugaugauaugauauguaaucuauuaggcucauuagaagaugucacuguuuaacuucaaagaaccaacaagaaguaauuccacauucaaaccaguacuccugaagaaauuaaucaccaaauauuuuaucguugcugaugaaaguggguuuuuaccuuuuuaaagaaaaagaagaagaaauaaaauagcuuauuaaaauuuaaugcaaugcuuccauccagggcaaugauuuuucaaacuauguuccaugaaacccuggaggccuagagaacucuguguguguguguguuuaugugugugugucuaugugugugucuguauguguguauagggugucugugugcaugugauauguggugugccuguaugugguaugauuuuguguaggugaguaauguguguggccaugggugguauaguguguaugugggugucauugggaggguauugugugugugugauaugggaugagcaguguguguggaguguugaggaguacuaaugugugugugugacauggggaugagcgugugugugugugaacacacauaagucugcaugauaaaggacuccaagccuccuacuucuucuucagucaaagcagcuucuuugauccauuuuauagauuaggagucaggauaaauuuguguuugcaaaaagggcucugcugcuuaugaaagguaguaggaauaucuagagaguuuauguugguuuuaaaaaccacauuucuuggccagaugugguggcucacaccuguaauuccagcacuuugggaggccgauuugggaggauugcuugaggccaggaguucaagaccaaccuggucaacauagugagacaccaucucuacaaaaaauaaaaaaaauuagccaggcaugggagugcaugccuauagucccagcuacuuuggaggcugaggcaggaggauugcuugagccuaggaaucugagguuacaguuagcugugacugcaccacuacacuacagccugggugagagaaugagaucccaucucuaaaacauaaaacaaaaaacaaugcaaaaccauuucucaaaacaucccuggcauauugcugcacaaaugcauuuuacuuaacugccucuguguuuaggucucccaaagcauuuaauugccucccaaagcauuuaacugccucuguguuuaggucuccuggaaguugcuuccacacauugccauaacacguuuuaucacucuuuauugauugaucauguguagacggauccaucaauucuccacuugguaauagaaggagguggauugcucacucugcuuccacugccccuguuccuccuggauuugauaguugccuguuuaauucuauuuuuucuuuuuuugaaauggagucucacucuguugcccaggcuagagugcagugguguuaucucagcucacuacagccucugcaucccggauucaagcgauucuccugccucagccucccaaguagcugggacuacaggcacccaccacacccagcuaaauuuuuuuugcauuuuuaguggacacaggguuucaccaugucggccaggcuggucucaaacuccugaccucaagugacccacccgccuuggccucccaaagugcugggauuacaggcaugagucacugcacccagcccugcuuaauucuuauauuggucaccuuuaugacgguaaagaguacguggaaccaccuacuuguucuguccgcuucagacucccauuuuguuaaaugaggaaauucacuccauacuccuccuuccucuccugacaaguuucaucuuccuaauucaaucagccccacuuuuacaaggugcuugacaugaugaacauguacauauccuucuuuaaucauugagguccugcuuacaucuuacucuuuaaucaucauucaguuuuuguacuuagucucuauguugauucuaaaaaaauggagaaaccagcagcuuugacauuguugugauuacauggagauuguucacugcugaaccgcaaaguaggauugaagucaaggagaagggaagguaguccugggucauuuaucuggcucacacaaaggaaaauaugacaggcaucaagguuuccaucauucaccaacuauuuaaaauuaggugacacuuuaauuuccuucauauuuggaccaugacuuauuugaauagauauuugcuuuucuccacauuucuaauugauucucuuuuuuucuuccaaacauuugccuugaugucauugcuguaucuauucuuuuuuuuuuuuaaguauuuuuauuguaucuuuaguuugguuccaaacaaauagauguaaaguuugguaccugccuauguacacuugccacugcuaauguugaggcuuauacuaguccguuuucacacugcuauaaagaauagcagucuucugagacuguguaauuuguaaaggagguuuaauugacucacaucuccaaauggcuggggagaccccaggacacuuacaaucauggcggaggacaaaggagaagcaaaggcacaucuuacacggcagcccaugagagagagaaaagagcacaaggggcugccaaacauuuuuaaaaccaucaauucucauaagaacucuuucacuaucaugagaacagcgugggggaaacugcccucaugauccaaucacuucacaucaggccccacucuugacaccuggggauuacaacuggagaugagauuugggugggacacagagccaaaccauaucaaggcucuugucagcaacguggauauaucaagcauggcugcagcaaaggcuacccuguggggagcuagggcaaaauuauugcacucuuuccaagaugaagccauacagauauuaccuuaaaaaugccauuuuguacuuuuauuugcauauacauaguuuauauuuaauauauacuuuguacuuuaaguucagggguacaagugcagguuuguuauguagguaaacuugugucauggggguuuguuguacagauuauuucaccacccaguuauuaagccuaguaccugcuaguuguuuuuccugacccucucccuccucccacucuccucccuccaaaaggccccagugucuguuauuccccucuauguguccauguguucucaucauuuagcucccacuuaugagaauaugcagcauuugguuuucuguuucugccuuaguuugcuaaggauaauggccuccaucuccauccaugucccugcgaaggacauaaucuuguucuuuuuuauggcugcagccauaucuauucucuuaauuguuacugucccauuucuucuugaagaaucuuucaaagccccaugaguuccuacccccaucuucccuggaugcucucaaugccuacuguacaguugucuacaucagacaucccuucguugcacucugagacuggccauugccuccuagaccccaugucuuccucccuuucagauuccuuuuucauuuugcuggaguacaucuucaaguaacuuuuacauaaaagcaugugggagaauuacugucugagucuguguuguguuucuguaacagaauaccacagaugggguaacugauaaagaaaggagauuuauuucuuacaguucuagaaacuggaaaguccaagaucaaggggcugguaucuugucagggccuucuugcuacaucaucccauggugggaggugaaaggguaagagagcgagagacagcgagagagggcugaacucuuaaaacaaaucucucaagaucaugaacccucucccucuauaaaagcauuaauccauucaugagagcagaauuucauaaccuaaacaauuuuaaaggucccaucucucagcacuguugcacuggggauucaguuuccaacacaagaacuuugggggacacuuucaaaccacagcaauuaucauucugugucuuuacaugucugaaaaaagucugccucacaugaggcucaagauuguccuaugauuuucauucaauuauagaugaaccauuguuuucucucugcucuuugcuuuuucagugcuugaaaauuucacaaggauguaucuucuauuucaagcaaaugaaaauagaaguguauagagaauacaaacucaagcagccauaucuucacacauguagacauuuaauucuucuggcuuucaaaggucccuuuaugcugaagaccugaaucagcucugugaaauuuucuucuaucucuucuuugaguauuucuuucuuuauuaucucuuucccuucaucuggauuuucuauuagucaagcaacugcugguccccuucucccagacugaccguccauuuucgguuuuuuauuucucuaucauuuugcuguauguuuuuggaaaucucaacuuuuucuuuagcuuuuauacaauuuuuaaagguuuaggcacucaugcuuuuuauauuuaagaaaguguuuuuguuccuuaacaauuuuauuuucuuauuagccuauuuucaucucacagaugcaauaucuaaggauaugaauuagauuuuuugaaguuaucuucuguucccuagauuaucucuauuuucucccuggucagcuguucuuuuuguucauuuuggguuuuucuguuaugcuguugauuuucucaaaugcucuagauccuuggcuguccaucacacuacagaaugagggauagaacugcuuaauugguauggaaacccauuuugccaacagguuuuucuccucccugggaggacugcccaggaauucccugcuuaggaaggagaguaucgccugaaccuccugcuuugcugagugccgacuggagagggcugaugggcucugggccucccuauucuuuagcagacauccucccaguuuuuacugggagugaagcccaggaaugcaguugcuugcucugcacccaccacaguggcagccuggagaccgggaggggauguguggccuccugcucuguagaccaucuuccggucaccaugccuucugcccaccacaugcccucuucuuuguaucuuggaaaaucuggucucaccucaagagcaaccuccacauuacacauuuugggcuuuggcuuccucuccauaguuuuaacugguccuucaaugcuuccagaaauuuguuaaaaacucucuggcccgccucuucucccugaaauagauuuuucuuuuucauacuccucugcugucauuuaaauaguaucuggggagggagggaagacaggaaacacaugcucaggcuguaaccuggagccaaaaguccuucucugucucccuacagugggauauaaggucuccaaaaucuucuuuuaauaguugaagcacucaagaaaggaugugccugugaaucuauagucuaucuagaauucuucauauaguagaaaacuugugguagggaggacauaagaauuccaacacaguaaaucaaucuuaggucugauuugcuauauauuacuagacaaaauucuucuaucuauauuuucuguuauugaaugcaaaaaauaaaagcugcaugagaguaugaugugguuaucagaagcuaggaugugagggauugggagauuuugguuuaaaaguacaaagucucaguuaagaagaauaaauucuggagaccuauuguacaacauagugacuauaauuaauaauaauguauagugcacuugaaaauugcuaaaagaguagauuuuaaauguucucaucacaaaaaugauaaguaugugaggugauggauauguuaauuagcuucaucguuccacaauguauacauauauuuaagcaucauguauaccauaaauauauacaauuugucauuugcuaauuaaaauaauuaauuaaaguaaaagcuuugcaaaaaaaauucuucuuaaaacaugcuuuuaaacauaacgaagaggccaggcacaguggcucacuccuguaauuccagcacuuuggaaggcugaggcggguggaucaccugaggucaggaguuugagacaagccuggccaacauggugaaaccccgucucuacuaaaaauacaaaaauuacccgggugugauguugcaugccuguaaucccagcuacuuaggaggcugaggcaggagaauugcuugaaccugggagccggagguugcagugagcugagaucaugccacugcacuccagccugggugacagaacaaaacuccgucucaaaaaacaaacaaauaaacaaacaaacaaaaaacauaaugaagagagagaaaaagagagacguuugauauauacagguaacaaaaggcaauuuauuuauuuauauugaaucauaaaaacuuuggacuaacaauuuuugaaggaaaaucaucaccaacauucaucucaagagcuuuuuuaucuugcaaaauggacacucuaugcccaucaaacaauaauuccccauccugcccucuccugugacuggcaaccaccauucuacuuucuguugccaugaauaugacuacuguuaguaccuccuauaaguggagucauguaauauuuguccuuuugugacuggcuuauuucacucagaacaaugucucaagguucauccguguuguagcauuugucagaauuuccuuccuuuuaaggcugaauaauauuccauuauauggauagaccacauuuugcuuauccaagcauccaucaguggacacuuggguugcucccauguuuuagaauaaugcugcuaugaauguagguguacaaauacuucuuugagacuugcuuucaguucuuuuggguaugccaagaagugaaaccauugaucacacgguaauccuauuuuuaauuuuuugaagaaucaccaaacuccucccacagcaguugcaccauuuuacauuuccacccacagugcacaggguuccaguuuguccucauuuucacaaacauuugucauuuucuguuguuuagauaauagccaucuuggcugggcacaguggcuuacaugccuguaaucccagcacuuugggaggccaaggcagguggaucaccugaggucaggaauuggagaccagccuggccaacauggcgaaaccccgucucuacuaaaaauacagaaaaaaaaaaaaaaaugagccgggagugguggcacacaucuguagucccagcuacugaggaggcugagguaggagaaucacuugaaccugggaggcggagguugcagugagccaacaucgugccacugcacuccagccugggcaacaagagcaaaacuccaucucaaauaaaaggaaaaaaaaagauaauagccaucuuaaugggugugagauaauaucucagaugguuuugauuuguauuucccuaaugauuagugauauugagcguuuuuguguguguuuauuggccauuuguguaucugcuuuguagaaaugucuauucaagucucuugccuauuuuugaaucagguuggguuuucuuguuguugaauuuuaggaguucucuauauauucuggcuaugaaccccuuaucauauacaugauguacaaauauauucuccuauucuguggcuaccuuuacucuguuaaugguauuuuuugcugcacaaaacuuuuaaauuuucauaaaguccaucggauuuguuauuaauaauuuuuccguuugugccugugccuuuggugucauauucaagaauugaauucccaaauccaauauagugauauuuuugcccuauguuuucuucuaagcauuuuaguuuaauuaauuaauuaguuuuugagauugaguuucacucuugucacccaggcuggagugcaacggcacgaucucagcucacugcaaccucuuccuccuggguucaaggaauucuccugccucagccuccuaaguagcugggauuacaggcacccaccaccauguccagcuaauuauuguauuuuuaguagagaugggauuuuaccauguuggccaggcuggucucaaauuccuggccucaggugauccaucugccucggccucccaacgugcugggauuacagacgugaacuaccgugcccagcagcauuuuauauuaguaguuuucgauuuuauguucagguauuugauucauuuugaguuaauauuuguauaugguguaagguaaggguccaacuccagucuuuugcauguggauauccaguuuucccagcaccauuuguuggaugcggugucacucugucacucaggaccauaacgguuuuaucugcaugaggagucagccaagacacuuuuucauccauauuuguauguugaccaggaacuauauaaaugcacaccuccccugacauaagcucugccucagcccuacuuaaggguuuuaagcaggagaguuacuugcuuccauuuuuauauuuaaaggucacucuggaguuacuguggaaaaugcacugggugggugccauggcaggugugcagaguccuauuaauaggccuuugaaauaauucaggccuuggacuagagcagaggcaaagaagaaggcaagaaucagaauuaagcaaaauuuagcauuaaacauggcugcacauagggguagaugaaucauugagggcacuggagggacugagaugucacaaugcuccccaguucucugguuugcacaacuugcaagcugugguaacauuucccugagauaagggacccuggaagaggacugggucggaggguagguccugagagugguuugggacauaaggagcugcaugucuuugagacaugcaagcaggaugcugagcaggcaacaggagcucuggggagagaggugggccgcagccagaaaggagaaguuguaugccaaucaguggugacugguggugugggggucaaugaggucgucaaggaagagaguagaguggaaagguagaaggcugaggacagagcccagaggaaccuugacauuuaaagcugcacugagaaguaguggccagacagggaagaggaaagcugggagcuugugaugcccaagaagccaagggaagagacucuaggaggaagcaggcaguggagucagaugugcugagaacccagcaugaaaugcccaugaggcaggcaccagcacaguucucagcaacuaaacccacagcccaggacagauggaagaagcagcagggugcgugcaggagagauaggaagagaggaaauggaggcuccucagguaggcaauccaccaggagcguuugguaagaggagcgggugggucuggcaagagaggacgccagcuggaggguccgguuguuuaggugcuggcucugugucugcaccaggacacacucccacauucuccaccagaccaggagacaaggccacggggccaggccuacuucugcugucccuccuguucucuggaguagagcacacacuccccuugaugaaugagucugucaccgcauugcaugcauuucagugacaugcggagagcuucuuuacccgccgauaagcuccaguuuacguuuacauccaggcaggcauccucaguucuauccauugucuuguacccccuucacaaucacuuuuucccaucauuaaacaacuauggacacaugucuuuggugccuuugaacucuccuuucagcauccuuuccuccaugcaaaagcacacauggaucaaaaugucagccacuuuaaguaugcaaagucgcugcaucaagucaaguguguguuugugcacacgaguaacagugguucccaguaucagagccuucuucagacagccaggccugcgacgacugaguauguagguguaugggauggaguccgugugcaccuguacauaugugugggcauaugugugcacugugugggugugcacauguacauugugugcauguguggugugcaugugugcacauacagaggugggagggucaaugagcuggucuggggacaagaaagagccuuaguaccauuucccaacucugauugcuguggacugcagccccugggaagccuggcacccccgacggacagcaaagccacggagaaggagaagaagccacccauggccaccaccaagggaggaagaggaaaagggaaaggcaagaagaaagggaaagugaaagaggaaguggaggaagaaacugacccccggaagauagagcugcugaacuggguauguggaaggucacagagaucacgagcuuggcaucacccuuccccaggggaagggaugguucuuguccuugcuucagucccacccagggcccugaucccaggagggacggguaaaggcuugacuggguagugucagcauuucaaacuacaacagcacauucgcugcaaugagccugucgguuguccaaaacaccaaacguuccugcuuuggggggaaugaugccacccacagaggggcccugagucauccuguucagcaaugguucuguaccuggcagacaugccaaugcuugaugcaugaauauacagcagacaaaucaguugucaccaaauaaaugcaauucaugaaaaagcccuuuuuugacagacagagcccaugauugggugugugggguaacagcaguuuagguggggaggcuggagccacacaucgcauggcaguucuuggucuugcugccaccaggacacaggcaagacaggggaccaggccucuguggugacgugugccugcccuuaucacagucacucacccacacggcacccuggucaugcugccugcccaugcagcuccuccuggcacaacuucucagucaaggaaacaaaugguggagacugggcaggccaaugccaggagggcugagauuuugaauccucuucaaucuauuuuuaaaaggaaacaauaauuuacagacauggauggaacauguagaggccaaacugagaagaaaggagaggggagauggggaguguuuacccaagauaaagagcaaagaguaccaugcuggagugcucuggaaucuggcguucggaauacccuuuccucuguguuuccagucgccccccuccccugugucucugagaggccacucacaggcucccggcccuuggucccugcaggugaaugcuuuggagcaagcgaugcuagaugcuuuagucuuagaucgugucgacuuugugaagcuccugauugaaaacggagugaacaugcaacacuuucugaccauuccgaggcuggaggagcuuuauaacacagugagugcucuagaaaaagggaaggaagcgggaggcagccaccuaaauguguuugucacuggugcauauugugcauaaaugugcucaucugaccuccuucagcugggagguccguacuuaauggcaggcggcuacuucucaccugcugcuggccacagccuguguucauauucucaccaccuccugccaugccucgccagucacuccuuucucaggcaguauuaacucuugucccgcauuuaaggguggugugugaguacuuguugcuacaaagagggaaucuagcuccccaagccauuagcagagugaaaugucaccaagggugagaagucaauuguuccuugggacccucacauuugaugaggcuuugggguaaaacauagagcuaaguuucacacccaggagcucugcuggaaggguuugaaugaaauucccuuggcuuauauuauuacaauauaaguuuugagaauuuacauuuccuucccuauuguaagauuuuaaguagcagaaaugauccucagcagcugcuugcuaaaacuuggugaauuuuuuuuuguuuguucugagacagagucucucuuguugcccaggcuggggugcagugacaugaucucagcucacugcagccucaaccuccuaggcucaagccauccuccgaucccagccuccugaguaucugggacuacaggugcacaccaccacacccagcuaauuuuuaaaaauuuuguagagacaggguuucgacauguugcccagguuggucucaaacuccuagccucaagugauccaccucccuuggccucccaaagugcugggauaauaggcucaaauauacuaauuugagccacugauucuggccaacuugaugaauuauuaacacuauauugugcaccuuaagauacucuuuuaaaaaaaugcaacagaaaguauuucacaacuuuugaaauguguuggauacuuucuaaccaugaccagcucuguuuuguaaaagaaaaaggcugguguggguuacacuccagcucucacaauucauuaauuauauagaguagggcaggauuuugcucgaagaguucaagaaaaaaacuuauuuauuuauuuauuuauuuauucauucuuagacgaggucucacuuuaucaccuaggcuggaguauaguggugcaaucuuagcucacugcagcugccuccccgguucaagugauccuccaaccucagccucccuaguagcuaggauuacaggugcccaccaccacgcccagcuaauuuuuguauuuuuaguagagaugggguuucaccauguuggccaggcuggccucaaacuacugaccucaagugaucugccugccuuggccucccaaagugcugggacuacaggcgugagccaccgcgccuggccaagaaaaacauauuuaacacacaugaaugcuucucuuucagagacuggguccaccaaacacacuucaucugcuggugagggaugugaaaaaggucagucuacuguuuuacaauucuuaccuguuggcaucuuucacaaaaucauuucuuaagagcaaguuuuaaauuuucaaaauguauuauuauuccaggcacaggagauaaugaauuccuucuuucguaaagagucuauuuaaaacuaagaaagcaaaggauaaucuuuuuuaaguugcauguucauccaaauccaugauagggacacugucagugacagccggauuauagguugacgccagcgccaggccagggcggccacugggugggguuggggaaggggguggccuggcugcugaccugagccccgcugucuguccaugcagccucucguucugucccuccuuugagaucucucacccacugccuguggcucuuuccagaagcaccggcaggagguuccucaagucauucuguguccuguugauugcagcugcuguucuuggcccuuucugccaccuuguuaucaagggauagaugcuuuccccagccugaauauuguuuaaucccccacccacccaccuguuacaugaacucccaagugggggccaggacagccacuuacccccuagacgugugaugaaguccacacugcgaacgcauucucacagggccugagaccagacuucuuuuacagagcaaccuuccgccugauuaccacaucagccucauagacaucgggcucgugcuggaguaccucaugggaggagccuaccgcugcaacuacacucggaaaaacuuucggacccuuuacaacaacuuguuuggaccaaagaggguagaacucagugccuguguaguguucugugguucgcgaguaccaugugguuccucgcuugcuuuucaacaacuuggccgguucagagccaagcccuucgcccuguccccagcacagcuguccugccuccuacagugcucucaggccagagccacggcauucuccagcuccccugagcacgggccgccccgcccauccauugcauuugcccuccuuuucuauccacagcagacuuccuccugggcuccggggcuacugucugccugcuccagccuauucuacuaucccaccacuguaccugccauaaucuuccaaagcaagggacaugccugcauucccugcuucaagccucccagagcuccucacugccuggagaaucguauccaaacucauuaucacagcagccaaggcccuccaccagcuggcccucacccacaugggagaccacauaccugcaccaaaaucaaauccugugaucaaaucaaagacguguaccugccacgucuuuccccacuaucagugccuuucccacccuuaucaaaaguccaacucaaaugucugaucuuucaugaugcccuccucucacacccaccuuacagccccacagcucucuacaugucuauuagggaacuucucgguuucuaccuggaauaagggccacgcgucugcugagcuuucuucucaauuaacuucugcugacagaagaagaguuucuauauuaaagcacuucuuuuccuuggauauuaucauuaauuguuaaugauacaaagugcuuuuuaauccauucguauguccacuaucaacaauacugcuaauguacuacuaacauuaguuaucuaaguaaauugauuuuuuuucuuccucuuucaccaugcagccuaaagcucuuaaacuucugggaauggaaguaaguagaacuuguuuucaacaguuuuauaauauccuggucaaauauacauagcccuuuuaaguucuguauuugcgaauauacgauacuacucaccaaaauuuaccuagaugucuuagucaaauuauauaaaaggaccauauauacauuuucuuuaauggggauaaaagcugcacaauccauuucuagaacuaacaaaaccacaguuucaaaagcaaagauuaagcaaacaaaaaaacuagagaggaacaccacuuacguaugcaaaaaccauaaguaaaaaaccaaaaauaacaccaaaaagaauucaauagacuauuuucauaguccuaaaucaaaguagaguccuccaagaaugcaaauacaaugcaguguuagucuuuaauauauugcaucauaucuaugaccaucucucagcaggugcuaaugaagaauuugaaacacauguaaaacauaugccuuacuuuguuaaaaaauauauaguuuucucaaaauagaaugauaaaauacuuucuuggaaugauuaaaauacacguauaucuuagagcaagggaaacguaugaugagcagugcaucccugaagucauguccaugagaaucaagaacaagacaagcaugcccaauaucauuggcgucaucuacuguuuuauaauucuuaccuauuggcaucuuucacuaguccccaaaaguguucuggaaauugaaccacaaggaaaaauaaaugcuaaaaaaagaauacccaagaaagggagaaauuauuaucagcaaaaaaauuuggggggaguuagaaaauccaggaaaaucaacuaaaguucccucacaauaggacaaaaguaccagaaauuaccuuuacuagcaaccguaagaacaaugucccagaccuaaaaauauuuaaaugaauggaagaaaugccauauuguggaauauuaggauugacucuuggaaacauucuuuuuaaauaaauuuaugagcuaaacagcaucccgauucuucauggauucaguguagacggcuuucauucuguguugacaauuaagacuguccuuuaacacggugcuccuggaaggguuaugagcuuucugugaucuccuguucucucaaacucuccaggucaggguuuauuuauuccaugaagguuugguggacucaccuguaaaauuuccggguccaguccuauuucuuagaagugugcauuucauaauacuacuucauaauagccauuauaaauauaaguacauuucaggcuuuuuauuuucuagagucaacuuuggucauuuauaguuuccuaaaaugacuuauuucaucuagacuuucaaguucccuggaauaaacuuuuacauaguauucuaguuuuuuucagucuccucaguaucuucaguugugucucauuucuugugccaauuuuuuuuuuuuuuuuuuuuuugaguaggagucucacucugucacccaggcuggagugcaauggugcaaucucggcucacugcaaccuuagccucccagguucaagcaauucuccugucucagccucccaaguagcugggacugcaggugcaugccaccauaccaggcuaauuuuugcauuuuuaguagagauggggcuucaccauauuggucaggcuggucucaaacuucugaucucagauucucaggugauccacccaucuuggccucccaaagugcuggaauuacaggcacgagccaccacgcccagccucuugugccauuuuuaaacaaaauuuauaucuccuauuuucuuaaacuuucuuuccuacauauuuuacugguauuuuugcuuuaucaagcaacuuccuuuuucuguuucuauuuuauuaaugucugcuuuuauuuguauuuguuucuuccauauacuuucccuacuguuauugcauuguucgugcuaacucaguuugaaaggaaaauucacucauuuuccaucuucacuguauuccuauaaaugcauuaaagguauaaauuguucugagcauuguuucaugguauuccacagguuuggauaaguagaaccuucauugucguuuuuucuaaggcauuuauuauuuccuuuucaauccaagaguuauuuagaaguguauuucaaauuucccagauacagacuuuuguuguugucauacuacuguuauugauuucaaaguuuauuccuuguauagaaauauccuguaauuuuuuuucaaauucauugcuaaguaagguguguuacuuacucaacuaugguaauaugucaauuuuuccuuacacucccaguucagauccuuuguuauuuuauugguuuuuuucccuuuuccucauugauuugugacaggccuuugcauuuuaggaaaauuaacucuuuguuucucauauucucucucuggcaguuuuuaaagagaauuuacaugcaauuaauauuuuaauaauauuagauguuauugaaagguaggcuuaaaaggacuucuguuuuauaacauuucauuagucauuaguuaauuuuuauuuuaucuuauauauucuugaaaaucuauguuuaucuaaacauuucuacgauguucauuuuuaaccuguguagaugaaccuuucccauaucacugcgacuguagcuucacugugacaaaauuagaaaauuagaacaaagauauuuaaauuggagucaagauacuauauuuuccauuaaaauguuaucacagcucauuaugauauuauaaaaauugggucagucguggccgggcgugguggcucauggcuacaaucccagcacuuugggaggccgaggcgggaggaccacgaggucaggagaucgagaccauccuggcuaacacggugaaaccccgucucuacuaaacauacaaaaaauuagccgggcgugguggcgggcaccuguagucccagcuacuccagaggugaggcaggagaauggcaugaacccgggaggcagagcuugcagugagccgagauggugccacugcacuccagccugggcgacacagugagacuccgucucaaaaacaaaacaaaacaaaacaaauugggucaguagugaacaaccugagauaggaauuggagagccaggauaccuccuauaacuccccaugcuccagaccacuccaacucugugaauguggcugaguuauucagacugagccacagcuuccuaaucugagggaauggaaggaauucacaaccucucagaguccuuguaagaauaaaagaagauaacugaugggaacgcuguuugcaaaagaacaaacaucuguuucuguuauuccauugaauacuaaaguauuagccuggaguagucugagacccacauauuucaugccaauuuucccaaucacgaucugccuuucuuaugaauccugauccauucacagaacaguucucauaaccccuuuaggaaaugggaaagauuggccuuccuuuuugcaccauauggggaaaaggacagugcucacuaaaagaggaauguuugcuuucuuaaaacacuggagggaaaccuaaaacauuuucucuagccccuuuugcauguuuccuguuaauuucugguucagcuacgucuggcaaacgaguguuauuuuugcuacauuugaagaccucccugaggaaauaaacuguagaccuucccucuuccaugauguuauuuguguuuaguuuugggggagguuuugcuuguuuguuuuaguuuugcagcgucgccucaguuaaaggcuucuaaguaaaacugcugacccaggggugcaaguuauccaaacaguaugccuucucaguucauuugguuuuagauaguuuacuuaucauaauaaacgugugcaucuuuucaaaagaauucauaugcggaguggaaauguaagauguacuucagaagucucuuuauuaccucugacagaaaggguucccuuucuccaggaguucuggaacucuuuguugcauacuuuuauggcaaaaccaugaaauccauguuucuccccucaggaugaugagccuccagcuaaagggaagaaaaagaaaaagaagaaaaaggaggaagagaucgacauugauguggacgacccugccgugagucgguuccaguaucccuuccacgagcugauggugugggcagugcugaugaaacgccagaaaauggcaguguuccucuggcagcgaggggaagagagcauggccaaggcccugguggccugcaagcucuacaaggccauggcccacgaguccuccgagagugaucugguggaugacaucucccaggacuuggauaacaauuccaaguuagugucuagcggggauuuaaaggccaggagagaugaccauccugaguacuugucucugcagggagggguggccaauguacuucucacuuaaggacaauggugguuaaagcuuguucacaaaucacuucgucugucaugucagcauuuuucuuucugucucucagagguguuuuuggacugucguuguuuuuguguacugccuucucuuugcaucaaaauugaaacacaauuuuuuuccuuuccuugaaacacaauuuuaaugcaaagauggugaaauuaauuuccauagggaaacacacacuaacaaggaauacaacauuaaugagccugugcccuggacugugaccuggacugugaccuucacagguguuucugauuuugcuccaugcuuaggugggacaggauggcuagagggggcuggaguugggcgugcuuccccugggucagucaggcucugaucaaaccagcaggugaggcucugguaaaauugguucuccuggccgggcacgguggcucaugccuguaaucccagcacuuugggaggccgaggugggcggaucacaaggucaggagaucgagaccauccuggcuaacauggugaaaccccgucucuacuaaaauauauuuuagcccggcguaguggcgggcgccuguagucccagcuacucgggaggcugaggcaggagaaaggcguggacccaggaaguggagcuugcagugagccgagauugccccacugcacuccagccugggugauagagugagacuccaucucaaaaaaaaaaaaaguugaaggaacuuggaacguuuaugguuauugccaaauauuugaaucuggaucauguggggaaggcaguaaacuuuaugcucaaaauucagcuugugccaccuucuccaugccccccaacuucuaucacuguccccaucagucauuagacgcccucuggccugggcccuaugacaacuaugccucaucccugucauagcacugagaauguuggcuucucuguaaucacugugauggugaaguguuacacgggcagagaaaggcauacauccgaaauguccagcuggugacaguccacaggugggacaugccggcaccaccagcacccagaucaacuaagaaccuagccggcacccaccagcccuccugugacuccuuucaguguccaccucccgccaccaccaccaccagcagccccgcuacuguggccuccaacuccacaggugcugcauuugaagucacuuuugcugucuuuucuaucugccucccugaucugugcacaacuugagggaagggacuuugucuucucgucucuaugucccuggggucugaggggcagauguggucucaaccuacagcuccauuugcagcaguagcagucagcccaccuccugacugagcucccagccacugucccuggccuucccccuuuggggacacaucccuggagcuucuugcuugcagagaaccucagagccccuccagugaaggauacugugucccguggcuccauaaguccuugguggauaugccugucuaagaaacagcuugcggccacuguggcuucacccuggucccuucucuuuccccccagagacuucggccagcuugcuuuggaguuauuagaccaguccuauaagcaugacgagcagaucgcuaugaaacuccugaccuacgagcugaaaaacuggagcaacucgaccugccucaaacuggccguggcagccaaacaccgggacuucauugcucacaccugcagccagaugcugcugaccgauauguggaugggaagacugcggaugcggaagaaccccggccugaaggugcgugcaacgugcugcgaggcgggccagggugacagugacaagugacucucugccaggcugaacugagcacuuucuguggcuuauuucauuuauuccuucuagcaacccccugagggagacgccaugacaaucauugucuuauagaugaggaaucugaagcuuugagaugaagugacaugccuaggaucuuagcuggucagcaugggaucagaaccuacacucaggugcucuaacuccagagccccaccugaccagcccaccaggcugcacaaaccccugccacagucagagucuccuaauggagccccccauaacucaguaugcacacgcacccugguugggucgucuacccaccauuaaaggagggacuggaacucuguuucuagauucccuuauaacucugaaauuguguauuauuuuaacuagugauguuuucaugacaugggagaaaauuacaagaaaauaggaagcuacgaaaggguuugaaaaagauauagugggggaaaaauuauauugcaaucaaacccuagcucuuggguuuacugcuguuaacuacuagguuaucuugagaagagauucuaaucugcagauaaccuagcaaucuaauggcaguauuauaucuauuuuagagcucuccaugaggauaaagaaaagacuauacgaguuacacuguguaguaugguucuggcaaauagagggcacuuuguuucuuagaaaugugaauguuaugcuuaacugucuaauucuauauaauaugcuaagcugauguuauacauaacuuaggauauuaauaaacaguuuucagaauuccaagaauaaagagcucuuuaagguuuucaggaaacuaaaguagaucgccuacauggggaugaacaucaaauuggcaucagacuuuucaucaacaacacugaaacccagaaggcagcacuggaguaaggccuucacgguucugaagggaaggcauuuggagccuggaauauuuucuacccaggccaacuauucaaaaagcaugagaaaagaauaucuguuuaagacaggcaaagacucaaacuauacaccuucaaccucccaugcagaagaauuaguuuagcagguaguccaagcaaaaaaaaaaaaaaaaaaaggggaagcauguuuucuaucuaugagccugggcauccgggcauccuuuuguugucuaggccgagcccauguuaguccuucuuuucugagucacauuagccuugcaacucuuaguucacauaaucucauuuauaucaaaguuauuucuauauaaaauacuuuuggccuacuucacuagagguauuauauuuuauuuauauuauucuauuuuaauuuaaagauuugccuuccucgaaauuucauguaaggacuuuuauuuuauuuuauuuuauuuuauuuuugagacagggucuugcucugucacccaggcuggagugcaguggcgcgaucucgccucacugcaagcuccgccuccuggguucaagugauucuugugccucagccucccaaguagcugguauuacagacgugcaccaccaugcccaguuaauuuuuguauuuuaguagagaugggguuucaccauguuggccaggcuggucucaaacuccuggccucauaugagccaccaaccuuggccucccaaaagugcugggauuacaggugugagcuaccaugccagccaagacuuuucuuuuuaaaguuaggaucaccaacagugcuguuugccauucaucuaaaaaauuuaguguauguucuuaaauuguuuuacugccugcaauucuacuaauuuaccaagcacaugucacagaacgucagaccagggauaacauuccagggcuccuagguuauugaauaauguugaaggucauaauuuaaaaauuuuaacuaugcugggacauuuuucuagaauugccacagcuuaaaaaaucaauuuauguuccguagguuaucauggggauucuucuaccccccaccaucuuguuuuuggaauuucgcacauaugaugauuucucguaucaaacauccaaggaaaaugaggauggcaaagaaaaagaagaggaaaauacggucagugacacacuugacccuaagcauaucaguguaaucuuguuuucaaaauuguugagauuucuuguaccacagauugagaaaucucacugguuaaagguauuuuuggaauuguguuuuucuaauggugccugugugccggagugccuugcauuucccauuuagccaccugccugucaugugcugugcucuguuuuccaggaugcaaaugcagaugcuggcucaagaaagggggaugaggagaacgagcacaaaaaacagagaaguauucccaucggaacaaagaucugugaauucuauaacgcgcccauugucaaguucugguuuuacacagugaggccuccuccugaacauuugacauucaguauauuuugaaugcuuugauauguuggaaucaagaaaaacuucaagggcuuaaaaaaguaucuaaaaauucacugaauuaaaaugaauuaugagaacaaaacugggacuaauugagaucucuggcuaacauuggaucucgauauccugucacauauugauauauggccauccuagucccaaauacaccaucucauaaggcaaaauagucacaugcuauuugcuuaagaugaauucuucugaugccuuuagcaauacaaacuuaaggaacuauaauuuuauuuuuaaaugaacagagaugacuagugauuuaaagagcaaauucacagauuccauuuuucaugaaauugguggggucauuacaagggcauggcuaaauccagaugguaaacucuuggaauagggaaacaaaucaaggcgucucauucugaagugcucaccaaacugacccgcuuggcuggcaagccauccuccagcccucucugaggcccugggucuacacagcucccagaguguggcucucuacuaacaagaacaggagaggaggcaggagggcagaucagagcgccucugggggaaauggccgagcugcaggcggucccaguggggguggccaggcacacuguggcuugugcaaccacgucagucgggaggagagagacuucucaugaaaucccaagcaucaagccacagcccccgccaggcaggccucggugcugugguugcacuggugaugaggugagagcaggguaugggacaugaggagcugggucccuggccguggucugggcgaugaaugagggugggcugggggcagagcaaagcucugugugggggcccaccucaagggucagcugagggccuggacacccaaccuuguggcagccaagauugaugauacagucgaagucacugcugcccaucgauucugguuagaaccaucugagggccuggggugcacccagccugcaggagagcccagccauagaggcugcugccggagauggggccaggaagccaucgaggccucucagccuugggucucaccccagacccucuggaucggguggaggguggagucaucacacauugugcagcuucgcagggauuaggaugcagcccaaagucugagaacauggcucuaaucuuucuucaaagaguggauaguggaucuugggguggggccugccucucuccugguaaagcuuauaggcuugggaggcaggaucuugaaaaaaaagaaaaaaaaaccaaacugcccaguuacaaauacucaguuuuuagcaccccucccccaagccuuccacaggggccugugccagugagggacccagaagcuuaaguuuccuuggcaucauggugaaucacuggggacaggugaucuacuucagacguccucccccaaccccuuaacuccccgcuuuugccucacccacugccaccuccagcucugccucuuucccugccacagagauaggggcccugcuguggccacagcaaauccuggacaugccaccaguaacugaggggacucuagggucagcucgcauaucugggugggcaacucauccacauguccucucaucuaacuucccaguuguggaaagaaucaggaaggaaauuucugaggcagggaggaguaaguaacauuuuccaguuuccaggaauguagaagacacuccagcaaacuauuaaaaguuucccguuaucauaauguuugcaacuucauaguuuccccaugaggaugacagcaccaaccaauaugucuccauguagaaaaugaaaagucagggcccauaucgugcugaaguauaaaaugccucccguccugccuccaggucuucugucugcacuggugaggugcagugaagguuuccucucaaugagucaguccaguuggaaacaaagauucuuuuagaugugucaaccugaaagaaaacagcguuucaaaauuugauugcuaugugauucccccaaacacggcuaacagcuugucuuucuuucagauaucauacuugggcuaccugcugcuguuuaacuacgucauccuggugcggauggauggcuggccgucccuccaggaguggaucgucaucuccuacaucgugagccuggcguuagagaagauacgagagguggcuacuccaaaggccucccccagcccacuaaccgcugacugcaaaugcagauauggcuccuuacugaaaaaacguuucaugcaaauuaugcauguugggccaggcgugguggcucaugccuguaaucccagcacucugggaggcugaggcggauggaucacuugaggucaggaauuugaaaccagccuggccaacagggugaaugaaacacugccucuacuaaaaauaaaaaaaauuagccagucgugguggugcacgccuguaaugccagcuacuagggaggcugaggugugaggaucacuugagauagcaguaauucgaaaccagccuggccaacauggugaaaccccgucucaacuaaaaauacaaaaauuagccggucguguggcaguugccuguaauuucggcuacucaggaggcugagguggaaggaucacuugaacccuggaggcagagguugcaaugagccgagaucgcgccacugcacuccagccugagugacagagugagaguccaucucgaaaacaaaaacaaaaaaacaaauuacacaugcugugggacuuuuuuuggagguaucacaaucccaaguuuauuccauuucuuuauuuaagauguauacaucuugaaugaacuugaacuugcaaaucaaaacacaaggcaaaauaaagauauuuaauaaugaaaacagguuugaaugcauaggaaagcaucagcaaaugcugccagcgaccugagauaaaccaauuaccgcaacugggcacaaauuuuggcuuaguuauuugggaucagagggagaaagagagauacaagagacacuugcacagugugguccaaagcccaaaguuacaggaaaaaugccaucucuuuuaucucuggacucuugugcaggagauuuaugaagggagggcucccagucaggaggaaaaggagcuaagugagguguggcuucagguggacccuguccuuggccuaauccuguagggggcucugaguggacuggacacuguggagucugucucaccuuugggccccaccucaauuugucauugguacccaccagagacauggcuccaagcaucuaagagcaagccucccagaagggggcaggugugggccuaacagcagcaccugcagcagauggggugggcaagcccaccuggggaaaagcuccaggggauaugggaggggccuagagcguuugcugcaaacagagggaacaggauuuucaacucaguauugcaaaagaacagauaccaucucacauaugacucguuaucccagagagcucgagugaaaauguaacucccaguaagcaaucucugcagacagcagaggaaagauaggccggauacuucccuuuccaauaucauucagaaguuuuaauucacuaaauuugcuuauaaagagaaagcauguauccaagcaaaaaagcaacuugagcugaaaaagcccacagcaucauuucauauccuuucuccaacugauauacaaccaauacuauuauuuugcaguaauuguugacccuuucacugaacugaaaaacauuauuaaccuaguccagauagagggaaucugauggcaucggucuaauuagagccugaaaaaccaaaagagcacugaauccaaaauuauacuugccaccuucuacuacuguuccuuuucuagcugggccucauucaaauucugcaggugcugcaacugguauuuccugagcggccugcuuuaccaucgcugugccguccuggccuugcugaggguccaccauacaccgagacacuguucuuuauuccagaaaccugcccccaguuauaggagagagaggguggccaucggcuagugugcauggguuguuaaacuagugaaucccuucugugugggcugacagauagccacugccccauccuaccacagagauccccaagaccucugcaacugaagggguaccaccuggcauggcaacccuccaucccagugugguaccacagacagcugugccauugggaaggcucugcgcacgccugugcaugcugcuugcuaaauaucuuccauuuuacucuguggaagucuccccuuaagcagcagugauuuugaaaggauaauaucucaaguaggggaaaaccuggucuaacuuuccccuaauuucucaugucuaaguugcaaaggaauuuugccaaaucaaaacauuuccuagugguauucugccaucuccacuggguggacugccccucuguggggccacguggggcucaucuaugcucuagaguuuucauccugugugacucuggaauguggaguaacaggcacguguccagauaauuaaaaaagaaaucaaaaugcagcugcuuuaauuacagccagaaggacauaauuuagaaggcauuuccugaguuuguaaaacccugaaucuaagaauagggaggauuccguggaauuucccuuucuagauaucucucccugccugagaagaagaguguuuaaacguuuugaguaggaaaggggccagaugaccuggaauguuccaucagucuuauuguuccaagauucuaagacaagacuucuaauacggcaucucaguuuauuguucuuugggguuuguuuucagauccucaugucagaaccaggcaaacucagccagaaaaucaaaguuuggcuucaggaguacuggaacaucacagaucucguggccauuuccacauucaugauuggagcaauucuucgccuacagaaccagcccuacaugggcuauggccgggugaucuacuguguggauaucaucuucugguacauccguguccuggacaucuuuggugucaacaaguaucuggggccauacgugaugaugauuggaaagaugguuaguaguggcauccuguggguauccagagagacuuuggcuguaguuaggacauaagaacaggccuugggcauggcuuccuucaauuucauuugguuuuucuuuugcaguuggcuuuuuaaaggaaauauucuuugcuuuaagauacacaguucuccuacauguugauaacuuaauaaaauccaauagaaaaacaugaguugagggccuacuguguauauauacauaacauauauacauauauaguguauauacauucacuguauauauguguguauacauacacacguacacauguauaucucucucaauauauaucagguacucaauauauacugucucccuucuuccauaccauaucucaacuguagggugacuaauuacguuuguuuuuuauuccuucugauuuauuauuaaugagucuauuuugacagcaauauaaaagaaaauagccucguuuuuuuguaagagcuuacuucacuuucccaggacauaagagaacaucaauuuuugaugcaauaggaauucaguagcaaaauagaugucucaaaauauuuacuucuugauggcuggaaacauauuuucagcauucuuuaguacagggacauggauuugauguucuaugagacuacauccacuucagaauguauauauauauggccaaaaaaaaaaaaaaaaaaaaccccgccugauuuauaaccuccuaacaugugguagaagccggagacaaagggagcccagggccaauccccaaccuguacuccagaugaucuucagcucauuuacucuggccuggagugaacacaggaaguccaugugauuagaccaugaugacuuauacuccagaacaggccagagaauaugaaacugaaaaugaaccagcaggucauccuuacauuaccuaaaagagcuucaguguuaggacugguacaagaagaaagcaagccuccuacauuuaggaaggacucuuuauagggcaagugguuuugagcuaagggaaguaugcuuuaguaaauuccagcaagggccuccaucuucagggauguucaaaauuaggaauuauaccaguuuaguauccacaguaaccagggcauugcucagcacuuguguagugaaugaauaaauguuggucuauacucucaauucauuaucguuuuauuuccuuagguaucugcuccucuuccuccuuagcaucccuuacaaacucccaucuuuucuucuaauucuucccuuucuccauuugcaguuguaguuacuaagggacauguguuuaugggcaacaacagagaagaagcaagaaggaugaagagcagaugaagauagcaauguucuagaagacauucuaggcauaaagcauugcauggaguaggaaaaagccuucccagggaugggaagaaaggaagggaaagaggcuuucuucguccuaauuaagcacucgugaagugcuuaauuggagacagcaauauaaugagccagggugaacuuggcccacaagccaagacagugagagacaaauguucuccuuacucagaugaucgacaugcuguacuuuguggucaucaugcuggucgugcucaugaguuucggaguagcccgucaagccauucugcauccagaggagaagcccucuuggaaacuggcccgaaacaucuucuacaugcccuacuggaugaucuauggagagguguuugcagaccagauagaccguaagaguagaauucauaguaagauucucuucccugcuucugaggcagaugaucaguuccaaauuaauggaagaacauguauuaauuuggaaauaaaaaauauuugucacuccaccauaggcaucaaauuauuuuacaaagaaauaagaacaaauuauggaacauggauuuucagacaucagucauuucuuuuauucuaaaaauaauucacuagaauucccuugagcuggaccugauggacaucgugucacaugaaugcaguucuaaugccaauagccuaguuuuucuucaacccaguaucuccccaccccaggauaaggcugauaguguuuuccaguagaaugaacuagugaacagagcagaguaacugauacuucccaccauccucuucuuaaagccaucagagcccauuuuccacauagcuacccauuucauacccauuucaucuucacuacuagagugcuauuuuguauuaucaaaaauaaucuggauguuaguagaggaaaugggcuaugauccugcacagauuucuggggaauguaggcccagcuccucugcaggcugagcuggugucuucuggauugaaggaauguaaagcucaaauguucuuguacacuauuuaccaggacaguugaauaaauguuccaccagugaaggaggcacuuuuagucccauuuccauuucaggaccaacauuuucauuugcauguugugauuuaucauaaagcaucagcuauaauagcaugucugcugcuuccagagcucugcuauuugggaauagaaaguuuuuaucaucuuccucucauauggaauguagggcugucaguguauaucuacugccucuagguuagacaauaaccagcucaugcaguagcuucuuucuaacuuuuauaaugucauucugaccauaucauuauugcaaguaucacaaagucaacuauugaaguguguuaguagcuugguaagccagaacauaaaaaucuaauuugauuucaaaagaauauuaguuuagguagauauacauacacguuaaaaguuccugaauuccaggcauaaacuguaguauuuuuauuguugagcucuuuuuuuuuuaaauuaaauuggguuaugagagaagguaaagagguaaacuuuaggcugugcuauucucaguaacauaauuaaauguagguuuuugauucuugaucuauuaacuaauaauuuuguaguuauuugugcuuaugagguguuuguguuggaauauagggagcgcgugauugguuaaccugaucaucugccaguaacaucaugucuuuuucacaguauuuuuaacuagugagcuuuugcucucgcuuaugacacaggguaaaauaaauauccaugauauauauuuucuagaaugauuaauguauguaauucuucuaaacagaucacuguuucuaagugugaaucaauauuucccaagcuuaaaauauuugcauuucuucacagcaaaacaguuauguuguuaaaccacuuguuuuacuuuucucucaaccaucaucuuauuuucuuuccuccccuccugucaaaacaaaacaaaacaaaaauccugcuuuccaaucgucauguagucuacgccauggaaauuaaucguaaguuuacauggaauugauuauucuagucuauggaauguguuuuucaauuaccuuuuccuuagcugauuacuaguagucuuaaacuguuuucaaauacuucucuuguuuuuuggugccaguacuuuuuaagcugucaguaaaaaguaaagagaaccacaaauucacuguugggaucacccuauuuuuuuaggggagaaauagacccccuaugauaaaaaguugcauuucaaaugagcagagggagaaaagauuauuuuucaaacauggcaccaaaacaguugauuaaacaauuugggaaguagaggaaaucccuaacccauacaacauaacaaaaauauuuucaaauuuaauguaucagugaaaccaagaaaacaaccagaagacaacauaagcugauguuaaauaauuagaagccacaaugacuuucaaauggauaacgauaaagggaaaaaacauaaagauacauuugucugcuuaaaaaugaagacuuuuauauuugaaagccacaauaaagaaaugggaaaauguuuagaaauaugacaaauaaugacuaucucugagcgcagauaugaguuucugacuuuuuucuuugugugaguuguuuuuuuuuugagacaacugggagucucgcucagucacccaggcuggaguacaguggcucgaucucggcucacugcaagcucugccucccggguucacgccauucuccugccucagacucccgaguagcuggggcuacagaguuuauuuuuucccauggaaaaaauauugcuuaugaaauaagaaagaaucauauuaaaaaagaaauagguauugaaaaacauauguaagagauauuuauccuuuucauuauauguaaaaagcaaagacaaaacuauuuuuuucuuucagcuccuuguggugagaaccuauaugaugaggagggcaagcggcuuccucccuguauccccggcgccuggcucacuccagcacucauggcgugcuaucuacuggucgccaacauccugcuggugaaccugcugauugcuguguucaaguacgugucacagccgaugaccacaugcuuauuauuuauuacuguacagauuuuccauuuaaucucagaacgcucccaagauaccaauauauuugcagauaauuucauuaggguuuuuaaguagauccaauuuuugcagucucuuuguucaaacuuaaucagucuuaauguauucauaaaucaagaguugacacuuaaauacauuuaaauuuaaucuugguuaguauuuuaacacuuuagcauguauuuuaaucuaaugaaaauauuuucuuagaugaaagucuccugggguacagaauauuugauuaagucaugcuuuuuauucaucagcagagguggaaaaggcaauaugaguuucauaagcuguuacaauuacuguaauacuaguaaagcauuuuuuucugaucauuuauagaauacaagauaaaauggccuaagaaaaaaauggcuuaaaggguuaaaucgaguuucuuauaaaaccugccuauuuggcauguuguguugaguauguugaccaugcucaauaaauauugaaaaaaaugauuuuagcuucuaagaugaaaaauauagagggaaaaauccuucacagaaauaugcaaucuuagaauugaacagggcauuggagaaaaccugguccaaacuucuggcuugagagaugagaaaacuaaggucagggaagguaacugguuuuccuaaggucccaguauugguagacaaugaaaucaugcacuuacugcuuccuguuggaagcuaaaauaagacaaagauuguaccuaccccauguccaaaauaacgaaccuucaaucaaauaaguucaauaacuaauuaauucaguugaaaaaaaaguagucaucuacuuguuagacagaauugaaaguuuaaacaugugaaagcauuuaguuaaauggcuuauaccgcuacacauaggaaauuaaauuuccugaguauaugaguagauuguggugugguuuuucaagaaagcaguacauagcaauuuauuacacuuagcuauuuaugaauacaauguccuuaagcacagauaauccacauugauggauaaaccaaaagauuggauaaucaaggaaucaguacuaaagggcacuaaaaggccaucucauugaguauuuucacuuaaaugugaguaacuuugacugcucugggaaaucacuauaaaaaguaauauaacuaacuguaaaaaugucuucuuuuuaaagcaauaccuucuuugaaguaaaaucaauauccaaccagguguggaaguuccagcgauaucagcugauuaugacauuucaugacaggccaguccugcccccaccgaugaucauuuuaagccacaucuacaucaucauuaugcgucucagcggccgcugcaggaaaaagagagaaggggaccaagaggaacgggaucguggauugaguaugugcagggcucuucauuucuaaguugggcugauuucaaaauaguguucaaauuggacauccucacagaaaucucacucaacuacuugcucgugugaaaagcaccacacucaguccaacugcuguucuuuucaaaaggcuucucauuuuguacccauuuuauucuaguuucguuaauuuguuaguaauuaauauuaggaaagccagcucauagagaccagaaguugagcuaauucucuaaaauaacucuacucuguaaauuucuauauaaauucaaugcuccuuucaaaacgucuuaauuuguugcaucuaaagaaaaugagaaaauaaugcuauacguuugacucuauucauaaaaauaagugcaaaaaguuuuccaggaaauauuacuuggcuuuacuuucccaguaaauguaauuuuguuuuuuauguuuaaaagcgggccguuuggcuccaacugauagaggguuggggcguaugacaaccccuuuuuagauaaaaaucaauuggaguaguggcgaacugccuuaggaguggcggagaagagagcuuaauuaaaguggggcugugaaauucucauugacgccacgaaacugauucuucuuguuuuucacguggccgacacuucucccuucacacagagcucuuccuuagcgacgaggagcuaaagaggcugcaugaguucgaggagcagugcgugcaggagcacuuccgggagaaggaggaugagcagcagucguccagcgacgagcgcauccgggucacuucugaaagguacguguagcguccccaccgcgggcccgugagccaaggguuugcugacucgggcgccccacucuaugggggaugccagaguucauuuaaacaugcacuccgaguucuccuguuuuauuuaaacuuuagguuuuaacgugguucccacgaaauagugagaaaguuacuagguaauaacugugcauuggauauagaagggaaugacauuuauuuauccugggccgaaagaaaaccuaacaguugacuaccuucacccccuaccccaaaguggggguguuuccgcaagguuaauggaagcuacagaaagccauccuucucccagcucuuguuccuaacuucccuuugcgagcaugguccuccccaggggacugcccuccucauccggccuagcugcuugcugcaccuuggcaacaccuuucccagccucacagggcagaggaaaaggcucccuccuggggcuccccugagagugggaacugggagggguggggugcaggguggggggugaggugucuggccccaugagggugggauccgcuaaacuagggcagggugugucuuucagacaccuucacauccgcaguacccagcaaggucagccuaaucuccgcggugaugcuuaauaaaugcagagugaaugaaugcaggaugugugaaccagugaaugaguaaaugaagucaggucgcgagguacagaaauggugacauuuuccaaacuucguaguauugcucuacccuaagcuaggaaagagcaacuggcaaaggguagacaggagcaauggaccuucacugucugcacuuuuuaucacguaaguuuugagagccuuuaucauuuacuaaaagcauuuucagccugcuaaagaucuuggugacugauaacacgcuguuccaaaggguuucacuaacaacguggccagaaggaugagcucagaggagccaugccuagcucugcuuucuauccuugaguacacagaauuaaaguuuccuaacagacacauugagagccauaaaaacagggugggacuucaaaaagauauugcagcugacaguucccaaacaauuacaacagaauucacagaugcaccuuaggucucccuggugcauguugaggccagugaacucugccccagcccacaggaggggagauggcaacugugggucccuggccucgguucccuccuagacccagucaccuugugacccaaccaaauccaaccagcuaaacucuaggguuaccugcaccaccuuucuuccuuaccaaggugaauuuuuaauaaaacuuugaaauguuucuuugaugcuuuaacaguaauugcuaaacuuucaagguauaaaaauuauuucuucaugagaaaguuaagguaccccauguaauccaauuuccacuuuuuaguuagacauuaacuugaacguaauuuuaaccagucauuuacaauggagauuguguuuuguuuugcucugccucccccucucccuuccccggcauuccuuggauuuuuaccauucuuggaccaaagcugcaagagugugguuaucaggucacuaccaaauugcauuuuucucugggggcucugugcacacguaauagggaugaaaguguguagggcagagaaaacaugcugcuuccuguuucccucggcugagaucccaggagcgaugggagcacauucuugccccuccauuucccuuggccuugucaggcugacucacaggugaaugcccaagacagaaagaggagaaggcuugaggagaagggaguuuuccuucccucuuagccaagccagcugagaagcaagggauaaggugggaggauggaaauaaaaguagcuauuugggcaccugugacuacuuuaaaaaucacacuugaaguacucaagcauuucugccauuucuuuaauauucuuucuauauaaaauuaguuuuauuuucugcaucaccauuucccauuugaugauuuuccugcucuucucucggucgugucuucgccagcacuauucagucuguagggucugguuaggagcaugucagccccugccuugucucccuguugucuugguagcuuucagagcugagcuaccaauucucaugacucaguuuuacaggcguguucacacaggauggguacccauuaaucauucuccuccacgcagggugcuuuuagugcuucugugcagaaaccaaauucaugguucucuccuaauguuuggaaauuuaccuauaaaaugcuaacaauuuaaccauuuauuuuuucucaaaaaguuccaacauuuuguaagauccaacauucaguccugcaaugagauuugcaauacgauucagcauugauugacacaacacugggucaguccuaccaaccacgcccacuuagaugucauaggggcccugcucucaggguucuccucccaaacuugcacuccagucucugugaauggcaucgccauuaagcucaguuagcaaacuggcaaaucauuguggcaccucccucuucuucacuaacaaucaucaaguucuguuuacuuccccucgugaauacauccugauccacuuauuuuuuucaucccuaccccaacgcaccuaguacaggcuuccaucauuuuccacuuccauuccuguagcugccccuaccugagcucuccauauuuguuucugcuguuucaauccauguugcacugucagcucucaugggguccuguucccuccugcacuggcuuuccugaaaaacccucuguggcccccacuguccucaggccugcaaggcccugcccucucucuggcuuugccaugcacuaucuucuccuucaugcucuguauuccauuucucuuucauuuccucaaagcacugcuuccuuccugccacaggggcucugcaugggcugugcccucugucugaugcaccucacccuccuucccugcuccucuuccuuggaucucugcccaaaugccaauuccuuauggaaaacuucaccaccucacaccuuagacuaggucaggacccucaggccuuaagcugcaugaaggcagggccaugucuggguuugguccaccaugauauaccuagagccugcacauauccacauaguaggagccagacuuuuguuucuguuuuuguuuuuguuuuuguuuuugagacaaggucucgcucugugcccagugcaguggcacaaucaggucucaccacagccucaaccuccuggacucaagcgagccuucugcaucagccucugaaguagcugggaauacauguaugugccaccacgcccagcuaauuuuuuuuauuuuuuauuuuaguagagaggaagucucacuguguugcccaggcaggucucaaacuccuggccucagcaauccugccucagccucgagauuuuuuugaacgaauggaugacuuaaaagcuuuucuccugauucgaauauaaauuucuaucccauccuuaaugaguucccucauggaauaucaaaaaggaaaccagcuaugcucccuccagguucaagacacugguuuuacuauaaggaaguaggagcagacucaagagccaaaggauugugccacaggaaggauaacaaguguugguguuggcaccaucuuuuugcucaaagggauaacaucaaagagccaugagggcuggugggauaagaacauuuuauaaacaacuccuuuuuuauuauuauuuguagaaacagggucucacuauguugcccaggcugaucucaaacuccugggcucaagcuauccuccugccucagccuuccaaaaugcugggauuacaggcaugggccaccaugucuggucaacuucuggcagcauggccaaaguagaccucgucaacccauguguucuguccucauugcuccaggagaauauuuggcaacaugaguccuuaucauugggagauuugaggcuaucugugucuucugcacauccacuacggagcacacuguucucuuugugguucagcaucccuuaucacagguucacagguucaagagcaauugggcuagaaagaaucuuuccugacaaaauuuugucagagacccaacuuccuuuucucaaugagaauuauguuauccaguguguuuuccuuuuuuccauggcuucaaggaagcuuaacaccaaacuuaauauuaaauuaucaaauauauuacuauaggauuuugaaauaugugggguacguugccucuucucugcuuuuuuuauaucgucuaccuccauuuacauacauuuuauuaaugucugacauuucacaauaugcaggauauaacucauaaauuauacauuuuaaguguaguuggccuugugcuuaagaagcuaugggucuuagaugagcuaaaccuauaauagcauuuucugauucccccaaaacuuucuggauuaagugguuucuugucagauuuguggauauggauuaaaguguuuugucuuuuuuuuuuuuuuuuuuaauucuagagacaggguacugcuuuguugcccaggcuggaguacagugggaugaucauagcucacuacagccuccaguuccugggcucaagugagucuacugccucagcuuccugaguagcugaggcuacaggcgugcaccaccacacccagcuaauuuuugcauauuuuguagauacaggaucucacuauguugcccaggcuggucuggaacuccuggccucaagcgguccucccgccuuagccucccaaagugcugggauuacaggcaugagacaucaugccccauccuggauugccugcaggcuugaugggaaaucagcaauuuguggcuuugaaaucuuuuuauuuggcauccucuucccaugugaccagaaagagaaauggcugguaauggagaccuaccuagaagaaacaagauaguaacuagaggaacugaaagagagaucagucuuaggaaggaggugggggauucuuugcauguagagaagguuguagaacggcaaaugcgcagugauggggaagacauuuggggaugauccugucugaauaccuuaaucuucuaaauucauaggguucaagguugcuuggauaauaggaaggagauggcuuaaauguugaaauuuugaugugccaguggaugacacccuuguuccugaucugacuuugaaagccaauucagagacagaugcagacuucaggaggauagagaaaaaaaaaucaguuuuauuaguaauaaaaguuguacuggaggguguggcuucguucuugccuacuacucacccagaauuaggaauacccacuuagccacaggcagcaccagccaccacaggccucgcuucccacaggcagaguuuagccugcgcgcuaagccuaccagaagaccaagacagagagacaagcaugcaguauccugguccccaaucuccaaccaaaugagccguccuccuccaaaauaaauaaaggccuggaaugaggucagagcauuacuaaugaaaaguccacauacauagaaagaaaaacuaggcaugggcaaaguguaccucuccaacaaucaacaucacugacuuaaagccaguaggaaggauucaagucaagugaguucacuuuuagggggaauauggcaggaaaggagauaaccaggauugcuuggcaggaauaacaaagaugcaaguuaaauuagauaacauggcuuuguacugggccaggucagugugguucccaugaccuucaucggugacaccguacagccgaaaggcagggauacagaaagacaacuguacauacggcauggaugcugaaggaggccaugcgcccaaaaaccagucuguggagagaccucaaagaugcuaguguuugcaaauggcagcauaaacauacgacauugccuccaggcaccaaauauccuugcuuaguccuggaguccugguagcaauagguuggggguuagggauuggcacuaacguguugcaaguaagggagaaagaacauagguuauuaaugagggcuucacuucguggccaaccacagaaucuggccugaauagaaaacagaacauaaccagaaaaggcuaaugauuagaugacuugaauucuauaaacccaggaagucugggguauguuuaaaugaggcagcauacagcuagaaucccagaaagcuuaauguucuuuuaguaacuauucaguauacuguuuauuacagagaaugaaaaagccagaagaaagacaugagucuuggccgggagcaguggcucacaccuguaauccuagcacuuugggaggccgaggugggcggaucacuugaggucaggaguucaagaccaaccuggucaacauggugcaaccccuuuucuacuaaaaaugcaaaaauuagccagguguggcagcgaaaggccuguaaucccagcacuuugggaggccaagguggaucacuugaggucaggcguucaagaccaaccuggucaacauggugaaaccccguuucuacuaaaaauacaaaaauuagccaggcaugguggcgaaagccuguaaucccagcacuuugggaggccgaggugggcagaucacuugaggucaggaguucaagaccaaccugaccaauauggugaaauccugucucuacuaaaaauacaaaaauuagcugggaguggugguaagcaucuguaaucccagccacucgggaggcugaggcaggagaaucucuugaacccgagaggcgaagguugcacugagccgagauagugccacugauugcacuccagccugcgugacagagacucccucucaaaaacaaacaaaaaaaagaaagacgugagucuuguucuuuuaugauuagucuucauuuagucuuucacacauaaaaacucuguaaguaagcacaacaagguucuauccugguguucuuccuauaacuacuaaauguaaaaggcagcccuguaugaagaaguggauggaaauuaaaauagcuggauguaaaauuuagaguggauaagacaacuuuaugaucaguaguucuggaauuaaauuauaggguaggaauaguuuuagaacucaaguauagaauaccaugggaucuugaaacagggguuucuucaaguaugaacuggaccuagcuccacuaacaucaugucuuuauguuaacauuuaacucuaucauuaaggaaauguucccauauaauuuaugagauuccuugcaggugaagggcaacuguuucccaugaaaagauaacugcauauaaaacaaguuuuaggcugggcacaguggcucacgccuguaaucucagcacuuugggaggccaaggugggcugauugcuuggggccaggaguucgagaucagcuuggccaacauggcaaaacuccaucucuacuaaaauuacaaaauuagccggguguaguggcacaugccaguaaucccagcuacugaggcacgagaaucacuugaaccggagaggcggaguuugcagugagccaagauugcaccccugcacuccagccugggcaacagagugagacucugucucaaaaauuuaaaaaggccagguguggugguucaucccuguaauccagcacuuugggugcugaggcagguggaucaccugaggucaggaguuagagagcagccugaccaacauggugaaaccccgucucuacuaaauacaaaaaauuagcugggcaugguggcgcaugccuguaaucccagcuacuugggaggcugaggcaggagaauuguuugaacccaggaggcauagguugcagugaaccgagacugcaccauugcacuccagccugggcaacaaaagugaaagucugucucaaaaauaaaaugaaaaauaaaauaaauuuaaaauuuaaaaggccaagugugguggcucacgccuguaaucccagcacuuugggaggccgaggcgggcagaucaccugaggucagggguucgagaccagccugaccaacauggugaaaccccaucuguacuaaaaauucaaaaauugccaggcgugguggcacaugccugaaaucccagcuguuugggaggcugaggcaggagaguugcuugaacucgagaggcagagguugcagugagccgaggucgcaccacugcacuccagccugggcgauagagcgaaacuccaucucaaaaauaaaauaaaauaauaaauaaauaaacaaauaaauaaaauuaaauaaaacagguuuuaacaacuggcuuacuacagaacuccagauguuucaguccuuccuaggaaagacacacagggacucuuaccacaaggacaugaguuuggaccuuauguuuaauagacaagagucuaugcaaaguccaauaaaguuaugccauacauagguauucucuuggaaguuaaugcaaaaguuccacaaauucagguauugccauaccuauuauuugaaugaaacagaacacauuauguacaaccccuuaacaaaaaguauguuuucauuuaaccaccuucaggcuuaguggcaucauguucaaaaucaaauauccuuaauaauagauauaccccaauauagagaagauuugcaaugauauucacacagccauguccuuugacacuuguguagcauuuacaguucacagagcacacaguuucauuuaauucauuuaauuuaguugcugucaugcugcaacuguuguuaauguuugauaaaucacuccccagggacagaaguacaauaaagaggggcugguggaguagcuucaucccgaaugccaauguggaugggcacaucucaaagggaacacugacacuggccauauguuaaucagaaacagcuuuuguuuuuucucaaaaccaaauuaaacaaaaagagucaugacauguaauaucaguuguuaaucugguacaaucuuuuacucuauuuuauuuauguauuuugagacagagucuugcucugucgcucaggcuggagugcaguggcgugaucucggcucacugcaaccuccgccucccggguucaagcaaccuuuguccugccucagccucccgaguagcugggacuacagacgcacgccaccauguccggcuaauuuuuguaguuuuaguagagacggggguuucaccauguuggucaggcuggucucgaacuccugaccucaggugaucugcccaccuuggccucccaaagugcuaggauuacaggcgugaaccaccacaaccggccgacuuucuuaauuuaaaaaacaaguuuuuuuuuuguguguguguguguguguguguguguacgccagguuuugagacugauuagggcauucagguguauccuuuuaacagaaaagcccaaagauuuaaucugugagucaaaagaugaauaugggcguggaggaucacagcuauuauuaaucaugacugauuaagcacaugcgguucugggcuccucgugacuuuaguagcaguacacaugaugcaguuaaggacagagcaaauauuguaauaaaucaagugcagcuuaaauuucuauucaaagucaggagaaugauuaauuggggcccagacaguuuauagauuucauuuguuuauaguuuccuuugauacaaaaggauggagaguggcccucaggaauugcucuuaggccugccaguuaagaaaucauguauuuggugguuagaaaaauggccucauuaaugaccuuuucaaaaguauucauaaguggaauuuuuuucugugaagucagugcuaccauaaugugaaaaauaaaaaccuaguggagcuauuuauagcaucuacaaguaaauccaaacccagaaauaguuacagaagccacaaacuucaauuagagggaaaggaagauaaucaaccugaucagaaaucagugucaccauguguaagaaagcacacuuugcaucacaaaaguaccacuauucaaagaaaucauuuauuagugcugaauacuuguuauacuaaaaacauaguuauaaguuauuucacuaugugauuugaaauauuugaggguauuggcauauuuuguaaagugaauauuauuuugaaaaauuucgcaaacccuauaauaaauaacacagccaugauaaucuaauuaaaucaugccuaaagccaggauaguaacguacguuuacaugcaauggcugaggucccugacaucaccaagacagcuuucauuuaucuaguucuuccacaaacaucagagguagcugaaagcucuaggacagguuuucucacagcuggggucaucaaaugccuuggcauuugggguucucaaguucuaagauuauuuuauuuuuuaauuuugaugaugacggcauguuugcaaaggguccuugaggaaauguggggaugaagaacaagaugagacaggaugggaagaugagggcagauucucaagagcuuugaauguauaugaguaacagaaaucucuauaggguguuaagauuaagggcugccauggauggaaggaaagaguuaaagcuacauuuucauagcacuuuacauaguaugaggaagugucaauguccaaauuguagaauaggguugccaauggagauuauaagguuuuccuuuaauacacucuuugguuuguucauugcauucaacacugcaaugaaauuguguuuuuaucuuaagugugaugggaagcugcuauuguuuuaaagcaaagauugacgugcuuguguuucugugcuaucuuuuuggagugagaagacauuggaggcaaagaggcuguuccuuauaacuaacauuuuuugcuuuaucagcuugggguacaacaugaggucauauaucuuuuuucuuuuucucuucuuuucuuuuuuuuuuuuuuaagacggagucucgcucugucacccaggcuggagggcaauggcaugaucucggcucacugcagccuccgccucccagguucaagcaauucuccugccucagcccccaaguggcugggauuacaggcgcaugccaccgugcccagcuaauuuauuauuuuuauuuuuuaguagagaugggguuuugccacguuguucagacuggucuggaacuccugaccucaggugauccaccugccucugccucccaaaugcugggauuacaggcgugagccaccgugcccagccaagguuauauaucuuuuaauauuaaaugaaauuauucuuugaccucaucucaucugcuuauaaucucaucuguuuauuccaagaguaccuuuuucccuuucuauugucccauagccccacccccacccccugccucaagucaggugcaggaaauccaguggucuggugaagucccuacccacugcaucaaaauucaagagggugaagucaaucguugcucuuugcuuugauuugagccccagcuuucugguuggaggauagaaaacggaaacucugaggaacuggagauaucagggagauagugagagggggaacuuggaaaaguaaugccauaaaguuaugaacuccagagcucaccugcagacugugucugucagggguggaggagucugcuccuuauucacauaccaaaggcauugaauggggugacaugaacaaaagcagguagaguaaggaacucuggaauucugccccaccauaaaagcaacaacaaaguuggcaaaaacugucagagucuauaucuuguggcacucuggaaauuaagcaauggcuuauuaagcaaccuagggcauucuuauuuaaacaaaauggcuggaucuugauaagaaaagugagcuuugugacauuuuaacuuagcccuguccuauccucugcucuccaguugaguagucaccuugaaaacaacaaccugcauuccuaguaccaguaggagcagaaagaaucucauaugcaaagaauuauaauuacuuguuuuguaauuacagggcagcuccuugaaagccuagcugaaagguucgucuguauuucaccugaguuggaacaggcccaguacuaaagcuucuaguuagaagggguggaggaaggguugucaaaaacauuuacaggcaaaggguuuagugcuugcucccugaggugacggaugacagcuggggcaaacaauagacuaaccaaaaaacuagggagaaaaacugauguccauaagagcuuugaaaagcucuaacacauuccugggaauuuagaaagcuaugugcaugcauagggcuguguguauacucaggaagaccugagaaggcuauaagcucauuucuggcugacuugaucuugaggcucugugcaagcaggaagugaaagcuaaagcaaagauguaaacugccugaguguugaagaugugccccuauauacacauacagcuucucagaaaagacuagaagauuuuguuguuuuuguuccacacauuuaaggaaaucucuaaguauuaacugaccacuaagcuaauaaaauacaaacuucaguggccacacaacauaaagaauauagacuuuacaauauuauuucagaaaaaucacuaagcaaacaacaacuacaaaaaucacuaaacaaacaacaaacaacaacuacacuaaacaaacaacaacuacacuaagcaauaacaacaagccugagaggggagagaaucugauuucuagaauugccacauuauaauacucaacauguccacuuuuaaauaaaaaugacaaaacaugcaaagaaauaagaaacuaugguccacacacaggaaaaaggacaaucuuaaaaaccaucccuuaggaauccuggauauuagauguuuuagcaaagaguuuaacucaacuauuuuagcuauuuuaaauauauuuaaagaccuaaaggaaaucaucucuaaagaacuaaaggaaaguaugagaaggauuuuucaccaaauaagggacuaucaauaaagagguggaaauuauaucaaguaguagacgaggucucaaaaaaaaagagguagaaauuauauauauuuuuaaaaaaauaggucaggcacagugacucaugccuguaaucccagagcuuugggagaccaaggagggaggauugcuugaagccaggaguucaagaccagccugggcaacagagcaagacaccaucuacauaaaaucauuuuuaaaacuggacaggcaugguggugcauaucauggcaacuggcagagcaugguggugccgguaguccuagcuacuugggaggcugaggugggaggauugcuugagcccaggaauucaaggcugcagugagcugugaucuugccacugcauuccagccuggacaauagagcaagacagugucaaaaaaaaaaaagaaaaaaaaaaagaaaaagaaagaaaugaaggaagggaaggaaauucugacauuggaaaguacaauaacugaaaugaaaaauucacucuagaggcccaauagcacauuugagcagguagauuaaagaaucagcaaacuggaagauaaaucaguuaaaaauuacccagucuaaggaacagggggaggaaaugaagagaaauugaacagucugaaaccuguagaacaccauccagcagaacaacauaggcaucaugagaguuauagaaagagagaagggaaacuggcagaaacaauauuuaaagaaauaauggccaaaauuuuacaaauuuaaugaaagauacgaaucuacauauccaagaagcucaaugaacuccaaguaggauaaacucaaggagauccauaccaauuaacguuauagucaaacuguuaaaagccaaaggaaaagaaucuugaaagcagcaagagagaagcaacucaucacauggaaaggaugcuuaauuagauuaaaaaagcugaccucucaucagaagccaggaagaccagaagaccuugggaugacauagucaaugugcugaaagcaaaacaauguccacuaaaaauuauauaugcagcaaaacuauccuuuaaaaaugaaggauaaauuaagauauucccagauaaccaagaacugagagaauucauuacuagcaaaccuacuaugagggauacuaaagauaguuuuucaggcagaaaugaaaagacauaagacaauaaccuaagauccacaugaagaaauaaagaggaccaguaaauuuaacuacauagguaaauauaaaaggcauuauaaauguauuuuuuguuuguaacuacuuuuuauuuucuacaugauuuacaagacaaccacauaaagcaaucauuacaaaucuauguugauggguacacaauguacaaaguuguaacuugugauaauaacagaauaacauggggggaggauggagcuuuauaagaguaaacuuuguguauauuauugaaaauaauugguguuaggccagaugcaagggcucacaccucuaaucccagcacuuugggaggcgaaggcagguggaucaccugaggucgagaguucaagaccagccuggccaacauagugaaaccccaucucuauugaaaauacaaaaauuagccugugugguggcacaugccuguaaucccagcuacucaggaggcugaggcacgagaaucacuugaaccuaggaggcagagguugcagugagcugagaucuugccacugcucuucagccugggcaacagagugacacuccaucucaaaaaaaaaaaaaaaaguaauuggcauuaaauuaaaguagacuguuauaaauuaagauguuacugauaauccccagggcaagcacuaagaaaauaacugaaaaacauaugauaaaagaaagaacaagagccaggugugguagugcaugccuguagucccagccacucaagagguuaaggcaggaagaucacuuaagcccagggguucaaggccagccuaggaaacauagcagggccccauaucuuaaaaaagaaaagaaauacuaagugaauuaaaaugauacacuagaaaauaccuauuuaacacagaagaaagcaguaaugauggaguugagggacaaaaaaaaagacauaacauauagaaaauaaauagcaguauggcagagguaaguucuuccuuaccaguaauuauauuaaauguaaauagauaaagcucucuaagacagagacuagcacaaugaauauuuaaaauaugguguaauuacaugcuaucugcagagacucacuucagauucaaagauuuuuaaaguuuuaaaguaaaaggauggauaaagacauuucaugcaaacaguaauaaaaaaauaguuggaguggcuacaccuaucagguaaaauagacucuaagacaaauauuguuacuagagacaaagaaggacaugauagacaugauauaaugauuaaaaagguaacuauaucaaaaagauauaacaauuauaaacauauaugcacccaauagcagagccucauaagauaugaagcaaaaacugacagaauugaagggagaagcagauaguucucaaauaauaguuguaggcucuaauauucaacuuucacuaauauuagaacuagacagaaguucauuaagaaaauagaagccuuagccaauacuauaugccaacucaagguaacagacaucaguagaacacucaaugacagcaaaauauauauucauuuuauaagcauauggaacauuuuccaagauacaucaucuguuaggccauaaaacaagucucaauaaguuuuaaaaagauuuaaguuaaacaaaguguauucucaggccacaacaaaauaaaaugauaaauuaauaacaaaugaaaauuuggaaaauuuacaaauaugugacaauuaaacaauacacucuuaaauaaucaauagaucaaagaagaaaucacaagagaaauuagaaaauacuucaaggcgaacaaaaugaaaacacaauauaccaaaauuuaugggauacaguaaaagcaguauucagaaggauauuuauaacuauaaagacccacauguaaaaagaagaaagaucucaaagacaguaagaacugaaguaaugaccagacugcuaccaaggucccagacugacuacugggcugcacgcacauaggucagaucucaauagcacuacaaagacuuugaaaacugaacuggcauuggaaucacaguccacagaaagcaugucagaacuugcagccugaaacuaaccagguugaucaccugcuaaaacaaaacaaaucaacauucuccaugaaaauuaaacaagauucagagucaugugguauaauauucaaaaugucaggcuacaauccaaaaucauuuggaguaugcagaauauagaaaaucucaacucaccuggggaaaaaagacaaucaguaaaugucaaugucaagauaacacagauguugaaauuaucugacaaaggcuuuaaagcagcuauuaggaaaaugcuuuaacaaaauugcaaaggcucuggaaacuaauagaaaacuagaaagucucagagaaagaauagaagauauuaagaaaauucaaagaaaauuuuaccaaaaaauaaaguaagugcaaugaaaaauucauuggauaggcucaauagcaaaacagggauuacagaggagagaguaaacuugaagauauuacaacagaaaauuacucaauuugaacaagagaguaaaugggcuaaagaaaaagcccaaagccucagagaaguguggggcaauaacaaaagguauaacauuuguauuauaagagucccagaagagaaagagcaugaugcagagaaacuacuugaagaaaucacugaaaaccucccaaguuugaucaaagacguaaacccacagauuaaauaaauguagagaaugcuaaauaggacuaacucaaaugaauccauaucaaaugaagggccacaaacuaaagacagagggaaaaaaauugacagcaaagaaaaaaauugaccagagaaaaaugauacauuacuuacuggagaacagugauuugaaugauggcagauuucucaucagaaaccuuggaggucagaaggaaguagcacuauguuuuuaauuuuaaauuuuauuuauuuuuugagccgaggucuccuguguugcccagacugaacucaaacaccugggcucaagcaacccucccaccacaaccucccgaguagcugggauuacaggcacaggucaccauggccugcauuauguuuuuaaagugcugaaagaaaaaaaugaucaacccagaauuacauacucaacaaaaacauucuucaaaaaugaaagugaaaaaaaaaaucagacaaagaauucauugcuagcagaccaauucuaaaagaauaacuauaggaaauucuucagacagaaggaaaugauaccagaauugaacuuggaacaucaaaaaugaaagaagagcaucagaaauaauaaauauguugauaaacauaaagaugagucuucucuuucugaguucuuuaaaguauauuugacagucaaaagcaaaaauugccauacugucugauggcauuuucaauauauguggauacaauauaugacaacugcagcacaaagggcuaugggaaagggaccuguaugguaguaauguuccuacauucaaauugaagugguaaaauacugaugcuauguauacugugaaauguugcuaucuauuuguaaucccuaaaacaaccacuguaaaauguauaguaaaugcuguggucacuucccaccucauuuccugaggccaucaucaccaugauaccaaaaccagacaaagacaauugaaaaaagaaaacuacagaccaauauuccucaugaacauagacacaaaaauucacaacaaaauacuagcaaauugagucuagccacgaucagguaguuuaucccaggaauaaaaggcuaggucaauauuugaaaacaaucaauguaauccaccauauuaaugauuuaaaggaaaaaacccuauauguuucuagcaauuggugcagaaaaagcauuugaugaaauucaacaucaugaugauaaaaauacauuuuauaaaagucucucagcaaacuaagaacagaagagaaccuccuuaaucugacaaauggcauuuacauaaaaucuauagcuaacauggugaaagacagacugcuuucucccuaaaacugggaacaaggaaggauggccacucucaccacuucaacaguguacuggaagucuuaggccaugcaauaaggcaaggaaaaaaagucuucugucuuggagagaaauacauaaauacauaaaaccauuccuauuuauagaugauuaucuauguagaaaaucacauaaaaucuuuaaaaaacaaaaugaaacaaaugaaaacguccuagaauuaauaagugaauuuaacaaggcuacagaguacaaagucaacaaaaauuaaucuuauuucuauauaccaucaguguguaauugaacauuggaauuuuuaaaauaauaccauucucacagagcuccaacaaaaaugaaauacuuagguauaaaucucguaaaauacguaugggaucuauaugcagaaaacuacaaagugcugaugaaagaaaucaaagaucacuuaaauaaaugggaggauauaccauauucauguauuggaagacucaacguggcacagaugucaguucuccccaaguuuaucuguagauuuaacacaauaccaaucaaaaucccagcaggauauuuuguagauauaggucaacuguuguuguuguuguuguuguuguuguuguuguuguuguuguugcugcgcugcuguuguuauagacgaagucucccuauguuucccaggcuggucucaaacuccugagcucaagcaauccuccuaccucagucucccgaagcacugggauuguaggcaugagccacugugcccagcuaugucaacuuauuuugaaaauuaaauggaaaggccaaggaacuagacuauguaaaacaauuuugaaaaagaagaauaacauuagaggaaucacacuauccaguuuuaaggcuuacugugaagcuacaguaaugaagacaguguggucuuggugaaggguccaacacauacauaaauggaacagaauaaagaguccgggaguagaucuacccaaauagagauaauugauuucuuuccccaaaggugcaaaacuaauucaacgacgaauggaucaucuuuucaacuaaugguguuaggacaguuugacauucuuaugcaaaaaaugaucucaacacauacaaaaauuaacuaaaaauggaucauagaucuaaacauaaaacacaaaacuauaaaauguuuggaagaaaacauaagagaaaaucuucacaacuugggaauagacaaaggauucuucaaugcaacaccaaaagcauaaucaugucaaucauauaucugacaaaagacuuuuauacaaaauaucuaaagaacucuaaaacccauaauauggaaaaaauggcccaauaaaaaaaugagcuaaggauuagacuagacacaccagagaggacauaagguuguuaaauauguacauaaaaagaugcucaacaucauuagcuaucagugaaaugaaaauuaaaaccagaaugagauauaucuacacaccgaauacaagagcuaaaaauaaaaaaaauuaaaaauaacaauagccaagaaggaugcugagcaacuggaauuugcauacacugcuaguaggaauaaaaaauuguacagccacucugaaaaaugguugggcaguugcuuauaaaguuaaacauacauuuacccuaugaaucagcaaucucggcuauuuaacuccuagguauuuauccuacagaaaugaaaacauguucacacaaaaccuguacaugaauguuuauagcagcucuuuucauacuugccaaauaauggaaacaacccaaauguccuucaacaggugcuguggcacauccauauuagaaauauaucuuugccaggcuugguggcucaugccuguaaucccagcacuuugggaggcuaaggcagguggaucaccugaggucaggaguucgaggccagccuggccaacauggcaaaaccccgucucuacuaaaaauacaaaaauuagucaggcaugguggcgggcgccugugaucccagcuacuugggaggcugaggcaggagaaucgcuugaaccugggagacagagguugcagugagcggaaauugcgccacuguacucuagucugggcaacagagcaagacuccgucucaaaaaaaaaagaaaagaaaagaaaagaaaucuuuaagagagcaucaaccuuaauuaaagggaaagccaagugaauuacuuggaucuggaaugcuucuguauucuguaaugugcugaaaaauauuuuucacucugugcugaaaggaaagcuggauuaagacuuagaaagcuacacaaauaacuucuuugcugauuaaucauaucucacuaugagcucuaucaugcaugauggauucucuuguguuuuuaugccauucaauguguaaauagauguggggcucuugucaaauugauuccuagauagccuuucucugucugaaauggaaaccacucuuugugugggugucaagguuugugaaacauguuuuaaauaauuaugggaagucaccaaccaugguuaacaaaggagauagauccucauuuauuuguccuuuauguuaaucauuucagauguaagugaacuuaaacucauuuuuaucuuucuucuuucauacguacuauaaaacucaaugcaacuucccaucguuuggcauagcuguuuaaaauuugcuguauccacguuguagcuguucacaagcuccaaacaagcaacugacaauuucucugaacccagggcacaucauuaagcauuguuucuuccacagcuucaaugaagggagcagcaguagggaugggagauuugagacaccaaaaaaggagcuugguaacugauucaaugcagaggggaggggagaggagagaagugaggggagggaguuaguauaagggagaccaaagaauccaaugacuuugagguuuguuuuucauauaugaguggcugagagugcuguuaucugaauuagguaauaaaggggaaaauagguaaaacuauaaaagauuugaaaggaaagauauucaucuucauuucaccaguguauuuauuuagaaaaguuugcacagcggcaauaucucuuacuguauguuuguaaaggaacucaaguuugacuagggcaaugugggguuuuuuuugauacaaaaggaauaaucaggguaauagaacugaacggaguagggagccuuuauuuauuuauuuauuuauuuauuuauuuauuuuuugagauggagucucgcucugucauccaggcuggagugcaguggugcgaucucggcucacugcaaccuccgccuccugggugcaagcaauucucgugccucagccucccaaguagcugggauuaccggcacacaccacugugcccagcuaaguuuuguguuuucaguagagacaggguuucaccauauuggccaggcuggucuugaacuccuggccucaggugauccacccgccuuggccucccaaagugcugggauuacaggugugagccacugcgugcggccaggagccauuauuuuuaaugaagaacaccaagucuuacucagaaguaauggaaaguuaauagugaaaaauucuucuguuggucucugaaaugcaagaggagagagaacccuuagaaccuacagugccugugauacagaggcuuuaaaaaaaggaagccaggacuucucaugcauggugaauuugguccucccugguggcaaacguccaggaagccagacccuuccugcucaaaugaugugguuuccuauaguacauauaaauaguucucaccccaagaaaagaguuaagaauagaagccaaggaaccacacauacaaacacagacacaucagagcacaguugucaauguggucaacagaagaguggcauuagcaaaaaaaaaacucugggagguggggcaagguagccacagaagcagcaggguggggguggaguucaggagaugcagucaagcacagagcugacuuagcgaugcaaacaguggcaggcaaucugcucagaagacaaaagagcgggguggcugaccaccgugaaauggauggauaagaggagagccagcaguacgagugaggacauguauaaggaugugcagagaagguagcaaagaccuucguaggucauacagacugcaaugcaagccaagucucccuauguuuuuaagaaagcugggagaaaauaaaagaauaauggaaucagaccuaaguguuugccaucacacagggaugaaccagccagaacacaguagccaggacuccuagcuccauccuggggacaaauucaacuuuuagaaagcaauccucaauccugggcauaccuugccucuuagaguuaaauuccuauugaaauaauucauacuguauguaguaaaauauaaaacaaagucuguaccaguggauuuuaggccaggcaacauuaugguuucauaggcuguugcccgaucuucuaagaacugaaaaaaaaaaaacuaauagcaggcauuuauaaucucccaugcucuuuuuuguguguaaccuuaaggaaauacuaauuauuaaauauaaagaauaauuuaaaguuuuugguauucuucagacaauuaaaucaccuacuauccuuuaagcaaacuaucugauaaucugaacuuaauuauuaacaguuuauuuucugaaucccuugaaccucaauaaggauuuuaauuuuauuuauuuuguuauaaccauucacugcugacagccauagucaaagcucuaaaaacuaagcacuaguagcuucuguuauuacuacaggcagcaugauguaccagcuaagagacaggcaccggagugagugcuggagcuaggcugcgugugcucaaauuccugcuccacugcuuccuaccuuuggggaaauuacuuauacgcuccaugacuuaauuuccucaccuguaaaauggagaugauaauaauagaccuacuuccaaggacuguucugaagauuaaauaagccuaggauugaaccucaguaaguaccuguuagugagaacauuaugcucuuagaacaaugacugagcaguaaguacuauaugcauuaacuauuuauuuccauuauuuucugguggcuccucaugguaauucgaguagucauguuaggggauugugaagcuuguaaauauacucaaacaguuccauauguauuaaaauucugaaaaaucacauagcaaugacauuaucuuuugauuuuuaauauccacuuaaucucaguuuaauaaaucuaucccuuuauauucaccagaguugaaaauaugucaaugagguuggaagaaaucaaugaaagagaaacuuuuaugaaaacuucccugcagacuguugaccuucgacuugcucagcuagaagaauuaucuaacagaauggugaaugcucuugaaaaucuugcgggaaucgacaggucugaccugauccaggcacggucccgggcuucuucugaaugugaggcaacguaucuucuccggcaaagcagcaucaauagcgcugauggcuacagcuuguaucgauaucauuuuaacggagaagaguuauuauuugaggauacaucucucuccacgucaccagggacaggagucaggaaaaaaaccuguuccuuccguauaaaggaagagaaggacgugaaaacgcaccuagucccagaaugucagaacagucuucaccuuucacugggcacaagcacaucagcaaccccagauggcagucaccuugcaguagaugacuuaaagaacgcugaagagucaaaauuagguccagauauugggauuucaaaggaagaugaugaaagacagacagacucuaaaaaagaagaaacuauuuccccaaguuuaaauaaaacagaugugauacauggacaggacaaaucagauguucaaaacacucagcuaacaguggaaacgacaaauauagaaggcacuauuuccuauccccuggaagaaaccaaaauuacacgcuauuuccccgaugaaacgaucaaugcuuguaaaacaaugaaguccagaagcuucgucuauucccggggaagaaagcuggucggugggguuaaccaggauguagaguacaguucaaucacggaccagcaauugacgacggaauggcaaugccaaguucaaaagaucacgcgcucucauagcacagauauuccuuacauugugucggaagcugcagugcaagcugagcauaaagagcaguuugcagauaugcaagaugaacaccaugucgcugaagcaauuccucgaaucccucgcuugucccuaaccauuacugacagaaaugggauggaaaacuuacugucugugaagccagaucaaacuuugggauucccaucucucaggucaaaaaguuuacauggacauccuaggaaugugaaauccauucagggaaaguuagacagaucuggacaugccaguaguguaagcagcuuaguaauugugucuggaaugacagcagaagaaaaaaagguuaagaaagagaaagcuuccacagaaacugaaugcuagucuguuuuguuucuuuaauuuuuuuuuuuaacagucagaaccacuaaugggugucaucuuggccaucuaaacaucaucaauuucuaaaaacauuuuccuuaaaaaauuuuggaaauucagacuugauuuacaauuuaaugcacuaaaaguaguauuuuguuagcauauguuaguaggcuuaguuuuuucaguugcaguaguaucaaaugaaagugaugauacuguaacgaagauaaauuggcuaaucaguauacaagauuauacaaucucuuuauuacugagggccaccaaauagccuaggaagugcccucgagcacugaagucaccauuaggucacuuaagaaguaagcaacuagcugggcacaguggcucaugccuguaauccuagcacuuugggaggccaaggcagaaagauagcuugaguccaggaguuugagaccagccugggcaacauagugauaccccaucucuuaa
